United States Patent 7,319,142 (NUCLEOTIDE AND AMINO ACID SEQUENCES FROM XENORHABDUS AND USES THEREOF) - sequence listing, part 3

SEQ ID NO: 7931 - protein, 318 aa, Xenorhabdus bovienii
  Coding DNA sequence: Name=SeqID_1823
  Gene classification: Gene name=PstC; Function=ABC-type phosphate transport system, permease component; Function class=P Inorganic ion transport and metabolism
  Homolog annotation: Query=1..317bp; Hit=1..317bp; Blast score=460; Percent Identity=84.0; E value=1e-129; Homolog= pstC COG0573
MAERKTALKAPSKNGDIIFSALVRLAALMTLFLLGGIIISLIIAAWPSIKTFGFSFLWNKDWDAPAEQFGALVPIYGTLVTSLIALIIAVPVSFGIALFLTELAPNWLKRPLGVAIELLAAIPSIVYGMWGLFVFAPLFATYFQQPVGDVLSSIPIVGELFSGPAFGIGILTAGIILAIMIIPYIASVMRDVFEQTPVMMKESAYGIGCTTWEVIWRIVLPYTKNGVIGGVMLGLGRALGETMAVTFIIGNTYQLDSLSLYMPGNSITSALANEFAEAESGLHTAALMELGLILFVITFIVLALSKLMILRLAKNEGR

SEQ ID NO: 7932 - protein, 308 aa, Xenorhabdus bovienii
  Coding DNA sequence: Name=SeqID_1824
  Gene classification: Gene name=PstA; Function=ABC-type phosphate transport system, permease component; Function class=P Inorganic ion transport and metabolism
  Homolog annotation: Query=27..308bp; Hit=15..296bp; Blast score=445; Percent Identity=87.0; E value=1e-125; Homolog= ZpstA COG0581
MRGAEMTTGNNHQPRAVGAINTAEMNNRRRMQAWRRQKNRIALLLSMATMAFGLFWLIWILFSTVTKGIDGMSLALFTEMTPPPNTEGGGLANAIVGSGLLIFWATVLGTPLGIMAGIYLAEYGRRSWLAEVIRFINDILLSAPSIVVGLFVYSVIVTKMQHFSGWAGVIALALLQIPIVIRTTENMLKLVPDNLREAAYALGTPKWKMISAITLKASISGIMTGVLLAIARIAGETAPLLFTSLSNQFWSTDLSQPIANLPVTIFKFAMSPFSDWQQLAWAGVLLITLCVLLINIVARVLFKNKKHG

SEQ ID NO: 7933 - protein, 258 aa, Xenorhabdus bovienii
  Coding DNA sequence: Name=SeqID_1825
  Gene classification: Gene name=PstB; Function=ABC-type phosphate transport system, ATPase component; Function class=P Inorganic ion transport and metabolism
  Homolog annotation: Query=6..258bp; Hit=5..257bp; Blast score=474; Percent Identity=90.0; E value=1e-134; Homolog= pstB COG1117
MNKANDIAGRKIQVRDLNFYYGKFHALKNITLDIAQNKVTAFIGPSGCGKSTLLRTFNKMYELYGEQRAEGEIILDDTNILTDKQDIALLRAKVGMVFQKPTPFPMSIYDNIAFGVRLFEKLPRAEMDERIQWALTKAALWNETKDKLHQSGYSLSGGQQQRLCIARGIAIRPEVLLLDEPCSALDPISTGRIEELISELKSEYTVVIVTHNMQQAARCSDHTAFMYLGELIEFSDTDTLFTTPRKKQTEDYITGRYG

SEQ ID NO: 7934 - protein, 238 aa, Xenorhabdus bovienii
  Coding DNA sequence: Name=SeqID_1826
  Gene classification: Gene name=PhoU; Function=Phosphate uptake regulator; Function class=P Inorganic ion transport and metabolism
  Homolog annotation: Query=1..234bp; Hit=1..234bp; Blast score=385; Percent Identity=87.0; E value=1e-107; Homolog= ZphoU COG0704
MDNLNHSKHISGQFNAELEHIRTELMTMGGLVEEQLSKAILAMHNQDGELARQVIEDDHKVNMMEVTIDEACVRIIAKRQPTASDLRLIMVISKTIAELERIGDVADKICQTALEKFSQQQQPLLVSLESLGRHAIQMLHDVLDAFARMDLEEAIRIYHEDKKVDQEYEGIVRQLMTYMMEDPRTIPSVMTALFCARSIERIGDRCQNICEFIFYYVKGQDFRHVGGDELEKLLTKDQ

SEQ ID NO: 7935 - protein, 33 aa, Xenorhabdus bovienii
  Coding DNA sequence: Name=SeqID_1827
MFIIFRNKKAKNAGIKFPRFRQLRSLVFGEQLF

SEQ ID NO: 7936 - protein, 282 aa, Xenorhabdus bovienii
  Coding DNA sequence: Name=SeqID_1828
  Gene classification: Gene name=ArtI; Function=ABC-type amino acid transport system, periplasmic component; Function class=E Amino acid transport and metabolism
  Homolog annotation: Query=17..268bp; Hit=11..260bp; Blast score=296; Percent Identity=58.0; E value=2e-80; Homolog= PA2204 COG0834
MKFRNQSRVAAVALLTSLALVSGVAKADKLDDIKKAGTVRIAVFDSNPPFGFIDPQTKKLAGYDVDIANAIASDLGVKLELRPTNPANRIPLLSSKKIDLIAANFTITDERAKQVNFSIPYFATGQKFIARKGVLKTPDDIAKLRIGADKGTVQEITLRERYPTAKVISYDDTPLAFAALRNGNVQAITQDDAKLVGLLANVPEAQKADFEISPFSITREYQAVAATKGEDRLIDVVNQTLLKLEKEGEAEKIYNRWFGAETKSAQPRGDFKFAPLDRQAKP

SEQ ID NO: 7937 - protein, 245 aa, Xenorhabdus bovienii
  Coding DNA sequence: Name=SeqID_1829
  Gene classification: Gene name=ArtM; Function=ABC-type amino acid transport system, permease component; Function class=E Amino acid transport and metabolism
  Homolog annotation: Query=10..238bp; Hit=5..229bp; Blast score=217; Percent Identity=60.0; E value=9e-57; Homolog= PA2203 COG0765
MFEQFITEHLLAPEYLRWLWQGFLITLWLSACTIISSTLLGFMITAARDSQIKPLRWLVTVYTTIFRNTPLLVQLFFWYFASGQILPQAAMIWLNTSHEIPIAGLTLAWPSFEFLAGFIGLTLYSAPFVAEELRAGIQGVGRGQKYAAHALGLTGWQAMRYVVLPQALKIAMPPLLGQYMNIVKNSSLTMAIGVAELSYASRQVETQSLQTFEAFGVATVLYIAIIAVMEGWGQWRQQRALARGY

SEQ ID NO: 7938 - protein, 249 aa, Xenorhabdus bovienii
  Coding DNA sequence: Name=SeqID_1830
  Gene classification: Gene name=ArtM; Function=ABC-type amino acid transport system, permease component; Function class=E Amino acid transport and metabolism
  Homolog annotation: Query=1..213bp; Hit=1..213bp; Blast score=211; Percent Identity=62.0; E value=4e-55; Homolog= PA2202 COG0765
MDFTVITENWRYLLLGTFPDGPLEGAALTLVISIMAGVISIVLGTVAGIALAMLRGFWVNLLAAILGFFRAIPVIMLIFWTYFLLPVVLGMEIPEITTVVCALALITSAYLAHGVKAGILAIGEGQWRAGLSLGFNRWEVLWHIVLPQALRMMVPSFINQWIALIKDTSLAYIVGVAELSFLATQVNNRSMVYPMEVFLFVALVYFVMCLSLELIANSVARRFSIQRERTTRFGFWRKKALIVVPKVNI

SEQ ID NO: 7939 - protein, 159 aa, Xenorhabdus bovienii
  Coding DNA sequence: Name=SeqID_1831
  Gene classification: Gene name=Hcp; Function=Hemolysin-coregulated protein (uncharacterized); Function class=R General function prediction only
  Homolog annotation: Query=1..159bp; Hit=1..159bp; Blast score=144; Percent Identity=47.0; E value=4e-35; Homolog= Z0248 COG3157
MANSIYVTIKGKLQGLISQGCSTLDSIGNKFQLGHEDQIFVLQFNHGISRAQNVAHQPVKFIKLLDKSSPLLLMAISNNEELDLMFDFYRTSQAGGQERYYSVNLRNAKLLNVNVQYPHSVNHNDRQPEEVVAVQYKDIVCQHHIAGTSGYCVWEETVY

SEQ ID NO: 7940 - protein, 341 aa, Xenorhabdus bovienii
  Coding DNA sequence: Name=SeqID_1832
MQFDSLTSQLRNEFDESKLPDFQHARMFGSIHHGADNIDFQIIADALDCHRDFYGAGIIYSDGLFKRYLVRPSKRRGSPVFSELTHIIIFNLEAGNAPEAELTKTVSEPSLVWEIGSTALSCGGAVAFLLTTAGSGAAIPFTGGASSAGVVLAYAGFTASSLQCMNGAYRIYNLTGKGDEGVEHIGWLDSQDWYVTTTTLLDITSLASGTAALKEAYQTYRVMKATSSRRAAEWLNKMPRYEKKRLTEEIIRYHNPGISNREIKNLIYSGQYPKRYPTEQIRQTLKNHLINTLSSGGAFAGSGMTGVIRNPASIVTSGNYIIGAIYSIAVEKPASYISNGY

SEQ ID NO: 7941 - protein, 240 aa, Xenorhabdus bovienii
  Coding DNA sequence: Name=SeqID_1833
MDINKKSDNTRIFMSIKEFIYNVRLNSLLIEVMNLDRRLKINDSSLKEEIGYKQFKYHFNPVTSKVYFLLGIIGFSLVLSSSMLLAVLISYVIDSGVNKLAIIPCMLLVFSILSLIFFSFLSLGKGGKEGIYIHRILYQSILVISVLLLLFDSSPFLHFFYYALVMAFSLLIKFIMNSYSYFNAVRDMKLFRIAHVFLTKDTQEILNMPRKESKKRIKEVEFQRRREIKEKKRAKEAAGK

SEQ ID NO: 7942 - protein, 105 aa, Xenorhabdus bovienii
  Coding DNA sequence: Name=SeqID_1834
MKKMPRHERKRLTEEIMRHNNSGVSNQAIKDTIEQGWYIKRYLIESIQKALRNHLRDFLIATGGFVGSGMTGTIRNPENILTSGNYMIGSIYSIAYGNPASYLSE

SEQ ID NO: 7943 - protein, 214 aa, Xenorhabdus bovienii
  Coding DNA sequence: Name=SeqID_1835
MKDFILNTEFKKLLGKAKDLEAKIKNADPVLKNITLNDLSYNKYFSYPGRFKIGFIIFFIMIVYMAFFSGVAVAIPSLLIENTSYEIKAFSFVLSLMLSAFISFSHIGLTLSGYYYGPVIQKYTNTVVFFFSLSMSYLKGVYDSDFFYFSAIALCCLFIKLMLNGKYYSGFIWAKMCIRVERIVFNDELDKIKGFNKKQLREYSRTIKSKKRKK

SEQ ID NO: 7944 - protein, 62 aa, Xenorhabdus bovienii
  Coding DNA sequence: Name=SeqID_1836
MDIKHILTNNQFRSILTLYKITDNRIRNSDSLLVDAPDIVRLKGKIMSANESPQKSLCYLTH

SEQ ID NO: 7945 - protein, 48 aa, Xenorhabdus bovienii
  Coding DNA sequence: Name=SeqID_1837
LICRARIECAHIIFIPKKRSFRPILQETYSNRYPEKVKKVNDCGKHNQ

SEQ ID NO: 7946 - protein, 445 aa, Xenorhabdus bovienii
  Coding DNA sequence: Name=SeqID_1838
  Gene classification: Function=Permeases; Function class=R General function prediction only
  Homolog annotation: Query=1..445bp; Hit=1..445bp; Blast score=576; Percent Identity=80.0; E value=1e-164; Homolog= ZyieG COG2252
MSTLNSGSANQQGLLQRVFKLEEHGTTVRTEMIAGFTTFLTMVYIVFVNPQILAVAGMDIKAVFVTTCLIAAFGSIMMGLMANLPVAVAPAMGLNAFFAFVVVGAMGISWQVAMGAIFWGAVGLLILTIFRVRYWMIANIPLSLRVGITSGIGLFIAMMGLKNAGIIVPNPDTIVSIGNFASHNVLLGTLGFFIIAILAARNFHAAVLVSIVVTTVIGLMMGYVEYHGIFDLPPSVMSVVGNVDVKGALDIALSGVIFSFMLVNLFDSSGTLIGVTDKAGIADSSGKFPRMKQALYVDSISSVAGSYVGTSSVTAYIESSSGVSVGGRTGLTAIVVGMLFLLVMFASPLASMVPAYATAGALVYVGVLMTSSLTRVTWNDLTESVPAFITAVMMPFSFSITEGIALGFIAYCAMKLGTGKWREISPCVIVVTLLFVLKMAFVDAH

SEQ ID NO: 7947 - protein, 489 aa, Xenorhabdus bovienii
  Coding DNA sequence: Name=SeqID_1839
  Homolog annotation: Query=1..489bp; Hit=1..487bp; Blast score=646; Percent Identity=71.0; E value=0; Homolog= ref|NP_927591.1|
MRFFDTSSYRMPLFLWITGYALLWVIASYSLDPTVPYDAVEALNWGMNGEWGSPKNPWLVGTVMLPAIHISTISFSFYWYFTHFVAIAIGMLGVWRLAFRLTGKVELAWLAMLTLNLSGIINFDIIPYNDNYLLVMLWPWALLFFLRAIDDHPKWWLAFALTTGLATMGKYSSLSIIGSVFLLSLFVPKVRRSYKEPLFYLAIALWFMLILPNGWWLVHNDFAAFKWVDSQIQQGFNLHTTRAVLSVFYPLIIVSTIIYLSGGRIGWPKQQSNALVNIVILLPLLIIYGWFSFNQGGRMTEWLQPFMTVAPALLVGSLTVLPRKPLKNTLRGLAICALLVWVGYISVMIANVRGAGQKFAGIKTFTSQLDQRWNELYPTPLHYVGGEYLHQWLTFYSHYRPETIQPWELGNGEPPNVYNRHIKESNIVKKGALLVGEKGKSCEQENFQSTLKQWSVLVISYKEEFSFQPQPSAKTETVCIGFVAPENNQ

SEQ ID NO: 7948 - protein, 172 aa, Xenorhabdus bovienii
  Coding DNA sequence: Name=SeqID_1840
  Gene classification: Function=Uncharacterized BCR; Function class=S Function unknown
  Homolog annotation: Query=4..151bp; Hit=1..145bp; Blast score=102; Percent Identity=53.0; E value=2e-22; Homolog= ZyihI COG3078
MNQLKKKSPAKFSAGKQKRKSREELNAEGRERKRQKKHSGHPSGNRNHGNDSNKNRSGDKPGQDPRIGSKVPVPLIIGEKVVVKPVVEKPKASQKPRLSPQEELAMLEQDEHLDELLARLEKGEELSQEENAYVDEKLDRIDELMEELGINLEEDDSEEEKKEDIMQLLKGK

SEQ ID NO: 7949 - protein, 59 aa, Xenorhabdus bovienii
  Coding DNA sequence: Name=SeqID_1841
MKCNEALNSCISGSKVNPKQWLALTYLFLPLFSPPETQRFYRIAALCSDGTTQPIFTSQ

SEQ ID NO: 7950 - protein, 457 aa, Xenorhabdus bovienii
  Coding DNA sequence: Name=SeqID_1842
  Gene classification: Gene name=HemN; Function=Coproporphyrinogen III oxidase and related Fe-S oxidoreductases; Function class=H Coenzyme metabolism
  Homolog annotation: Query=1..457bp; Hit=3..459bp; Blast score=728; Percent Identity=77.0; E value=0; Homolog= hemN COG0635
MSEQAIVWDLPLIQKYNYSGPRYTSYPTALEFNQQYDNTAFAQAAARYPDRPLSLYIHIPFCHKLCYFCGCNKLVTRQKHKADDYLNILEKEITARARLFSQRKVSQMHWGGGTPTYLDKTQISRLMSVLRSHFDFLSEAELSIEIDPREIELDVIDHLRHEGFNRLSMGVQDFNKEVQHLVNREQDEDFIFELVNRARETGFTSTSIDLIYGLPKQTSESFAFTLQRVLALSPDRLSVFNYAHLPDLFAAQRKIKEHDLPSAEQKLDILQDTIATLTGNGYQFIGMDHFARPDDELAIAQREGVLHRNFQGYTTQGECDLLGMGVSAISMLGDSYSQNQKDLKIYYAAVEEQGHALWRGLVLTQDDCIRRDVIKDLICNFRLTFADIEQRYGLNFADYFAEDLQLLAPLVEDGLVDITEKQIQVLPKGRLLIRNVCMCFDSYLRNQMRQRQFSRVI

SEQ ID NO: 7951 - protein, 42 aa, Xenorhabdus bovienii
  Coding DNA sequence: Name=SeqID_1843
MGKEYDYPEIEGVGDRIVINLLTQIRPFYIINSGNQNIRVSG

SEQ ID NO: 7952 - protein, 477 aa, Xenorhabdus bovienii
  Coding DNA sequence: Name=SeqID_1844
  Gene classification: Gene name=AtoC; Function=Response regulator containing CheY-like receiver, AAA-type ATPase, and DNA-binding domains; Function class=T Signal transduction mechanisms
  Homolog annotation: Query=1..476bp; Hit=1..469bp; Blast score=729; Percent Identity=77.0; E value=0; Homolog= ZglnG COG2204
MQRGKVWIVDDDSSIRWVLERALSGAGLECISFENADSVLTALSQDCPEVLLSDIRMPGLDGLSLLNQIKQSNPQLPVIIMTAHSDLDAAVSAYQQGAFDYLPKPFDIDETVALVERALSHYREQHQSSRNPQVAASVSEMIGEAPSMQEVYRIIGRLSRSSISVLINGESGTGKELVAHALHRHSPRASSPFIALNMAAIPKDLIESELFGHEKGAFTGANQVRHGRFEQANGGSLFLDEIGDMPLDIQTRLLRVLAEGQFYRVGGYAPVKVDVRIIAATHQNLEQRVTEGKFREDLYHRLNVIRVQLPPLRDRVEDIPRLAHHFLQQTAKELGVEAKVLHPDTEIALMHLPWSGNVRQLENVCRWLTVMAASKEVLVQDLPADLIENPTTEKIGNFPSSRSALPEHWPRQLAEWAQNALKEGRTDLLSDALPLLERTLLNCALEYTNGHKQEAARLLGWGRNTITRKLKELGIES

SEQ ID NO: 7953 - protein, 347 aa, Xenorhabdus bovienii
  Coding DNA sequence: Name=SeqID_1845
  Gene classification: Function=Signal transduction histidine kinase, nitrogen specific; Function class=T Signal transduction mechanisms
  Homolog annotation: Query=5..347bp; Hit=7..349bp; Blast score=513; Percent Identity=76.0; E value=1e-146; Homolog= ZglnL COG3852
MADFPKAEHILDSLINSVLVLDNDLIIRYANHSAMQLLAQSTRKLFGTPLPVLFSYLSLDTELMRSSLIRGHGFTDNEVILVINNHSHVMSLSAQPISEQFILLELAPMDSQRRLSQEQIQQAQQAAARELVRGLAHEIKNPLGGLRGAAQLLAKALPDPSLREYTQVIIEQADRLRALVDRLLGPQHPGTRISQSIHHVVERIYQLVSLEMPANVTLIKDYDPSLPELAHYPDQIEQVLLNMTRNALQALGEKGGTITLRTRTAFQITLHGERYRLVARIDIEDNGPGIPPNIQDTLFYPMVSGHEGGTGLGLSIARNLIDQHAGKIEFTSWPGHTEFSIYLPIKK

SEQ ID NO: 7954 - protein, 81 aa, Xenorhabdus bovienii
  Coding DNA sequence: Name=SeqID_1846
VSRVCVLLWENQPSSSNLCTFLVHCTLFRHKSSSLSVQSVICSSSVICRRECAGKGPIRRWVKSFTATKKDSRNAIKHYTL

SEQ ID NO: 7955 - protein, 469 aa, Xenorhabdus bovienii
  Coding DNA sequence: Name=SeqID_1847
  Gene classification: Gene name=GlnA; Function=Glutamine synthase; Function class=E Amino acid transport and metabolism
  Homolog annotation: Query=1..469bp; Hit=1..469bp; Blast score=824; Percent Identity=83.0; E value=0; Homolog= glnA COG0174
MSVEHVLSMIEEHQVKFIDLRFTDTKGKEQHITIPAHQIDEDFFEDGKMFDGSSIGGWKGINESDMVLMPDPTTAMRDPFFNDATLILRCDILEPGTMQGYSRDPRSIAKRAEDFLRASDIADTVLFGPEPEFFLFDDIRFGSSISGSYYHIDDVEAAWNSGTRYEGGNKGHRPGIKGGYFPVPPVDSSQDLRSAMCLTMEKMGLVVEAHHHEVATAGQNEIATRFNTMTKKADETQIYKYVVHNVAHSFGKTATFMPKPLVGDNGSGMHCHMSLSKNGTNLFAGDKYGGLSELALYYIGGVIKHARALNAFTNPTTNSYKRLVPGFEAPVMLAYSARNRSASIRIPVVASAKARRIEVRFPDPAANPYLSFSALLMAGLDGIINKIHPGDAMDKNLYDLPAEEAQEIPTVASSLDDALAALDADREFLTRGGVFTDDAIDAYIKLLHGEIERVRMTPHPLEFELYYSV

SEQ ID NO: 7956 - protein, 74 aa, Xenorhabdus bovienii
  Coding DNA sequence: Name=SeqID_1848
MVGLHKSIRLQRAIFMLSTTAVKIAKSMYYQIRDKLRTYMTSNRDISLAHIKALKTLTVGHHSHGFLLISLALS

SEQ ID NO: 7957 - protein, 58 aa, Xenorhabdus bovienii
  Coding DNA sequence: Name=SeqID_1849
MQINTLYATLKDIHIIRLLDTNVAYIEIAIILIHVPHKIEQVAHSYELKAKIGLRTTW

SEQ ID NO: 7958 - protein, 31 aa, Xenorhabdus bovienii
  Coding DNA sequence: Name=SeqID_1850
MQPPVKIWLMIFIITGLYAGQWHSVKETIRL

SEQ ID NO: 7959 - protein, 76 aa, Xenorhabdus bovienii
  Coding DNA sequence: Name=SeqID_1851
LYHKRWNIEELYEISKSILDIEDFHSHTEKGIRQKIQENILLLYLARISENDLKGRRNDTFCHLQRSLHQSGGLGW

SEQ ID NO: 7960 - protein, 55 aa, Xenorhabdus bovienii
  Coding DNA sequence: Name=SeqID_1852
  Gene classification: Gene name=GlnA; Function=Glutamine synthase; Function class=E Amino acid transport and metabolism
  Homolog annotation: Query=1..50bp; Hit=1..50bp; Blast score=89; Percent Identity=78.0; E value=6e-19; Homolog= VC2746 COG0174
MSIKHVLSMIEEHQVKFIDLRFTDTKGKEQHITIPAHQIDEDFFEDGKMYHFSCL

SEQ ID NO: 7961 - protein, 45 aa, Xenorhabdus bovienii
  Coding DNA sequence: Name=SeqID_1853
MDKTCLMDMLNSPGSRLPDRTMQEGCHFILKEHFWMINFYKTGVA

SEQ ID NO: 7962 - protein, 592 aa, Xenorhabdus bovienii
  Coding DNA sequence: Name=SeqID_1854
  Homolog annotation: Query=206..576bp; Hit=66..444bp; Blast score=80; Percent Identity=26.0; E value=9e-14; Homolog= ref|NP_897658.1|
MINEDALLAAPIISGVKDGVLDKSKIDDYISLYVPKYEGISNKDTIILNFVKEFNYEVSDPHGLADPILVGKIHKNDVPAQEYVASYTRKQYFGNVEYSEPLYVKVINGTSSQPSDKEPFIVMGARYADLAVANGLKAPQRLTAWTKEGKPHPVTWTYIGGTPSFTSPFSHINSPFFYDSAPWLPISVQDEQGNKLKINPINVFGNGGTLGLPKADFNDPVEEPYPSAFAVLLNDNTMVGWGGTFGNSYIQSGVKTITTNGPSYAGLNVGSGTLWYHGDSNSSDLPTGSFDDVGAGGNSFFAVSEANQQMEAWGTMTGIYTYLGDGKNVFVGNSLAITIYNPGTEQIISWWGSSMENWNIEPRYSSISKPRYITSMATRGFAVIDESGNLSTWGDSSVFGDFNPPHQDFIQAASTTPFISNLGAPTGNYALHRDGTLYSWSTLGYTTNTGSDGDSSSNGVDIATTKQKYLMPGGIPPHGKVYWGGIQNYDDGPVFEKFIALKDVVQITCSANASAALRQDGTVLTWQNAEPSSVNFIPQPEMKNVRAIYATGTAFLALTADNKVHTWGGSDGGGDSNAVQARLQGKLTYYMD

SEQ ID NO: 7963 - protein, 521 aa, Xenorhabdus bovienii
  Coding DNA sequence: Name=SeqID_1855
MVVNMPSNMQLSLPSGSSVIIGQQLAITVTLTSDTSISPKTDFYLSNNTAIIYIDSSNIKLGNGFGLFIVNLQVSPEVNDGDTITFDIGSSDDNFPTIPIQYTARTLDHNSLILKWDSHYIQVPHNKNIPPKGKFVRATAFVKDENQKSIPNLSVVISANSIFSLEKVNFYKSDNINKIDVLSFNNDNEMILNTDKKGRLILHVYPKESQALILSLYTEVYGVSGQIESEGGLQIIDKNTPDDNDKLAAPRIDGFNGGELNNEGQTTFLVKVEKYNDCRRGDVIHFSVNGKYNDYYYTVEDINNLGDYKIPLPYSMFPIDMTIEFAYTVSHNNSNILYSKSLELTYSGEPWPAPTYYDKCVVYSSFGHDDQNNIIQEFPTTECIGFNENNVVNCYNISNYYKNKYSEGLFVLITGTNDPDDKTKPPLGSKIYLKLNITANYRSPHKTYPGKIPETPGPDGKTAVGVISIPYNILNGCGQYEDCHAGLIQFDYQATSDNGTIQAKSWKGRISTANEGTPPEC

SEQ ID NO: 7964 - protein, 413 aa, Xenorhabdus bovienii
  Coding DNA sequence: Name=SeqID_1856
MVNTAKDIVNLKSLILHIDSPFISISQSSNNNTDEIYTKVTATIRDIHGKPLGGKKIFISDSSNSNLKKIKIYDSNNRTEITTVSEKNYEGFFVKADKQGNVLFFIHPIKSENLILKLFSQILGDTKPIPADHAIYIVDHTLDEIPEKYPEPEILNFIEGDLISDGESKFLVRIPEYDNVQDGDYILFIVNNKYTGNVIQISGKNYLSKFFPLPYDIFDKENDHFSYFSYIVIRALGDITKYKSRPLTLTYKGNQQNQPWADVIRIYNTCQVYSSYGIFPDSIVYDTVDNNTISQYKKTNDLAGLFVQITGTNDPNDSTKVALGSEVTLNLYINSKTGIIHWSCTRIMPYAAGNAGKNVALTFPIPHDLLKDRESYEDRSSMIYFDYQVGKDTDLNVTYGNIWQATIDTDIYS

SEQ ID NO: 7965 - protein, 404 aa, Xenorhabdus bovienii
  Coding DNA sequence: Name=SeqID_1857
MNSNKINFESLRLDVCFPFLAVPNLSTQGVDGRKIKVTAKVQDIYGNSLPNISIFVSDSISGNLKNVKIYGSDQNKEITPVKQDGREGFSIETDKCGDILFFIHPHQSLPVVLNLYTNIVDSTRLMPAKHKIFIVNNSLDSMKIKFDMPEIINFWGEYLKSDGSAKFEIDIPHYPGKTLGDYILFFVNGEYTKYFIRVDNNNDSSTSTEIPYDIFTKNVYSNFFYVIIRGFGNILEEKSVSLPLTYKGGVIYKPVPVVERNYAACIVYTSLGTESDAIIPNDSSINYAAIMQYPDGQKKGLYVEILGTQDPNREKDKVPLNIPVTLKLYLNSIDKSYAKIYPGKIKVQPSGRTSAVIHIPFDDVKDVKLYQDGGVGYIYFDYTFYDGNDQYGEIWSAEIETDDD

SEQ ID NO: 7966 - protein, 524 aa, Xenorhabdus bovienii
  Coding DNA sequence: Name=SeqID_1858
MKTTAKNPLTASLNQNATLIIGQSFVLILTLTPDTPLSGDVKAKFTTVTNITPPTDHLDFKPITNKEGKIINYTCVIMLSVSSALTEQDQIIFNVGTTLPVANMTPLKFKCNLNKINPDSLELTIDNVFLDTFNVKNSSVTNKTKVSTILTDKSGKTLSGVPIYIDSFRSNNLHECTIKDNNGNIITPQQFYTYDGLFLNSQSDGSIVFYIYPEKSLSMVLDLRCSVIDAFDYIPATSPLFFINTERPNPMDSLREPDILGGFPGPLTSNTGEPNFYASIDNYDNSKRGDYIVFMIKTDNDTTPKYSGYYVSVSNPNTELGQGKYSYSLPYDIFNISINYEFSYIVIFGEAAGSKTSRPYPVTYMGGAIYNPPTNVTRDYDLCKVYTSLGIGKAEIQPDTGISYDSIKRYLDNPSTPNTGLFVEVLGGNNIPGKVPLNYKVTLNVYIQSSNRNTHKSWTLPMPTQVGSQGIVSLSFHISFEFLNKIYPYDNGGPGSIYFDYEFNIGNEKNYGKIWEGLIDTRPE

SEQ ID NO: 7967 - protein, 115 aa, Xenorhabdus bovienii
  Coding DNA sequence: Name=SeqID_1859
MNPAAERRMIDGYPSLSHHFFQITQAQNVGQRPANTLSDNINRIMEAFKRVSDQGHHSGFAQKQGSLPDDRLMRQSQNLSPIELFYRLTVLKKQSHRIRLINSPLMRQNPNFSLK

SEQ ID NO: 7968 - protein, 84 aa, Xenorhabdus bovienii
  Coding DNA sequence: Name=SeqID_1860
  Gene classification: Function=Putative transposase; Function class=L DNA replication, recombination and repair
  Homolog annotation: Query=1..76bp; Hit=58..133bp; Blast score=105; Percent Identity=68.0; E value=1e-23; Homolog= XF2303 COG3316
MMAERGITVDHSTLCRWVHRRVPLMGKRYRRSKPAIGRRWRMDETDIKIKGQWRYLYRAVDSDGNTVDFLLTAYRDKSGTTKPR

SEQ ID NO: 7969 - protein, 31 aa, Xenorhabdus bovienii
  Coding DNA sequence: Name=SeqID_1861
MARAFLPLLMPGRFKQTNKRSKSVLQKWVRP

SEQ ID NO: 7970 - protein, 105 aa, Xenorhabdus bovienii
  Coding DNA sequence: Name=SeqID_1862
  Gene classification: Function=Transposase; Function class=L DNA replication, recombination and repair
  Homolog annotation: Query=8..105bp; Hit=231..338bp; Blast score=56; Percent Identity=38.0; E value=5e-09; Homolog= CC2740 COG3547
MASYPVAIPAVGPITASALSAQLGNGKQYARSRDFAASGGRNTLLGISKRGDKNLRWLRVQCARVFIQNIAPLSGKLADWVKMQLTRKHSCVACCALANKLARIA

SEQ ID NO: 7971 - protein, 64 aa, Xenorhabdus bovienii
  Coding DNA sequence: Name=SeqID_1863
  Homolog annotation: Query=2..45bp; Hit=170..216bp; Blast score=62; Percent Identity=72.0; E value=2e-09; Homolog= emb|CAA60622.1|
LYLNNLIEQDHRRRIRPILRFKNFRRAQTVLAGIERVCMLRKGQYPQEPEYPISPEAYFYQLTA

SEQ ID NO: 7972 - protein, 1258 aa, Xenorhabdus bovienii
  Coding DNA sequence: Name=SeqID_1864
  Homolog annotation: Query=47..924bp; Hit=89..955bp; Blast score=429; Percent Identity=34.0; E value=1e-118; Homolog= ref|NP_929318.1|
MSSYIRKFIGFFIFICALVMLSILMNAFADGKDNVDIFISESSKKIINENTNDTSESDAKNLIARNIQTVGNILSSSPSDLAEQAKSYTLGKFNSTVSSEAKKWLSQFGTARINFGLDKKGTLENNSLDLLLPLYDNKADWLLFSQLGYRNKDSRNTINVGLGGRYFYQNWMYGMNTFYDHDLTGNNQRLGLGGEIWGDYIKLSANAYYRLSELQKSRNFKNYHERPANGYDINGEFFLPVYPNLGAKLTYEQYFGDNVTLFNRNTRQKNPSLAKLGLTYTPIPLITMGVDYKQGESGHTETQFLANFNYKLGVPLSAQLSPENVASMRTLTGSRYDLVERNNNIVLDHIKQSTIQLSIPQSLIGYSHEEKTISTTNNPDNKVELQDNKEFIKNGGKINVKGNQIFITFPTYQLSHSETNNYPVNFSVFENSTVKTASNNGIMTLIVRPFVVKEKEVSPIETLPADGKKTYLFTPVITYDAVGNQPLAQVTLDNVQWTTEPEIGEKSGLQWGKPEKTSKTNEKGQLQAALTSTKPIKDVKVFLQMDGMPKTQVGTVSFGEDTSRFQLGEINISLPNNMKTPLTADGVQAYTYKAVVLYGKNRVPPNTSIADIKWDHDHKEISTLKLVPDGDKTDSEGQLIATLTSSEPVNHVTVTLSIEGHPEKPAGRVSFEPAEISLKHSPSGPILVGETYTVKATSNDKDSPKNLPITWDFDAPQHDKVTHNYTAGHSEATFSSSVEQVVTVKAAINGSLPSQTDLVFKSPSIENIMLSSETPNGTISPGESYKFIATVFGADGKTPYSGSTIPFEWRIKSPTDAEKAGLSLSPSGKVTAVSDGALNAELTSKKDTSAVTAAEVCLTIVDAPQSPTTRKCIDSINFKSPPVDFDITSVEVHKVVVDGIEKPFDPQKPLLGNGADKYKYRALITKKGSKDQEKIANHTFNGVEWTRNQKQIDNKYLSEPETISLKTDDDGYLYATLDSNVGVGNEKDIEKTFINVTLTIPSELPSGEPKSKGSANLVNFIPKPEQAVMFVYNQYNENKNITFQEPHPYNYFRSLNAELRDPHEPEKNFNQPEVIYSYSDAKSDFDPLLSLGENNKGPIEFYAVGSATVKATINKDDGRIYLYEYKINIKKYPLLPTYTGNENQINLYGYHTADSPVICELSNTPPGSARFGESITFSVQDLSSSIGGITALSNEFKNLNDWGFFHPEQTQADSKTIQYKLNDGSNKYVIFNPITDKENTDINASGLLICETNTKKSN

SEQ ID NO: 7973 - protein, 48 aa, Xenorhabdus bovienii
  Coding DNA sequence: Name=SeqID_1865
VGSVALNPVWIIWHFLLVELTMSPTREAFKHLHYPVDIIAQCVRGSTR

SEQ ID NO: 7974 - protein, 66 aa, Xenorhabdus bovienii
  Coding DNA sequence: Name=SeqID_1866
MRLINSPLMRQNPPPDICCQSKKCCPCCVDGFYILHFRLGYKVNATRFSMLPSLIRYHLDVMPQIH

SEQ ID NO: 7975 - protein, 63 aa, Xenorhabdus bovienii
  Coding DNA sequence: Name=SeqID_1867
LNHIFESYKFLEHWAVVIILHFIPIYYAMWRGSPRIRFFCLVVAISTPLLYLNKNNLCKNIIY

SEQ ID NO: 7976 - protein, 43 aa, Xenorhabdus bovienii
  Coding DNA sequence: Name=SeqID_1868
VVQRSNRAGIIKPTAELYLVDVLDVLITSSHHGISSCTDKLLG

SEQ ID NO: 7977 - protein, 607 aa, Xenorhabdus bovienii
  Coding DNA sequence: Name=SeqID_1869
  Gene classification: Gene name=TypA; Function=Predicted membrane GTPase involved in stress response; Function class=N Cell motility and secretion
  Homolog annotation: Query=3..603bp; Hit=2..602bp; Blast score=1062; Percent Identity=87.0; E value=0; Homolog= ZyihK COG1217
LSINNLRNIAIIAHVDHGKTTLVDKLLQQSGTFGERAATTERVMDSNDLEKERGITILAKNTAIKWNDYRINIVDTPGHADFGGEVERVMSMVDSVLLLVDAMDGPMPQTRFVTQKAFAHGLKPIVVINKVDRPGARPDWVVDQVFDLFVNLGATDEQLDFPIVYASALMGIAGNEHTDMAEDMTPLYQAIVDHVEPPKVDLDGTFQMQISQLDYNNYVGVIGIGSIKRGTVKPNQNITIVDSEGKTRNGKVGKVFSHLGLDRIESAQAEAGDIIAITGLGELSISDTLCDTSAVEALPALAVDEPTVSMYFCVNTSPFCGREGKYVTSRQILDRLRKELVHNVALRVEETEDPDAFRVAGRGELHLSVLIENMRREGFEMGVSRPKVIYREIDGRKQEPFEQVTLDIEEQHQGDVMQALGERKGELRDMLPDGKGRVRLDYSIPSRGLIGFRTEFMTMTSGTGLLYATFSHYDDIRPGEIGRRQNGVMISNGQGKAVAYALYSLQDRGKLFLGHGTEVYEGQIIGIHSRSNDLTVNCLTGKKLTNVRASGTDEATTLSPYLKKTLEQALEFIDDDELVEVTPQSIRLRKRHLTENDRRRANRGKEM

SEQ ID NO: 7978 - protein, 219 aa, Xenorhabdus bovienii
  Coding DNA sequence: Name=SeqID_1870
  Gene classification: Function=Predicted hydrolases of the HAD superfamily; Function class=R General function prediction only
  Homolog annotation: Query=15..208bp; Hit=8..201bp; Blast score=251; Percent Identity=60.0; E value=5e-67; Homolog= ZyihX COG1011
MIKVQNDNRQSGGIMLYIFDMGNVIIDIDFKRVLAVWSNLSGTPLATLTTRFSMGEAFEQHECGQITDAEFADVLCDEMEVSLSFEQFTEGWHALFIDVRQNVIELMNKLREQGHRVVVLSNTNRLHLDYWPHHYPEIAASTDFLYLSQDLGMRKPNSDIFKYVLGAEGVTAEQVVFFDDVLVNVEAARKIGINAIHVTDRNVIPDYFKAHDFSLPTET

SEQ ID NO: 7979 - protein, 182 aa, Xenorhabdus bovienii
  Coding DNA sequence: Name=SeqID_1871
  Gene classification: Gene name=Dtd; Function=D-Tyr-tRNAtyr deacylase; Function class=J Translation, ribosomal structure and biogenesis
  Homolog annotation: Query=38..182bp; Hit=1..145bp; Blast score=212; Percent Identity=71.0; E value=1e-55; Homolog= dtd COG1490
MISPFPQKRNLFCPCRGGLPHFPCPFWARMTWITDKKMIALIQRVTQAKVVVKDETMGEIEQGLLVLLGVEKEDNQQKAQRLSEKVMGYRVFSDEQGKMNLNVQQANGSLLVVSQFTLAADTQKGLRPSFSGGAEPQKADELYRYFVEQCRVTGVKTETGQFAADMKVSLTNDGPVTFWLQV

SEQ ID NO: 7980 - protein, 305 aa, Xenorhabdus bovienii
  Coding DNA sequence: Name=SeqID_1872
  Gene classification: Gene name=WecD; Function=Histone acetyltransferase HPA2 and related acetyltransferases; Function class=K Transcription
  Homolog annotation: Query=1..300bp; Hit=17..316bp; Blast score=470; Percent Identity=74.0; E value=1e-132; Homolog= yiiD COG0454
MYHLRVPQTEQELETYYQFRWEMLRKPLHQPIGSEKDGYDSMAHHQMVVDEHGNPVAVGRLYINADSEGAIRFLAVHPNVQQKGLGTLIAMALESVARQEGVKRIVCSAREDAVDFFNKLGFKNRGLINGARTSPISHFLMIKPIMSLDDILHRPDWCAELQQAWYQQIPLSEKMGLRITQYTGQRFITTMPEAGNQNPHHTIFAGSLFSQATLTAWGLIWLLLQERQLGGNIILVDANIRYRQPITGRPNAVADFNNMSGDLARLARGNKARVKLEVQVSGEQGVGSVFTGTYLVLPVERPVTV

SEQ ID NO: 7981 - protein, 607 aa, Xenorhabdus bovienii
  Coding DNA sequence: Name=SeqID_1873
  Homolog annotation: Query=1..561bp; Hit=1..560bp; Blast score=590; Percent Identity=52.0; E value=1e-167; Homolog= ref|NP_927608.1|
MKWLRKFFVTLLLLLILAIIVIYIVVQTHWGTKQLNQWLNRQGHYEISIESIGHNWLQPATLTLNNVNIHDQQSAFSLNANTVNLDLKWQHLLTPRNLHRLTLQQGKLILAGDQLPSLLQADILQLNQMNIQLENPHTQIKGENITGGITPWMPTAGNPFGNGQYQFSASTMSFNGIPFEKVIMQGSYQNKTLTIDTFGAAFLQGAISGDGRQLPDGSWRWNNLLISNIRWQSPMTLSTLQEKTRHLPAIHVKDLNITNAKLQGKNWSVDYLDTTIKNLGLVNGSWKAKDGLIDFNVMNMAFNNAQFSNTLGQLHFSGDTFTVAHLTTHYQKGLFNIQSEWDRKNRQLTFSNSSVTGLVYDLPPTWRNDIKNAAPEWISGLKLNDISVNNTLLIDVNPDFPFQLTTLSGHVDTMNILKNGRWGLWEGQASLQAASGTFNKIEITRPYLQLHATNDKLTIDKLNAFNGHGLLQASGSAEQQTAQKPFVLNFKGMNADLGILPRWGWIPLTIQGEGNFSLTITGNLSADDIKGTINGTLTAEDKSSNKDSQSIAQGLILSSNCSPAGAVDGAAIAHPTAPSTEVHTAEAGNTSAESETAESKTCPKIKL

SEQ ID NO: 7982 - protein, 461 aa, Xenorhabdus bovienii
  Coding DNA sequence: Name=SeqID_1874
  Gene classification: Gene name=UraA; Function=Xanthine/uracil permeases; Function class=F Nucleotide transport and metabolism
  Homolog annotation: Query=2..461bp; Hit=3..462bp; Blast score=641; Percent Identity=80.0; E value=0; Homolog= yicE COG2233
MVTSSREHSASEAPEKSGCELIYRLEDKPPLLHALFAASQHLLAMFVAVITPAMLICQALGLSEQDTQRIISMSLFASGVASLIQIRSWGPVGSGLLSIQGTSFNFVAPLIMGGLALKNGGADIPTMMAALFGTLMVAAITEVLLSRVLHLARKIITPLVSGIVVMIIGLSLIQVGLTSIGGGYSAIQNGTFGAPENLLLAGAVLAVIVLLNRQRNPYLRVASLVIAMAVGYLVAWYMGMQPHATPRTDTPVITVPSPLYYGLSFDWNLLIPLILIFMVTSLETIGDITATSDVSEQPVSGPLYMKRIKGGVLANGLNSIVSSVFNTFPNSCFGQNNGVIQLTGVASRHVGYIIASMLILLGLFPAVAGFVQHIPEPVLGGATIVMFGTIAASGVRIVSREPLNRRAIMIIALSLAVGLGVSQQPLILQFAPEWVKNLLSSGIAAGGLTAILLNLIFPQEK

SEQ ID NO: 7983 - protein, 33 aa, Xenorhabdus bovienii
  Coding DNA sequence: Name=SeqID_1875
MRRYNHPIKTPRAAKGWIRKKITDKHKLKNLKV

SEQ ID NO: 7984 - protein, 404 aa, Xenorhabdus bovienii
  Coding DNA sequence: Name=SeqID_1876
  Gene classification: Gene name=GltS; Function=Na+/glutamate symporter; Function class=E Amino acid transport and metabolism
  Homolog annotation: Query=1..399bp; Hit=1..399bp; Blast score=481; Percent Identity=77.0; E value=1e-136; Homolog= gltS COG0786
MYQLDIYGTLVAATLVLLLGRKLVQSIPFLEKYTIPEPVAGGLLVAVVLLAVKQSTGWEMSFDLSLKDPLMLMFFATIGLNANLASLKAGGKFLVLFVFVVIGLLLVQNTVGIALAKMLGLDPLMGLLAGSITLSGGHGTGAAWGKVFSERYGFDNATEVAMACATFGLILGGLIGGPVARLLVKNTKAPGLGADDTEIPTAFEKPYTGRMITPLVMLETIALISICLLAGSYIEKQLEHTMFELPTFVCVLFVGVILSNGLSLLGFYRVFDRAVSVLGNVSLSLFLAMALMSLKLWQLASLALPMLVILVVQSIVMALYAIFVTYRVMGKNYDASILSAGHCGFGLGATPTAIANMQAITDRFGPSHMAFLLVPMVGAFFIDIVNAAVIKIYLLLPVFPSIAG

SEQ ID NO: 7985 - protein, 693 aa, Xenorhabdus bovienii
  Coding DNA sequence: Name=SeqID_1877
  Gene classification: Gene name=RecG; Function=RecG-like helicases; Function class=L DNA replication, recombination and repair
  Homolog annotation: Query=1..693bp; Hit=12..704bp; Blast score=1051; Percent Identity=77.0; E value=0; Homolog= ZrecG COG1200
MKGRLLDAIPLTTLHGVGASQVTKLAKLGLVNLQDLLLHLPLRYEDQTRLYSINDLLPGVYATVTGEVLRTHVTFGRRRIMTCQISDGTGVLTLRFFNFTAAMKNNLAEGKHVIAYGEIRRGNQGPEIIHPEYKVQQHAERVQLQDTLTPIYPTTEGVRQTTLRKLIEQALELLDTCVINELLPEEFSRKIISLPNALHTLHRPPPDVSLTDLDNSRHPAQRRLILEELLAHHLSMLAVRAGAQRFHAQPLTADNALKQQLLSQLPFVPTDAQARVVAEIEQDLEKNVPMMRLIQGDVGSGKTLVAALAALRALVHGKQVALMAPTELLAEQHANTFRQWFEPLGIQVGWLAGKQKGKARQAQQEAIANGQVSMVVGTHAMFQEQVKFSGLALVIIDEQHRFGVHQRLALWEKGREQGFHPHQLIMTATPIPRTLAMTAYADLDTSIIDELPPGRTPVTTVAIPDTRRNEIIQRIKSACLDEGRQAYWVCTLIEDSEVLEAQAAQATSEELALILPDLKIGLVHGRMKSAEKQTIMDTFKQGELQLLVATTVIEVGVDVPNASLMIIDNPERLGLAQLHQLRGRVGRGAVASHCVLLYKTPLTNTARMRLQVLRDSNDGFVIAQKDLEIRGPGELLGTRQTGNAEFRIADLLRDQGMLPEVQRISNYIHQHYPEHAKALIERWLPDRSQYSHA

SEQ ID NO: 7986 - protein, 41 aa, Xenorhabdus bovienii
  Coding DNA sequence: Name=SeqID_1878
LAAVSRCKGLEQPLIDQQGQIIASESWWAAMQATTAPSTGK

SEQ ID NO: 7987 - protein, 702 aa, Xenorhabdus bovienii
  Coding DNA sequence: Name=SeqID_1879
  Gene classification: Gene name=SpoT; Function=Guanosine polyphosphate pyrophosphohydrolases/synthetases; Function class=T Signal transduction mechanisms
  Homolog annotation: Query=1..702bp; Hit=1..702bp; Blast score=1245; Percent Identity=87.0; E value=0; Homolog= spoT COG0317
LYLFESLNQLVLKYLPEDQIVLLKQAYVVARDAHEGQTRSSGEPYITHPVAVSCILAEMRLDHETLMAALLHDVIEDTPATFQDIEQLFGTAVAGLVEGVSKLDKLNFRNKKEAQAENFRKMIMAMVQDIRVILIKLADRTHNMRTLGSLRPDKRRRIARETLEIYSPLAHRLGIHHLKTELEELGFEALHPNRYRVIKEVVKAARGNRKEMIQKILSEIEGRLTDAGIQCTVSGREKHLYSIYRKMHLKEQRFHSIMDIYAFRVIINNLDTCYRVLGQMHSLYKPRPGRVKDYIAIPKANGYQSLHTSLIGPHGVPVEVQIRTEDMDQMAEMGVAAHWAYKVQGESGTTAQIRAQRWMQSLLELQQSAGSSFEFIESVKSDLFPDEIYVFTPEGRIVELPAGASPVDFAYAVHTDIGHACVGARVDRQPYPLSQTLSSGQTVEIITAPGARPNAAWLNFVVSSKARAKIRQLLKNLKRDDSIGLGRRLLNHALGNGKKITDIPQESITKELVRMKLATLDDLLAEIGLGNAMSVVVARNLLGATEKIPNNNNSTRKLPIKGADGILITFAKCCRPIPGDPIISHISPGKGLVIHHESCRNIRGYQKEPEKFMPVEWDKDVNSDFIAEIKVDMFNHQGALANLTAAINDANSSIQSMNTEEKDGRVYCAFIRLTTQDRIQLANIMRKIRVMPDVMRVSRNRN

SEQ ID NO: 7988 - protein, 91 aa, Xenorhabdus bovienii
  Coding DNA sequence: Name=SeqID_1880
  Gene classification: Gene name=RpoZ; Function=DNA-directed RNA polymerase subunit K/omega; Function class=K Transcription
  Homolog annotation: Query=1..91bp; Hit=1..91bp; Blast score=100; Percent Identity=87.0; E value=2e-22; Homolog= rpoZ COG1758
MARVTVQDAVEKIGNRFDLVLVAARRARQLQSGGKDPLVAEENDKMTVIALREIEQGLINNKILDVRERQEQQEQDAAEIKAVSVIAEGRR

SEQ ID NO: 7989 - protein, 207 aa, Xenorhabdus bovienii
  Coding DNA sequence: Name=SeqID_1881
  Gene classification: Gene name=Gmk; Function=Guanylate kinase; Function class=F Nucleotide transport and metabolism
  Homolog annotation: Query=1..206bp; Hit=1..206bp; Blast score=326; Percent Identity=81.0; E value=9e-90; Homolog= gmk COG0194
MNQGTLYIVSAPSGAGKSSLIQALLKTQPLYDTQVSVSHTTRPTRSGENHGEHYFFVTVDEFQNMISHDEFLEYACVFGNYYGTSLKIIEDTLASGVDVFLDIDWQGAQQVRQKMPAARSIFILPPSKEELLRRLRGRGQDSDEVIDKRMSQAVAEMEHYGEYDYVIINDDFNTALADLQSIIRSERIRLDRQAQRHDALISKLLAG

SEQ ID NO: 7990 - protein, 69 aa, Xenorhabdus bovienii
  Coding DNA sequence: Name=SeqID_1882
MSVGMYCNAAWVDVSVYTMWDFIFLRLHLLIPNQSRNHHEPRNVIYCFCAEWSRQIKPYSGFIKNSAFV

SEQ ID NO: 7991 - protein, 619 aa, Xenorhabdus bovienii
  Coding DNA sequence: Name=SeqID_1883
  Gene classification: Gene name=Lig; Function=NAD-dependent DNA ligase (contains BRCT domain type II); Function class=L DNA replication, recombination and repair
  Homolog annotation: Query=43..538bp; Hit=22..519bp; Blast score=396; Percent Identity=41.0; E value=1e-110; Homolog= yicF COG0272
MLNFLIMILALLFGIPVALAGMAEQAPAKFTESVETGSTGNMADCPVWSQEKIQREMQHLTRQMAEWDQLYRQQGISEIDDEIYDQLLETLTLWRTCLHQTSDSTFSVAVPREGKHPHPVQHTGLNKLKGIKEIHQWLQGRSAVWLQPKVDGVAVTLVYEKGRLAGLISRGNGSEGTNWMDKSPFITRIPKQIKNAPERLVLQGELFWQQDSHRQSIVGSQGARSKVAGLMMRKSSAPELGQIGIFIWGWPDGPDEMAVKLERLASMGFPTAQQYSHRIISAQDAEKRWKSYFIQPLPFATDGVVLRQETEPTGRQWRAGSNSWAVAWKYPLQQQLTTVRDVHFKIGRTGRISVLLALEKVKLDDRQVRRVNLGSVRRWKQWNVYPGDKVTVALAGHGVPKLDKVVWRIAERPDIQPPNAQDFHSLSCLVSHDSCQQQFIARLTWLGENLKMKGVGQGTWVALVKYGLVTHLTDWLALDIVQLTEVPNIGTKRAELIFAQFQQARLQPLSSWREAIGLPYANRFTDEMGWQWDLLLSETGMKNPLTAKQTAKIAAFLQHPEIKALVHALTVYRIGEKQGSEENKVGEKKEAEPISHSEAREQERAPDALNNVSDQNRHN

SEQ ID NO: 7992 - protein, 232 aa, Xenorhabdus bovienii
  Coding DNA sequence: Name=SeqID_1884
  Gene classification: Function=Predicted membrane protein; Function class=S Function unknown
  Homolog annotation: Query=26..232bp; Hit=17..223bp; Blast score=230; Percent Identity=68.0; E value=1e-60; Homolog= yicG COG2860
MWLKNFSRDVIIPTLHFTTTLFHLIKLMLLSVLYIIGITAEAMTGALAAGRRKMDVFGVIIIASVTAIGGGSVRDIILGHYPLGWVENPAYIVTVACAAVITIWVAPMMKHLRRLFLILDAIGLIVFSIIGAQIALNMNHSPIIAAIAAVITGVFGGVLRDMFCNTIPLVFQKEIYAGVSFAAAWLYIGLLHTPLHPNSVILITLIAGLAARLIAIRYRLGLPIFNYDGSDH

SEQ ID NO: 7993 - protein, 433 aa, Xenorhabdus bovienii
  Coding DNA sequence: Name=SeqID_1885
  Homolog annotation: Query=1..428bp; Hit=1..428bp; Blast score=667; Percent Identity=72.0; E value=0; Homolog= ref|NP_927650.1|
MVFKERQITFDSRSHQITNINIWTPDSQWLVYDVRPSGASFTGLTIEKIHVGSGQVEVIYQAQDGAHVGVVTVNLQEPVRYAFIHGPEKPDRQWQYDFHHRRGVIVSDTQPNVAVNIDALDITPPYTPGALRGGTHVHVFSPDGNRLSFTYNDHVMHERDLALDLRNVAVAIPLRAVIPPKKHPREYDGSYFSVVVSRTTAQPRSGSDEINRAYEEGWIGQQGYLKENGQWQRWALAFIGDTRAENGEKIPEIYLVDLPENNEDYAIEGKQPLAGTEATLPAPPAGVKQRRLTFTHQNRWPGVVNVPRHWLRTSPDGSKIGFLMKDETGIVQLWYISPNGGVPMQLTHSAYHIQSAFNWDSGGRFIAFVCDNSIMLCNSQNGEMHRLTARTDDAPSADAIVISPDDRYVAFMRDIDGYRQVLIVETGIAGVGE

SEQ ID NO: 7994 - protein, 118 aa, Xenorhabdus bovienii
  Coding DNA sequence: Name=SeqID_1886
  Homolog annotation: Query=4..107bp; Hit=1..105bp; Blast score=149; Percent Identity=68.0; E value=8e-36; Homolog= ref|NP_927651.1|
METMKNHKVLLLLCTTLGWSLVTGCSSIMTHSGPYQGYYSGAKASIGMLKDDSTGWVMKPLLAVDLPFSAFLDTLLFPYDYTRSSKDQAEHSPKHRLEKLEQRSTATATAPENTNAET

SEQ ID NO: 7995 - protein, 43 aa, Xenorhabdus bovienii
  Coding DNA sequence: Name=SeqID_1887
VNRTVVIRIQKEFFTQLGKENNPCLYSFPELSLFNQKNPNLIT

SEQ ID NO: 7996 - protein, 418 aa, Xenorhabdus bovienii
  Coding DNA sequence: Name=SeqID_1888
  Gene classification: Gene name=AvtA; Function=PLP-dependent aminotransferases; Function class=E Amino acid transport and metabolism
  Homolog annotation: Query=1..416bp; Hit=1..416bp; Blast score=663; Percent Identity=75.0; E value=0; Homolog= ZavtA COG0436
MKFSQFGNKFTQDSGITRLMNDLNQGLRTPGAIMLGGGNPAHIPEMDDYFQQILADLVSSGQLGETLCNYDGPQGKNTLIAALAQELQEKLGWEIHPQNIALTNGSQSAFFYLFNLLAGRSEDGSMKRVLFPLAPEYIGYSDSGLDEGLFVANKPNIELLPNGQFKYRVDFDHLNISEDISLICVSRPTNPTGNVITDEELLRLDGLAQQHQIPLLIDNAYGVPFPGIIFNDATPLWNPNIILCMSLSKLGLPGSRCGIIIANEKIISAVSNMNGVISLAPGGVGPAIALEMIRRNDLFRLSQNVIQPFYKTRVDNVIEIIRRHMSEDRCLIHKPEGAIFLWLWFKNLPITTEVLYQRLKKRKVLMVPGHFFFPGLEHNWPHAHQCMRMNYVPDLEKIEEGIRILSEEIEIAHREAIR

SEQ ID NO: 7997 - protein, 52 aa, Xenorhabdus bovienii
  Coding DNA sequence: Name=SeqID_1889
LCEFVSELRKFHNGVCVCCFIGERDTIPRPLLGRNGVKPVLCVVIYYIMIIH

SEQ ID NO: 7998 - protein, 195 aa, Xenorhabdus bovienii
  Coding DNA sequence: Name=SeqID_1890
  Gene classification: Gene name=Tag; Function=3-Methyladenine DNA glycosylase; Function class=L DNA replication, recombination and repair
  Homolog annotation: Query=10..188bp; Hit=3..181bp; Blast score=254; Percent Identity=60.0; E value=4e-68; Homolog= Ztag COG2818
MEFINKESIRCAWVTADPDYLAYHDNEWGKPLKNSQQLFELLCLEGQQAGLSWLTILKKRQGYRKCFHQFDPVKIASMDENDVEQLLKDPAIVRNRAKINAIIHNARTYLKMADQGEDFSSFIWHFVDDSPLINHWKSRTDVPVRTPISDDLSNALKKRGFKFIGSTTCYAFMQAAGLVNDHLTSCLCRKVEISA

SEQ ID NO: 7999 - protein, 96 aa, Xenorhabdus bovienii
  Coding DNA sequence: Name=SeqID_1891
VRSSCADFHIQWLDNGAALTRPVILQCQDEPLKGFGIKLLHVESTRDTSRDTYEFKRKRSVYPLTVRYTALITRQFCCSIKKSYPSLFTCIFIQLI

SEQ ID NO: 8000 - protein, 302 aa, Xenorhabdus bovienii
  Coding DNA sequence: Name=SeqID_1892
  Gene classification: Gene name=GlyQ; Function=Glycyl-tRNA synthetase, alpha subunit; Function class=J Translation, ribosomal structure and biogenesis
  Homolog annotation: Query=1..302bp; Hit=1..302bp; Blast score=605; Percent Identity=94.0; E value=1e-173; Homolog= ZglyQ COG0752
MQKFDTKTFQGLILTLQDYWARQGCTIIQPLDMEVGAGTSHPMTCLRALGPEPIAAAYVQPSRRPTDGRYGENPNRLQHYYQFQVIIKPSPDNIQELYLGSLKALGLDPTVHDIRFVEDNWENPTLGAWGLGWEVWLNGMEVTQFTYFQQVGGLECKPVTGEVTYGLERLAMYIQGVDSVYDLVWSDGPLGKTTYGDIYHQNEVEQSTYNFEHADVDFLFTCFEQYEKEAQELLALEAPLPLPAYERILKAGHTFNLLDARKAISVTERQRYILRIRTLTKSVAEAYYASREALGFPMCKKN

SEQ ID NO: 8001 - protein, 689 aa, Xenorhabdus bovienii
  Coding DNA sequence: Name=SeqID_1893
  Gene classification: Gene name=GlyS; Function=Glycyl-tRNA synthetase, beta subunit; Function class=J Translation, ribosomal structure and biogenesis
  Homolog annotation: Query=1..689bp; Hit=1..689bp; Blast score=1092; Percent Identity=81.0; E value=0; Homolog= glyS COG0751
MIQQTFLVEIGTEELPPKALRSLAESFAANFETELKNANLGHGEISWFAAPRRLALKVANLAVAQADREVEKRGPAIAQAFDTEGKPTKAAEGWARGCGITVDQAERMVTDKGEWLLYRAQVKGREAKELLADMVSSSLGKLPIPKLMRWGDKETQFVRPVHTVTMLLGSDVIEGEILGIKSDRIIRGHRFMGEAEFAIDNAEQYPAILQERGRVIADYYARKALIKRDAEQAAMQLGGVADLTDSLLEEVTSLVEWPVVLTAKFEEKFLEVPAEALVYTMKGDQKYFPVYDKSGKLMANFIFVANIESSDPQQIISGNEKVVRPRLADAEFFFKTDRKQRLEDNLLRLETVLFQKQLGTLRDKTDRIQALAGWIAEKIGADVTHATRAGLLSKCDLMTNMVFEFTDTQGVMGMHYARHDGEAEDVALALNEQYQPRFSGDELPSTAVSCAVAIADKMDTLAGIFGIGQHPKGDKDPFALRRAALGVLRILVEKKLPLDLQTLAEEAVRLYGDKLTNENVVDDVVEFMLGRFRTWYQEQGYSVDAIQAVLARRPTQPADFDARMKAVTHFRTLDEAVSLAAANKRVSNILAKSEEKLNDSVLASVLKAAEEIQLATHLVVLKDKLAPLFAEGNYQDALVELASLREVVDAFFDNVMVMDEDQQVRINRLTLLSELRELFLRVADISLLQ

SEQ ID NO: 8002 - protein, 610 aa, Xenorhabdus bovienii
  Coding DNA sequence: Name=SeqID_1894
  Gene classification: Gene name=PurH; Function=AICAR transformylase/IMP cyclohydrolase PurH (only IMP cyclohydrolase domain in Aful); Function class=F Nucleotide transport and metabolism
  Homolog annotation: Query=82..610bp; Hit=1..529bp; Blast score=900; Percent Identity=85.0; E value=0; Homolog= ZpurH COG0138
ALHSKRLVYTYLYTNLSTDGYFGKICRASRKRFRYNYRRKKHHVIFSDCFEMLLRMPFFLSICWFFLNSTVLFYEIQGIIPMQQLRPIRRALLSVSDKAGIVEFAKALSSRGVELLSTGGTARLLAEAGLNATEVSDYTGFPEMMDGRVKTLHPKVHGGILGRRGQDDEIMSLHQISPIDMVVVNLYPFAQTVAKPDCSLEDAVENIDIGGPTMVRSAAKNHKDVAIVVNSQDYGKIIEEMDNHQNSLTQLTRFDLAIKAFEHTAAYDSTIANYFGKLVPAYHGEANQPSGRFSRTLNLNFIKKQDMRYGENSHQDAAFYIEEQIAEASIATATQLQGKALSYNNIADTDAALECVKTFAEPACVIVKHANPCGVAVGADMHTAYDRAFKTDPTSAFGGIIAFNRELDADTAKAIIERQFVEVIIAPSINEEALPILATKQNVRVLACGEWHSPVAGLDFKRVNGGLLVQDRDLGMVAEADLKVVSKRQPTEQEMRDALFCWKVAKFVKSNAIVYAKDNMTVGIGAGQMSRVYSAKIAGIKAADEGLEVQGCAMASDAFFPFRDGIDAAAAVGVSCVIQPGGSIRDDEAIAAADEHGIAMIFTGMRHFRH

SEQ ID NO: 8003 - protein, 427 aa, Xenorhabdus bovienii
  Coding DNA sequence: Name=SeqID_1895
  Gene classification: Gene name=PurD; Function=Phosphoribosylamine -glycine ligase; Function class=F Nucleotide transport and metabolism
  Homolog annotation: Query=1..425bp; Hit=1..426bp; Blast score=642; Percent Identity=75.0; E value=0; Homolog= ZpurD COG0151
MNILIIGSGGREHALAWKAAQSPLADKVYVAPGNAGTALEANLENIDIAATDIAGLLAFAQNHNIGLTIVGPEAPLVIGIVDAFQQAGLTIFGPTKAAAQLEGSKAFTKDFLSRHQIPTAAYQNFTEIEPALAYLKKMGAPIVIKADGLAAGKGVVVAMTIEEAQNAVKDMLAGNAFGDAGHRIVIEEFLDGEEASFIVMVDGKNVVPMATSQDHKRVGDGDTGPNTGGMGAYSPAPVVTDEVHRRVMEKIISPTVEGMAAEGHTYIGFLYAGLMIDKQGEPKVIEFNCRFGDPETQPIMMRLRSDLVELCLAGAQGQLSGKTSEWDTRPALGVVLAAGGYPANYAKGDVISGLNQEADTDEKVFHAGTAFKDKDVVTAGGRVLCVTALGDDIAEAQKKAYLGAEKIGWQGCFYRKDIGYRAIARLK

SEQ ID NO: 8004 - protein, 217 aa, Xenorhabdus bovienii
  Coding DNA sequence: Name=SeqID_1896
  Homolog annotation: Query=3..217bp; Hit=19..234bp; Blast score=296; Percent Identity=65.0; E value=2e-79; Homolog= ref|NP_927846.1|
MLQGLLALGFISLLSACSVQPKVPLFSASGFITDGGVIRLWRLNDQNSQPQVIMSVYSPYRNTDTSVTFYEYRYGNLWQIRRSVLDNYPIDETLRIDKDNKVIFMQRQAKEHSEPLSSDEIVRLRFDAKRIKEISDALMAGNVHLVQGHWQDGKVTTCSEKQLSIQFEPEDRAWLKEREKNSAGILTIAWLDAPEGKQLLLVANDDFCRWEPTKDKL

SEQ ID NO: 8005 - protein, 90 aa, Xenorhabdus bovienii
  Coding DNA sequence: Name=SeqID_1897
  Gene classification: Gene name=HimA; Function=Bacterial nucleoid DNA -binding protein; Function class=L DNA replication, recombination and repair
  Homolog annotation: Query=1..90bp; Hit=1..90bp; Blast score=125; Percent Identity=84.0; E value=6e-30; Homolog= hupA COG0776
MNKTELVDAIAEQAGLTKTQAKTALESTLNAITESLRNGDSVQLVGFGTFKVNHRAERTGRNPQTGNEIKIAAANVPAFSAGKALKDAVK

SEQ ID NO: 8006 - protein, 54 aa, Xenorhabdus bovienii
  Coding DNA sequence: Name=SeqID_1898
LPDLKTSHLPSLCSTLGVKRSGYRCVYAGVLSNRHIRRTRCFANDKHTVRIIYE

SEQ ID NO: 8007 - protein, 196 aa, Xenorhabdus bovienii
  Coding DNA sequence: Name=SeqID_1899
  Gene classification: Function=Uncharacterized BCR; Function class=S Function unknown
  Homolog annotation: Query=1..196bp; Hit=1..196bp; Blast score=304; Percent Identity=77.0; E value=3e-83; Homolog= yjaG COG3068
MLRNPIHLRLEKFESWQHWTFMASLCERMYPNYQVFCRQTGFADPAQYRRILDLAWETLIVKDAKVNFDSQLEKLETIIPSADSYDIYGVYPAIDACIALSEVIHSRLSGATLEHAIAVSEISIRTVAMLEMTQAGREMTEDELKALPAIEEEWDIQWEIYRLLADCEERDIELIKGLRADLRETKVSNIGINLEQ

SEQ ID NO: 8008 - protein, 255 aa, Xenorhabdus bovienii
  Coding DNA sequence: Name=SeqID_1900
  Gene classification: Gene name=Nfi; Function=Deoxyinosine 3'endonuclease (endonuclease V); Function class=L DNA replication, recombination and repair
  Homolog annotation: Query=21..247bp; Hit=2..217bp; Blast score=297; Percent Identity=62.0; E value=7e-81; Homolog= nfi COG1515
MPEHSSKRYTDFQKNITDDFMIDTKALRQEQIEKAQQVIRHDSFVTTSTSAIPESTPFTPELIAGADVGFEKNGTVTRAAIAVLHYPSLELLEYQVARIDTVLPYIPGLLSFREYPALMAAWQKLSLRPDLVMVDGQGIAHPRRFGVASHFGLLADIPTIGVAKSRLCGEHPPVGDAVGSYQPLMDHAEQIGVVWRSKKRCNPLYISIGHKVSLDSSVFWVEQCMKGYRLPEPTRWADGIASNRPFFKQTMQKNL

SEQ ID NO: 8009 - protein, 354 aa, Xenorhabdus bovienii
  Coding DNA sequence: Name=SeqID_1901
  Gene classification: Gene name=HemE; Function=Uroporphyrinogen-III decarboxylase; Function class=H Coenzyme metabolism
  Homolog annotation: Query=1..354bp; Hit=1..354bp; Blast score=631; Percent Identity=85.0; E value=0; Homolog= hemE COG0407
MNELKNDRYLCALLRQPVDVTPVWMMRQAGRYLPEYKATRQEAGDFISLCKNTELACEVTLQPLRRFPLDAAILFSDILTIPDAMGLGLYFESGEGPRFHSPILSHADVEKLPVPDPEMELGYVMDAVRAIRKALAGQVPLIGFSGSPWTLATYMVEGGSSKAFTKIKAMLYAQPATLHLLLDKLANSVILYLNAQIKAGAQSVMIFDTWGGVLSHRDYREFSLQYMHKIVDGLIREHEGRRVPVTLFTKGGGQWLEAMAATGCDALGLDWTTNIADARRRVGDKVALQGNMDPSMLYAAPARIEEEVSTILQDFGMGNGHVFNLGHGIHQDVPPEHAGAFVEAVHRLSEKYHR

SEQ ID NO: 8010 - protein, 48 aa, Xenorhabdus bovienii
  Coding DNA sequence: Name=SeqID_1902
MSEWLTLLQLCQKFDFWHVTMRRFFIVKVKLTVTKEFCGQLIKGACHE

SEQ ID NO: 8011 - protein, 256 aa, Xenorhabdus bovienii
  Coding DNA sequence: Name=SeqID_1903
  Gene classification: Gene name=NPY1; Function=NTP pyrophosphohydrolases containing a Zn-finger, probably nucleic-acid -binding; Function class=L DNA replication, recombination and repair
  Homolog annotation: Query=9..254bp; Hit=8..253bp; Blast score=349; Percent Identity=67.0; E value=1e-96; Homolog= yjaD COG2816
MIQQKLTGMERGWWVISLENLVWLPQGELPSGTARQWSLQGHMARPIGEWLGETVWLVCQKMASEMASPRMVASQNSTLFQLVGRGIQLAEFYRSHHHCGYCGHEMQHSQHEWACLCNHCHERYYPQIAPCVIVGIRRDDHILLAQHQHHRNGIHTVLAGFVEVGETLEETVHREVMEESGIKIRNLRYVASQPWPFPQSLMMGFLADYDSGEIQHDPVELISADWYHYDDLPLIPPSDTIARRLIEETVALCRNT

SEQ ID NO: 8012 - protein, 46 aa, Xenorhabdus bovienii
  Coding DNA sequence: Name=SeqID_1904
MIQSIYIKIYLFRNETLTFPNFSPILSLTNKFWTISFTGISVDELK

SEQ ID NO: 8013 - protein, 220 aa, Xenorhabdus bovienii
  Coding DNA sequence: Name=SeqID_1905
  Gene classification: Gene name=SerB; Function=Phosphoserine phosphatase; Function class=E Amino acid transport and metabolism
  Homolog annotation: Query=1..220bp; Hit=1..220bp; Blast score=209; Percent Identity=47.0; E value=1e-54; Homolog= VC1940 COG0560
MSQQIAVFDLDDTLICGDSSLLWTEYLWEKDIITDHRFIEADQKMMADYSAGKLDMHDYLAFNLQSLNQVHYEQVDIWLTDFVETKIKPIFYPAAKKQLAIYRQQNIPIIIISATVSFVVKKIAAAFGVPTAMGIDMVMEDGCYTDSILGIPTFREGKVTRLQQWLTEQNLSPQHISFYTDSMNDLPMCLFANKVFTVNADIRLQKEAENHGWRQLSWVL

SEQ ID NO: 8014 - protein, 47 aa, Xenorhabdus bovienii
  Coding DNA sequence: Name=SeqID_1906
METIELGVIKKPFLHPIYFKFSDIVRRYFSYYFITTFPFQKTLQFSY

SEQ ID NO: 8015 - protein, 43 aa, Xenorhabdus bovienii
  Coding DNA sequence: Name=SeqID_1907
MHIFIVIYCIYCIYCIYCIYCIYCIYCIYCIFSWFWYFLIRKL

SEQ ID NO: 8016 - protein, 41 aa, Xenorhabdus bovienii
  Coding DNA sequence: Name=SeqID_1908
MFSVAFSPNVATLGEYLQIIRRGKAFIPFRYEYSNHYSSFK

SEQ ID NO: 8017 - protein, 85 aa, Xenorhabdus bovienii
  Coding DNA sequence: Name=SeqID_1909
LSECLAFNVYHDEHRLRPLIRDPQNLIGLIPAKGTRVIIPLAYPPVSIEILFSTNHYSLRAPDKQFSQLKPIPVGDAPIRITDRL

SEQ ID NO: 8018 - protein, 657 aa, Xenorhabdus bovienii
  Coding DNA sequence: Name=SeqID_1910
  Gene classification: Gene name=ThiC; Function=Thiamine biosynthesis protein ThiC; Function class=H Coenzyme metabolism
  Homolog annotation: Query=28..650bp; Hit=8..630bp; Blast score=1111; Percent Identity=84.0; E value=0; Homolog= thiC COG0422
MSNNTVIPTTDIIPAADVSPKTHPARPRKAQRDAAQEFINSVQGITFPNSRRIYLAGSRKDIQVPMREIQLSPTLIGGINENPQFEENESVPIYDTSGAYGDPDSVLDVRAGLKKIRQPWIKERNDTEPVATLSSDFTQQRLADAGLDHLRFNQLPHPLKARQGGRVTQLHYARQGIVTPEMEFIALRENMGRERIRSEVLLQQHPGQSFGANLPENITPEFVRQEVAAGRAIIPANINHPESEPMIIGRNFLVKVNANIGNSSVTSSIEEEVEKLIWSTRWGADTVMDLSTGRYIHETREWILRNSPVPIGTVPIYQALEKVNGVAENLTWEMFRDTLLEQAEQGVDYFTIHAGVLLRYVPMTAKRLTGIVSRGGSIMAKWCLSHHQESFLYTHFREICEICAAYDVSLSLGDGLRPGSIQDANDEAQFAELHTLGELTKIAWEYDVQVMIEGPGHIPMQLIRRNMTEELEHCHEAPFYTLGPLTTDIAPGYDHFTSGIGAAMIGWFGCAMLCYVTPKEHLGLPNKDDVKQGLITYKISAHAADLAKGHPGAQIRDNAMSKARFEFRWEDQFNLALDPETARAYHDETLPQQSGKVAHFCSMCGPKFCSMKITQDVRDYAAKLEQEAGMEQMSEEFLAHGSELYHSAEDISDEKSA

SEQ ID NO: 8019 - protein, 257 aa, Xenorhabdus bovienii
  Coding DNA sequence: Name=SeqID_1911
  Gene classification: Gene name=ThiE; Function=Thiamine monophosphate synthase; Function class=H Coenzyme metabolism
  Homolog annotation: Query=45..247bp; Hit=3..205bp; Blast score=271; Percent Identity=67.0; E value=5e-73; Homolog= thiE COG0352
MQQNWNRKQAWNRCQKNSSLMAASCITVLRTLAMKNQPESSTIPQAPFASTVHRLGLYPVVDSLTWIERLLKAGIRTLQLRIKDLPEDQVEEDIQSAIVLSRQYNARLFINDYWDLAIKHHAYGVHLGQEDLDIADLNAIRQAGLRLGISTHDEHELARAKALRPSYIALGHIFPTATKEMPSKPQGLSALKHQVEITPEYPTVAIGGISLDRVPDVVATGVGGVALVSAITKAKDWRQATDRLLHLIEGNDRRLLC

SEQ ID NO: 8020 - protein, 274 aa, Xenorhabdus bovienii
  Coding DNA sequence: Name=SeqID_1912
  Gene classification: Gene name=ThiF; Function=Dinucleotide-utilizing enzymes involved in molybdopterin and thiamine biosynthesis family 2; Function class=H Coenzyme metabolism
  Homolog annotation: Query=8..246bp; Hit=1..238bp; Blast score=273; Percent Identity=61.0; E value=1e-73; Homolog= thiF COG0476
MLNDQEFMRYSRQLLLEDIGPDGQEKLKAGKVLIVGLGGLGSPAALYLAAAGVGHLYLADDDMLHVSNLQRQILYRTADIPAGKAVLAAKQLTALNPLVEVTVLTERQDRESLENFVRQVDLVLDCCDNMATRHAINTACIAENKPLISGSAVGFSGQLIVFEPPYLHGCYACLYPDQEEPHRNCRTAGVLGPVVGVIGTLQSLEAIKMLVGLPSSLSGKLRLFDGRQQSWSTLQLTSSSQCPVCGTHASKSGSTKPDRAETVSGKTRSGREVA

SEQ ID NO: 8021 - protein, 66 aa, Xenorhabdus bovienii
  Coding DNA sequence: Name=SeqID_1913
  Gene classification: Gene name=ThiS; Function=Sulfur transfer protein involved in thiamine biosynthesis; Function class=H Coenzyme metabolism
  Homolog annotation: Query=1..66bp; Hit=1..66bp; Blast score=67; Percent Identity=53.0; E value=2e-12; Homolog= ZthiS COG2104
MNIIVNDQPITLSTSMTVQQLLEHVQRSQSGTALAINQTIIPRSEWNTHQINDGDNILLFQAIAGG

SEQ ID NO: 8022 - protein, 255 aa, Xenorhabdus bovienii
  Coding DNA sequence: Name=SeqID_1914
  Gene classification: Gene name=ThiG; Function=Uncharacterized enzyme of thiazol biosynthesis; Function class=F Nucleotide transport and metabolism
  Homolog annotation: Query=1..254bp; Hit=26..279bp; Blast score=347; Percent Identity=72.0; E value=7e-96; Homolog= thiG COG2022
MLKIADTLFHSRLFTGTGKFANANLMIESIRASGSQLVTMAMKRIDLHGNDDGILAPLQQLGVKLLPNTSGAKTAEEAVFAARLAREALGTHWIKLEIHPDVKYLLPDPIETLKAAGQLVKEGFVVLPYCGADPVLCRLLEEVGCAAVMPLGAPIGSNKGLLTRDFLQIIIEQSRVPVVVDAGIGAPSHALAAIEMGADAVLVNTAIAVARNPIKMALAFKTAIEAGELSHQAGVASQKSHAEASSPLTDFLGAL

SEQ ID NO: 8023 - protein, 374 aa, Xenorhabdus bovienii
  Coding DNA sequence: Name=SeqID_1915
  Gene classification: Gene name=ThiH; Function=Thiamine biosynthesis enzyme ThiH and related uncharacterized enzymes; Function class=H Coenzyme metabolism
  Homolog annotation: Query=5..374bp; Hit=3..372bp; Blast score=598; Percent Identity=77.0; E value=1e-171; Homolog= ZthiH COG1060
MTDHTFRQRWQQLDWDDITLRINSKTTQDVERALNRDRLAMDDFMALLSPAALSYLEPLAQRAQQLTRQRFGNTVGFYIPLYLSNLCANDCTYCGFSMSNHIRRKTLNEQEIEAECQAIKKLGFEHILLVTGEHQSKVGMDYFRRYLPIIRSQFSSITMEVQPLAQEEYAELKTLGLDGVMVYQETYHAPSYQLHHLKGKKQDFHWRLETPERLGRAGIDKIGLGALIGLSPSWRTDCYMVAEHLLFLQKQFWKSRYSISFPRLRPCAGGVEPASLMSEAELVQLICAFRLLAPDVELSLSTRESPFFRDHVVPLAINHVSAGSKTQPGGYADDHHELEQFTPHDNRSVVQVAAALVKSGLQPVWKDWDNYLGR

SEQ ID NO: 8024 - protein, 345 aa, Xenorhabdus bovienii; identical to SEQ ID NO: 7397
  Coding DNA sequence: Name=SeqID_1916
  Gene classification: Function=Predicted transposase; Function class=L DNA replication, recombination and repair
  Homolog annotation: Query=165..332bp; Hit=20..184bp; Blast score=76; Percent Identity=29.0; E value=4e-14; Homolog= BH2520 COG3335

SEQ ID NO: 8025 - protein, 198 aa, Xenorhabdus bovienii
  Coding DNA sequence: Name=SeqID_1917
  Gene classification: Function=Uncharacterized ACR; Function class=S Function unknown
  Homolog annotation: Query=8..198bp; Hit=14..198bp; Blast score=193; Percent Identity=50.0; E value=1e-49; Homolog= YJL217w COG3506
MNLQHCHWLNEPASWKHQEDVLHVTTDIKTDFWRDTWYGFQRHSGHVFGRYVDDIHVEAGFTFQICIEGCFEHLYDQAGIMLLVDEQHWLKAGVEHSDGQATIGSVLTNSCSDWAMGVFPGNPDKFWLRLTYGEGVIRLQYSTDGVKWPLLRLSPFAVDSQRIFIGAMCCSPEREGLQVKFSDFSLKSSLKRHLHDLS

SEQ ID NO: 8026 - protein, 356 aa, Xenorhabdus bovienii
  Coding DNA sequence: Name=SeqID_1918
  Gene classification: Gene name=ProP; Function=77 Permeases of the major facilitator superfamily; Function class=G Carbohydrate transport and metabolism
  Homolog annotation: Query=3..354bp; Hit=30..383bp; Blast score=137; Percent Identity=32.0; E value=2e-32; Homolog= mlr3825 COG0477
MAAWAPLIPLVKERFALDDGAMGLLILVFGIGSFITMPLAGMLASRFGCRKIFPLFALLAILMLPGLSILPTPWALACALFMFGVGIGATDVVINIHAVNVEKMVQQPIMSGFHALFSLGGIAGAGSVSLLLLMGISPFQVMSAVALFIILLLLPAWNGLLDHIETGNTPSFALPRGIVILLGFLCFVVYLMEGSMLDWSGILLSSVHNMDSHQAGFGYTLFAITMTCGRFLGDKIISMFGYRRVFLASAILATSGFVLIYLASSMIVLGISFLMIGAGLSNLAPMFFTASGQQKVMPDSQAVSAVSTMGYSGILLGPAIIGGLAHQVTLHGAFACIALLSLTLLAGYGLIHPARK

SEQ ID NO: 8027 - protein, 62 aa, Xenorhabdus bovienii
  Coding DNA sequence: Name=SeqID_1919
MPNTSMSNPIAPSSSANLSLTKGIRGAQAAILKPAIKKASRVAMIGCFIEETAYSSDNLIPP

SEQ ID NO: 8028 - protein, 31 aa, Xenorhabdus bovienii
  Coding DNA sequence: Name=SeqID_1920
MYSDAQSCPPQVLLEDINIAYIAIALTLASR

SEQ ID NO: 8029 - protein, 212 aa, Xenorhabdus bovienii
  Coding DNA sequence: Name=SeqID_1921
  Gene classification: Function=Predicted phosphatase/phosphohexomutase; Function class=R General function prediction only
  Homolog annotation: Query=6..183bp; Hit=4..189bp; Blast score=68; Percent Identity=31.0; E value=5e-12; Homolog= TM1254 COG0637
MDKFNVIFDIDGVIVDSEQLHFDVLCGLAPDHTRDIQPQQLIGLSLAETLNEIGVPLLEQQGITDKIISVYQEKLSAHYLRPGVTRLIAALQQNDIAFGFVSTAPRAVCLANLGLLGLFDEPALISGDDVERTKPFPDPYLAMLKLKRMDVQQTLVIEDTDLGIAAAKQAGIPWVYAWPHDLSVAEQYGQATCIIGELTDIPQFSGINSLSA

SEQ ID NO: 8030 - protein, 353 aa, Xenorhabdus bovienii
  Coding DNA sequence: Name=SeqID_1922
  Gene classification: Gene name=Tdh; Function=Threonine dehydrogenase and related Zn-dependent dehydrogenases; Function class=E Amino acid transport and metabolism
  Homolog annotation: Query=28..323bp; Hit=29..326bp; Blast score=123; Percent Identity=29.0; E value=4e-28; Homolog= BH0189 COG1063
MKALKFNQVWNVQIQQVEPLHCIESDDVVVDIAVCGICGTDIGIITGSYPVAVPGTTLGHETTGVVTQIGSHVTRFQIGDRVVINPTYSCGHCRMCQTGNPNHCEKKLGTEAGVSYDGAFAEQYLAKESSLIKLDEHVSMEAASLTEPLSCTLTGVDKLGITHTNIRAVVAGAGPMGMLYLWALHERGVKAFMIEKNPSRVQFAINNLPAECRLYTDFDEALTQEYGDKSALIDLCVDTTGQLTEYVFDHLAAGGKLLNVALKDKHANLDILKIADKSLSVIGSIDSLNNSFERAYAMIRDGVIPAERLISQIFDFEDYQQAFLTVGCDIAEKAQVPLSTPNCKVLIRMADFK

SEQ ID NO: 8031 - protein, 416 aa, Xenorhabdus bovienii
  Coding DNA sequence: Name=SeqID_1923
  Gene classification: Gene name=ArgD; Function=PLP-dependent aminotransferases; Function class=E Amino acid transport and metabolism
  Homolog annotation: Query=15..401bp; Hit=44..444bp; Blast score=181; Percent Identity=31.0; E value=1e-45; Homolog= TVN0024 COG0160
MENRNHLDDMLSRFVGHGPYLEIDGEKHIDAASGTFNLPLGYTNHRVAEKLKQQIDRCTHLSSAYTREMSQYILTKLVKHTPEGIDRMWLRDVSGSGAVEGAIRIAQKATGRSGIISFFLAHHGQSLATAQISGNAFRIKDFHISIDGSIKIPAPASVMVEPDSNEKESQYADLEQFIQLGSSDNIACLIIEPIQGNGGNTVFPVEFYRKIREICHQHGIIIIADEVQTGFGRTGTFFASTGYAKELEPDIIVFAKGAGGIGIPTGGVLMRSSLDVLESFEHSSTSGANPLSLVALNEVIDIIEDDSILENVQQNEAFLRDGLLALQHKYPEITGVRGMGYMFGFDTPTPEFAAQVIETASRQRLILRGSRYGKGRALKVRPPLVCTQEHLHEILHKLDLAFAELTVSAPKHREVA

SEQ ID NO: 8032 - protein, 958 aa, Xenorhabdus bovienii
  Coding DNA sequence: Name=SeqID_1924
  Gene classification: Gene name=MalT; Function=ATP-dependent transcriptional regulator; Function class=K Transcription
  Homolog annotation: Query=50..953bp; Hit=1..901bp; Blast score=1197; Percent Identity=71.0; E value=0; Homolog= malT COG2909
MKSTNLFAKDRRFSKFGWALMNVSGENESITLNRVLVSVLFIAYEGKKSMLIPSKLSRPLRLNNMVMRERLLELLSEVQHYRLVLITSPAGYGKTTLMSQWAAGQSNLGWYSLDDSDNQPERFASYLIAAIQQATQGHCVKSDVLAQKHQYANLPALFAQLFIELSEWKQPIFLVIDDYHLIENNLIHEAMRFFLRHQPENLTLTILSRHLPSLGVANLRVREQLLEFDSQQLAFDYQETQQFFDKRLASPLGADNCKQLCNDVAGWATALQLIALSARQSGNTAEMSAKRLSGINASHLADYLVDEVLNRVDQDTRDFLLRSSILRSMNDGLIVCLTGEDNGQQRLEDIERQGLFIQRMDDSGEWFCFHPLFASFLRQRCQWEMAAKLPELHRAAAEGWLMQGFPGEAIHHALAAGDTVLLCDILLQHAWGLFNHSKLSLLEECMNALPYEQLLENPRLVLLQAWLAQSQHRYYEVNALLNQTEQSLKQKQIIIEPELLAEFDALRAQVAINDGRPDDADTLAEKALAALLPDNEYGRIVAMSVKGEVLHCKGELSHALALMKQTEQLARRCHVYHYALWALLQQSEILLAQGYLQAAYEIQNHAFDLIREQHLEQLPMHEFLLRIRSQLLWCWARIDESEEAARRGLEVLSSVQPQQQLQCLTQLAKCSLIRGDIDNARRYLSRCENLLNNGHYHRDWRTNTDKLRVIIWQNLEDSGSATQWLVQAERPESFNNHFNQNQWRNIARAQILLGQYEEAEPILGMLNKYARELLLISDLNRNLLLCNLLHWQLGHKAEAQAVLMEALSLANRTGFISHFVLEGELMAQQLRQLIQLNILPELEQHRAQRILREINRQHRHKFAHFDETFVEQLLTHPDVPELIRNSPLTQREWQVLGLIYSGYSNDQIAAELEVAATTIKTHIRNLYQKMGITHRQDAIQQAQHLMQIMGLSVESMNI

SEQ ID NO: 8033 - protein, 72 aa, Xenorhabdus bovienii
  Coding DNA sequence: Name=SeqID_1925
MLKILEAVGIILRGYSQGGVQGRSHWPYLNKQQGRWQKKWVNNLIGKVSYLSRFFEAFRNFIGNRKNCKQRM

SEQ ID NO: 8034 - protein, 802 aa, Xenorhabdus bovienii
  Coding DNA sequence: Name=SeqID_1926
  Gene classification: Gene name=GlgP; Function=Glucan phosphorylase; Function class=G Carbohydrate transport and metabolism
  Homolog annotation: Query=1..802bp; Hit=1..796bp; Blast score=1141; Percent Identity=67.0; E value=0; Homolog= ZmalP COG0058
MQQPKLDKAVFQAALTRQWQRFGLSSAQEMTPHQWWQAISAALLELLPSSSQNHAHQFHNPKRHVNYISMEFLIGRLTANNLLNLGWYDDVQAYLAEDGLTLSDLLEQEADPALGNGGLGRLAACFLDSMATIDQPATGYGLNYQYGLFRQSFDQGLQIEAPDDWKRGSYPWFRHNAQLKVDVGLGGKIVMTAEGHETWLPAFTLIGEAWDLPVIGYGNGVTQPLRLWQATHDNPFDLSLFNDGQFLNAEQQGIEATSLTKVLYPNDNHQAGKRLRLMQQYFQCACAMADILRRHQQAGRKVEELPRYEVIQLNDTHPTIAIPEMMRLLLDEYQLDWETAWEITGQTFAYTNHTLLPEGLERWDEHLVSELLPRHHRIIQEINRRFQKTVEQTWPGNQQVWEKLAVIHENQVRMANLCVVACFAVNGVAALHSSLIVTDLFPEYYHLWPEKFHNVTNGVTPRRWLKQCNPALSSLIDQTLNHEWVNDLESLKQLEPYANDAAFCEAYRSIKQENKIRLSNYVNKVMGLKIDPHAIFDVQIKRLHEYKRQHLNLLHILSLYRQIQENPSLDIHPRVFLFGAKAAPGYYLAKNIILAINHAAEKINHDPIVRDRIKIAFIPDYNVSTAELMIPAADVSEQISTAGKEASGTGNMKLALNGALTIGTLDGANVEIAEQVGNDNIFIFGNNVEEAKALLKSGYNPREILQQNPHLQGILDALASGEFSHGDTQAFDLMLHSLVDGGDPYLVLADFDSYCHAHTQIDTLYRNPQHWTHRTILNTARMGKFSSDRAIQDYQQRIWQAK

SEQ ID NO: 8035 - protein, 702 aa, Xenorhabdus bovienii
  Coding DNA sequence: Name=SeqID_1927
  Gene classification: Gene name=MalQ; Function=4-alpha -glucanotransferase; Function class=G Carbohydrate transport and metabolism
  Homolog annotation: Query=1..695bp; Hit=1..681bp; Blast score=846; Percent Identity=59.0; E value=0; Homolog= malQ COG1640
MENKHLDNLATEAGIAAEYINAYGKPQAIPAEIRHRILAAMYTDPPANRPVSDLPVLTVPVVKVMTQGQTITLPLNSTENYRWQIQTEQGEIFQGDCQYQITLPANLPLGYHTLTLVPIQSISAKEPHTQHPVMQIIVAPERCYEPETLINGGKLWGACIQLYTLRSENNWGIGDFGDLKYMLQELTQRGGAFIGLNPLHAMYPAMPEDASPYSPSSRHWLNIIYIDVNQVEDFTYSVEAQKWWLLPETQLKLQHVRQTELVDYTSVMTLKITALRLAYQQFQTRSATDHLYIAFRQFVTKGGKSLYSQAAYDALHRKLYDEDSAYWGWPVWPEKYREPDSDTVKEFCQSHWQEVEFFLWLQWLADTQLAGCFTESQHNHMPIGIYRDLAVGVAQGGSETWCNRTVYCTKASIGAPPDILGPLGQNWGLPPINPHVLRAQAYQPFIELLRSNMRHCGALRIDHVMSLLRLWWIPQGETADKGVYVHYPVDDLLAILALESQRHHCMVIGEDLGIVPEEIVGKLHDRSVYSYKVFYFERDGHGEFRSPDEYPTQAMATITTHDLPTLRGFWQNKDLMLGESIGLYPDTTLLDGLYDERKHCKQKLLDGLNRHGYLSASLSMTDTPAPMSASINQSIHRYIAHSTSALLGLQPEDWLDMELPVNIPGTSTEYPNWRRKLSITLEAMFQDEHINHLLQTVGEYRR

SEQ ID NO: 8036 - protein, 296 aa, Xenorhabdus bovienii
  Coding DNA sequence: Name=SeqID_1928
  Gene classification: Function=ABC-type maltose transport systems, permease component; Function class=G Carbohydrate transport and metabolism
  Homolog annotation: Query=1..296bp; Hit=1..296bp; Blast score=432; Percent Identity=82.0; E value=1e-121; Homolog= malG COG3833
MAMVQPKSQRWRVGATHMLMLAFIALILLPMLMVIAISLRPGNFATGSLIPETISWEHWKLALGYSVESPDGRVTPPPFPVIQWLWNSVKIAFITATGIVALSTTCAYAFARMRFRGKSTLLKGMLIFQMFPPVLSLVALYALFDRLGAYIPFMGLNTHGSVIFAYMGGIALHVWTIKGYFETLDGSLEEAAMLDGATSWQVFRLILLPLSVPILAVVFILSFIGVITEVPVASLLLRDVDSYTLAVGMQQYLHPQSSLWGDFAAAAVLSAIPITVMFLLAQRWLVGGLTSGSVKG

SEQ ID NO: 8037 - protein, 520 aa, Xenorhabdus bovienii
  Coding DNA sequence: Name=SeqID_1929
  Gene classification: Function=ABC-type maltose transport systems, permease component; Function class=G Carbohydrate transport and metabolism
  Homolog annotation: Query=5..520bp; Hit=4..514bp; Blast score=711; Percent Identity=71.0; E value=0; Homolog= ZmalF COG3834
MSARLDKTEWWSHPVLKWFGVSLCLFFTGYLIVLMYAQGEYLFAMLTLVLLGSGIYVFANRKAYAWRYTYPGIAGMSLFVLFPLICTVAIAFTNYSSTNQLTFERAQTVLMSRQYQAGQTFNFKLYPESEQWVLALSVPSSSQLLVSDPFSLSTSAGEEVILPLHKQEKVFESDAAALRTITQYRQALGQLVTVLPDGSKLRMSSLRQFSGIHPLHSIGEDGITLTNNQTGTQYRPNMDTGFYQATNAEGGWSEGTLSPGFTVSVGWKNFLRVIQDDGIQKPFLSIFVWTVIFSLLTVILTVALGMILACIVQWEALKGRAIYRVLLILPYAVPSFISILIFKGLFNQSFGEINLLLNGLFGLKPEWFTDPTLARTMLIIVNTWLGYPYMMILCMGLLKSIPDDLYEASAIDGAGPLQNFSRITFPLLIKPLTPLIIASFAFNFNNFVLVQLLTNGRPDRIGTTTPAGYTDLLVNYTYRIAFEGGGGQDFGLAAAIATLIFLLVGALAIINLKATRIKFD

SEQ ID NO: 8038 - protein, 399 aa, Xenorhabdus bovienii
  Coding DNA sequence: Name=SeqID_1930
  Gene classification: Gene name=MalE; Function=Maltose-binding periplasmic proteins/domains; Function class=G Carbohydrate transport and metabolism
  Homolog annotation: Query=6..399bp; Hit=3..396bp; Blast score=637; Percent Identity=78.0; E value=0; Homolog= malE COG2182
MTKTTLKVGARALMLSVLTTWILSAPAFAKLEEGKLVIWINGDKGYNGLAQVGEKFAKETGIPVAVEHPDKFEEKYSQIAANGDGPDIIFWAHDRFGGYAQSGLLAEVTPDQPFMDKLFPFTWDAVRYDGKLIGYPIAVEALSLIYNKDLVKSPPKTWEEIPALDNELKKQNKSAIMFNLQEPYFTWPLIAADGGYAFKVENGAYNTKDSGVNNAGSKAGMQFLVDLVKNKHLSADIDYSIAEAAFNKGKTAMTINGPWTWTNIDKSKINYGVTLLPTFKGKPSKPFVGILTAGINAASPNKELAKEFLENYLLTNEGLATVDKDKPLGAVALKSYQDILAKDPRIAATMANAQQGEIMPNVSQMSSFWYAMRSAVLNAVNGRQAIDAALNDAENRIAK

SEQ ID NO: 8039 - protein, 61 aa, Xenorhabdus bovienii
  Coding DNA sequence: Name=SeqID_1931
MSLKRKASEREHPLSELFLSSFRPFRRLQVQDEFLVTPLENGSQCAINGRQAHPPLFYASP

SEQ ID NO: 8040 - protein, 31 aa, Xenorhabdus bovienii
  Coding DNA sequence: Name=SeqID_1932
MSVNLITKTLKIRMLTLKRHQFLRFKSHLAQ

SEQ ID NO: 8041 - protein, 51 aa, Xenorhabdus bovienii
  Coding DNA sequence: Name=SeqID_1933
LLSDFSRNLSITLISSSLCLPHKKLWDGGFLFLLFCTQFCHQFFTKFLLQT

SEQ ID NO: 8042 - protein, 45 aa, Xenorhabdus bovienii
  Coding DNA sequence: Name=SeqID_1934
MEDFYSCYFAHNFATSFSLSFYYKHETRVTTPRGTHVQRHTPQCI

SEQ ID NO: 8043 - protein, 369 aa, Xenorhabdus bovienii
  Coding DNA sequence: Name=SeqID_1935
  Gene classification: Function=ABC-type sugar transport systems, ATPase components; Function class=N Cell motility and secretion
  Homolog annotation: Query=1..369bp; Hit=1..371bp; Blast score=611; Percent Identity=82.0; E value=1e-175; Homolog= malK COG3839
MSSVTLRNVSKTYGETVISKNFNLEIEEGEFVVFVGPSGCGKSTLLRMIAGLEDITSGDLLIAGQRMNDVPPAKRSVGMVFQSYALYPHLSVADNMSFGMKLAGIKKSDIQKRVQQVAETLQLAHLLDRRPKALSGGQRQRVAIGRTLVAEPNIFLLDEPLSNLDAALRVQMRIEISRLHQRLQRTMIYVTHDQTEAMTLADKIVVLDTGNIAQVGKPLEIYHYPANRFVAGFIGSPKMNFLPVKVSATAVDQVQIILPNGQHVWLPVESKDVTVGSNVSLGIRPEHLLPNDVADVTLEGTVQIVEQLGNETQIHIRIPAIHQNLVYRQPDVVLVEEGATFTIGLAPHRCHLFREDGTACQRLHKEPGV

SEQ ID NO: 8044 - protein, 424 aa, Xenorhabdus bovienii
  Coding DNA sequence: Name=SeqID_1936
  Homolog annotation: Query=1..424bp; Hit=4..428bp; Blast score=712; Percent Identity=83.0; E value=0; Homolog= ref|NP_927809.1|
MRILPLSLAMLTGLLSMQATAVEFHGYARSGIGWAGKGGEQKCVQSTGAQSKYRLGNECETYAELKLGQELWKEGNKRFYFDTNVAYSVAQKDDWESTNPAFREVNVQASNIIDWLPGSTLWAGKRFYQRHDVHMIDFYYWDISGPGAGLQDIDLGFGKLSLAVTRNTESGGSHGWIADKRDEVPTSNDVFDVRLANLQVNEGGTLELGIDYGRANARKGYHLNQKASKDGVMLTAEHTQSLLGGFNKFVVQYATDAMTSYNSGHSEGASVNNDGHMLRILNHGAINITDKWDLMYLAMYQNIDRDNRNGNTWYTVGVRPMYKWTPIMSTLLEVGYDNVKSQRTKDTNNQYKITLAQQWQAGDSIWSRPAIRLFATYAKWGEKWGYANKNNGYKGVAYNDSSSHRFSRGNSDEFTFGAQFEAWW

SEQ ID NO: 8045 - protein, 334 aa, Xenorhabdus bovienii
  Coding DNA sequence: Name=SeqID_1937
  Homolog annotation: Query=9..323bp; Hit=1..303bp; Blast score=379; Percent Identity=65.0; E value=1e-104; Homolog= ref|NP_927808.1|
MDSDKANTMKIKLLSVCLSTLLCYALPAASYAAPDTAMPDSSDNVVVPDSKLHNTTAPALTMSSLQKLKWLPANTHATQTIILNSASSQINEGDIQGAVAAFALPANQGSLEITLNSLIKDKQVYSPNVLVLDEQLRPAAFYPSHYFQYQRPGIMSVDRLEGTLKLTPALGQQQIYLLVYTTRADLQSSTQMVDPAKAYAQGVGNAVPNIPDPMARHTETGTLTLKVKSERDAGNVLIGQAFSAPAPKPVTVGSMQTATTAVTTLQPVVPAIIPKNKPVLSDTEKYFNDAIKKAINDGDIDKALHLLDEAEHLGSSTARDTFIIGVMVRNEIFI

SEQ ID NO: 8046 - protein, 36 aa, Xenorhabdus bovienii
  Coding DNA sequence: Name=SeqID_1938
VVILLELQYICIIILDIYFFGKILKKYLVNKGVIDC

SEQ ID NO: 8047 - protein, 417 aa, Xenorhabdus bovienii
  Coding DNA sequence: Name=SeqID_1939
  Gene classification: Gene name=CDA1; Function=Predicted xylanase/chitin deacetylase; Function class=G Carbohydrate transport and metabolism
  Homolog annotation: Query=34..417bp; Hit=24..405bp; Blast score=435; Percent Identity=54.0; E value=1e-122; Homolog= ZyadE COG0726
MSRIVYVIEVALLLFFSFFSNPVLAQHHNLSNYRYMEVTKDSEIYARVGEHIVQVGLLKKGHFLKAAQEKGDQDDHYEFHFGNGQGYIEKENLKEVKKSVSFNVPLATLDKKNSENLMIFKDVRVYSTPEVNSSSIAILSANLRYPILDKLKDPSDQTWYEVNLGDRVGYISGQDAELDHGIPLLTYHHILKDKENKRFLHTSTTTSLSAFREQMDYLKQADYTTISLYELEGYLNGTLNLPAKVVGLTFDDGLKSIYRYAYPILKKNGQKATLFIISSRIKRYPQEWNSEDLQFMNLSALYATKDVFDFQSHTHFLHRLGKNKQPILFSRSYHTILYDFERSRRALSQFNPHVLYLSYPFGGYNQQAMDAARNAGFHLAVTTKQGKVKLGDNPFALKRLYILRTDSIEKMAKMVAN

SEQ ID NO: 8048 - protein, 1423 aa, Xenorhabdus bovienii
  Coding DNA sequence: Name=SeqID_1940
  Gene classification: Gene name=RpoC; Function=DNA-directed RNA polymerase beta' subunit/160 kD subunit (split gene in archaea and Syn); Function class=K Transcription
  Homolog annotation: Query=16..1422bp; Hit=1..1407bp; Blast score =2569; Percent Identity=91.0; E value=0; Homolog= rpoC COG0086
MGHSPNRSNSDRSYFVKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRDRMGHIELASPTAHIWFLKSLPSRIGLLLDMPLRDIERVLYFESYVVVEGGMTSLERAQILTEEQYLDALEEFGDEFDAKMGAEAIQALLKNLDLENECETLREELNETNSETKRKKLTKRIKLLEAFIQSGNKPEWMVLTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPASGEPIIVPSQDVVLGLYYMTRDCVNAKGEGMVLTGPKEAERVYRAGLASLHARVKVRITEEVRDGEGNVTTNTGLVDTTVGRAILWMIVPRGLPYSLINQALGKKAISKMLNTCYRILGLKPTVILADQTMYTGFAYAARSGVSVGIDDMVIPEKKEGIIAEAEAEVAEIQEQFQSGLVTAGERYNKVIDIWAAANERVAKAMMENLSTETVINRDGEEEQQVSFNSIFMMADSGARGSAAQIRQLAGMRGLMATPDGSIIETPITANFREGLNVLQYFISTHGARKGLADTALKTANSGYLTRRLVDVAQDLVVTEDDCGTHNGILMTPVIEGGDVKEPLRERVLGRVTAEDVLKPGTADILVSRNTLLNEKWCDLLEESSVDSVKVRSVVSCETDFGVCANCYGRDLARGHIINKGEAVGVIAAQSIGEPGTQLTMRTFHIGGAASRAAAESSIQVRNKGHLKLFNAKYVTNSAGKLVITSRNTELRLIDDFGRTKESYKVPYGSVLSKGDGETVTGGETVANWDPHIMPVVSEVSGIIQFYDMVDGQTITRQTDELTGLSSLVVLDSAERTGSGKDLRPALKIVDAQGKDVLISGTDMPAQYFLPGKAIVQLEDGISISAGDTLARIPQESGGTKDITGGLPRVADLFEARRPKEPAILAEISGIVSFGKETKGKRRLVISPLDGSDAYEEMIPKWRQLNVFEGEVAERGDVISDGPESPHDILRLRGVHAVARYITNEVQEVYRLQGVKINDKHIEVIVRQMLRKVTIASVGSSEFLEGEQVEYARVKVANRKLELDGKLAATFHRDLLGITKASLATESFISAASFQETTRVLTEAAVAGKRDELRGLKENVIVGRLIPAGTGYAYHQERIRRRHANEVVEAPQVSVDEATANLAELLNAGFGSSSDKQ

SEQ ID NO: 8049 - protein, 1342 aa, Xenorhabdus bovienii
  Coding DNA sequence: Name=SeqID_1941
  Gene classification: Gene name=RpoB; Function=DNA-directed RNA polymerase beta subunit/140 kD subunit (split gene in Mjan, Mthe, Aful); Function class=K Transcription
  Homolog annotation: Query=1..1342bp; Hit=1..1342bp; Blast score=2507; Percent Identity=94.0; E value=0; Homolog= rpoB COG0085
MVYSYTEKKRIRKDFGKRPQVLDIPYLLSIQLDSFQKFIEQDPEGQNGLEAAFRSVFPIQSYSGNSELQYVSYRLGEPVFDVQECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPASIILRAMNYSTEDILNLFFNKTVFEIRDNKLQMTLVPERLRGETASFDIEANGKLYVEKSRRITARHIRQLEKDQIDRIEVPVEYIAGKVVAKDYIDQNTGEIICAANMELSLDLLARLSQSGHKTIETLFTNDLDHGAYISETLRVDPTNDRLSALVEIYRMMRPGEPPTREAAENLFENLFFSEDRYDLSAVGRMKFNRSLDRTEIEGSGILSKEDITDVMKKLIDIRNGKGEVDDIDHLGNRRIRSVGEMAENQFRVGLVRVERAVKERLSLGDLDTLMPQDMINAKPISAAVKEFFGSSQLSQFMDQNNPLSEITHKRRISALGPGGLTRERAGFEVRDVHPTHYGRVCPIETPEGPNIGLINSLSVYARTNEYGFLETPYRLVRDGVVTDEIHYLSAIEEGNYVIAQANTVLDEEGHFVEDLVTCRHYDESSLFNRDQVQYMDVSTQQIVSVGASLIPFLEHDDANRALMGANMQRQAVPTLRADKPLVGTGMERAVAVDSGVTSVAKRGGVIQYVDASRIVIKVNEDEMYAGEAGIDIYNLTKYTRSNQNTCINQMPCVSLGELVERGDVLADGPSTDLGELALGQNMRVAFMPWNGYNFEDSILVSERVVQEDRFTTIHIQELACVSRDTKLGPEEITADIPNVGEAALSKLDESGIVYIGAEVKGGDILVGKVTPKGETQLTPEEKLLRAIFGEKASDVKDSSLRVPNGVAGTIIDVQVFTRDGVEKDKRALEIEEMQLRQAKKDLTEELRIFEAGLFARIHSVLVAGGIEAEKLSKLPRERWLELGLADEEKQNQLEQLAEQYDELKTEFEKKLDAKRRKITQGDDLAPGVLKIVKVYLAVKRQIQPGDKMAGRHGNKGVISKINPIEDMPYDENGTPVDIVLNPLGVPSRMNIGQILETHLGMAAKGIGDKINAMLKQQQEVAKLREFIQKAYDLGDDTRQTVDLNTFTDEEVLRLAENLKKGMPIATPVFDGAKETEIKELLKLAGLPTSGQITLFDGRTGEQFERQVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 8050 - protein, 48 aa, Xenorhabdus bovienii
  Coding DNA sequence: Name=SeqID_1942
MSITENILFSVRINSVAECCPKGRAEWVTDQRAEEPYGLLLYREKTYS

SEQ ID NO: 8051 - protein, 121 aa, Xenorhabdus bovienii
  Coding DNA sequence: Name=SeqID_1943
  Gene classification: Gene name=RplL; Function=Ribosomal protein L7/L12; Function class=J Translation, ribosomal structure and biogenesis
  Homolog annotation: Query=1..121bp; Hit=1..122bp; Blast score=122; Percent Identity=68.0; E value=4e-29; Homolog= BU035 COG0222
MSITKEQILDAVAEMSVMDVVELITMMEEKFGVSAAAAVAVVGGAAEAVEEKTEFDVILSSIGANKVAVIKAVRGATGLGLKEAKDLVESAPAALKEGISKDDAEALKKSLEEAGASVEIK

SEQ ID NO: 8052 - protein, 165 aa, Xenorhabdus bovienii
  Coding DNA sequence: Name=SeqID_1944
  Gene classification: Gene name=RplJ; Function=Ribosomal protein L10; Function class=J Translation, ribosomal structure and biogenesis
  Homolog annotation: Query=1..165bp; Hit=1..165bp; Blast score=233; Percent Identity=89.0; E value=1e-61; Homolog= rplJ COG0244
MALNLQDKQAIVAEVSEVAKGALSAVVADSRGVTVGKMTELRKAGREAGVYMRVVRNTLMRRAVEGTDYECLKEAFVGPTLIAFSSEHPGAAARLFKEFAKANPAFEIKAAAFEGEFISGENIDRLATLPTYEEAIARLMATMKEASAGKLVRTLAALRDQKEAA

SEQ ID NO: 8053 - protein, 50 aa, Xenorhabdus bovienii
  Coding DNA sequence: Name=SeqID_1945
MKFIFWILLTVFQRSGTLGALSEVSPGFSRLIQEQEANGTKSSRQTSDCC

SEQ ID NO: 8054 - protein, 233 aa, Xenorhabdus bovienii
  Coding DNA sequence: Name=SeqID_1946
  Gene classification: Gene name=RplA; Function=Ribosomal protein L1; Function class=J Translation, ribosomal structure and biogenesis
  Homolog annotation: Query=1..232bp; Hit=1..232bp; Blast score=356; Percent Identity=92.0; E value=1e-98; Homolog= rplA COG0081
MAKLTKRMRTIRGKVDATKQYDINEAVALLKELATAKFVESVDVAVNLGIDARKSDQNVRGATVLPHGTGRSVRVAVFAQGANAEAAKAAGAELVGMDDLADQIKKGEMNFDVVIASPDAMRVVGQLGQILGPRGLMPNPKVGTVTPNVAEAVQNAKAGQVRYRNDKNGIIHTTIGKVDFDADKLKENLEALVVALKKAKPSSAKGIFIKKVSLSTTMGAGVAIDQSGLNATA

SEQ ID NO: 8055 - protein, 142 aa, Xenorhabdus bovienii
  Coding DNA sequence: Name=SeqID_1947
  Gene classification: Gene name=RplK; Function=Ribosomal protein L11; Function class=J Translation, ribosomal structure and biogenesis
  Homolog annotation: Query=1..141bp; Hit=1..141bp; Blast score=224; Percent Identity=91.0; E value=3e-59; Homolog= rplK COG0080
MAKKVQAYVKLQVAAGMANPSPPVGPALGQQGVNIMEFCKAFNAKTESIEKGLPIPVVITVYADRSFTFVTKTPPAAVLLKKAAGVKSGSGKPNKEKVGKVTSAQIREIAETKAADMTGADVDAMMRSIEGTARSMGLVVEG

SEQ ID NO: 8056 - protein, 181 aa, Xenorhabdus bovienii
  Coding DNA sequence: Name=SeqID_1948
  Gene classification: Gene name=NusG; Function=Transcription antiterminator; Function class=K Transcription
  Homolog annotation: Query=1..181bp; Hit=1..181bp; Blast score=327; Percent Identity=94.0; E value=4e-90; Homolog= nusG COG0250
MSESPKKRWYVIQAFSGFEGRVAQSLREHIKLDGMEDSFGEVMVPTEEVVEIRSGQRRKSERKFFPGYVLVQMVMNDATWHLVRSVPRVMGFIGGTSDRPAPISDKEVDAIMDRLQQVGDKPRPKTLFEPGEMVRVSDGPFADFNGVVEEVDYEKSRLKVSVSIFGRATPVELDFSQVEKA

SEQ ID NO: 8057 - protein, 127 aa, Xenorhabdus bovienii
  Coding DNA sequence: Name=SeqID_1949
  Gene classification: Gene name=SecE; Function=Preprotein translocase subunit SecE; Function class=N Cell motility and secretion
  Homolog annotation: Query=1..127bp; Hit=1..127bp; Blast score=140; Percent Identity=76.0; E value=2e-34; Homolog= secE COG0690
MSANSNAQESRRGLDIAKWLLVAVLLVVAIVGNYYYREYNLALRAIAVVAIVALAGAVAFWTAKGKATLAFAREARVEMRKVIWPTRQEALHTTLIVAAVTAVMSLILWGLDGILVRLVSFITGLRF

SEQ ID NO: 8058 - protein, 45 aa, Xenorhabdus bovienii
  Coding DNA sequence: Name=SeqID_1950
MGFVIMQIRKVLLNYGAKSDTITIIFGFGLICFALARQAGYLFTS

SEQ ID NO: 8059 - protein, 394 aa, Xenorhabdus bovienii
  Coding DNA sequence: Name=SeqID_1951
  Gene classification: Gene name=TufB; Function=GTPases - translation elongation factors; Function class=J Translation, ribosomal structure and biogenesis
  Homolog annotation: Query=1..394bp; Hit=1..394bp; Blast score=696; Percent Identity=92.0; E value=0; Homolog= tufB COG0050
VSKEKFERKKPHVNVGTIGHVDHGKTTLTAAITTVLAKTYGGSARAFDQIDNAPEEKARGITISTSHVEYDTPTRHYAHVDCPGHADYVKNMITGAAQMDGAVLVVAATDGPMPQTREHILLGRQVGVPYIIVFLNKCDMVDDEELLELVEMEVRELLSQYDFPGDDTPIIRGSALKALEGEAEWEAKIIELAEALDSYIPEPERDIDKPFLLPIEDVFSISGRGTVVTGRVERGIVKVGDEVAIVGITDTVKTTCTGVEMFRKLLDEGRAGENVGVLLRGTKRDEIQRGQVLAKPGSIQPHTQFESEVYILSKDEGGRHTPFFKGYRPQFYFRTTDVTGTIELPEGVEMVMPGDNINMIVTLIAPIAMDEGLRFAIREGGRTVGAGVVAKVIA

SEQ ID NO: 8060 - protein, 702 aa, Xenorhabdus bovienii
  Coding DNA sequence: Name=SeqID_1952
  Gene classification: Gene name=FusA; Function=Translation elongation and release factors (GTPases); Function class=J Translation, ribosomal structure and biogenesis
  Homolog annotation: Query=1..699bp; Hit=1..702bp; Blast score=1186; Percent Identity=84.0; E value=0; Homolog= fusA COG0480
MARKTPIARYRNIGISAHIDAGKTTTTERILFYTGVNHKIGETHEGSATMDWMEQEQERGITITSAATTAFWSGMAKQYEPHRVNIIDTPGHVDFTIEVERSMRVLDGAVMVYCAVGGVQPQSETVWRQANKYNVPRIAFVNKMDRMGANFLRVVEQIKSRLAANPVPLQLAIGAEDTFTGVVDLLKMKAINWSEADQGVTFEYEEIPADMVELAQEWHQNLIESAAEASEELMDKYLGGEELTEEEIKTALRKRVLASEIILVTCGSAFKNKGVQAMLDAVIDYLPAPTDVESIKGMLPDGKDTPAERHSSDEEPFSALAFKIATDPFVGNLTFFRVYSGVVNSGDTVLNPVKDRKERFGRIVQMHANKREEIKEVRAGDIAAAIGLKDVTTGDTLCDLNLPIILERMEFPEPVISVAIEPKTKADQEKMGIALGRLAQEDPSFRVSSNEETGQTIIAGMGELHLDVLVDRMRREFNVEANVGKPQVAYRETIRNTVEQEGKHAKQSGGRGQYGHVWLRVEPLEPGGDGYVFENAIVGGVVPKEYIPGVDKGVREQLKGGVLAGYPIVDVKVTLFDGSYHDVDSSEIAFKIAASMAFKEGFMKAKPVLLEPIMKVEVETPEDYMGDVIGDLNRRRGMIEGMDDLATGKIVRAQVPLSEMFGYATDLRSQTQGRASYSMEFLKYNEAPSNVAQAIIETRKAR

SEQ ID NO: 8061 - protein, 49 aa, Xenorhabdus bovienii
  Coding DNA sequence: Name=SeqID_1953
VKTFTVWQKLTRRSHTTVGNSFVVNMFWVASRGYSFSKLNAHERGKHGS

SEQ ID NO: 8062 - protein, 156 aa, Xenorhabdus bovienii
  Coding DNA sequence: Name=SeqID_1954
  Gene classification: Gene name=RpsG; Function=Ribosomal protein S7; Function class=J Translation, ribosomal structure and biogenesis
  Homolog annotation: Query=1..156bp; Hit=1..156bp; Blast score=265; Percent Identity=95.0; E value=2e-71; Homolog= rpsG COG0049
MPRRRVIGQRKILPDPKFGSELLAKFVNILMVDGKKSTAEAIVYSALETLAQRSSKGHLEAFELALDNVRPTVEVKSRRVGGSTYQVPVEVRPVRRNALAMRWIVDAARKRGDKSMALRLANELSDAAENKGTAVKKREDVHRMAEANKAFAHYRW

SEQ ID NO: 8063 - protein, 182 aa, Xenorhabdus bovienii
  Coding DNA sequence: Name=SeqID_1955
  Gene classification: Gene name=RpsL; Function=Ribosomal protein S12; Function class=J Translation, ribosomal structure and biogenesis
  Homolog annotation: Query=59..182bp; Hit=1..124bp; Blast score=221; Percent Identity=93.0; E value=3e-58; Homolog= HI0581 COG0048
LSVNTLSLQVFYQHRKAVYFLTPRQVSNKIPRPHVLSLWLTEDKIRVYEAKKPGVFLIMATINQLVRKSRSSKVVKSNVPALEACPQKRGVCTRVYTTTPKKPNSALRKVCRVRLTNGFEVSSYIGGEGHNLQEHSVILIRGGRVKDLPGVRYHTVRGALDCSGVKDRKQGRSKYGVKKPKA

SEQ ID NO: 8064 - protein, 95 aa, Xenorhabdus bovienii
  Coding DNA sequence: Name=SeqID_1956
  Gene classification: Gene name=DsrH; Function=Uncharacterized ACR involved in oxidation of intracellular sulfur; Function class=P Inorganic ion transport and metabolism
  Homolog annotation: Query=1..95bp; Hit=1..95bp; Blast score=96; Percent Identity=51.0; E value=3e-21; Homolog= yheL COG2168
MLYTVSRSPYHDDFNAMLGLVSDADDVLLMQNGVLLGINDNRYLAELIRTGARVYALQEDLIARGLVEQISDRVQVIDYKGFVSLTAKHPQNFGW

SEQ ID NO: 8065 - protein, 119 aa, Xenorhabdus bovienii
  Coding DNA sequence: Name=SeqID_1957
  Gene classification: Gene name=DsrF; Function=Uncharacterized protein involved in the oxidation of intracellular sulfur; Function class=P Inorganic ion transport and metabolism
  Homolog annotation: Query=1..119bp; Hit=1..119bp; Blast score=148; Percent Identity=62.0; E value=9e-37; Homolog= yheM COG2923
MKKIAFVFTEAPHGSSAGREGLDALLATSALTEQIGVFFISDGVFQLLANQQPETILARDYISTFKLLPLYDIDKCYICLDDLNARGGSPASDLVLEAEFLPAAAIREVLSGYDVVLKF

SEQ ID NO: 8066 - protein, 131 aa, Xenorhabdus bovienii
  Coding DNA sequence: Name=SeqID_1958
  Gene classification: Gene name=DsrE; Function=Uncharacterized ACR involved in intracellular sulfur reduction; Function class=P Inorganic ion transport and metabolism
  Homolog annotation: Query=4..131bp; Hit=1..128bp; Blast score=162; Percent Identity=68.0; E value=6e-41; Homolog= ZyheN COG1553
MSSLSYCLLVTGPAYGTQQASSAYQFAQALVASGHKLHSVFFYREGVQNGSRLVAPASDEFDLVRAWQAIAAQHQFNLFICVAAALRRGVTDEQQANELNLSAVNLADGFELSGLGSLAEAMMLCDRVVQF

SEQ ID NO: 8067 - protein, 244 aa, Xenorhabdus bovienii
  Coding DNA sequence: Name=SeqID_1959
  Gene classification: Function=Uncharacterized BCR; Function class=S Function unknown
  Homolog annotation: Query=1..244bp; Hit=1..244bp; Blast score=387; Percent Identity=78.0; E value=1e-108; Homolog= ZyheO COG2964
MVYCMSTPLLSGDNSDIDLLENQPFSETDHEILKSYEAAVDGLAMLIGGHCEIVLHSLEDLKCSAVRIANGEHTGRKIGSPITDLALRMLHDITDEDCSVSRAYFTRAKSGALMKSVTIAIRNRSRRVIGLLCINMNLDVPFSEIIQTFIPEKTHEVSSNVNFASSVDDLVAQTLEFTIEEVNADRNVSNNAKNRQVVLNLYEKGIFDIKDAINQVADRLNISKHTVYLYIRQFKNGEYASSEK

SEQ ID NO: 8068 - protein, 42 aa, Xenorhabdus bovienii
  Coding DNA sequence: Name=SeqID_1960
MQYTILQAQTLPHRKYQGEIYYKITLMQLNRKHFKCSVFYSE

SEQ ID NO: 8069 - protein, 252 aa, Xenorhabdus bovienii
  Coding DNA sequence: Name=SeqID_1961
  Gene classification: Gene name=FkpA; Function=FKBP-type peptidyl -prolyl cis-trans isomerases 1; Function class=O Posttranslational modification, protein turnover, chaperones
  Homolog annotation: Query=1..251bp; Hit=1..254bp; Blast score=268; Percent Identity=61.0; E value=5e-72; Homolog= fkpA COG0545
MKSLLKTTLLAASLAMAFSVPQALSANTENEVKLNSAFKTENQQNAYALGSSLGRYMGASLKEQESLGIKLDQSQLLAGVEDALKDKSKLNDQEIQQILGAFEVKVKNAAQAKAEKEADENAEKGAKYSEQFAKESGVVKTKTGLLYKIEKEGSGKTPTEKDTVVVNYKGSLIDGKVFDSSYERKEPLTIGLDRIIPGWKEGLQHVKKGGKITLVIPPDLAYGKASLPSIPANSTLVFDIELLDIKPAAKAK

SEQ ID NO: 8070 - protein, 57 aa, Xenorhabdus bovienii
  Coding DNA sequence: Name=SeqID_1962
MPLPVTLPIKSFLTMISSYSPISFFGIHRPQKLRERTHYNCLRKPNTILVIHWLQNH

SEQ ID NO: 8071 - protein, 72 aa, Xenorhabdus bovienii
  Coding DNA sequence: Name=SeqID_1963
VELSEFEQRFEQLETKLAYQEVTIEELNKEVRKQQIETEKLKEQLQLMSERLKTHQSSIIAPLSEETPPPHY

SEQ ID NO: 8072 - protein, 176 aa, Xenorhabdus bovienii
  Coding DNA sequence: Name=SeqID_1964
  Gene classification: Gene name=SlpA; Function=FKBP-type peptidyl -prolyl cis-trans isomerases 2; Function class=O Posttranslational modification, protein turnover, chaperones
  Homolog annotation: Query=1..148bp; Hit=1..148bp; Blast score=239; Percent Identity=87.0; E value=9e-64; Homolog= slyD COG1047
MKVAQDLVVSLAYQVRTEEGVLVDESPVSAPLDYLHGRGSLISGLEKAVEGREAGERFDVSVEANDAYGQYDENLVQRVPKDVFVGVDELQVGMRFLADTDMGPVPVEITALEGDEVVVDGNHMLAGQNLKFNVEIVAIREATEEELAHGHVHGQGGCGDHDHDHEEHACCGGGCH

SEQ ID NO: 8073 - protein, 67 aa, Xenorhabdus bovienii
  Coding DNA sequence: Name=SeqID_1965
  Gene classification: Function=Predicted nucleic-acid-binding protein containing a Zn-ribbon domain; Function class=R General function prediction only
  Homolog annotation: Query=5..66bp; Hit=4..65bp; Blast score=84; Percent Identity=66.0; E value=2e-17; Homolog= Z4708 COG3529
MSVSRKRFIAGAVCPKCQSQDTLAMWQENKVDIVECVHCGHVQRQTDETVAPHVREQEQVIGIFKPQ

SEQ ID NO: 8074 - protein, 615 aa, Xenorhabdus bovienii
  Coding DNA sequence: Name=SeqID_1966
  Gene classification: Gene name=KefB; Function=Kef-type K+ transport systems, membrane components; Function class=P Inorganic ion transport and metabolism
  Homolog annotation: Query=14..412bp; Hit=1..399bp; Blast score=473; Percent Identity=70.0; E value=1e-133; Homolog= kefB_1 COG0475
MAEIAFVFGRDVIMENSALLSAGTLFLFAAVVAVPLAQKFKIGAVLGYLIAGIVLGPWGLGFIKDVEEILHFSELGVVFLMFIIGLELNPAKLWQLRRSIFGAGTAQVVLTALVLILFLCLTNFSWQAAVIGGIGLAMSSTAMALQLMKEKGMTSSESGQLGFSILLFQDMALIPALALIPLLAGSTASSDWYRVGLKFVAFAGMLLGGRYLLRPLFRLVVKSDVREVFTAAALLVVLGAAIFMEELGFSMALGTFIAGVLLADSEYRHELEISIEPFKGLLLGLFFISVGMSLNMGVLLTHLSGVLFSVLGLVLIKIFILYVIGRLAGLKNSSCLQFSGVLSQGGEFAFVLFSTALGQSVLDQNQMSLLLVVVTLSMMTTPLVMQLIQRILAGYYNAQEEKNSEQPFVEDNEPQVILVGFGRFGQVVGRLLMANKIRITVLERDASAISTLRRYGYKVYYGDARERELLRAAGAAKAEAIVIASDEPEETMAIVHLCQKNFPHLHIIARARGRLEAHELLQNDVKDFSRETFSSALELGRKALIKTGMHPHQAYRAQQHFRRLDMRMLRELMPQLHGDVAQISRVKEARRELEELFEREMLNERRRPEGWDEYK

SEQ ID NO: 8075 - protein, 182 aa, Xenorhabdus bovienii
  Coding DNA sequence: Name=SeqID_1967
  Gene classification: Gene name=MdaB; Function=Putative NADPH-quinone reductase (modulator of drug activity B); Function class=R General function prediction only
  Homolog annotation: Query=1..181bp; Hit=2..183bp; Blast score=248; Percent Identity=69.0; E value=3e-66; Homolog= yheR COG2249
MLLPPKILLLYIHPEPQISVANHVLLQPVQALEHVTLHDLYGCYPDFFIDVPLEQKLLREHQIIVFQHPLYTYSCPALLKEWMDRVLSRDFVGGSELALRGKYWRSVITTGEPEGAYRRGGYNLYPMEEILRPFELTASMCHMHWLSPMIIYWARRQRPEVLVSHANAYREWLKSPLSLGGM

SEQ ID NO: 8076 - protein, 650 aa, Xenorhabdus bovienii
  Coding DNA sequence: Name=SeqID_1968
  Gene classification: Gene name=Uup; Function=ATPase components of ABC transporters with duplicated ATPase domains; Function class=R General function prediction only
  Homolog annotation: Query=1..642bp; Hit=1..630bp; Blast score=970; Percent Identity=78.0; E value=0; Homolog= yheS COG0488
MIVFSSLQIRRGIRVLLDNASATINPGQKVGLVGKNGCGKSTLLSLLKGELQAENGSVTFPNNWALAWVNQETPALEISALEYVIDGDREFRQLEQKLKIANEQNDGHAIAHLHGQLDTIQAWTIRARASSLLHGLGFSQPQLEQSVSSFSGGWRMRLNLAQALICRSDLLLLDEPTNHLDLDAVIWLEKWLKNYTGTLILISHDRDFLDPIIDKVLHIEQLILAEYTGNYSSFERQRAAKLAQQQALYQSQQEKVTHLQSYIDRFRAKASKAKQAQSRIKMLERMELIAPAHVDNPFRFSFRQPDSLPSPLLVMEKVSAGYGEKTVLDSIKLNLVPGSHIGLLGRNGAGKSTLIKLLAGGLAPQRGEIALAKGIKLGYFAQHQLEYLRADESPLQHLVRIAPQETEQQLRDYLGGFGFKGNQVTDPSGRFSGGEKARLVLALIVWQRPNLLLLDEPTNHLDLDMRQALTEALIDFDGALVVVSHDRHLLRSTTDELYLVHDGKVEPFTGDLEDYQQWLTEQQRQQTRENQEKEKAASSPDASMNGAQNYSAQERKDQKRREAEFRNQTQPLRKQLTALEKQMEKLGTALAGWEEKLSDNTIYENDRKTELTECLQQQTQTKSKLEDAEMEWLDIQEQLEQMSKAFNADQ

SEQ ID NO: 8077 - protein, 296 aa, Xenorhabdus bovienii
  Coding DNA sequence: Name=SeqID_1969
  Gene classification: Gene name=LysR; Function=Transcriptional regulator; Function class=K Transcription
  Homolog annotation: Query=1..82bp; Hit=1..82bp; Blast score=73; Percent Identity=43.0; E value=4e-13; Homolog= XF1722 COG0583
MDIRNLEAFIVLAETLNYHKASERLYLSQPALTKKIHGLEGILGASLFLRGPNGTRLTDFGHKTLENARKFLSHYEQFKSRVHFDSKEDIIRHLYVGSCFPIHNYSQIEKQIADKKGNVVLALMTGLSVEQQISLLNAGMLHVAVMPLAAITQLEPKKIFTEKLVYLFKRRSHLIPKFRAEKSRLGNGNVPVHSSEKKDIVELTDCLNVFPIYTGDSKHLLLKTNDIMLIMEMITKNSAYTCVPQRIISSIPEYYMNLLEIVETDKKIELGVIWGKSIDDHLIDDVENFSALVANL

SEQ ID NO: 8078 - protein, 40 aa, Xenorhabdus bovienii
  Coding DNA sequence: Name=SeqID_1970
MIIKSLSQNDKSLKIAYIHVLSLNDCLITTKHYRLMVIAF

SEQ ID NO: 8079 - protein, 50 aa, Xenorhabdus bovienii
  Coding DNA sequence: Name=SeqID_1971
METKNQNTQLTVQHQENFNLYLSIHHTHNHITGYFICRTIWTITRKKIMN

SEQ ID NO: 8080 - protein, 90 aa, Xenorhabdus bovienii
  Coding DNA sequence: Name=SeqID_1972
MKVLMTLSCIHGRPLFAKQSFVMTRTRLRLQSYIRTLVEAVAFSLTRLLSFRRAMSACTTPEFSDHGLTSLAITSRLPVQPLEITFIWAP

SEQ ID NO: 8081 - protein, 69 aa, Xenorhabdus bovienii
  Coding DNA sequence: Name=SeqID_1973
MYQQRPDNPGILIRQRHHSNIGITSRQQTIQPVFCSASFLFGRFSLLRTVPPPYLHKSIVSVNNCHPVC

SEQ ID NO: 8082 - protein, 75 aa, Xenorhabdus bovienii
  Coding DNA sequence: Name=SeqID_1974
LSPRLLIPCKVNLLPLECCRGTRPRHAASWQPLEKCLASPTDASVEFSVPVLSPDDQAVMLPIVRLSLQDSIHAQ

SEQ ID NO: 8083 - protein, 84 aa, Xenorhabdus bovienii; identical to SEQ ID NO: 6530
  Coding DNA sequence: Name=SeqID_1975
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 8084 - protein, 83 aa, Xenorhabdus bovienii; identical to SEQ ID NO: 6529
  Coding DNA sequence: Name=SeqID_1976

SEQ ID NO: 8085 - protein, 91 aa, Xenorhabdus bovienii; identical to SEQ ID NO: 6528
  Coding DNA sequence: Name=SeqID_1977
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 8086 - protein, 37 aa, Xenorhabdus bovienii
  Coding DNA sequence: Name=SeqID_1978
MTRSSSFRCSPNCWNSCLKISGRLLLTLSRISGSRTP

SEQ ID NO: 8087 - protein, 51 aa, Xenorhabdus bovienii
  Coding DNA sequence: Name=SeqID_1979
MKMTTVGIDLAKMSFRSTALMHKVKRCSKNSYRARGIGQTVLRRPMPLGVY

SEQ ID NO: 8088 - protein, 90 aa, Xenorhabdus bovienii
  Coding DNA sequence: Name=SeqID_1980
  Gene classification: Gene name=InsB; Function=Insertion element IS1 protein InsB, putative transposase; Function class=L DNA replication, recombination and repair
  Homolog annotation: Query=17..68bp; Hit=101..152bp; Blast score=71; Percent Identity=73.0; E value=1e-13; Homolog= insB_g4 COG1662
MRFDGVIVSFQHCGLYDRWLERVKTLAGKLHVVSKRYTQRIERHNLNLRHHLVRLTRKTLSFSKSVEIMGWMPHSSGISVPKWKCIKTAI

SEQ ID NO: 8089 - protein, 43 aa, Xenorhabdus bovienii
  Coding DNA sequence: Name=SeqID_1981
MLKGDNNAIKPHQCLLCSWAKNVGDDFSPNPVVGIKEPTRFVL

SEQ ID NO: 8090 - protein, 37 aa, Xenorhabdus bovienii
  Coding DNA sequence: Name=SeqID_1982
  Gene classification: Gene name=InsB; Function=Insertion element IS1 protein InsB, putative transposase; Function class=L DNA replication, recombination and repair
  Homolog annotation: Query=3..37bp; Hit=33..67bp; Blast score=58; Percent Identity=68.0; E value=1e-09; Homolog= Z1192 COG1662
MAPGIEVIICCEMDAQWSYVKSKNKPRWLFYAYDRIR

SEQ ID NO: 8091 - protein, 83 aa, Xenorhabdus bovienii
  Coding DNA sequence: Name=SeqID_1983
  Gene classification: Function=Transposase; Function class=L DNA replication, recombination and repair
  Homolog annotation: Query=1..77bp; Hit=1..77bp; Blast score=102; Percent Identity=64.0; E value=7e-23; Homolog= insA_g3 COG3677
MAKIDVTCPSCCAVKGIHRNGRSRSGHQRYLCQSCRHFWQLEFTYTACCPSTHEQIVDMAMNGVGCRATARVMGLVLILSFVT

SEQ ID NO: 8092 - protein, 314 aa, Xenorhabdus bovienii
  Coding DNA sequence: Name=SeqID_1984
  Gene classification: Function=Predicted sugar phosphate isomerase; Function class=R General function prediction only
  Homolog annotation: Query=14..313bp; Hit=5..304bp; Blast score=402; Percent Identity=71.0; E value=1e-112; Homolog= VC0206 COG2103
MAYSLSHHIQQEQMMKIDLSNMVTESRNPASTHIDELSTLDMLRVINDEDKKVALAVEKTLPQITRVVDKVAEAFRHGGRLIYSGAGTSGRLGILDASECPPTYGTKPEWVVGLIAGGHQAILKAVENAEDNQQSGAEDLKGLHFNEKDVLVGIAASGRTPYVLGAMEYARSVGATIACISCNPNSPMTQLADIAITPVVGPEIVTGSSRMKAGTAQKLVLNMITTGAMIRTGKVYGNLMVDIEATNAKLIERQKNIVMAATECSRETAEQALNACDGHCKTAIVMILSGTCAEDAKRLLAEHQGFIRPAISKS

SEQ ID NO: 8093 - protein, 482 aa, Xenorhabdus bovienii
  Coding DNA sequence: Name=SeqID_1985
  Gene classification: Gene name=PtsG; Function=Phosphotransferase system IIC components, glucose/maltose/N-acetylglucosamine-specific; Function class=G Carbohydrate transport and metabolism
  Homolog annotation: Query=108..482bp; Hit=1..375bp; Blast score=478; Percent Identity=70.0; E value=1e-135; Homolog= PM1575_2 COG1263
MAKISQEMLVEILRAMGGVNNIVHCGNCMTRLRLTLHDDSLVDKTALTKISGVLGVIENDEQLQIVLGPGKAQTAADMMNGLLSTADHSTAEPQPAGLKEIASSNKKQLKEKQTRSVHKFLAKFATIFTPLIPGFIAVGLLLGFATLLEQIFIQGAGHPNAALGEMVGYMKVFSKGMFSFLSILIGYNAQKAFGGSGVNGAIIASLFVLGYNASATSGFYSGISDFFGFAIDPRGNIIGVLIACILGAWVEKQIRKIIPSDLDMILTSTLTLLIMGAVAFIVIMPVGSYLFTAMSWLFMHLNGNPFGAAILAGLFLIAVMFGVHQGFVPVYFTLMDVQNFNSLFPILAMAGAGQVGSALALYMKAQKGSLLRTQIKGAIIPGFLGIGEPLIYGVTLPRVKPFVTACLGGAIGGFFIGLVAWLGVPVGLNSVFGPSGLVALPLMTSDSGIFTGMAVYGAGLIIAYISGFILTFFFGSKNIDLS

SEQ ID NO: 8094 - protein, 201 aa, Xenorhabdus bovienii
  Coding DNA sequence: Name=SeqID_1986
  Gene classification: Gene name=RhtB; Function=Putative threonine efflux protein; Function class=E Amino acid transport and metabolism
  Homolog annotation: Query=1..193bp; Hit=3..193bp; Blast score=107; Percent Identity=36.0; E value=8e-24; Homolog= PA2306 COG1280
MTASLIFSLSAFLLISAITPGPNNMLLTSSGANFGFRRSLPLWVGILLGIQTILLLSAFGVGAVLLLYPAMHTVLKVLGSLYLLRLAWKTSTAHYKRLETANLAAVPIKGYQGWLLQFLNPKAWMMGLGAVGSYSLQGDLYNHSVVVISVVMLVSNMIAGTVWIVLGSLIGSLLKSRNAWFIFNITMGILTAACVPLIWMG

SEQ ID NO: 8095 - protein, 72 aa, Xenorhabdus bovienii
  Coding DNA sequence: Name=SeqID_1987
  Gene classification: Function=Uncharacterized BCR; Function class=S Function unknown
  Homolog annotation: Query=1..71bp; Hit=1..71bp; Blast score=102; Percent Identity=78.0; E value=1e-22; Homolog= yheU COG3089
MMIPWQQLAPETLLDLIESFVLREGTDYGEDEKTLEQKVQDVKRQLERGEVLLVWSELHETVNIMPKEMFRP

SEQ ID NO: 8096 - protein, 305 aa, Xenorhabdus bovienii
  Coding DNA sequence: Name=SeqID_1988
  Homolog annotation: Query=17..304bp; Hit=1..288bp; Blast score=521; Percent Identity=86.0; E value=1e-147; Homolog= ref|NP_927750.1|
MTRKIVPTFIDKESVLMSAKHPVIAITGSSGAGTTTTSVAFRKIFQQLEVTAALIEGDSFHRYTRPEMDAEIRKAKEQGRHVSYFGPEANDFSMLEKTFCNYGETGTGRCRRYLHTYDEAVPYNQVPGTFTPWESLPSNTDILFYEGLHGGVVTPQYNVASYVDLLIGVVPIVNLEWIQKLIRDTSERGHSREAVMDSVVRSMDDYIRYITPQFSRTHINFQRVPTVDTSNPFSAKAIPSLDESFIVIRFRGLKQIDFPYLLSMLQGSFISSINTIVVPGGKVGLAMELIMAPWVQQLLEGKKIS

SEQ ID NO: 8097 - protein, 62 aa, Xenorhabdus bovienii
  Coding DNA sequence: Name=SeqID_1989
MAYGKPNNANISKEKRKRNIKAGTAKWLLYRVRIGEYFGKYCTAFTSFTLLNFLFIICFYCY

SEQ ID NO: 8098 - protein, 210 aa, Xenorhabdus bovienii
  Coding DNA sequence: Name=SeqID_1990
  Gene classification: Gene name=Crp; Function=cAMP-binding domains - Catabolite gene activator and regulatory subunit of cAMP-dependent protein kinases; Function class=T Signal transduction mechanisms
  Homolog annotation: Query=1..210bp; Hit=1..210bp; Blast score=404; Percent Identity=95.0; E value=1e-113; Homolog= crp COG0664
MVLGKPQTDPTLEWFLSHCHIHKYPSKSTLIHQGEKAETLYYIVKGSVAVLIKDEEGKEMILSYLNQGDFIGELGLFEEGKLRTAWVRAKSACEVAEISYKKFRQLIQVNPDILMRLSSQMAKRLQTTSEKVGNLAFLDVTGRIAKTLMNLAKQPDAMTHPDGMQIKITRQEIGQIVGCSRETVGRILKMLEDQNLISAHGKTIVVYGTR

SEQ ID NO: 8099 - protein, 73 aa, Xenorhabdus bovienii
  Coding DNA sequence: Name=SeqID_1991
VFPRNSWPHSEDVRRSKPDLCSWQNHCSIWNPLVPEIALETEPAQPLSCTGFFVASFVLSVQWQHQAPFRRFL

SEQ ID NO: 8100 - protein, 191 aa, Xenorhabdus bovienii
  Coding DNA sequence: Name=SeqID_1992
  Gene classification: Gene name=PabA; Function=Anthranilate/para -aminobenzoate synthases component II; Function class=E Amino acid transport and metabolism
  Homolog annotation: Query=1..189bp; Hit=1..190bp; Blast score=286; Percent Identity=72.0; E value=7e-78; Homolog= VC2619 COG0512
MLLIIDNYDSFTFNLYQYFCELGTNVLVKRNDELQLEDIEKLAPTHLVISPGPCTPNEAGISLEAISHFAGKLPILGVCLGHQAIGQAFGASVVKAREVMHGKNSLIHHNQQGVFKGLNRPLTVTRYHSLVIAAETLPASFEVTAWSQHNGNVDEIMGIRHRTLPLEGVQFHPESILSEQGHDLLNNFLRY

SEQ ID NO: 8101 - protein, 38 aa, Xenorhabdus bovienii
  Coding DNA sequence: Name=SeqID_1993
LPYPSGHCAFCISIKSGKAASTAAGRSSYHRRIFKIVG

SEQ ID NO: 8102 - protein, 188 aa, Xenorhabdus bovienii
  Coding DNA sequence: Name=SeqID_1994
  Gene classification: Gene name=PpiB; Function=Peptidyl-prolyl cis -trans isomerase (rotamase) - cyclophilin family; Function class=O Posttranslational modification, protein turnover, chaperones
  Homolog annotation: Query=1..188bp; Hit=1..190bp; Blast score=267; Percent Identity=72.0; E value=5e-72; Homolog= ppiA COG0652
MFKRIFVSLMAACAISVIAAPALAAETHVKLVTSAGEIELALDSNKAPITTKNFIEYVNEGFYNNTIFHRIIPGFMAQGGGFTKDMKQKVTKAPIKNEADNGLRNLRGTIAMARTADKDSATSQFFINVTDNAFLDHGQRDFGYAVFGKVVKGMDVVDKMSQVKTENVGPYQNVPVKPIVILSAKVAP

SEQ ID NO: 8103 - protein, 198 aa, Xenorhabdus bovienii
  Coding DNA sequence: Name=SeqID_1995
  Gene classification: Function=Predicted GTPases; Function class=R General function prediction only
  Homolog annotation: Query=7..198bp; Hit=3..196bp; Blast score=286; Percent Identity=76.0; E value=7e-78; Homolog= ZyihA COG0218
MTHFVTSAPDIRHLPQDVGIEVAFAGRSNAGKSSALNALTKQKSLARTSKTPGRTQLINLFEVEEGIRLVDLPGYGYAEVPEEMKRKWQNALGEYLQKRECLLGLVVLMDIRHPLKDLDMQMIEWAVVMQVPVMVLLTKADKLASGARKSQLAKVRQELASLGGEIQIENFSVLKKIGIDQLEQKLDYWFNQPAIEVE

SEQ ID NO: 8104 - protein, 55 aa, Xenorhabdus bovienii
  Coding DNA sequence: Name=SeqID_1996
LSQALSRHYEDNFRPLNKQSFHQYTSIKNYPHKILHHNKKATFFVALLFTLQIFD

SEQ ID NO: 8105 - protein, 948 aa, Xenorhabdus bovienii
  Coding DNA sequence: Name=SeqID_1997
  Gene classification: Gene name=PolA; Function=DNA polymerase I - 3' -5' exonuclease and polymerase domains; Function class=L DNA replication, recombination and repair
  Homolog annotation: Query=305..948bp; Hit=1..640bp; Blast score=871; Percent Identity=70.0; E value=0; Homolog= ZpolA_2 COG0749
MAFYALIIPQNDEENFMAQIADNPLILVDGSSYLYRAYHAFPPLTNSAGEPTGAMYGVLNMLRSLIIQYKPSHVAVVFDAKGKTFRDELFAEYKSHRPPMPDDLRGQIEPLHKMVEAMGLPILVVPGVEADDVIGTLALQAEKEGRSVLISTGDKDMAQLVTPHITLINTMTNTILGPEGVSEKYGVPPELMIDFLALMGDSSDNIPGVPGVGEKTALGLLQGIGSLDDIYARLDEIATLSFRGAKTLSGKMEQHKEVAYLSYQLATIKTDVELDKTCLELAVTAPDSDELLALFSRYEFKRWLSDVQNGSWLEGNSQKPAAAGATANSAPAGSAPVAVNISSENYQTILDRKSLDEWIVKLKQAPAFSFDTETDGLDTLTVNLVGMSFAIAVGESEVEAAYLPLGHDYLDAPEQLDLHEVLAALKPLLEDANLPKIGQNLKFDRGVLARYDVALNGIVFDTMLESYVLNSVSGRHDMDSLADRHLGYKTTTFEEIAGKGKKQLTFNQIPLEEAAKYAAEDADVTLRLHQAMYPQVDSVPTLKSIFQNIEMPLVPVLSRIERTGVLIDAQTLAEHSTEITARLGELEKAAYELAGEEFNLASPKQLQVILFEKLNLPVLKKTPNGAPSTNEEVLEELADNHELPRVILEHRGLAKLKSTYTDKLPQMVNPLTKRVHTSYHQAVTATGRLSSRDPNLQNIPVRNDEGRRIRQAFIAPEGYHIMAADYSQIELRIMAHLSQDKGLLEAFAQGKDIHSATAAEVFGVPLEKVTSEQRRSAKAINFGLIYGMSAFGLSRQLSIPRGEAQRYMDLYFERYPGVLAYMERTRQQAAEYGFVETLEGRRLYLPDIKSRNAMRRKASEREAINAPMQGTAADIIKLAMIAVDNWIVSEQPNVRMIMQVHDELVFEVHESELATAEQKVSELMEKSMQLDVPLKVDVGIGINWDQAH

SEQ ID NO: 8106 - protein, 84 aa, Xenorhabdus bovienii
  Coding DNA sequence: Name=SeqID_1998
LIFTSCCSFFRGVNINLFYVPIFCAQSYPQFIHQNICQKKPVSTRKLSQNSSITTQYGILRFNHPTERRRKFYGTDSRQSLDFG

SEQ ID NO: 8107 - protein, 35 aa, Xenorhabdus bovienii
  Coding DNA sequence: Name=SeqID_1999
MFTPLKNEQQEVKINGLRGVLKKYYNDLKITDLWI

SEQ ID NO: 8108 - protein, 207 aa, Xenorhabdus bovienii
  Coding DNA sequence: Name=SeqID_2000
  Gene classification: Gene name=TrxA; Function=Thiol-disulfide isomerase and thioredoxins; Function class=O Posttranslational modification, protein turnover, chaperones
  Homolog annotation: Query=1..207bp; Hit=1..208bp; Blast score=247; Percent Identity=56.0; E value=5e-66; Homolog= dsbA COG0526
MKTFWLALVGVFMAFNASASGFYEDKQYVELKNPVANQPQVLEFFSFYCPHCYQFENIYHVPSTVEKNLPAGVTHERYHVDFIGPLGKDLTEAWAVAIVMKIEDKVTPILFDGIQKTQTINSKADIRNAFIKAGVSGEEYDAALNSFIVKSVAAKERQAASDLQLQGVPAVYVNGKYQIKNGGIEPATVTEYAKGFSDVVNYLVTKK

SEQ ID NO: 8109 - protein, 325 aa, Xenorhabdus bovienii
  Coding DNA sequence: Name=SeqID_2001
  Gene classification: Function=Putative homoserine kinase type II (protein kinase fold); Function class=R General function prediction only
  Homolog annotation: Query=2..325bp; Hit=5..328bp; Blast score=421; Percent Identity=61.0; E value=1e-118; Homolog= yihE COG2334
MAFNFQNITPDLIMDALVQSGLYIDSGLTELNSYENRVYQFMDENRKRYVVKFYRPQRWSQQQIQEEHDLALALQQADLSVAAPLVFAGQTVLNHGGFFFAIFPSVGGRQYESDNFDQLEDVGRLLGQMHQIGRQKIFSTRPTIGLDEYLYQPYRYLSACKLIPAKHKKAFFAALDELNQTVEGSWYSDGQILRLHGDCHAGNILWRDEAWFVDLDDARNGPAIQDLWMLLNGSRQERLIQLDILLESYSQFTDFDPKTLALIEPLRAMRMVYYLAWVARRWQDPAFPKAFPWMADSDFWHGQVSLFSEQIRLLQESPLQLNPMY

SEQ ID NO: 8110 - protein, 37 aa, Xenorhabdus bovienii
  Coding DNA sequence: Name=SeqID_2002
LLICIAIYKELKMKKILRRLCCVREALLKINEERAGL

SEQ ID NO: 8111 - protein, 68 aa, Xenorhabdus bovienii
  Coding DNA sequence: Name=SeqID_2003
MRVDSPPARIAPLIFGCVMLTHLIFGNEIFNYLAYNLCKPICNNAFMEESITFTLIDRPTLSLSHYPC

SEQ ID NO: 8112 - protein, 195 aa, Xenorhabdus bovienii
  Coding DNA sequence: Name=SeqID_2004
  Gene classification: Gene name=MobA; Function=Molybdopterin-guanine dinucleotide biosynthesis protein A; Function class=H Coenzyme metabolism
  Homolog annotation: Query=6..189bp; Hit=7..191bp; Blast score=179; Percent Identity=45.0; E value=1e-45; Homolog= mobA COG0746
MTHPKMSGAILAGGLSTRMGGDDKGLLQFEGIPLYQHIATRLQPQVQELLINANRNQALYQQSGYPIIPDIITDFSGPLAGMLAVLKKAINEWVIFVPCDVPDFPDDLVEKLWRYRQHSWAVYVHDCQRAHPTLALMHRSLIPRLESYLALGERKLVFFMQMIKAKAVYFPYLGSFTNLNTPEEYQHWEYFQESA

SEQ ID NO: 8113 - protein, 177 aa, Xenorhabdus bovienii
  Coding DNA sequence: Name=SeqID_2005
  Gene classification: Gene name=MobB; Function=Molybdopterin-guanine dinucleotide biosynthesis protein; Function class=H Coenzyme metabolism
  Homolog annotation: Query=6..169bp; Hit=2..166bp; Blast score=199; Percent Identity=61.0; E value=2e-51; Homolog= mobB COG1763
MSPTTLPLLGITAYSGTGKTTLLKQIIPLLRQQHIRVGLIKHTHHNMDVDQPGKDSYELRKAGAAQTLVASQQRWALMTETPDLPELDLHYLASRFDADSLDLVLVEGFKEEAIAKIALYRHGLNIVFDQILDPQVIAIASNTPLATSLPQLNINQPQQVTAFIVAWLRAGSAGKHG

SEQ ID NO: 8114 - protein, 246 aa, Xenorhabdus bovienii
  Coding DNA sequence: Name=SeqID_2006
  Gene classification: Gene name=SmtA; Function=SAM-dependent methyltransferases; Function class=Q Secondary metabolites biosynthesis, transport and catabolism
  Homolog annotation: Query=39..156bp; Hit=37..153bp; Blast score=67; Percent Identity=36.0; E value=1e-11; Homolog= TM0938 COG0500
MPKKDVDYNSIGDRYELFMNNRPQREIDVRTILNLVGDVRGKSVLDLACGYGYFGRELRNHGASKAVGVDISETMVGLARAKSKQYGDDLEFHVRNVCNMESFGQFDIVIAAWLLNYSESIEDLEKMFQAVANNLKPSGKFIAYTVSPDYRLAVSNCDIYGINILSEEPWKDGIRYQAEFLTTPPSPFTFYRWSHEDYERAIQKAGFNRFEWQKPELLESDIKRFPEGFWDDLQQNGLNIGLTCRF

SEQ ID NO: 8115 - protein, 37 aa, Xenorhabdus bovienii
  Coding DNA sequence: Name=SeqID_2007
LISESINTSRGKQRNFLENSPQIMLRVVHIMWNCSVY

SEQ ID NO: 8116 - protein, 118 aa, Xenorhabdus bovienii
  Coding DNA sequence: Name=SeqID_2008
MFPVTYKIDFLILLTRPQKPSKNPLHYWRYPFHKMKNWTVSLIVTEPKVLVVSSRGIDRLIERGLNKNNFLGWSMFLGSPVWKITATKMNHYLNIDYPYKYGQYRSKIEMLANFPELK

SEQ ID NO: 8117 - protein, 92 aa, Xenorhabdus bovienii
  Coding DNA sequence: Name=SeqID_2009
MTPTNSTEELLLDIANKDNLSKENKKMLINATAYPDQKTNYAARKPCAVCPPPQAIPEFIENLISSLDINQPQQVTAFIVAWLKGRNAGKHS

SEQ ID NO: 8118 - protein, 246 aa, Xenorhabdus bovienii
  Coding DNA sequence: Name=SeqID_2010
  Gene classification: Gene name=SmtA; Function=SAM-dependent methyltransferases; Function class=Q Secondary metabolites biosynthesis, transport and catabolism
  Homolog annotation: Query=39..168bp; Hit=37..155bp; Blast score=65; Percent Identity=35.0; E value=6e-11; Homolog= TM0938 COG0500
MSKKHAAYNAIGERYEQFIEDTPQREIDVRTILSMVGDVSGKSVLDVACGYGYFGRELRKRGASKVVGVDISEAMIEHAREKSEQHNDDIEFHVQDVCHMESLGKFDIIVAAWLFNYAESIDDLEKMFQVVASHLKLSGKLVAYTVSPAFRFNQGNYDIYGINILSEEPCKGGAYYHVEFLTTPPSLLIFYRWNHEDYERAIQKAGFSRVEWQKPKLLENDFKRYPDGFWDIFQRNNLNIGFTCQF

SEQ ID NO: 8119 - protein, 45 aa, Xenorhabdus bovienii
  Coding DNA sequence: Name=SeqID_2011
MFFRHDYYSPDKRIMIIAPIFYCAVEGASYLYEWHLILLDGANGR

SEQ ID NO: 8120 - protein, 99 aa, Xenorhabdus bovienii
  Coding DNA sequence: Name=SeqID_2012
  Gene classification: Function=Uncharacterized ACR; Function class=S Function unknown
  Homolog annotation: Query=1..96bp; Hit=1..96bp; Blast score=134; Percent Identity=70.0; E value=1e-32; Homolog= yneC COG1359
MQVTLVKINVKADKIDEFIEVFRDNHLGSVKEPGNLRFDVLRDENIPTRFYVYEAYADETAVAAHKKTPHYLRCVERLEALMTEPRKKITFIGLMPEGK

SEQ ID NO: 8121 - protein, 294 aa, Xenorhabdus bovienii
  Coding DNA sequence: Name=SeqID_2013
  Gene classification: Gene name=FbaB; Function=DhnA-type fructose-1,6 -bisphosphate aldolase and related enzymes; Function class=G Carbohydrate transport and metabolism
  Homolog annotation: Query=1..290bp; Hit=1..290bp; Blast score=510; Percent Identity=86.0; E value=1e-145; Homolog= yneB COG1830
MADLDDIKDGKDFGIDTPQKNTLFELKGSGALDWGMQSRLARIFNPATNKTVMLAFDHGYFQGPTTGLERIDINIAPLFEHTDVLMCTRGILRSQVPPATNKPVVLRASGANSILTELSNEAVAVAMEDALRLNVCAVAAQVYIGSEHEHQSIKNIIKLVDQGMRYGMPTMAVTGVGKDMARDQRYFSLATRIAAEIGANIIKTYYVDSGFERIAAGCPVPIVIAGGKKLPEIEALEMCYQAIDQGASGVDMGRNIFQSEAPVAMLKAVQAVVHHNEKPAQAYELFLSEKAKGE

SEQ ID NO: 8122 - protein, 343 aa, Xenorhabdus bovienii
  Coding DNA sequence: Name=SeqID_2014
  Gene classification: Gene name=RbsB; Function=Periplasmic sugar -binding proteins; Function class=G Carbohydrate transport and metabolism
  Homolog annotation: Query=11..343bp; Hit=7..340bp; Blast score=523; Percent Identity=81.0; E value=1e-149; Homolog= yneA COG1879
MEIGMKAPTLKKWVLASALSLVCVSWVQAAEKIAFIPKLVGVGFFTSGGQGAVETGKALGVDVTYDGPTEPSVAGQVQLINNFVNQGYNAIVVSAVSPDGLCPALKRAMQRGVKVLTWDSDTAPECRSIYIDQGTPKQLGGMLVEMAASQVKKDQAKVAFFYSSPTVTDQNQWVKEAKAKIAAEHPNWEIVTTQFGYNDATKSLQTAEGILKAWGDLDAIIAPDANALPAAAQAAENLKRRNVAIVGFSTPNVMRPYVASGTVKQFGLWDVVKQGKIAIHVADEMLKKGDLNVGDQLDIPDIGKLEISPNSVQGYRYEAKGNGIVVMPERVIFTSENINQYDF

SEQ ID NO: 8123 - protein, 338 aa, Xenorhabdus bovienii
  Coding DNA sequence: Name=SeqID_2015
  Gene classification: Gene name=AraH; Function =Ribose/xylose/arabinose/galactoside ABC-type transport systems, permease components; Function class=G Carbohydrate transport and metabolism
  Homolog annotation: Query=6..332bp; Hit=4..330bp; Blast score=408; Percent Identity=77.0; E value=1e-114; Homolog= ydeZ COG1172
MNALQRYGWETALAALLVMEILLFGMVNPRMLDINVLLFSTSDFICIGIVALPLTMVIVSGGIDISFGAVIGLCAIALGIMYQAGLPMIAAIPLTLIVGVLCGLINATLIFYTGVNPLVITLGTMYLFGGSALLLSGLSGATGYEGIGGFPAAFTDFANLTLFGLPVPLVIFIFCVLMFWLFMHRTHRGRYVFLIGQNSRAARYGAIPVNRTLYLLYALTGLASALAAIILVSYFGSARSDLGSSFLMPTITAVVLGGANIYGGSGSIVGTALAILLVGYLQQGLQMAGIPNQISSALSGALLIAAVVGRSVSLHRHQIRDWWQRQRASASPQNTPER

SEQ ID NO: 8124 - protein, 337 aa, Xenorhabdus bovienii
  Coding DNA sequence: Name=SeqID_2016
  Gene classification: Gene name=AraH; Function =Ribose/xylose/arabinose/galactoside ABC-type transport systems, permease components; Function class=G Carbohydrate transport and metabolism
  Homolog annotation: Query=1..329bp; Hit=1..329bp; Blast score=379; Percent Identity=72.0; E value=1e-105; Homolog= ydeY COG1172
MLKFIQNNREVTALIAILGLFLLLGSLDRQAFSVQTMGMIFGNAQILMLLALGATWVMLTRSIDVSVGSTTGLCAVVLGMSLNGGLPLPMACLMTLLVGMVAGLINGVLVVWLKIPAIVATLGTLGLYRGLMLLLTGGKWIEGLPADVKALARPDWFGISPIGWLLILLVLAMTWMLKKSDFGRGFYATGDNQQGARQLGVPVNIICITVFAANGVMAALAGIVFVAQIGFIPNQTGSGLEMKAIAACVLGGISLLGGMGTVVGAIFGAYFLTQIDSVLVLLRLPAWWNDFIAGLVLLAVLVFDGRLRSAVEKNLRQQRYARFLEPIKSPAKKQEKP

SEQ ID NO: 8125 - protein, 515 aa, Xenorhabdus bovienii
  Coding DNA sequence: Name=SeqID_2017
  Gene classification: Gene name=MglA; Function=ABC-type sugar (aldose) transport system, ATPase component; Function class=G Carbohydrate transport and metabolism
  Homolog annotation: Query=13..515bp; Hit=4..511bp; Blast score=605; Percent Identity=64.0; E value=1e-173; Homolog= ego COG1129
MSQNNTTNMPSQNDSGSVPLLAVRGVSKQFSGLAVLKHIDFILTRGQVHALLGGNGAGKSTLMKIIAGIEQPDAGTLMLDGRSVSHLTPTKAHQLGIYLVPQEPLLFPNLSVQENILFRLPKHQVSKSRMQQLLAQLNCSMDLNAPAGSLNVADQQLVEIMRGLMRYSRILILDEPTASLTPAETERLFERVRELQQQQVGIIFISHKLPEIRQIADYVSVMRDGGIALSGATVAFSTEAIIQAITPEAKTGALTGSQKLCLEVSSSAFAINQAEPVLEVSSLGGEGFRDISLNLSAGEIVGLAGVVGAGRTELAETLYGLRPIVQGEIRFRQQVINQRDTVARLRSGLVYLPEDRQASGLFLDAPLSWNIGSLTHSRRTFWTRPAYDAAVLERYRRALNIRFSHINQPVRTLSGGNQQKILIAKCLEAKPAVLIIDEPTRGVDVAARSDIYQLIRSIASQQVAILLISSDLDEIVQLADRTLVMHQGGICGHLDKASMSVDAIMHLAFGEEASC

SEQ ID NO: 8126 - protein, 31 aa, Xenorhabdus bovienii
  Coding DNA sequence: Name=SeqID_2018
MFNVRVRKTKVCNAMRCCNVTEQYHQYAFPK

SEQ ID NO: 8127 - protein, 368 aa, Xenorhabdus bovienii
  Coding DNA sequence: Name=SeqID_2019
  Gene classification: Gene name=DeoR (BS); Function=Transcriptional regulator, contains sigma factor-related N-terminal domain; Function class=K Transcription
  Homolog annotation: Query=65..367bp; Hit=13..315bp; Blast score=404; Percent Identity=67.0; E value=1e-113; Homolog= ydeW COG2390
MFKFLRSPSSTSEAFMLNSLPVDKQVVMPIKPTKKQSVSERSVLSEELSYSDNNHSGHGYSGNRMSEEELLARIAWFYYHDGLTQGDIGELLGLSRLKVSRLLEKGRQSGVIRVQINSRYEGCLELEDTLQKRFNLKQVRVLPALDGINLNTRLGVGAAHLLMALIEPSQLLAIGFGETPMCTLQHLSGFISSQQIRLVTLSGGVGPYMTGIGQLDADCPVSIIPAPLRASTHQVAATFREERSVRDVILAACAADIAVVGIGAINQRQQATIMRSGYISDGEQLMFGRKGAIGDILGYFFNAEGELVGNIDIHQELISISLPELKTIPNVIGVAGGIEKADAIVAALKGGYISSLVTEEQTARAMLT

SEQ ID NO: 8128 - protein, 530 aa, Xenorhabdus bovienii
  Coding DNA sequence: Name=SeqID_2020
  Gene classification: Gene name=XylB; Function=Sugar (pentulose and hexulose) kinases; Function class=G Carbohydrate transport and metabolism
  Homolog annotation: Query=13..530bp; Hit=13..530bp; Blast score=855; Percent Identity=78.0; E value=0; Homolog= ydeV COG1070
MNQRAHAHPSGKYLMALDAGTGSIRAVIFDLEGNQVAVGQTEWIHQPVPNVAGSMEFDLKNNWQLACQCIRQALQKAELPASAIQGVAACSMREGIVLYNRSGDPIWACANVDARSGHEVSELKELYDNTFEYDVYRYSGQTLALGAMPRLLWLAHHRADIYRQASTLTMISDWLAYMLSGELAVDPSNAGTTGMLDLVSRNWRPSLLEMAGLRSDILSPVKETGTLLGYITGKAAAECGLNSGTPVIMGGGDVQLGCLGIGVVKPAQTAVLGGTFWQQVVNLPAPITDPNMNIRINPHVIPGMAQAESISFFTGLTMRWFRDAFCAEEKLMAERLGVDAYSLLEDMAARVPAGAYGIMPIFSDVMRFKSWYHAAPSFLNLSIDPEKCNKATLFRALEENAAIVSACNLDLIADFSGVKPDSLVFAGGGSKGKLWCQILADVTGLPVRVPVVKEATALGCAIAAGVGVSLYDSLPETGEKLVRWEREYQPDLTHWEIYQKTKKNWQAVYTDQLHLVDDGLTTSLWKAPGL

SEQ ID NO: 8129 - protein, 57 aa, Xenorhabdus bovienii
  Coding DNA sequence: Name=SeqID_2021
MIFYILFPFCVNFVRFNILAFLVMLMGLRRIFNLYMKEHIHNPGAFHSDVVSPSSTR

SEQ ID NO: 8130 - protein, 38 aa, Xenorhabdus bovienii
  Coding DNA sequence: Name=SeqID_2022
MSDADQQIEHMTKKPSIPIEGFYYITSASFKNSDISIP

SEQ ID NO: 8131 - protein, 77 aa, Xenorhabdus bovienii
  Coding DNA sequence: Name=SeqID_2023
  Homolog annotation: Query=1..76bp; Hit=214..292bp; Blast score=95; Percent Identity=60.0; E value=2e-19; Homolog= ref|NP_716636.1|
MKAKALSLWDRLMLRRRFLIETVIDQLKNISQIEHSRHRSQLGFLLEIAAGLIAYTFQPKKPSLNLRDTDIAILKRS

SEQ ID NO: 8132 - protein, 188 aa, Xenorhabdus bovienii
  Coding DNA sequence: Name=SeqID_2024
  Homolog annotation: Query=1..188bp; Hit=1..188bp; Blast score=223; Percent Identity=55.0; E value=1e-57; Homolog= ref|NP_927753.1|
MVNLEEFYCCVDDFCQTFIPLWHQQLIENGLLKRHREASLSLSEVMMILILFHMSHYRDFKTFYIKYVKQHLKADFPGLVSYTRMLTLKKRALIPLCAFLSSRKAKTQGIAFIDPTKIAVCHNLRIPRHRVFEGVAQRGKTSTGWFYGFKLHLVINDCGELLAVKLTTGNKDDRHPVKAMVKGLTGCL

SEQ ID NO: 8133 - protein, 32 aa, Xenorhabdus bovienii
  Coding DNA sequence: Name=SeqID_2025
MPGDLHDFVFFSKNFDRASGTLVPFLSKSQVI

SEQ ID NO: 8134 - protein, 153 aa, Xenorhabdus bovienii
  Coding DNA sequence: Name=SeqID_2026
  Homolog annotation: Query=25..149bp; Hit=1..125bp; Blast score=173; Percent Identity=64.0; E value=6e-43; Homolog= ref|NP_930786.1|
MTIKSRETPVNPDYPTCDECYAKLMIYPEYIHPDEVSSLLQLEPTKKNIVGTKITSSSGRTREIKIAGWLLSSENYVNSKDIRDHLDWLLNKISKSSEGLKQLQNTDKVTMRIDCVWRSIAWHGGPTLWPEQMKIMSDLGLECSFDIYFVGEE

SEQ ID NO: 8135 - protein, 450 aa, Xenorhabdus bovienii
  Coding DNA sequence: Name=SeqID_2027
  Gene classification: Gene name=Lpd; Function=Dihydrolipoamide dehydrogenase/glutathione oxidoreductase and related enzymes; Function class=C Energy production and conversion
  Homolog annotation: Query=1..450bp; Hit=1..450bp; Blast score=763; Percent Identity=83.0; E value=0; Homolog= gor COG1249
MSKHYDYIAIGGGSGGIASMNRAAMYGQKCALIEAKALGGTCVNVGCVPKKVMWHAAQIAESIHQYGPDYGFDTTVNRFDWKTLIASRTAYIDRIHQSYERVLGNNKVDVIQGFARFVDAHTVEVNGEKITADHILIATGGRPVRPAIPGAEYGIDSDGFFELDEMPKRVAVVGAGYIAVEIAGVLKALGSETHLFVRKHAPLRSFDPLIVETLLEVIKNEGPTLHTEAILKAVIKHADGSLTLQLQDGREQTVDTLIWAIGREPMTDNLNLAVTGVELNEKGYIPVDKYQNTNVKGVYAVGDNTGAVELTPVAIAAGRRLSERLFNNKPEEHLDYTNVPTVVFSHPPIGTVGLTEPQAKEQYGDDQVKVYTSSFTAMYTAVTQHRQPCRMKLVCTGAGEKIVGIHGIGFGMDEILQGFAVALKMGATKKDFDNTVAIHPTAAEEFVTMR

SEQ ID NO: 8136 - protein, 76 aa, Xenorhabdus bovienii
  Coding DNA sequence: Name=SeqID_2028
MFTHLRSLPSNQLTYKYKLKFNLASIMTKSYHRLWMVLAFITIGHNYLVIMPFWTDVYSGTTHATEVCPVPSGTNT

SEQ ID NO: 8137 - protein, 280 aa, Xenorhabdus bovienii
  Coding DNA sequence: Name=SeqID_2029
  Gene classification: Function=Protein involved in catabolism of external DNA; Function class=R General function prediction only
  Homolog annotation: Query=1..280bp; Hit=1..280bp; Blast score=452; Percent Identity=78.0; E value=1e-127; Homolog= ZyhiR COG2961
MLSYRHSFHAGNHADVLKHTVQSLIIESMKGKEKPFLYLDTHAGAGRYQLSGEHAERTGEYLEGIARIWQRDDIPEELTAYMGAVKALNPHGVLRYYPGSPLIARHLLREYDELNLSELHPSDFPLLRSEFSRDERVRLLREDGYQQLKSKLPPRSRRGFVLIDPPYELKSDYQNVVKGILEGYKRFATGTYALWYPVVLRQKIKRMLKDLEATGIRNVLQIELGVRPDSDQRGMTASGMIVINPPWKLEQQMKAVLPWLHQVLVPEGTGHTSVAWVVPE

SEQ ID NO: 8138 - protein, 84 aa, Xenorhabdus bovienii
  Coding DNA sequence: Name=SeqID_2030
VNGLSLITSKYIPQKSGLAAILIVTVNLSNELPEKFLISGNLVKKYLRGVTITPHSVFLWFGFHLFQNKYSSITLLLCFIMFLY

SEQ ID NO: 8139 - protein, 123 aa, Xenorhabdus bovienii
  Coding DNA sequence: Name=SeqID_2031
  Gene classification: Gene name=Nlp; Function=Predicted transcriptional regulator; Function class=K Transcription
  Homolog annotation: Query=44..117bp; Hit=7..81bp; Blast score=93; Percent Identity=66.0; E value=4e-20; Homolog= sfsB COG3423
MVVQAGEASASLVIVTQSANPVWIATINDQLMEGVAGMNNVRNDWHQADIIAALRKRGTTLAAVSRESGLSSSTLANTLSRPWPKGEWIIANYLEIHPSEIWPSRYFDSNGQLIKRTTRKVSN

SEQ ID NO: 8140 - protein, 477 aa, Xenorhabdus bovienii
  Coding DNA sequence: Name=SeqID_2032
  Gene classification: Function=Transposase; Function class=L DNA replication, recombination and repair
  Homolog annotation: Query=1..474bp; Hit=1..472bp; Blast score=492; Percent Identity=52.0; E value=1e-139; Homolog= PA1368 COG3666
MSHHITGQSRHQSTLFPELMDDFVSEDNPVRVIDVFVEHLDLLDLGFESVNPKSTGRPRYHPATMLKLYIYGYLNRIQSSRRLEKECNRNVELMWLLERLSPDFKTIANFRKDNGKGIKNVCRQFVELCRQLNMFEDAVFAIDGSKFKAVNNKSKNYTPSKVQFHIERVEKSIEKYLSQMDAKDENEKESDLIVAASKLAWLKQRLVELKALEKQVNEHPDKQISQTDPDARLMKTHHMERQVCYNVQTAVDTKHHLIVCHDIVMTTDRGQLTLVAGQVQKVLGKESITVLADKGYFSRNDIKDADDQGITANVPQIDTSGSESKGIFNKSLFKYDNDSDVYICPAGQSLQKRMRVVEKGVELDVYFNNLACNKCPIRSQCTKSKKEPRRIRRWIHESIIDDMQKRLDEHPEFPVIRKQSVEHPFGTIKMWMGATHFLTKRLKNVSTEISLSVLAYNLKRMMTILGTVGLMAAISLS

SEQ ID NO: 8141 - protein, 37 aa, Xenorhabdus bovienii
  Coding DNA sequence: Name=SeqID_2033
MSANRMLKCNPNRCLLDEITVFTQSVPEADIADDTVC

SEQ ID NO: 8142 - protein, 30 aa, Xenorhabdus bovienii
  Coding DNA sequence: Name=SeqID_2034
MRGSKVQRFANNAICQVSEPPFMPSEALLF

SEQ ID NO: 8143 - protein, 231 aa, Xenorhabdus bovienii
  Coding DNA sequence: Name=SeqID_2035
  Homolog annotation: Query=29..138bp; Hit=29..135bp; Blast score=66; Percent Identity=35.0; E value=4e-10; Homolog= ref|NP_800770.1|
MVIQMTNFTLSPEDEVIIAECIKKGYAAWKDDSVKDLKSRLKEHLKKRQKHFCCYCLRNMFDEFNYVIDIEHILPKHKYVDFMFTLDNLAASCKRCNMKMKGRSVAFINPCFENNHDPFATENYKFIHPNTDIFVDHILYITLQEGTNILVSYSVKNNSPKGCYSINFFKLDRLARNTNDKAQGIPVEDEDYYEGNPEDDDIDDIDDIDAGNRLMDIEGIIEDLAFKNDQI

SEQ ID NO: 8144 - protein, 404 aa, Xenorhabdus bovienii
  Coding DNA sequence: Name=SeqID_2036
MSSSKWITKGTNMAKIKIILGENGQGKTRYLLNYFNENFHREHIAVVSNSIINPFPLIRKNSHHYYGLRSRYGQTQDILSRNINNYFIKLITNNSLRGLLSICKLIGYSDEILVRREPLYRIQKKERYDYELVYSTYGKEQYKRFQSYKQQLSRGIVEKHGSYIEKSHDYYLTYNGNERENQSIKDHMKYEQEVRTDLGLHSFNQLFTSRIFVKKNNKIFPIENSSSGELYMLSFGLFLRKFLDERKTNLPKVILIDEPENSLHPKLQRKYIEFLIGFLGYNDDVKVIIATHSPFITMENDFYSADFSLYGIENGVIFDTNHKQKNNNIEQVYYELFGILTPKNRYLSYYCNEIVRGVAEKRISFDDAFQAISRMKNVAFDEKQYDFLNDVINLLKKVHGDSND

SEQ ID NO: 8145 - protein, 38 aa, Xenorhabdus bovienii
  Coding DNA sequence: Name=SeqID_2037
MSEKPTSHMEAVDINLLVFCKASRNDAPRVSLYDISVG

SEQ ID NO: 8146 - protein, 553 aa, Xenorhabdus bovienii
  Coding DNA sequence: Name=SeqID_2038
  Homolog annotation: Query=1..553bp; Hit=1..553bp; Blast score=905; Percent Identity=76.0; E value=0; Homolog= ref|NP_707056.1|
MNAWEQYAFNIQNGKISACKRLKQAVKHYYNDLNNPRYTFDTEVVARFIAFSRLCPHVKGHLRGKPIILEPWQQFAFANLFGFKVKATGRRKYRSAYIQVPRKNAKSTVAAILANWFLVMESGQQDIYTAAVSRDQARIVFDDARQMSLLSKPLKKRVSIQQHKLTYSKTNSLLKPLAAKASTIEGTNPSLAIVDEYHLHPDNAVYSALELGMGARPEGVLFAITTAGSNVISACKQHYDYCCQILDGEEQNESLFALIYELDGENEIDDEALWIKANPNLNVSVDSDALHDTIQKARGIPSQWTEMLTKRFNIWCQGETPWMGEGAWKACQTDYNESDLKGLECYAGLDLSSTGDITSVCYTFPVDNELLLLTRHYLPEAQLQNPANKNRAVYRQWAQMGWICTTAGDCIDYDRIRDDILKDSQHFDIRLVGFDIWNATHLRTQLQGAGLDVEPFPQTYMRFSPVAKSAEVFVNRKVIRHNGDPVLAWAMSNVVMETDANANIKPNKKKSANKIDPAIAFLMSFGTWQSEHKEFAFSLSDGQKQRLANFDGI

SEQ ID NO: 8147 - protein, 149 aa, Xenorhabdus bovienii
  Coding DNA sequence: Name=SeqID_2039
  Gene classification: Function=Uncharacterized phage protein; Function class=S Function unknown
  Homolog annotation: Query=33..140bp; Hit=1..108bp; Blast score=165; Percent Identity=75.0; E value=2e-41; Homolog= Z1853 COG3747
MTNALLSGTDPLLKFLRTALFLKINSQGRQKIMARAPKPPTYLNDIAASQWKSKAKILGEREDLNAADWNNLELYCVNYAIYRKAVADLDIRGFSIVNSQGSESRNPSLSAKADAEKIMIKMSSLLGFDPVSRRKNPVETEEEDELDRL

SEQ ID NO: 8148 - protein, 144 aa, Xenorhabdus bovienii
  Coding DNA sequence: Name=SeqID_2040
  Homolog annotation: Query=1..141bp; Hit=1..141bp; Blast score=155; Percent Identity=58.0; E value=8e-38; Homolog= ref|NP_309622.1|
MPWQPLRRCSYPNCRERVKSGRCEQHQREARRQQDKQRGTRTQRGYSNRWGRYRLQYLKANPLCVHCLQQDIYASATIVDHIIPIQGEADVLFWPEFNHQSLCQPCHNRKTVQTDPITKAKRKQGIYQEREAEAAKHRGWLVAE

SEQ ID NO: 8149 - protein, 98 aa, Xenorhabdus bovienii
  Coding DNA sequence: Name=SeqID_2041
  Homolog annotation: Query=4..98bp; Hit=6..98bp; Blast score=117; Percent Identity=56.0; E value=3e-26; Homolog= ref|NP_707052.1|
MVEIPLNEIKQHCRLDESDTLDDALLMGYAEAALEVCQQHIGKRFDNGLAFTPAIKVGCLLYIGLLYENREMAVDAELKEVPFTIKSLWSVYRDVGVY

SEQ ID NO: 8150 - protein, 125 aa, Xenorhabdus bovienii
  Coding DNA sequence: Name=SeqID_2042
  Homolog annotation: Query=16..123bp; Hit=1..109bp; Blast score=87; Percent Identity=42.0; E value=3e-17; Homolog= ref|NP_309620.1|
MEANGRNQETTGGQGMRAGRLRHRVTIQKSEQSRAPSGQVIDKWVDAATVWAEVRAISGRERLASGAVFSEATVRIWMRYRDDVTTANIILYNGANTRGTAFDIVAVIPDAKYTRLELLCKGGVF

SEQ ID NO: 8151 - protein, 405 aa, Xenorhabdus bovienii
  Coding DNA sequence: Name=SeqID_2043
  Homolog annotation: Query=1..399bp; Hit=1..398bp; Blast score=643; Percent Identity=76.0; E value=0; Homolog= ref|NP_287334.1|
MWPFKRKDTETRSMSIDEFLFLAGASNTKSGEHVSPSTAEGLPAVMNAVTVISEAVATMPCYLYRVQHQHGKESREWLSDHPVDYLLNECPNDCQTPFQFKRTLMRHCLLNGNAYAVIVWGRDGQPQSLHPYPPSAVVPQRLSDHRFVYTITEPYSGKVKTYLQEEILHLRYATEDGFLGRSPVTICRETLGLGLAQQRHGASIMKEGMMAAGVIKAADWLDGIKGNKALEALERYKGARNAGKTPILEGGMEYQQLGMSNQDAEWLASRRFTIDDIARMFNVSPIFLQEYSNSTYSNFSEASRAFLTITMRPWLANFEQQIKSALLMASPKRGIRYQVEFDTADLLRANPKERFQSYETAIKSGVMCPNEAREREGLSPRAGGDEFSQAWKQTVEIKKQPEGKE

SEQ ID NO: 8152 - protein, 182 aa, Xenorhabdus bovienii
  Coding DNA sequence: Name=SeqID_2044
  Gene classification: Function=Phage head maturation protease; Function class=R General function prediction only
  Homolog annotation: Query=6..182bp; Hit=10..190bp; Blast score=205; Percent Identity=60.0; E value=2e-53; Homolog= Z1848 COG3740
MNNDFEIRTASLSASEKKLIGYVVKWNSRSHVLWDEFVEQFAPNAFTNSLTNNTDVRALYEHDHMNLLGRTTSGTLRLSEDTTGLRFELTPPDTQLGRDVLTLVERGDISGMSFGFRALKDQWDIGQEPYIRTVLEAELREITVTSLPAYPESGVEIARRSLNAVKPNHVDLRHYWLQLSEV

SEQ ID NO: 8153 - protein, 384 aa, Xenorhabdus bovienii
  Coding DNA sequence: Name=SeqID_2045
  Homolog annotation: Query=1..379bp; Hit=1..380bp; Blast score=511; Percent Identity=66.0; E value=1e-144; Homolog= ref|NP_287332.1|
MKKLLELRQQKSILTNQMRSLLTKAGDEKRSLTNDEAKQFDELRSQSDSLNAEIARYETLADDERSQAGKTQPTRDNLSNDEFRHYILTGETRTLSTGVPSEGGYTVISELNKQIMQQLTGESVMRQICTIKTTRSNEYKQLVSVGGAAVAHGEEGKARSETTTPKMEEVSIKLFPVYAYPKTTQEIIDFSDVDILGWLTSEIADTFVDTEETDLVSGDGSKKAKGFLAYPRDTKSDKVRDFGTLQKLEATTLEADNLIDLKFLLKNKYRKNSVWVMNSNTAAQVQKLKNGNGDYIWRERLQAGDPDMLLGLPVHYLEFMPDGVIGLGDFKRGYFIVDHETGIRTRPDNITEPGFYKVHTDKYLGGGLVDSNAIKVLEVKSATK

SEQ ID NO: 8154 - protein, 222 aa, Xenorhabdus bovienii
  Coding DNA sequence: Name=SeqID_2046
MDLVKSEELIINHGWIGFLLFIFMFLLFVFTIVNVHTTLLYKVFVLFNPEKNLFRKIKSLRRISNNERISEDIRALAKNEEIRIINSFYLKCNLSVDAQNIWAKLILFHKNKNIPMELYKRAYSLFPVKDSRLVEKISLSNLVRVWIVTVFQIILLLFVGALGSLSIVAYLGAVDGGVKLSLFFFSYFIIFILFLAFFSSGIPNYFSYSKIKKLIKEYNETH

SEQ ID NO: 8155 - protein, 169 aa, Xenorhabdus bovienii
  Coding DNA sequence: Name=SeqID_2047
  Homolog annotation: Query=11..163bp; Hit=7..152bp; Blast score=103; Percent Identity=36.0; E value=2e-21; Homolog= ref|NP_746990.1|
MYYRDKFGVLLLDKKDNLSYYSQQKIFIENKMTALDVYNQMTQKTPLWLRLSFAIRDKISSLAGVEKIHGFSDENLNKELHAGSYIDFFKIVRISDDEICLLSKDIHLTVLISLNIFSDDNHKDGCIATVTASVITHNFFGKVYMIPVSLIHGSIVRGMLSKVGQVLKD

SEQ ID NO: 8156 - protein, 63 aa, Xenorhabdus bovienii
  Coding DNA sequence: Name=SeqID_2048
MSYDLSSHQFVSLLYFYIPISSFIYNYIDFHGITGYIDIFVFISNGYPTPFYPTYPVAQKYYF

SEQ ID NO: 8157 - protein, 912 aa, Xenorhabdus bovienii
  Coding DNA sequence: Name=SeqID_2049
  Homolog annotation: Query=350..881bp; Hit=154..685bp; Blast score =420; Percent Identity=42.0; E value=1e-116; Homolog= ref|NP_246721.1|
VNQGNNNQKSRPLDVIRAVKQSAVTHWQLLLPACGVDVPLKGKHGACPICGGTDRFHFIDDNNNGDWHCRQCDEQNHGDGLDLVARTKGITIFAAAKLVAGVLALPLPEPKPAKEQPRPVKPIAERITTMLATAITGESQYLVKKGLQCPNQRLLKDGSLLLVVQTLDGTITGGQTIKPNGEKRLVSGTQKKGSFIPVSEITGTPDTFIISEGYATALTVNQLHEGVVLAAIDESNLLTVAELVRAQWPDAKIILAADNDCHVQGERDKNGKLKKNVGKIAAEKAAQSVDGWVTLPPTEDKADWDDYRQRYGIKAAKQAFSEGLYQVGKKVSVSKSVVINLGEHREKERDPLKPHVDTRKNGIYWVEPKEQNGEIIEIEKWLSDYMEVVGIGSDGGEGYLIIKLSQEGTGKHTFEAMPRREIGMPMGWARLRSRGINITTKNSLLPILADHLQRSGDRRKWEVTQTAGWHCGAYVMPDGEIIGQPYMPVAFCGGTSAIAGYVVRGTAEDWTTHVASLMKGNRSMMLGVLVGLAAPLNSLTGGNCFGVHLFAQSSAGKTTTVEAASSLYGDPEELKLSWHGTHHGLNNEAAARNDGFLPIDEIGQSANPKEVANSAYSLFNGVGKIQGKREGGNRAVIRWKIAALSTGEEDLETFLIKGGITPKAGQLVRLLSVPFVDTEFFNGYEDGDAHARAIKRESKRYCGAVGRAWILWLSENQERAIETVTCKEKEWLDSLPEEASAQVKRVAVRFALLDAAGELATHITGWSKEDCHTAIKQSFDDWLEDFGIGNREKYQVVTRARDFIQKYGLSRFQPYTYGKLNGNIDTANAMRINNLAGYLVHNRRGDGQVEYHIIPSVFEEEILQGLQKKSGFEALEEAGMLIKMEKDRFISKTISVNGTQGRFVVLIFKDED

SEQ ID NO: 8158 - protein, 135 aa, Xenorhabdus bovienii
  Coding DNA sequence: Name=SeqID_2050
MSNKPISLKQALYRVGLSTSLFTFIIKKANDECETNLNNLIALACDINQEVHRALLKHAPQPLANKLLNSVIHRQSGSLDQAAFRAGLCTSLYEVILEQASQHCSEELHDLLSLACDINQEAYYSLYAVVHGEDE

SEQ ID NO: 8159 - protein, 183 aa, Xenorhabdus bovienii
  Coding DNA sequence: Name=SeqID_2051
MVNSYRDSLRLSNYQFDKQPSLRGLVNNHSYYWLVQILGFIPKVRSFSRQASLTHELKLPLSAISSICSSRSSSKRIVRRVLLFRSYGFLLFSSCIGSNHYVNLLNSGANHYKDERHKKAMPRSGGTLTRHLTKPLIEVTIMADTQSNQTRLKFTFLIASGTQRLAGMFSLIFVSRQEAHHEQ

SEQ ID NO: 8160 - protein, 94 aa, Xenorhabdus bovienii
  Coding DNA sequence: Name=SeqID_2052
MTIQYSTPTPEERRSILSEYGEPYDRLIREKERQHITSISRTSAWKLENEGRFPARKPLGRNSCAWLLSDLLHWVRNPPTVDNVNNPYSRKPAN

SEQ ID NO: 8161 - protein, 465 aa, Xenorhabdus bovienii
  Coding DNA sequence: Name=SeqID_2053
  Gene classification: Gene name=XerC; Function=Integrase; Function class=L DNA replication, recombination and repair
  Homolog annotation: Query=59..461bp; Hit=8..410bp; Blast score=375; Percent Identity=47.0; E value=1e-104; Homolog= Z1835 COG0582
MKFGVLTLSYLHLIILNINSLDYILYCILFQCLLTFSYFYITLWGNRWGNKYLELESQMTTGINRLSDKKLKSLLGARADKVRKVSDGAGLMIRITKAGSITWIYKYRLGGRSTEANLLTLGRYPDLSLAKAREMRTQCRTWLADGKDPQRMIKLDREETLKPVTVQDAIEYWLTEYVDNNLVNANRYRERFNKHLFPYIGDMALSDCDTRYWLRRFDQVKKVAPSVAGMLLQMSQQALKFCRIRRFAVSHVLEGITKQDIGVKLNKRKKVLTEKELSDVVRAVHSDFFIPYYSDLFYLLIVFGARTVEVRRSKMNEWDLEQRLWIVPEINSKTREKIVRPIPDAMVTKIHRLKSQNKHSEYLLGEYKENTAVSSTGNRVWERLKHNEKWVLHDLRRTFATMLSDAGIAPHIVELLLGHTLGGVLAVYNRSQYLPEKLDALNKWCERLDVLAGNYENVVILKAVQ

SEQ ID NO: 8162 - protein, 44 aa, Xenorhabdus bovienii
  Coding DNA sequence: Name=SeqID_2054
MTTPSRDLSKILYTDLDLILKIQLRLQLIGGKWRLLSFLARMGL

SEQ ID NO: 8163 - protein, 117 aa, Xenorhabdus bovienii; identical to SEQ ID NO: 7849
  Coding DNA sequence: Name=SeqID_2055
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 8164 - protein, 163 aa, Xenorhabdus bovienii; identical to SEQ ID NO: 7546
  Coding DNA sequence: Name=SeqID_2056
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 8165 - protein, 93 aa, Xenorhabdus bovienii
  Coding DNA sequence: Name=SeqID_2057
MMSKTMILSALIVFSMNVAYASQEKTGCEIKKKTLKKQLEYAQADGDKRLIAGLTRTLESIKATCELEKRLKYQQHNPEPTKDRLKKMQTKNK

SEQ ID NO: 8166 - protein, 198 aa, Xenorhabdus bovienii
  Coding DNA sequence: Name=SeqID_2058
  Homolog annotation: Query=27..194bp; Hit=15..184bp; Blast score=116; Percent Identity=38.0; E value=2e-25; Homolog= ref|NP_927518.1|
LPRVKFQKPFSHIKFDYEGGMMFVHVANKNIIIVFALILGIAIVFLSFNNSKLSLIGYVDKHCQKNTTCLIDMNKITSFDWDKMYIINKGMGREDIEYIIGAAFTGKASLFYKIIFVKNQKVIYSDEYYPHAESYEKKFLKPDFNYPYDVKGNNFIYYAISRDNSILSVEIENKPFMGDKVYYKISPSNAQQVRGRSL

SEQ ID NO: 8167 - protein, 32 aa, Xenorhabdus bovienii
  Coding DNA sequence: Name=SeqID_2059
MWQFIHKSRYILMAYCKLQKIRLLIESRGGLF

SEQ ID NO: 8168 - protein, 51 aa, Xenorhabdus bovienii
  Coding DNA sequence: Name=SeqID_2060
VDKLPHHLQATVLQLLFDLLSAVYKIKKFNLSLFFLHLKNAIIGALYSEKV

SEQ ID NO: 8169 - protein, 50 aa, Xenorhabdus bovienii
  Coding DNA sequence: Name=SeqID_2061
MTLIEHLSVVKETRSDINRQYDMIDVIFLVVSAIMACLSYTNILTRPLRY

SEQ ID NO: 8170 - protein, 155 aa, Xenorhabdus bovienii
  Coding DNA sequence: Name=SeqID_2062
  Homolog annotation: Query=1..155bp; Hit=1..155bp; Blast score=296; Percent Identity=97.0; E value=6e-80; Homolog= ref|NP_927691.1|
MFSTCAEQWASDTFQHAELGDKRRTNRLVKVACSLANHIGQSLVQALDSPADVEAAYRLTRNSAIAPQAIAEAGFTATVAHAQRYHCLLALEDTTTLSFSHASVADELGYTTSKKKSRGMQAHSVLLFAPEEQQVVGLIEQQRWCRDVSDYGKSR

SEQ ID NO: 8171 - protein, 30 aa, Xenorhabdus bovienii
  Coding DNA sequence: Name=SeqID_2063
MAKADNATHALMKGKRVISGNGPHKPPTAG

SEQ ID NO: 8172 - protein, 276 aa, Xenorhabdus bovienii
  Coding DNA sequence: Name=SeqID_2064
  Homolog annotation: Query=1..276bp; Hit=185..460bp; Blast score=510; Percent Identity=95.0; E value=1e-144; Homolog= ref|NP_927691.1|
MANVISVCDREADIIEYLRYKTSQKQRFVIRSMQSRRIEESQDRLYGFISQLQSAGARLVQVRQKGGRQARVADCDISYAEVTLKIPEGKSGEAVRIFYVGCYEKGTEDGLCWHLLTSEPVNSQEEAHKIFSYYERRWLIEEFHKAWKTGDTQVEALRMQSKDNLERMIVLLAFIAVRIHQLRFMGLNKEEAEKESGETVLSPLAWKLLWSKQEKRRPPKKAPSLHWAFINLGKLAGWYDSKRMGRVGWERLWEGWFRLQTLIDGYLLAKSVDLEI

SEQ ID NO: 8173 - protein, 37 aa, Xenorhabdus bovienii
  Coding DNA sequence: Name=SeqID_2065
LPARSRRAGRDWLNGRPARPCRKPASYWAAAGARPVS

SEQ ID NO: 8174 - protein, 492 aa, Xenorhabdus bovienii
  Coding DNA sequence: Name=SeqID_2066
  Homolog annotation: Query=1..437bp; Hit=1..435bp; Blast score=488; Percent Identity=64.0; E value=1e-136; Homolog= gb|AAN64195.1|
MSEHPENLIIRAGGSPQNLPEFAVIRDEINKISHPAQPEVNWVLVESLSLTLFRRNGVDLQTAIYYTLARMQLNGLAGFTEGCELLAGVIVSEWDALWPPQPAVRTDLLEWFHTRTGSQLRQMDFGTGDLRMIYRAERALQLIIDRLQQSDLKRLPRVENLLWFFQNAAKKLEKPRPAAKPAQTPVQMPPLVYLSQSDTEPEMPPPSAPPRPDRPPEADSPRVRVQFPEPPRGWSAWQGFGLGALLGVLVLVGSGLLFYQPLHQQLTAITAHPAGARLAWLYQSELAGYQRQLDRLAETPLLATWDAARTLTDTAEKQWPDSAEQRSATRQWTQAMTARIESIPLKGSWHTTRDQLQQLADKILLQERTRGSFTLSYLKTAVYDLQRSHGSEVPLEELLRQLNARVASGEAVPPVLLKGIDDRFNALLGRYDRLRQATENPAEKQTEKQTTHHESTVTPDGGHVGGIRGRQHPTSAGSGDCRPDHVGRAGTG

SEQ ID NO: 8175 - protein, 742 aa, Xenorhabdus bovienii
  Coding DNA sequence: Name=SeqID_2067
  Gene classification: Gene name=IcmF; Function=Uncharacterized BCR; Function class=S Function unknown
  Homolog annotation: Query=14..742bp; Hit=418..1144bp; Blast score =883; Percent Identity=59.0; E value=0; Homolog= Z0250 COG3523
MFGIYCHVMQCRLRQLYTFSTVSALVIVAMWGGWHYFYQKNYQAGEEVLAQAKNFLSVPPPDGDDRYGHLQLPLLNPIRDATLAYGNYHEKKSFLTDMALYQGDGVGPYVEGTYLKLLEQRFLPSLMQGLLDDLNRAPAGSEEKLEILRVMRMMEDGSKRNNGLVGQYMRARWSKAFHGQRDLQAQLLTHLDYALAHTDWKGQRDRDNQDALARFAPFIKPMKQAQQELSALTINQRVYQNLRLKAQDTLSAPVNLRDQIGPSFDSVFIAGNDSRLVIPQFLTRHGLTDYFVRQDKELVELTEMDSWVLNLPLKTNKYSDTDQGNIQREITELYVGDYTAHWRAAMNNLEVRDFEDLPQAISAIEQVISGEQPIKRALQILSDNTRPPELGGALSDKEKQALLAQSDYRLLNRISRDFAPETGVLVEHGDKGSALQSVYQKLMALHRYLLAIQNSPVPGKAALQAVQLRLDQNNSDAIFEVQQMAKNLPEPLNRWVGDLAEQAWRVVMMEAVRSLEVEWNETVVKQYQTYLAGRYPFNPAATEDVPLSEFDRFFRPDGTLDTFYKQSLKPFVENNLTTGTDGRELIRPDVLKQLAVADRIRTTFFTPQNGLGTAFAIEPVSLTGNKRRGLLNLDGQLVDYAHGRSNVAHLVWPNSMRAGTESRLTLMPDRSNAAPRSLSFTGPWAQLRLINSGKLTNVQPGAFDVRFAVDGGEITYRIYMDESDNPFAGGLFSQFRLPDTLY

SEQ ID NO: 8176 - protein, 88 aa, Xenorhabdus bovienii
  Coding DNA sequence: Name=SeqID_2068
MPAAPHGHDHQGADRGEGVQLAQAALHDMAINAEHVAIVKKLAGIFGKKGKLWRDLTGSLKLDVYPVFILRVASQRSILMMESCAGWR

SEQ ID NO: 8177 - protein, 163 aa, Xenorhabdus bovienii; identical to SEQ ID NO: 7546
  Coding DNA sequence: Name=SeqID_2069
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 8178 - protein, 117 aa, Xenorhabdus bovienii; identical to SEQ ID NO: 7849
  Coding DNA sequence: Name=SeqID_2070
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 8179 - protein, 111 aa, Xenorhabdus bovienii
  Coding DNA sequence: Name=SeqID_2071
  Homolog annotation: Query=11..102bp; Hit=9..91bp; Blast score=84; Percent Identity=46.0; E value=5e-16; Homolog= ref|NP_930598.1|
MTTPSNAGTCIYKISQPERYQKVVYRPKGLNRTTPAINLSGNWLSEAGFSVNDPLKIRVMPGCLIITAQNFPELWHCLKSLNEGQWDDIAVADWLRQFPGKLNKTGLRKNT

SEQ ID NO: 8180 - protein, 34 aa, Xenorhabdus bovienii
  Coding DNA sequence: Name=SeqID_2072
MRTASQNENIAINRWKAVHSLCSECLFYFDKTDC

SEQ ID NO: 8181 - protein, 116 aa, Xenorhabdus bovienii
  Coding DNA sequence: Name=SeqID_2073
MSLQLSLQMAELPECVITGSALRQIGFTTDALFRIAQFANGLILSLIEPETEPDLAALLHETEFEPHQGIDWVRDNGELYLAGDWLTESGLLDHPVTVETAYGTIVIRAELPILLA

SEQ ID NO: 8182 - protein, 116 aa, Xenorhabdus bovienii
  Coding DNA sequence: Name=SeqID_2074
VNLPELKLQSGWFILSYDRPYYSDDSSIAIELCQYFDRLIGFHKKTGYYFDARYEGDEYSPGGRINGIFSVTFQRFNFDINTSGYGDSTSTEKLKTDSIREFSRSLNDFVERAEQQ

SEQ ID NO: 8183 - protein, 69 aa, Xenorhabdus bovienii
  Coding DNA sequence: Name=SeqID_2075
MWLIIKQTNPAGILLRVKIVVEISYYFFLSLFYKHWIYYIKPCSIINFLYRLVSVTLISKNPHALIHSK

SEQ ID NO: 8184 - protein, 95 aa, Xenorhabdus bovienii
  Coding DNA sequence: Name=SeqID_2076
VLKDCVRDSQSSRELLISHMIIMNYSFFVLKYHPTDFLLLKEYLKNDDDMFVKILSLIVNIGFHVDKKTFFALGLSEYIDNVSRNYHLLYNCYFE

SEQ ID NO: 8185 - protein, 216 aa, Xenorhabdus bovienii
  Coding DNA sequence: Name=SeqID_2077
MERVLLSIYKYKTESFFNESTLPFDNQFLLYKSDRKRPRRDESKNRELCFKRGCYGDFLKVTSWDYLFSEYMPIEYWNHIPDEFIKDKNIFGFANIDYYNVNLIINIMFFIFDINKEACFYRKELSKFYYQYQASHYKSNDKTRIFFLGRLFAEVWVWDLAYKRLSIRNGELLYTAESGVAYHIHDLIDRFCDMIRAFSLPKYLQEMLDFINPMLH

SEQ ID NO: 8186 - protein, 39 aa, Xenorhabdus bovienii
  Coding DNA sequence: Name=SeqID_2078
MIPFYICKLTAKHAPSLIILVRNDKFWRYNICENKKQTS

SEQ ID NO: 8187 - protein, 343 aa, Xenorhabdus bovienii
  Coding DNA sequence: Name=SeqID_2079
MLFSIYKYKVESFFNEKMPPLDDQFLCYRTHDEDQINNENLFFKKEYNGEYLQVRFWEYLFREYIPEEYWNHIPDEFIKNIGIPDFVHMDYSGVNLILNNMFFIFDIHREVPFYRKELTKFYCQYQLSHYEGDNNIRLFFLKRLFGEMWIWNLAYDKLSIKNGNLIFKSESGADYNIHELIDRLCDIIRVFSLPDHLLDMLDFINPMLHECIDIILGKNGVYDFNFDDVNLKYIDGSYFLETYRNNQEEIFNAIKGCVRDGQSFQELFVSHVIVMNYSCFILKNSPDEILQLKSFLSDSEKTFIKLLSLAIDINFYVWEDSFDGLNLEEHLEKVEKSDFLIDK

SEQ ID NO: 8188 - protein, 1573 aa, Xenorhabdus bovienii
  Coding DNA sequence: Name=SeqID_2080
  Gene classification: Gene name=RhsA; Function=Rhs family protein; Function class=M Cell envelope biogenesis, outer membrane
  Homolog annotation: Query=363..1401bp; Hit=392..1491bp; Blast score =702; Percent Identity=38.0; E value=0; Homolog= Z0705 COG3209
MGIMQEIVTRSARVGAMHSGRRVQGPNGPAAAREGDPIQHTSFLAALAGVVAGALVAAAAVAATVAVAALVIGTGGLASVAAFALGAYAVHELGGVISNVTASVTNMVNSLGSPDGAVDSGSSNVKIEGKAAARAEADKAKCSKHPTPPLIAQGSETVFINGHAAARVDDKLVCGAAIKGGAGTVFIGSGKHDYLEVQEEFSLLERAVLVAVEFLVPPTRGGLKIAGKLLTQQGRQALLKLARKEGNALLASAKAGARAAGKRAKNAVKDPKAAASALAAGAKSGAKKAAAYTKAEVKRIAGNVRTAPGRVMNGARMGAAKARQSVPNAKTGCSNRVGCAKRAFHETKGAKRYWEAAKRFFKSDPIDVTTGAVFAQHTEIELGQTLPLTFMRSWSPGERGLLGENWTDTFSGRAIVIGDRVEIRTTEGASLYFILTPSDRSSMNPEHPEFTLSRAEAGYLLHERNNPVSQHFSVPVPANDGSQRWLLGALRDHYNNVIGFHYSEQHQLVRVTHSDGPALVLLYRADGLLEEIRRTDSDLNDVMTHYRYHDNGWLAEADSRQHFHLFYDYNAQGLISRWSDGSQTVVDYTYDAQGRCTDTVASGGYYPVHFDYEPGLTRASNPQGHTTTWHHNDQQQVTQLETPCGRVARYEYDAWGNLCREISPEGQVVTLDYLADTGLVTAFTNAMDLTWQYDYDDHDRLISVTDPRGRCWAQQYDDNGAPECFIAPNGDKTTLIRNEFGLVTTVEESDGSTRTLEYDRHHRLTSLFDEDKRSLQWGYDSQDRVQQLTTVGGARWRWEYDRHHNVALSDRPNNSLERFRHDRQGNLTEWTDARGVVWHIEYGPFDLPVARVDGEGNRWQYRYDVDCLQLVAVVNPQGESYRYQLDADGRVVTETDYAGTQWHYAYDGNSNCIEMRDALGQVTRFEYDAAQRMTAMHTPEGTTTYRYDVLGHLLAVAAPGSAPITYEYDEQDRLVREIQQNGEIRRDYPENQSVSRTVLTDGQQWHMQAAVNNAGEVNVLILGGEECLTRSRDAEGQEWHRQSNKGFILRQEYSLMGQLTAQRAGRNTEIFTADEVADIPQPTLAGLDKEYRYDAALNLVAANDERQWLRYVVNGNGQVTSVSDGDRLREHYQYDAAGYPSRRFDGLNEIDGEWLYQKGHRLRRVGPHLFEYDDAGRMTAMQQWQEGHRPQLTKFRWNSQNQLTHVLTPGGQQWAYRYDAFGRRIEKDCAQTGMRTTYLWDGSTPAEIREYRHDRLYSLRHLVFDGWQLLAQQVQFFTPNPENRRELIAGDIRTHYAVCAPTGEPLALFDTAGHRVWRQPAYSLYGLRLGAAGENAEFDPGLKFAGQWLDEESGLFYNRFRYYSPLAGCYLTPDPIGIQGGENTYGYVPNPTGFIDPLGLAKKKPKEDPRRPAPEVPKVKEETYKIVRHVSPEELENIKKAGGKIVLHYDSPRVARWINVPAEQHGYGTVNPNEQKNIHRVTYTVTEKGFRMLDMSNRNLALDFWKFDDGEAGAPDKVFYKGNEKGARGIGVNVLKDFNKEIISAQYETRIGKTKKYSEPKPIIECKGKKKGR

SEQ ID NO: 8189 - protein, 139 aa, Xenorhabdus bovienii
  Coding DNA sequence: Name=SeqID_2081
  Homolog annotation: Query=6..139bp; Hit=6..139bp; Blast score=193; Percent Identity=70.0; E value=5e-49; Homolog= gb|AAN64197.1|
MSAHPYQMNEGTLTIPANWRDESMHVFVLPDDSGVNLVINRSAVPLGTDPEAFYAQTLTQFVTHLPDYQEHQRLQIELSGEPAWRLDYQWQSPEGEMHQTVVMQIRGSQLLAFNLTSPEPFNEGQRHALLDVITSFHAA

SEQ ID NO: 8190 - protein, 86 aa, Xenorhabdus bovienii
  Coding DNA sequence: Name=SeqID_2082
MVVSFFTRLRLSLYWSVQPALTGGYRAEIFVTGLAAITVCLVLFRLVQGDLAAVHRNPPAIHRNVGAAKRDKNTVRRHLNGAIADR

SEQ ID NO: 8191 - protein, 483 aa, Xenorhabdus bovienii
  Coding DNA sequence: Name=SeqID_2083
  Gene classification: Gene name=VgrG; Function=Uncharacterized BCR; Function class=S Function unknown
  Homolog annotation: Query=7..483bp; Hit=139..633bp; Blast score=450; Percent Identity=46.0; E value=1e-126; Homolog= Z0707 COG3501
VFSLRHPHPAREFCVQYQESDFTFLQRLTAEEGIFYFFECGSGRNTLVFADDAGSVPPGIVLPYQPGEGSTTGVPSVGSFTCSAQVRPAQVQLKDYTFKNPAWPAEFSRQMKEDTLQQRYYEHYDYPGRFKDEAHGEAFTRYRLEALRSDAVTGQGSGQAIAVQPGKLFTLDNHPRADLNQPWQVVSASHTGSQPQARETASSDSGTTLHSQFSFIRHNQHWRPAPRPKPTIDGPQIAKVVGPAGEEIFCDQYGRIRLQFPWDRYGKSDDQSSCWIRVSQPWAGQGWGMLAIPRIGQEVVVDFLHGDPDQPIVTGRTYHASNIPPGALPGSKTQMAFRSKTHKGEGYNELLFEDAKGSEQLALHAQKDMHTTVKDAQSLVVEAGNRTLTIQKGDEFKTVTEGNLTESICQARSTTANAVSVTTNANGTVPGTQLYEAQDAITLTVGDGTIQMTTDGILISFGGSNITVNGGGVSVNGSQITLN

SEQ ID NO: 8192 - protein, 150 aa, Xenorhabdus bovienii
  Coding DNA sequence: Name=SeqID_2084
  Gene classification: Gene name=VgrG; Function=Uncharacterized BCR; Function class=S Function unknown
  Homolog annotation: Query=73..150bp; Hit=47..124bp; Blast score=71; Percent Identity=47.0; E value=3e-13; Homolog= Z0267 COG3501
MIIASRSTMTTSMMREYLNWPRSRTPMVTVCCWIMTSTDCRCRGLLGSSRRAASMRPARPCRKPASYWAADPAIDFPAVLDRSATLTILQEGVEQRSITGMVARFEQGNTGLHQTTYQMSIYPDLWRTTLRQNSRIFQQLDIAAILTMLL

SEQ ID NO: 8193 - protein, 69 aa, Xenorhabdus bovienii
  Coding DNA sequence: Name=SeqID_2085
MRLSWRSRIPDSDNTRTIRQQYQRQQNQLSEIKLRMRELIGEYKTHKRERKAGIEKLQAALDYHGYAPR

SEQ ID NO: 8194 - protein, 133 aa, Xenorhabdus bovienii
  Coding DNA sequence: Name=SeqID_2086
MTTENSVHLWIGNNFSSEDEYVKYFELDYSVEGNFDDPNYKLCQFCKDIGLQWYDEDFIGIIPRRDESVSIDEILIDAAVDQSEFQSIKDICDRLGIKEANAIFWYQDSELHINPPYKEQYNGLKYIGLFEGD

SEQ ID NO: 8195 - protein, 1525 aa, Xenorhabdus bovienii
  Coding DNA sequence: Name=SeqID_2087
  Gene classification: Gene name=RhsA; Function=Rhs family protein; Function class=M Cell envelope biogenesis, outer membrane
  Homolog annotation: Query=141..1415bp; Hit=255..1514bp; Blast score =746; Percent Identity=37.0; E value=0; Homolog= Z0705 COG3209
MGLTDDIVARIARVGATHAGQRVAPAQGPRGPAAAREGDPIQHTSFLAALAGVAAGALVAVAAMAATVAVAGLVIGTGGLASVAAFALGAYAVNELGGVISNVTTSVTNMVNSLGSPDGVIDSGSPNVKIEGKAAARAEVDKATCSKHPTPPLVAQGSETVFINGSAAARVDDKLVCGAAIKGGAGTVFIGSGKHDYLEVQEEFSLLERAVLVAVEFLMPPSRGGLKIAGKLLSQQGRQALLRLARKEGNALLASAKLGAQKARAAAQKIANTVISGAKAGAKKVGDVAKKAANKVKASAMKVMNGAKMGAGKAKEGLNNAKKNLSDRWDCAKTAFGETQGAKRYWEATKRFFSKDPIDVVTGALFDQRTDIALGQTLPLLFMRSWVPGERGLLGESWTDSFSGCAVIIGDRVEIRTTEGASLYFILTPTDRSSTNPEHPQFTLRRAETGYILYERDNPVSQHFSVAMPAEDGNQTWKLGALRDRHDNTIDFHYSEQQLVKVIHSDGPELALLYREDGLLAEIRRIDTGLNDVMARYGYHDNGWLADANSTQQFHLFYEYNAQGLISRWSDGDQTAVDYRYDEQERCIYTVGSGGYYPGVFDYEPGITRVTNPEGHITTWHHNDQQLVTQEATPCGNVTRFEYDEWGNLRRKILPEGQILTLDYLANTGLVSVFTDAMGATWRYHYDDADRLVSMTDPFGRAWWQSYDDNGNPACFMAPDGSKTTLTRNEFGLVIAAEDNEGRKRTWEYDGHQRLTRLFDEENRSLKLGYDSHDRLQRLISGGGSLWLWEYDRHHRVSLSDRPNNSLERFRHDRHGNLTEWTDARGVKWHIEYGPFDLPVGRVDGEGHRWQYRYDLDSLQLLAVINPKGESYCYTLDADGRVITETDYAGTQWHYAYDGNGNCIKKRDTLGNTTHYEYDAAGRMTAMHTPEGSTTYRYDILGRLLEVSAPESEPLTFDYDEQDRLVKEVQPHGVIQRDYPDSATAERTLHTSDGRCWQASTQINNVGELKLLRINGEHTLNLERDEDGYEWHRQSDKGFILRQAHSLMGQLTAQRAGCNTEFFSAHEVADIPQPTLAGLDKEYRYDAALNLVAANDERQWLRYVVNGNGQVTSVSDGDRLREHYQYDASGYPSRRFDGLNEIDGERLYQKGHRLRQLGQHLFEYDDAGRMTAMQLWQEGHRPQLTKFRWNSQNQLIGVLTPGGQQWDYRYDAFGRRTEKVCGQAGMRTTYLWDGDVPAEIREYRHNRLYSIRHLVFDGWQLLAQQVQFFTLNPENRHELLAGEIQTQYAVCAPTGEPLALFDAGGHRVWRQPAQSLYGLRLGVPGENAELNPGLKFAGQWLDEESGLVYNRFRYYSPVASCYLTPDPIGLLGGENPYAYVHNPTGQIDPLGWAEWKPGKFDEWFNKATVQDVIDNKASVSSALRGNGGKHEMFPVSLAAKAKELGFTAEELKKYVVDTDKITFTNVTDAKGNPVPDGGHHGSRAGRHFHNKLIADLKEATGKFGAKKIMVRHHRNHMIYSEKCGR

SEQ ID NO: 8196 - protein, 139 aa, Xenorhabdus bovienii
  Coding DNA sequence: Name=SeqID_2088
  Homolog annotation: Query=6..139bp; Hit=6..139bp; Blast score=203; Percent Identity=75.0; E value=4e-52; Homolog= gb|AAN64197.1|
MSAHPYQMNEGTLTIPADWRDESMHVFVLPDDSGVNLVINRTPVPMGMDAAAYYEQTLTQFVTHLPGYQEHQRLQIELSGEIAWRLDYHWQSPEGEMHQTVVLQIRGRQLLAFNLTSPQPFNAGQRDALLAVVTSFQAA

SEQ ID NO: 8197 - protein, 45 aa, Xenorhabdus bovienii
  Coding DNA sequence: Name=SeqID_2089
MVFSFSLFLRLSVYSSAQPTRERRWLASSCYRLIRHGILFWFSAG

SEQ ID NO: 8198 - protein, 720 aa, Xenorhabdus bovienii
  Coding DNA sequence: Name=SeqID_2090
  Gene classification: Gene name=VgrG; Function=Uncharacterized BCR; Function class=S Function unknown
  Homolog annotation: Query=115..720bp; Hit=3..624bp; Blast score=523; Percent Identity=44.0; E value=1e-148; Homolog= Z0267 COG3501
MSIKKNIAKLKKGRALVQQGQQAANMAKQAAGVLGGLGGAGTPRLPSIQGIAGPVASGGLGGASSPRLPVQGIAGPIASGGQGLVERAAGGQHAASKALQKASQLLGGGGGTAPSGLQFTLTAGGLPPETFVVTDFSLTEGFSQPFHLTVGLASADPAIDFPAVLDRSATLTILQEGVEQRSITGMVARFEQGNTGLHQTTYQMSIYPDLWRTTLRQNSRIFQQLDIAAILTTLLKEHGIRDVVFSLRHPHPAREFCVQYQESDFTFLQRLTAEEGIFYFFECGSGRNTLVFADDAGSVPPGIVVPYQPGEGSTTGVPSVGSFTCSAQVRPAQVQLKDYTFKNPAWPAEFSRQMKEDTLQQRYYEHYDYPGRFKDEAHGEAFTRYRLEALRSDAVTGQGSGQAIAVQPGKLFTLDNHPRADLNQPWQVVSASHTGSQPQARETASSDSGTTLHSQFSFIRHNQHWRPAPRPKPTIDGPQIAKVVGPAGEEIFCDQYGRIRLQFPWDRYGKSDDQSSCWIRVSQPWAGQGWGMLAIPRIGQEVVVDFLHGDPDQPIVTGRTYHASNIPPGALPGSKTQMAFRSKTHKGEGYNELLFEDAKGSEQLALHAQKDMNTTVLNDRTTRVTQNHTETIGGKQVITVRQDRHKEIVGKDVTAINKEQEVTVNETSLLSVKKTITLKSLEGDISISTAGASITLKQSGEINIEGTTVTINGSNVITLN

SEQ ID NO: 8199 - protein, 463 aa, Xenorhabdus bovienii
  Coding DNA sequence: Name=SeqID_2091
  Homolog annotation: Query=1..437bp; Hit=1..435bp; Blast score=484; Percent Identity=64.0; E value=1e-135; Homolog= gb|AAN64195.1|
MSEHPENLIIRAGGSPQNLPEFAVIRDEINKISHPAQPEVNWVLVESLSLTLFRRNGVDLQTAIYYTLARMQLNGLAGFTEGCELLAGVIVSEWDALWPPQPAVRTDLLEWFHTRTGSQLRQMDFGTGDLRMIYRAERALQLIIDRLQQSDLKRLPRVENLLWFFQNAAKKLEKPRPAAKPVQSPVQMPPLVYLSQSDTEPEMPPPSAPPRPDRPPEADSPRVRVQFPEPPRGWSAWQGFGLGALLGVLVLVGSGLLFYQPLHQQLTAITASPAGARLAWLTEPALAGYQGQLDRLAETPLLATWDAARTLTDTAEKQWPESAEQRSATRQWTQAMTARIDSIPLKGSWHTTRDQLQQLADKILLQERTRGSFTLSYLKTAVYDLQRSHGSEVPLEELLRQLNARVASGEAVPPVLLKGIDDRFNALLGRYDRLRQATENPAEKQTEKQTTHHESTVTPDGGH

SEQ ID NO: 8200 - protein, 1189 aa, Xenorhabdus bovienii
  Coding DNA sequence: Name=SeqID_2092
  Gene classification: Gene name=IcmF; Function=Uncharacterized BCR; Function class=S Function unknown
  Homolog annotation: Query=38..1189bp; Hit=2..1144bp; Blast score =1213; Percent Identity=54.0; E value=0; Homolog= Z0250 COG3523
MKWPSLSSLAPLKSALPALSKFKSLPRLKATMALALALIPGLLLIAVWVWGPEWKLRNDTPLDSLAARWLATALIILMVLLWIGIKAWRRLRQLEKLNLDVELKGVDPVRVDIEHQARYLDHWKAQLQRHLDSYNYLYQRPWYMMIGSQQSGKTTLIKEGYKLSDIAAPEYLRQDGDISLRLRCWLGEKAVIIDPEGGLIDQPVPVNSDKPQINSRLWESLLNWLTENRQRQPLNGIILAVDTLRLLTDNREQRDRYVREIHQRLQNLRLTFHSQLPLYLVMTKIDLLHGFEAMYPSLDRRQRDQILGVTFSLNNRDEKAWRSELEQFWQQWMANLNGAMPDMMLNGVDAGQRSALFSFTRQVQGLHSYIAQMLEDILYNDEHHRPMLRGVYLTSARQVGQMDDLFTQSASAQYHLGSQAFPTWPAGDTLPYFTQALFEEVLLAEPNLAAENRLWLSRNRRQLYTFSTVSALVIVAMWGGWHYFYQKNYQAGEEVLAQAKNFLSVPPPDGDDRYGHLQLPLLNPIRDATLAYGNYHEKKSFLTDMALYQGDGVGPYVEGTYLKLLEQRFLPSLMQGLLDDLNRAPAGSEEKLEILRVMRMMEDGSKRNNGLVGQYMRARWSKAFHGQRDLQAQLLTHLDYALAHTDWKGQRDRDNQDALARFAPFIKPMKQAQQELSALTINQRVYQNLRLKAQDTLSAPVNLRDQIGPSFDSVFIAGNDSRLVIPQFLTRHGLTDYFVRQDKELVELTEMDSWVLNLPLKTNKYSDTDQGNIQREITELYVGDYTAHWRAAMNNLEVRDFEDLPQAISAIEQVISGEQPIKRALQILSDNTRPPELGGALSDKEKQALLAQSDYRLLNRISRDFAPETGVLLEHGDKGSALQSVYQKLMALHRYLLAIQNSPVPGKAALQAVQLRLDQNNSDAIFEVQQMAKNLPEPLNRWVGDLAEQAWRVVMMEAVRSLEVEWNETVVKQYQTYLAGRYPFNPAATEDVPLSEFDRFFRPDGTLDTFYKQSLKPFVENNLTTGTDGRELIRPDVLKQLAVADRIRTTFFTPQNGLGTAFAIEPVSLTGNKRRGLLNLDGQLVDYAHGRSNVAHLVWPNSMRAGTESRLTLMPDRSNAAPRSLSFTGPWAQLRLINSGKLTNVQPGAFDVRFAVDGGEITYRIYVDESDNPFAGGLFSQFRLPDTLY

SEQ ID NO: 8201 - protein, 478 aa, Xenorhabdus bovienii
  Coding DNA sequence: Name=SeqID_2093
  Gene classification: Function=Uncharacterized BCR; Function class=S Function unknown
  Homolog annotation: Query=208..462bp; Hit=6..259bp; Blast score=236; Percent Identity=51.0; E value=3e-62; Homolog= Z0251 COG3515
MDIRTQFDWFGALLAPLSDEQTGKALSESDPAWEFIDGEMVKFGSLSHGTLEVDALQRQALQLFSEHSKDFRLMVHLLRTLQHAGHPAELILAIELLTEYVKNYWEKAWPVKPGLKRRLAQQVIKRFESAQAGFTEQASKSQRDEAQGALAHLAQCWHANEPDLAKDVDQLRTRYNRQPEARTAPAPPAPTAPQAASAAPSSHAPEQAPMPDVAVNSSSDKAWKQTLMIVADLLCERYPESPIGYSLRRHAVWHTITTAPMANATGKTPLAPASADRTADYLARLPTADNKLLAQIEQSLTLAPYWLDGHAIAAQAAEQRGYSHVAQAMRDELNAFLARLPVLKTLSFSDLSPFISPDTLDWLTPEPDTSGNPGAVSADQEAIWHCFQQQGLEAALKMLEEHQQLLTEPRDQFYGQLFTAQLLEEAGMTALAQQHYRNLLHTGQHMLLTEWEPSLLTLLAEKIPSPAKDTASHRSVNT

SEQ ID NO: 8202 - protein, 221 aa, Xenorhabdus bovienii
  Coding DNA sequence: Name=SeqID_2094
  Homolog annotation: Query=1..221bp; Hit=1..215bp; Blast score=251; Percent Identity=60.0; E value=6e-66; Homolog= ref|NP_927716.1|
MNIVLIISALLASLGGDPKLANLVEPKEVAAPKEEYVDEMQKCRFEPSPLVRLACYDRTVNNLKFNALQIPMENMGLVWRQAMEQEMKRTDYSTGFIVTQGENGEAPVILTTPAVGVPPPRPVLMLSCIDRITRLQVALPKPMESGTVTVATDKTQFKTEWFLREHGYLWESSRGLPGIEEIKRLMNSDQMTITARTGSPITFNISQLEQAAKPLRDACRW

SEQ ID NO: 8203 - protein, 264 aa, Xenorhabdus bovienii
  Coding DNA sequence: Name=SeqID_2095
  Homolog annotation: Query=1..264bp; Hit=1..266bp; Blast score=350; Percent Identity=69.0; E value=2e-95; Homolog= ref|NP_927717.1|
MKQRLKSALALLDDDTIEQLVGHFLLVSQSSRFDALLVFLLNTNENRLECYNLPELHQASSRRLNVDIDDVNNPLIQVLRKGAPTVWDSLNHGARIDDVPFRTFVAELPHNCGLYAIPLFDCNGQACGVIAIFAEHVSHFINNENMFGLYCHVMQHRLKKLQELEQLRGQLRQIRQVFQVQQQKEKQLDELLASLSGSKPAGVSRISVDYSHIDNLPKAIEEFESAVLVQRQRQYGNDTRLIAQSLGIAPRSLVYKLAKYGCRL

SEQ ID NO: 8204 - protein, 904 aa, Xenorhabdus bovienii
  Coding DNA sequence: Name=SeqID_2096
  Gene classification: Gene name=ClpA; Function=ATPases with chaperone activity, ATP-binding subunit; Function class=O Posttranslational modification, protein turnover, chaperones
  Homolog annotation: Query=1..904bp; Hit=1..911bp; Blast score=1125; Percent Identity=68.0; E value=0; Homolog= Z0254 COG0542
MIQIDLPTLVNRLNPMTRHALEAAAASCVSQQQPEITVAQLLFQMIDTPLSDVRLILNKADIDKDLLKEQLDQMMPHHQAIVQTYPNFSPMLVEWLQDSWLLASTEMQHTELRGGVMLIALLFSPMRYLTPQPARMLAGINRELLRQNFAEWTNGSAEQPFSGDDKNGQGVHPANSDSLLARFTQNMTEQARQDKLDPVLCRDNEIDLMIDILCRRRKNNPIVVGEAGVGKSALIEGLALRIINDRVPDKLRNSELMTLDLGALQAGAAVKGEFEKRFKGIMAEISQSSKPIILFIDEAHTLIGAGNQAGGLDISNLLKPALARGELKTIAATTWSEYKKYFEKDAALSRRFQLVKVSEPSAEEATVIMRGLRAIYEQAHGVLIDDEALKASAVLSDRYLSGRQLPDKAIDVLDTACARVAINLTSPPRQISSLTTELHQMQMEIDVLKREQRMGLNEHAERLEELQNQQVEIQEELVTLEKNWRQQQELVTQIIELRSQLLADSDESVAAETMDKTIENAVEETAEDAEEQEAIAQDEPEVAADEQSLIEKLALLNAQLAELQQKQTLVSPHVDKTQIASVIAEWTGVPLNRLSQSELSIVTELPTHLGQSIKGQEVAIQNLHKHLLTARADLRRPGRPLGAFLLVGPSGVGKTETVLQIAELMFGGRQYLTTINMSEFQEKHTVSRLIGSPPGYVGYGEGGVLTEAIRQKPYSVVLLDEVEKAHPDVLNLFYQAFDKGELADGEGRIIDCKNVVFFLTSNLGYQTIVDHAEQPDQLNDLLYPELAAFFKPALLARMEVIPYLPLGHETLKTIIQSKLARLDNLLSQRFNAEVTISDDVSEEILQRATRAENGARMLESIIDGALLPPVSLLLLQKMAAGTAISAICLTAVEHEFHAEVEEAE

SEQ ID NO: 8205 - protein, 255 aa, Xenorhabdus bovienii
  Coding DNA sequence: Name=SeqID_2097
  Gene classification: Function=Uncharacterized BCR; Function class=S Function unknown
  Homolog annotation: Query=22..255bp; Hit=20..253bp; Blast score=278; Percent Identity=61.0; E value=4e-75; Homolog= Z0255 COG3455
MSDINVGSPSLEKSETLKTFQRQYQLPLRGESLNPMIDAATPLLGMVLRLQDMSDQALPDKLYQQVVTDIRAIEQFLQTKGYEPGAIVSFRYVLCTFIDETALGHGWNSQNGWLKQSLLVHFHNETWGGEKVFVLLERLMGEAQRYQHLLEFIYLCLCLGYRGRYKVSTQKSDDFDRLFRRLQQQLHSLRGEAPPTTLYVDINERDERYRLSRRWTIKHLFWISVGLLAAIYSFYAIRLGDQTQDILKQLSNLLR

SEQ ID NO: 8206 - protein, 450 aa, Xenorhabdus bovienii
  Coding DNA sequence: Name=SeqID_2098
  Gene classification: Function=Uncharacterized BCR; Function class=S Function unknown
  Homolog annotation: Query=4..447bp; Hit=5..443bp; Blast score=456; Percent Identity=50.0; E value=1e-128; Homolog= Z0256 COG3522
MPGKNRVIWHEGLFIKPQHFQQQQKHNDYLAHSLVSVLAAYGHGFSSLSINQDLLNLGRIGITEASGIMQDGTIFSAPSQDLLPKPLDIESVNDLKSKDIYLALPMSSDTIREIADKEAEIQSAVRYRELPSDVRDLHTKGGDSFALNLAQLTPVLMQGSEDMSAYTAIPLCRIKEKQKDGTIVLDSEFIPTCLSIFVADKLRRFMVEIDGLLTERSRTLAKRIGSPGQQGVADVAEFMMLQLLNRVQPLFNHYAKQTVLHPLHLYTQLLQTCGELRTFTDASRLPGNVLAYDHNNLTDTFQDAMHAIRDALNVVLTPRATSIVLKQNEGGIRVATLHDNDLLRKAEFVLAISASTPQEQLRRQFVQQTKVTSMEKIRDLVSVQLPGVPLIALSAAPRQLPYHSGYTYFRLDQKSPAWKEIQQGNSIAFHVSGDFPDLDMQLWAIRGGKE

SEQ ID NO: 8207 - protein, 184 aa, Xenorhabdus bovienii
  Coding DNA sequence: Name=SeqID_2099
  Gene classification: Function=Uncharacterized BCR; Function class=S Function unknown
  Homolog annotation: Query=16..184bp; Hit=10..174bp; Blast score=159; Percent Identity=45.0; E value=1e-39; Homolog= Z0257 COG3521
MKHSASHRVWAVGILLLSAMLLNGCSGAWNATKKVGQVIWDPSTPVGKPDEQASVANITLLAEPNINPNESGEAAPVEMNLVYLSEDSRFLAADYDQLESDKLEKALGKNYIDHQDYTLLPGQYKPLSTLILEKNNRYIGVIVHYADANQSEWKKIIRVKDIGRHYNILVHVRNNDVELRKEEE

SEQ ID NO: 8208 - protein, 431 aa, Xenorhabdus bovienii
  Coding DNA sequence: Name=SeqID_2100
  Gene classification: Function=FHA-domain-containing protein; Function class=T Signal transduction mechanisms
  Homolog annotation: Query=2..420bp; Hit=10..426bp; Blast score=331; Percent Identity=45.0; E value=8e-91; Homolog= Z0258 COG3456
MEKQQPTLSLRVLNSEQLESGRSASCLFSAQGGTVGSSESHLWSVQDQQGNIHPSQFSVQWRDGAFCLQVLAEPVQINNAALTSQSSLIRLQQGDQIKAGNLSIKIHISFSDADRVDPSTVSPESLVSSYSNPLDAMMEGAVAQKAVFADDNSIAPTIQHSFSDDPLRVLDSESLTTLKQQVEANDTEQLLPPDHFQTPPFANPISDNRGSVMDQEFLDLPGITSDRQYADMDVDHVAITPLMRGLDAQLPLHDSQQANDFLQEMGKTMKAAIEGLLALQREQHGLRDKQLRPIEDNPLRLNMDYDTTMQVMFSDQKSPVHLSAPAAVSESLHNLQLHYQANREAISAALDTMLEAFSPDQLLRRFSHYRRSNEVRNKDAAWAWEMYTNYYRELASSRQQGFEKLFREVYEQAYDRALRQGLEDSSNETFR

SEQ ID NO: 8209 - protein, 350 aa, Xenorhabdus bovienii
  Coding DNA sequence: Name=SeqID_2101
  Gene classification: Function=Uncharacterized BCR; Function class=S Function unknown
  Homolog annotation: Query=15..348bp; Hit=23..358bp; Blast score=353; Percent Identity=53.0; E value=2e-97; Homolog= Z0259 COG3520
MASTDRSTLIDVITEQDPATPLALDISQYNFYQLVELLNQLAVAWEKTGETDRPDRESVRFRASASLAFPTRDVISLSQARRGYFELEVSFMGLHGSQSPMPGYYLDSLAWEEAQNENRLTDFLNLFNHRLITLLHQIWRKYRYYVCFKKGGDDHFSQRMFSLVGLGSDVNRRMLNINHSKMLAYAGLLASPGRSPEVICSLVSHCFDLQDVTLHGWQFRKVTIPLDQQNRLGSERKGQVIGDSKLSMLGQNFTIGSWVGDYSGKFLLSINNLTRDRFLSFLPDGKNYAPLVMFISFVMRSQFAWELRLGLAENQVSGMVLGAQQNNHLGWTSFLGEPEKKPFVTISVME

SEQ ID NO: 8210 - protein, 610 aa, Xenorhabdus bovienii
  Coding DNA sequence: Name=SeqID_2102
  Gene classification: Function=Uncharacterized BCR; Function class=S Function unknown
  Homolog annotation: Query=4..610bp; Hit=5..616bp; Blast score=606; Percent Identity=50.0; E value=1e-173; Homolog= Z0260 COG3519
MSFEKYFRDELNYLRQLGKEAAVERPHLAAFLSEQGSDPDVERLLEGFAFLTGNLRAKIDDQFPELTHGLLNMLWPNYLRPTPSMTIIEYTPDESVVTKATPVKRGTQIMSNTLSTHDDIYSNEKSGGKRDEQSRCTFTLCRDVWLFPLSIQDISVNNSNEQGIIGLNFASKTELNLHELELDKLRFYLSGDDYTTSQLYFWLCYYFRKAELVVGDKVIPLPDFDFVPVGFEREDALLPYPKNAYMGYRILQEYFCFAESFLFFDVKGFPTLPEDLKTKDFKLNLHFSQALPPEAKIRHDTFRLHCTPAINLFPMDSEAIELNGSQTEYPLKASYSLPDNYDIFSVDGVESWLAGENGERSRARIGERVYTPFESFNHQIDDEDERSMRYYRLRVKESPFRRGLEHFISFVRGDESDLLRLKLKENVSISLTCTNRELPLQLRVGDINYPSIGSPTFATFRNITRPSVPLYPLLDGGLHWSLLSNMSLNYMSLLDKDALKQVLRTYDFPSIHNRQSKRSSQKRLDAIEKIETEPTDRLFRGQPVRGLRSTLYIRQQAFSSEGELYLFSTILSRFFSLYASVNAFHMLKVINLDNQECYEWPVQIGQHSLM

SEQ ID NO: 8211 - protein, 146 aa, Xenorhabdus bovienii
  Coding DNA sequence: Name=SeqID_2103
  Gene classification: Function=Uncharacterized BCR; Function class=S Function unknown
  Homolog annotation: Query=16..140bp; Hit=16..142bp; Blast score=97; Percent Identity=40.0; E value=3e-21; Homolog= VCA0109 COG3518
MAALYSWNRGSSASLFERIQGKGSGSSRQSRMRSLLDSIKKHLKEVLNSRPGACQSAIDLGVIDLNDATATSVDFKQSIEWAIEECIRNYEPRISAVSVSAINDDSDPLLLSFHISAEILLDDINDIVEFSIQLDNNRRYCLERTQ

SEQ ID NO: 8212 - protein, 492 aa, Xenorhabdus bovienii
  Coding DNA sequence: Name=SeqID_2104
  Gene classification: Function=Uncharacterized BCR; Function class=S Function unknown
  Homolog annotation: Query=15..491bp; Hit=15..491bp; Blast score=783; Percent Identity=75.0; E value=0; Homolog= VCA0108 COG3517
MAQHEENSTALASGATTSLLDEIMSQARITPENDGYYIAKQGIAAFISSILDTGANEEPINKLVVDKMIVELDKKLSEQMDEIMHAKPFQELESSWRSLKILVDRTDFRENIKINIIHATKDEMLEDFEFSPEIIQSGFYKHVYSTGYGQFGGEPVAAVIGNYAFTNSSPDIKLMQYVSAVGAMAHSPFLSSVSPEFFGVNSFTDLPAIKDLKSVFEGPSHTKWRALRESEDSRYLGLTAPRFLLRLPYSSVENPIKNFNYQENVSRDHEHFLWGNTAYLMASCLTDSFAKYRWCPNIIGPQSGGTVSDLPVHLYEAMGQVQAKIPTEVLITDRREFELAEEGFITLTMRKGSDNAAFFSANSVQKPKVFPNTREGKIAETNYKLGTQLPYMFIINRLAHYIKVLQREQIGSWKERQDLERELNMWLKQYIADQENPPTDVRSRRPLRAAEIKVLDVEGDPGWYQVAMQVRPHFKYMGASFELSLVGRLDKE

SEQ ID NO: 8213 - protein, 165 aa, Xenorhabdus bovienii
  Coding DNA sequence: Name=SeqID_2105
  Gene classification: Function=Uncharacterized BCR; Function class=S Function unknown
  Homolog annotation: Query=1..165bp; Hit=1..166bp; Blast score=184; Percent Identity=64.0; E value=3e-47; Homolog= Z0264 COG3516
MSKNSPGSVAPKERINIKYVPNTGDQTAEVELPLNLLVVGDLKGKKEDTPIEERQTVSVNKSNFNAVMNEANINLTFNVPNRLDEKNEEDMPVNLEIKSLSDFSPDNIAKKVPELNKLLELREALVALKGPLGNIPAFRTRLQSLLDDESVREQLLKELEIVNKK

SEQ ID NO: 8214 - protein, 46 aa, Xenorhabdus bovienii
  Coding DNA sequence: Name=SeqID_2106
MQSVKPNICLFLGGKSAYNFLQIDIGILKAGIEGVINLCLGFTSKK

SEQ ID NO: 8215 - protein, 42 aa, Xenorhabdus bovienii
  Coding DNA sequence: Name=SeqID_2107
MIIKFLFVIELELALQFANYFALHDFRFIIRSECSAAIVLFN

SEQ ID NO: 8216 - protein, 172 aa, Xenorhabdus bovienii
  Coding DNA sequence: Name=SeqID_2108
  Gene classification: Gene name=Hcp; Function=Hemolysin-coregulated protein (uncharacterized); Function class=R General function prediction only
  Homolog annotation: Query=1..172bp; Hit=1..172bp; Blast score=296; Percent Identity=80.0; E value=7e-81; Homolog= Z0266 COG3157
MPTPCYISINGKTQGNITAGAFTAESVGNIFVQGHEDEMLVQEFDHIVTVPTDPQSGQPSGQRAHKPFRFTVALNKAVPLLYNALASGEMLPTVELKWYRTSIEGKQEHFFTTKLEDATIVDIDCKMPHCQDPSKAEFTQLIRVSLSYRKINWEHTTAGTSGSDDWRAPIVA

SEQ ID NO: 8217 - protein, 32 aa, Xenorhabdus bovienii
  Coding DNA sequence: Name=SeqID_2109
MHKYMITYVTNLTDATVLILPYGSTHFCMTIY

SEQ ID NO: 8218 - protein, 48 aa, Xenorhabdus bovienii
  Coding DNA sequence: Name=SeqID_2110
VICQLLPLTCNQSDISEIFKLKIQSNKRTLLFYRYPTEILIKHELHLT

SEQ ID NO: 8219 - protein, 33 aa, Xenorhabdus bovienii
  Coding DNA sequence: Name=SeqID_2111
MVCSYIFILMIYYDSFWLCPILLLRVKSNVIRA

SEQ ID NO: 8220 - protein, 556 aa, Xenorhabdus bovienii
  Coding DNA sequence: Name=SeqID_2112
  Gene classification: Gene name=FhaC; Function=Hemolysin activation/secretion protein; Function class=N Cell motility and secretion
  Homolog annotation: Query=8..531bp; Hit=8..539bp; Blast score=191; Percent Identity=28.0; E value=1e-48; Homolog= PA0040 COG2831
MIKKTAIFILLCTALQVKASPEELNVILPTDETRRTLQDSSREIDQLIEQRRHQGLINRSGALSPQTVSPVLVEAPACLDIRSVYLQGITLLTLTDLNTLSALPDNCITSNDINKLSAEITNLYIAKGYITARVQFIPPSHHGELGINVVEGFIEAIEGGNRWINSQMLFPHLTNKPLNLDQLDQGLDQANRLQSNKTTLDILPGTVSGGSVIRLSNQHSTPWKISATTDNYGQKSTGKWISRLNASIDSPLGLSDFISLSGISTVDNPDTQYNRAATLFYSLPYGAATFSGFTSYSRYTSHPKLQNNVHKLHGNSQQSGMRMDWVFHRNQSQISTLNTQLVYKNFNNYFDSAKLSHSSQTLTVFSLGISHLQIIANGLITFDTGIEQGTPWFSAQTSTDNLNKQFTKGKLSVNLQQRFRLFDMSYRLNNQFYTQYSPNGLPGVEWLNITDRNAVRGFSKNTLSGDNGWYLRNTLSHSIPILKGSLDLRAGVDVGRVKGYRSQDGWQSSAGLSTGLTLRYQRLLADVEFSRGKLLSHQNRDKDESMQLLTRVSYTF

SEQ ID NO: 8221 - protein, 39 aa, Xenorhabdus bovienii
  Coding DNA sequence: Name=SeqID_2113
MDTASFPVGDNLNFFSCILLPLLTFFYCHVQPPESETLS

SEQ ID NO: 8222 - protein, 1482 aa, Xenorhabdus bovienii
  Coding DNA sequence: Name=SeqID_2114
  Gene classification: Gene name=FhaB; Function=Putative hemagglutinin/hemolysin; Function class=M Cell envelope biogenesis, outer membrane
  Homolog annotation: Query=14..294bp; Hit=11..298bp; Blast score=135; Percent Identity=35.0; E value=5e-31; Homolog= PA0041 COG3210
MQEKKFKLSPTGKLAVSMAIILATCSASFANGITPGGDAGHRPDVILADTGATVVNIVAPSDSGLSHNQYEDFNVNQMGAVLNNSLIEGSSELAGHLSANSNLNGQAASVILNEVISRNPSFLLGQQEIFGIAADYVLANPNGITCNGCGFINTNQASLVVGNPLVENGVLQGFNTFNNQNALSIKNNGLSHTDVLNFIAPKIDSHGREITAKTINITTGNNQISADGKILASQQADVGVLDSYYLGSMQAGRIRLLNTAEGSGVNLQGKVTASDSIDIKSYGDVKLQAANLKGGDITLQGNNVLSQGRLNQSSSDKDGSDNHQDSFSGLYVQQKQISESIARTQLEGKNITLVAKQNNRVMATDIVGDNVELAGADLKLGGQQLHQLTRDTKNKWILSWQYDVTKESDKYHHEGNTIKAHENVHLTASEGNAEVLGSKISAGNKLSVSAQKDVKLAGLLESEVTAEKGYKKNHTVGLQTGNWNKNHTAQRSIGSELNAGGDLGINAGANAEIIGSQVHSGKNLIVSADQQAKITVQSLVDNQSLAKSKKYWGGIAGGSNKDNLNKEETHHTSDINANGHLLLSGMNGVTITGSKVKAQQGAYVEANDGQLIIDNAVNNSYKKVDERTGTIFNITKNSNQEHNTQQTTSNSQLVSDTDLKLLSNKDINIIGSLVKSAGELEVNTSGNINVLAYGEQNSHHQEKTDLNWQYYAREAEDKQYRVGIGLEHTRDSQKTDVTTQRPSELNGGNLTVNASENVTVTGSKLVTTQGDAKVTGNNINFLTGENRTSTENSQVKGRGGLFLTGGMDRLGGGIEGGYASNGQSQNQTTAVVSKTQVTGNLELNAMGELKQQGTQHQVNGAYQANAGSSKNLATENTESNSTNQLRVDGEISGSADYSATTRPAEKTAKAVSEKKLDTSIAKIGLPNAGLELAAKGRSHYTGNSQSNAVVTSIQAGNVKVTTNGDAYDQGTQYQANKGDVSLTAGSHTSEAAYNRKDSHSSDTTGNARLRVYTSTGSDISVNGKGDGSYQATSNSSANAVTSGVQAQNGIDIQVTRDARYQGTTMNAGSGSTNINAKENIQFDQATNRNEQNRTGHNGEISLTVGTNPDGKNFSASAGGGYNTDQQNSTTAQTSTLTGEQGVNLNAGNNLALKGSDVSGKQVDLTAQRGKIELTSAQDTVNNNGWNVGLKGKGGMSSKARNNESGGSAGSSNAATDNSTDSSEAGNKIIDSKYNIGGEVKFGVNRLDTMTYHNGHVSGGNVTLTSGGDTSLKGTNITADHVTGNVGGNFNVESLKDSTHSLNVGLDAGLGYSKTVKGDDKATLPVPTADSSSSEAAPETTAADDKKEVPGLKDQLTAAFKGYSGKLKGNYDTLDREAIGEQSTLTGTHGVNLDVAGKTYLVGGKIDSAQGTVSMNTQQIGHQSVTGYDKGRNLGVNLPDSIVGLTGAAQKNIFSGKIPFVKNESHDTEIPATHSGIKGHQLN

SEQ ID NO: 8223 - protein, 47 aa, Xenorhabdus bovienii
  Coding DNA sequence: Name=SeqID_2115
MLLTMLTLCAESVCRKRVTGKTEKATDTDRSVAVGKRVIKWAELKDK

SEQ ID NO: 8224 - protein, 324 aa, Xenorhabdus bovienii
  Coding DNA sequence: Name=SeqID_2116
  Gene classification: Gene name=Rbn; Function=Predicted multitransmembrane protein; Function class=R General function prediction only
  Homolog annotation: Query=19..324bp; Hit=21..328bp; Blast score=394; Percent Identity=65.0; E value=1e-109; Homolog= yhjD COG1295
MLSDIEKKERSNTEKDNTPLQKGLDGSKKALSMTIRISNYIRRIPFIAHLIRTLQRFNDRMGSQFGAAITYFSFLSLIPILMLSFATAGFVLASNPDLLTRLINGIANSISDPSLANTLKNSVDTAVNQRTTVGLTGLAIALYSGVNWVGNLREAILAQSRDVWERHHTEKEKIYSQYIRDFFSLFGLLFALVITLSLTSIAGSAQATLVHALGLEGIEWLRPAWTLIGMTISISANYLLFLWILWILPRHQPERKALFQGTLMAAVGFEIIKYIMTIMLPRLASSPSGAAFGSVIGLMAFFYFFARLTLFCAAWIATAEKQSE

SEQ ID NO: 8225 - protein, 94 aa, Xenorhabdus bovienii
  Coding DNA sequence: Name=SeqID_2117
MSKIFQKRAIKFALYMDKLSVNHRLLFRRSPDFGYTFAANAPVIRFNFINNDKRRRRVFTQYIHQQLGCTFNQLLLLLGSRAFAGDSDVYKWHT

SEQ ID NO: 8226 - protein, 134 aa, Xenorhabdus bovienii
  Coding DNA sequence: Name=SeqID_2118
  Homolog annotation: Query=1..132bp; Hit=1..124bp; Blast score=64; Percent Identity=30.0; E value=3e-10; Homolog= ref|NP_461831.1|
MNNARELIAHRSIMELHQWIEDVFTNDQQKGAASLEKLLSCFSPEFSMITTRGHTAFFVQVSELFHQNIGNKPGLKIEIDSIKTLVNTGDTVVCQYRETHCMNDIKQARWSVVIIEFKEGNALWRYLHETSIVV

SEQ ID NO: 8227 - protein, 449 aa, Xenorhabdus bovienii
  Coding DNA sequence: Name=SeqID_2119
  Gene classification: Gene name=ProP; Function=77 Permeases of the major facilitator superfamily; Function class=G Carbohydrate transport and metabolism
  Homolog annotation: Query=6..442bp; Hit=6..441bp; Blast score=235; Percent Identity=37.0; E value=9e-62; Homolog= PA1313 COG0477
MTYRYRIAIIFLVGFFIDCINIFMSAIALPDIARNLSVSESTVTWVANSYILGLTLIIPISNWLASRFGTRQIMTASMLIFSIAAFFAGMATHFLSLALFRFVQGLGGGLLIPVGQALTLSLFKKHERAKISMIIMAVALIAPAVSPGVGGIIVDHFSWHWVFFSNIPFSLIAALLSFFWIKTEKTTAPKPDLSGLFLVSLSLASLLLGLSLYAEASIKFVPYILVITGILFALLYVRHYRRINNPVLDLNILTNIQMRFSIWVYYAVPGVFTGVNLLNIFYLQQELNWSAEKAGLLMLFYAAGSFCAILVCGRIYNQLGSVRLFFAGLVLHAAGIAILATVNTPQDQPLLIMAYLLMGIGGGIGANTAQTTAMLDFEGEDLSRASTIWNLNRQICFSIGATIFAMIFNVLQHKTTPATAYSITFIIAAISGLLPLLKLRQLAKSRETV

SEQ ID NO: 8228 - protein, 296 aa, Xenorhabdus bovienii
  Coding DNA sequence: Name=SeqID_2120
  Gene classification: Gene name=LysR; Function=Transcriptional regulator; Function class=K Transcription
  Homolog annotation: Query=6..294bp; Hit=4..297bp; Blast score=182; Percent Identity=34.0; E value=3e-46; Homolog= PA1312 COG0583
MMNNQLNRIQTFIAVVDCGSFTRAAERLLISKAMTSIHVKRLEESLNVPLLIRNSRGVALTEAGQLLYNEFSEIFINIQSSLDNVAEQYLSLSGTLRITSTIEFGDRFLLPLIGEFCKIHPQLNISYNAGSALNDLISDRLDLAIRLGVLRDSSLKSRKIADYKIYLVASPDWLEKNKLESVNDLRGVDWIANSNLQTPTHWELSHPALPSIDIRAKARFNTNSSTSIKTMAIAGFGVTVLPEWMIKTELKSGNLVRLFPEYSLPKQPVTIVFPNGHKIQRKCRVFIDYLVEKIKL

SEQ ID NO: 8229 - protein, 494 aa, Xenorhabdus bovienii
  Coding DNA sequence: Name=SeqID_2121
  Gene classification: Gene name=PqqL; Function=Predicted Zn-dependent peptidases; Function class=R General function prediction only
  Homolog annotation: Query=1..472bp; Hit=1..473bp; Blast score=479; Percent Identity=51.0; E value=1e-135; Homolog= ZyhjJ COG0612
MQGKKIGYLIGGAILATSYLAQAETLQPDPAWQQGKLENGFSWQALQTPQRPNDRIQLRLIVKTGSLAEKMQQQGYTYLIPKVVLFSSKDLSSQKLENLWRNAIDSKNPLPPAIVSYDFTLYSLSLPNNRPDLLKDALVWLSDIAGGAVFTPETLAQAMKATDHSVATLPADIRDPVWRMRLQGSTLLDHDPGASVSVPVDVKKVEAFYRQWYTPDAMTLYVAGHVDSRVLSERINQAFSPLKGKRQTPVAVATLLPLKSETLGVVSDKAQQDRLSLVWNLNWQPINDSQTLLQYWLNDLAREALYRYLQLGREEEQADMKLDLDCRILYQRANCFLNMDTSSDKLTESTLYLASELASLRENGLPQEQFDELYAQKRLQLQQLFAVYARTNTDLLINQRLISQQNNVIDIAPEQFQRLRQTFLSSLTPQLLNKKLKEMLSQDISFILVQPKDETAVNVNQLRNGFNQIMRPGPVPEAPAVDTKQAADIKKGAE

SEQ ID NO: 8230 - protein, 45 aa, Xenorhabdus bovienii
  Coding DNA sequence: Name=SeqID_2122
MAPPIRYPIFLPCILTYPYLFSFILVIPGFTCHSLTIHAKPLIPR

SEQ ID NO: 8231 - protein, 235 aa, Xenorhabdus bovienii
  Coding DNA sequence: Name=SeqID_2123
  Homolog annotation: Query=1..231bp; Hit=3..233bp; Blast score=339; Percent Identity=77.0; E value=2e-92; Homolog= ref|NP_927666.1|
MKLRVKRSLTIKQMAAVTGVALITIAIFITIQLSHLLQQRKDDYISQLNNAAAQIQVPLAEALLNSDLNKAKTLLIGLKTSGMLGRADVVSPDNARVMSLDFATYRPIPELAKQVFGIPVEVQIPLHIYGITSQTEASQGYLILQVDSNRVYRFALNTLALMLTTYLLLALILTVAISWCVNRIIIHPLRDVARALNEEQPTAPIPCPKNHQDDELGLLVKGYNRQIDKQKLRLK

SEQ ID NO: 8232 - protein, 42 aa, Xenorhabdus bovienii
  Coding DNA sequence: Name=SeqID_2124
MIWIMQTLLNINVMLRSFFCFELIKIRRPLEKSSILSHIIKV

SEQ ID NO: 8233 - protein, 343 aa, Xenorhabdus bovienii
  Coding DNA sequence: Name=SeqID_2125
  Gene classification: Gene name=OppF; Function=ABC-type dipeptide/oligopeptide/nickel transport system, ATPase component; Function class=E Amino acid transport and metabolism
  Homolog annotation: Query=20..343bp; Hit=11..334bp; Blast score=543; Percent Identity=85.0; E value=1e-154; Homolog= ZdppF COG1124
MSEQNIRNQNRREQEKATVPLLKATELKKYYPVKTGMFAPERMVKALDGVSFELEKGKTLAVVGESGCGKSTLGRLLTMIEKPTEGELYYQGQDLLVPDKQAEKLRRQKIQIVFQNPYASLNPRKKVGQILEEPLLINTSLTAAERKEQVLQMMEKVGLKPEYYQRYPHMFSGGQRQRIAIARGLTLNPDVLIADEPVSALDVSVRAQVLNLMMDLQQDLGLSYVFISHDLSVVEHIADEVMVMYLGRCVEKGSKDQIFNNPRHPYTQALLSATPRLNPALRRERIKLTGELPSPMNPPPGCAFAARCRRAFGHCTQFQPKLRQYDEQLVACFAVEQDENSAR

SEQ ID NO: 8234 - protein, 343 aa, Xenorhabdus bovienii
  Coding DNA sequence: Name=SeqID_2126
  Gene classification: Gene name=DppD; Function=ABC-type dipeptide/oligopeptide/nickel transport system, ATPase component; Function class=E Amino acid transport and metabolism
  Homolog annotation: Query=18..343bp; Hit=1..327bp; Blast score=552; Percent Identity=84.0; E value=1e-157; Homolog= dppD COG0444
MGCVTHSILSSSSRGIEMALLNVDQLSVHFGEEDAPFRAVDRISYSVEQGQVVGVVGESGSGKSVSSLAIMGLVDYPGRVMAEKLEFDGRDLTKISEKERRQLVGAEVAMIFQDPMTSLNPCYTVGFQIIEALKVHQGGSRKTRYQRAVDLLTLVGIPDPASRLDVYPHQLSGGMSQRVMIAMAIACRPKLLIADEPTTALDVTIQAQIIELLLELQQQENMALVLITHDLALVAEAAHHIIVMYGGQVVEAGKATEIFRAPRHPYTQALLQALPEFSTDKSRLASLPGVVPGKYDRPTGCLLNPRCPYANEHCRQVEPALKTVGESQVKCHMPLDDEGRPTV

SEQ ID NO: 8235 - protein, 316 aa, Xenorhabdus bovienii
  Coding DNA sequence: Name=SeqID_2127
  Gene classification: Gene name=DppC; Function=ABC-type dipeptide/oligopeptide/nickel transport systems, permease components; Function class=E Amino acid transport and metabolism
  Homolog annotation: Query=17..316bp; Hit=1..300bp; Blast score=409; Percent Identity=84.0; E value=1e-114; Homolog= dppC COG1173
MASSTHVSVIRNKEHMMTQTTEPAVSGAPKLMTPIQEFWHYFKRNKGAVVGFAYIVLMLLVALLANVLAPHGPAEQFRDSLLVPPIWQDGGSWQFILGTDDVGRDILSRLMYGARLSLLVGCLVVVMSLVMGIILGVLAGYFGGLVDTIIMRIVDIMLALPSLLLALVLVAIFGPSIVNASLALTFVALPHYIRLTRAAVLVEVNRDYVMASQVAGAGAIRQMFINILPNCLAPLIVQASLGFSNAILDMAALGFLGMGAQPPTPEWGTMLADVLQFAQSAWWVVTFPGLAILLTVLAFNLMGDGLRDALDPKLKQ

SEQ ID NO: 8236 - protein, 339 aa, Xenorhabdus bovienii
  Coding DNA sequence: Name=SeqID_2128
  Gene classification: Gene name=DppB; Function=ABC-type dipeptide/oligopeptide/nickel transport systems, permease components; Function class=E Amino acid transport and metabolism
  Homolog annotation: Query=1..339bp; Hit=1..339bp; Blast score=542; Percent Identity=88.0; E value=1e-154; Homolog= dppB COG0601
MLQFILRRLGMVIPTFIGITLLTFAFVHMIPGDPVLIMAGERGVSAERHAELMAAMGLDKPLWEQYLHYINGIFHGDLGISLKSRIPVWDEFVPRFKATLELGVCAMLLAISVGIPVGVLAAVKRGSVFDHTAVGISLTGYSMPIFWWGIMLIMLVSVQWNLTPVSGRISDSVFLDDSYPLTGFMLIDTLFWGEEGNFIDAVMHMILPAVVLGTIPLAVIVRMTRSAMLEVLGEDYIRTARAKGLSRMRVIIVHALRNALLPVVTVIGLQVGIMLAGAILTETIFSWPGLGRWLIDALQRRDYPVVQGGVLLVATMIILVNLVVDLLYGIVNPRIRHKK

SEQ ID NO: 8237 - protein, 536 aa, Xenorhabdus bovienii
  Coding DNA sequence: Name=SeqID_2129
  Gene classification: Gene name=OppA; Function=ABC-type dipeptide/oligopeptide/nickel transport systems, periplasmic components; Function class=E Amino acid transport and metabolism
  Homolog annotation: Query=5..536bp; Hit=4..535bp; Blast score=877; Percent Identity=79.0; E value=0; Homolog= dppA COG0747
MTISSKKKFSLLKLGIGLVALAVTASVQAKTLVYCSEGSPEGFNPQLFTSGTTYDATSRQIYNRLVDFKAGTTNVIPSLAERWDVSDDGKTYTFYLRKGVKWHSNKEFKPTRDFNADDVIFTFMRQKDKNHPYHKVSGGSYEYFIGMDLDNIISKIEKVDDYTIRFVLSRPEAPFIADLAMDFASVLSKEYADVMMKAGAPEKVDLNPIGTGPFQLQQYQKDSRILYKAFKDYWEGPAKIDRLVFSITPDASVRYAKLQKNECQVMPYPNPADISRMKQDKNIVLKEQAGLNVGYLSFNVDKKPMDNLKVRQALAMAVNKDAIIDAVYQGAGQKAKNLIPPTMWSYDDDIKDYAYDPAKAKELLKEAGFPNGFETDLWAMPVQRPYNPNARRMAEMIQADWAKIGIKAKIVSYEWGEYLKRAKDGEPQTVMMGWTGDNGDPDNFFGTLFSCAAKEKGSNYSKWCYKPFEDVIKPARETADTAKRTALYKQAQVVMHEQVPALIIAHSTVYEPIRKEVKGYLVDPLGKHIFYNVTLD

SEQ ID NO: 8238 - protein, 78 aa, Xenorhabdus bovienii
  Coding DNA sequence: Name=SeqID_2130
MCRLSYFYTVSVNYFLILCFSNVASVICDYVDVRHNNWLIDKRTTITQVGTASFRWKRWTWPRHDKHHKRSLSNDNLQ

SEQ ID NO: 8239 - protein, 52 aa, Xenorhabdus bovienii
  Coding DNA sequence: Name=SeqID_2131
LAKFKTFLLFYPYPHLILPRLFYKADCSFFKYSVTNFKLSPIEINSLYIHYF

SEQ ID NO: 8240 - protein, 47 aa, Xenorhabdus bovienii
  Coding DNA sequence: Name=SeqID_2132
MNKEKNNELSNRGDSVPERIAGGFRDKIQIDEQFYQTDRDITSMFNE

SEQ ID NO: 8241 - protein, 50 aa, Xenorhabdus bovienii
  Coding DNA sequence: Name=SeqID_2133
LVAQLVWDQWVGGSNPLSPTSIQKPCSLSRVFSYVLNKNSALTHSLISIH

SEQ ID NO: 8242 - protein, 37 aa, Xenorhabdus bovienii
  Coding DNA sequence: Name=SeqID_2134
MLVGERGFEPPTHWSQTSCATKLRYSPKTKRILLPSL

SEQ ID NO: 8243 - protein, 324 aa, Xenorhabdus bovienii
  Coding DNA sequence: Name=SeqID_2135
  Gene classification: Gene name=SSL2; Function=DNA or RNA helicases of superfamily II; Function class=L DNA replication, recombination and repair
  Homolog annotation: Query=85..295bp; Hit=134..358bp; Blast score=78; Percent Identity=28.0; E value=1e-14; Homolog= YDR332w COG1061
MLRQNWKQHRTFMVYSPTGSGKTGLAAFITDGYISREMRVMFCVPYTILVDQTAAKFTEYGLPEREISYVWRDHPNYDPTRLIQIASANTIIRREFPDNIDLLIIDEAHLRHKRMLEIIRDSDFPVIGLSGTPFAPFLGHYYEKLIKPTTMKELIQRGDLSKYEFYAPTKPDLSGVKSNQSAEYGSDYKEAEIAEIMCGSDLVGDIVSNWLANGNNQPTICFCVTVSHANFVTVEFNRAGINADIITAETPHEERQIMIHRFEQGATKILVNVGCLLAGFDSDVRCIIYARPTKSEIRWAQARFTALAIPMISNTTNCPARMTA

SEQ ID NO: 8244 - protein, 205 aa, Xenorhabdus bovienii
  Coding DNA sequence: Name=SeqID_2136
  Homolog annotation: Query=3..176bp; Hit=337..510bp; Blast score=240; Percent Identity=60.0; E value=1e-62; Homolog= ref|NP_930151.1|
MGSGTVHRLGYPDDIEYNELPSKNDGMKTRDSYREQEKREKLPKECSSCHYMKPAGVYVCPKCGFKPLTGEDVEVDTSRNIQKLSKKERVYTQAEKQSFYSQLKYYQNQRASQGKTISNGWVSNTFKDKFGAYPRGLHDTPQELTPEVNNFIKHKQIAFAKSRKKAEQVQPSSNEQQEMRLEVAHQKVRDIREALGRPSHQGGTL

SEQ ID NO: 8245 - protein, 59 aa, Xenorhabdus bovienii
  Coding DNA sequence: Name=SeqID_2137
  Homolog annotation: Query=4..49bp; Hit=1..46bp; Blast score=76; Percent Identity=60.0; E value=1e-13; Homolog= ref|NP_459878.1|
VNRIKTTEAVIGHWPEIFAYYKLPPVTGKNHFKGKCPICERKGKFRIDDMILKQACSHG

SEQ ID NO: 8246 - protein, 85 aa, Xenorhabdus bovienii
  Coding DNA sequence: Name=SeqID_2138
  Homolog annotation: Query=1..85bp; Hit=47..133bp; Blast score=89; Percent Identity=56.0; E value=2e-17; Homolog= ref|NP_930954.1|
MKLLCNYHKKGYQTVAKMIDRWAPNVENNTSAYIKGVAKALGVDPHQVISVDKVTLIVLAKSIIQHENGKQPYSNEVFEKAFNLL

SEQ ID NO: 8247 - protein, 289 aa, Xenorhabdus bovienii
  Coding DNA sequence: Name=SeqID_2139
  Homolog annotation: Query=1..288bp; Hit=1132..1425bp; Blast score =433; Percent Identity=72.0; E value=1e-120; Homolog= ref|NP_928235.1|
LGTLAPDAYDTVVINSVVQYLDKVLAQLLPAIAAGGTILLGDIRNLDLLTAHVTAIEQSHLGEQRISVGTMANRIQRRLQQEEEFLLSPTYFAQLSARYPEIGRVDILVKRGVGDNEMLCYRYEVILHKRDKNAASCHDQLITWFDFNAIEEVSSLLQAGTYDTFGISGIPNTRVKDDVELAEGLRHWPANQILFPPEYAGKFSPQAEKQVQAFESLFQYAEQCGYQCGVTWSQQQLDLLDVIFSRHSLPPVQARHEYNQTHLANYPQISAIGGELSELLETALKKTIT

SEQ ID NO: 8248 - protein, 577 aa, Xenorhabdus bovienii
  Coding DNA sequence: Name=SeqID_2140
  Gene classification: Gene name=EntF; Function=Non-ribosomal peptide synthetase modules and related proteins; Function class=Q Secondary metabolites biosynthesis, transport and catabolism
  Homolog annotation: Query=1..568bp; Hit=111..663bp; Blast score=246; Percent Identity=27.0; E value=4e-65; Homolog= PA2400 COG1020
MVPSIYIPMERMPLSLNNKIDKKALPVPNDNDLHHQTYVAPRDEIEKKLCQLWQNHLKINQVGIYDNFFSLGGHSLLAVKITTSIKNDLSNNFSMNQMFTNPTIAQIASVIRSAQGHDISTLLPIQNVFDGRIPISYYQKMFWSLIKEEALDDAFNVPISLLIEGELNQSALEKSLHVILERHESLRLRFYEEDEQVFIKPNNNMRINLQIIDSLPKGIEKEQITIEINKLWEEELRIPFDVYNGPLFKTFLLPVSKTRHVLLINIHHIIFDGWSINIFINEFKKLYTAYSQEQDVILPAVAMQYSDCVYDLQERHKTEKYQNQLKFWQQQFADLDMNERIFPVAFSKHLTTKYQFKVISINTPKSLDNAVSRYCEIHKITPYMLYMALFHACLFMYSGESQHIATSPQADRSHIDSHQTIGLFLNDLIVKSTISKEMSLHDIIQQISNFIYKALENSDVHMAAVIDSIGEKARDNIFNILFNYMDAHNFYNYADSPDSGKISLPNLDMELIKVDPTPFQSLGINFINIPQNIMCELSYNPELYTEETANNLVRYYERLLEAFVSGQDKENISYFYD

SEQ ID NO: 8249 - protein, 245 aa, Xenorhabdus bovienii
  Coding DNA sequence: Name=SeqID_2141
  Gene classification: Function=Uncharacterized ACR, predicted metal -dependent hydrolases; Function class=R General function prediction only
  Homolog annotation: Query=5..244bp; Hit=4..244bp; Blast score=239; Percent Identity=48.0; E value=2e-63; Homolog= PM0097 COG1878
MTHDILQALTLLKSKKWIDLTHSFDECSPHFFMFQPAEFKTIFNYKNGFFVQQLTFPGQYGTHLDAPCHFVSDARSLDELELKELVLPLIVIDQSERAKHNPNFSLSKDDILQFEAEHGMIEADTFIALRTDWSKRWPSQEKMDNKDDQGNNQTPGWGLDALKFLFEERHIKAIGHETFDTDSAKDFRQNNALIGEYYVLAQDTYQIELLANLDQVPVRGAVILNIVAKPKNVSGFPVRSFAIVP

SEQ ID NO: 8250 - protein, 137 aa, Xenorhabdus bovienii
  Coding DNA sequence: Name=SeqID_2142
MQGNNINKVIVFAMLFIPRMGFSLVDEDLDYCAKKESWVAYKVIEKAVEKNNRLDKHRAVSTLIARHKLKKEELPITFSEWGQLYSQTTKIIIPFIDNQVPPMTLITSSIISAAECSLTEPTYFDITPNSYPKDDTP

SEQ ID NO: 8251 - protein, 124 aa, Xenorhabdus bovienii
  Coding DNA sequence: Name=SeqID_2143
  Homolog annotation: Query=1..121bp; Hit=1..121bp; Blast score=118; Percent Identity=71.0; E value=2e-26; Homolog= ref|NP_929218.1|
MKNDLDLLSAYQRILSLSEQMLDLAKNEQWDELVDMEITYLKAVEVVTLLSENSDAPLSLQQKLTQILQTVLDNEKETKRLLQKRLDELSDLIKQESCKQLLHDTYGQFPVSDYEMELTTTEPK

SEQ ID NO: 8252 - protein, 136 aa, Xenorhabdus bovienii
  Coding DNA sequence: Name=SeqID_2144
  Gene classification: Gene name=FliS; Function=Flagellar protein; Function class=N Cell motility and secretion
  Homolog annotation: Query=1..124bp; Hit=1..124bp; Blast score=120; Percent Identity=53.0; E value=5e-28; Homolog= fliS COG1516
MYQRSASQLYAQVDLESEIMNASPYQLIQILFNGALSALRRAIILMQQGNIPEKGLAISKAINIIDNGLKEGLDFEKGGEIAQNLFALYDYMNRRLLHANLRNDEKAITEVIDLLTEISDSWRQIGPHYNASQDIV

SEQ ID NO: 8253 - protein, 478 aa, Xenorhabdus bovienii
  Coding DNA sequence: Name=SeqID_2145
  Gene classification: Gene name=FliD; Function=Flagellar capping protein; Function class=N Cell motility and secretion
  Homolog annotation: Query=1..475bp; Hit=13..456bp; Blast score=230; Percent Identity=37.0; E value=2e-60; Homolog= ZfliD COG1345
MDLGSILDKLQAAERKRLEPLAQQQTSYKAKLTGFGTLKGSLEKLKSASEELKKFDKLNTTKVSEDHKTFTPTTDSKASPGNYIIEINQLAKAQSLQSTAVSNVKSPQGDILGEGKTRTIVITQPGEEKPLRISLKDDETSLIEIRDAINKQEGNVNASIIKATDNKDDKGENKNYLILTSKKAGIQSVMTIKVEGDDKLGNLLNYTSDYTSGSESTPKSGSGAMKQTVEAANAKLKVNGIDIERQTNEIKDAPEGITLNLKKLSEKSEDGKMSKPETLVVSRDIEPTKEAIKKWVEAYNGVQTTFESLTKFKPVAKGESASKDNGALLGDGTLKSIQSQLRHQIFSPQDVADIATLNKLGIKQKLDGTLEISNEKLEKNLKEKPANVKAFFMGDGEKTGFATQTYNILKQTLDSHEGTIATATEGINKRLKTLERQVEQTNKNIDATIERYKRQFTELDKLVNSLKSTSSSLFQLLR

SEQ ID NO: 8254 - protein, 323 aa, Xenorhabdus bovienii
  Coding DNA sequence: Name=SeqID_2146
  Gene classification: Gene name=FlgL; Function=Flagellin and related hook-associated proteins; Function class=N Cell motility and secretion
  Homolog annotation: Query=1..225bp; Hit=1..222bp; Blast score=211; Percent Identity=62.0; E value=7e-55; Homolog= ZfliC COG1344
MASVINTNYSSLLAQNNLTKSQGTLGTAIERLSSGLRINSAKDDAAGQAIANRFTANVKGLTQASRNANDGISIAQTTEGSLNEINNNLQRIRELAVQAQNGTNSESDRKSIQEEVTKRLDEIDRISAQTQFNGVKVLSKDTTLNIQVGANDGEKIAIDLQRIDKETLKLGDFSVELQRTDAEKKEITAAEGKVKTAEEAAKKATGAAKTAAEATLKTEQAALEKAKETGALPADTLVKLDGALSKVDSLRSSLGAVQNRLESTVNNLNNTVNNLSAAKSRIEDADYATEVSNMSRGQILQQAGTSVLAQANQVPQSVLSLLR

SEQ ID NO: 8255 - protein, 240 aa, Xenorhabdus bovienii
  Coding DNA sequence: Name=SeqID_2147
  Gene classification: Gene name=FliA; Function=DNA-directed RNA polymerase specialized sigma subunit; Function class=K Transcription
  Homolog annotation: Query=1..236bp; Hit=1..236bp; Blast score=342; Percent Identity=80.0; E value=2e-94; Homolog= fliA COG1191
VSDLYTAEGVMDKNSLWKRYVPLVRHEALRLQVRLPASVELDDLLQAGGIGLLNAVERFDSLQGTAFTTYAVQRIRGAMLDELRSRDWAPRSVRRNAREVTQTIRKLEQELGRPASEQEVAKELKINLIEYRQILLDTNNSQLFSYDEWHEIHGESCEPVIEEEHETNPLQQLLEGDLRQRVIDVIESLPEREKMVLTLYYQEELNLKEIGAVLNVGESRVSQLHSQAIKRLRARLNPEK

SEQ ID NO: 8256 - protein, 170 aa, Xenorhabdus bovienii
  Coding DNA sequence: Name=SeqID_2148
  Homolog annotation: Query=1..170bp; Hit=1..170bp; Blast score=296; Percent Identity=94.0; E value=1e-79; Homolog= ref|NP_929223.1|
MSVTTQKKRPLSRYIKDYKHSQTHCLHCHKTLDRISLVFNGQVINKEAISEMTELVDDKTWDELQGKFVALCRFCSEIYCNSQTDYFDIMSFKQYLFEQTEMSHSTVREYVVRLRRLDELLTSSNYPAQEFTPEKIQEKLSEKLSQSAFSNYNIALRKYEQYLSWQQNGH

SEQ ID NO: 8257 - protein, 1321 aa, Xenorhabdus bovienii
  Coding DNA sequence: Name=SeqID_2149
  Gene classification: Gene name=PutA; Function=NAD-dependent aldehyde dehydrogenases; Function class=C Energy production and conversion
  Homolog annotation: Query=521..1321bp; Hit=1..795bp; Blast score =1157; Percent Identity=73.0; E value=0; Homolog= ZputA_2 COG1012
MGVKLDEATRNRIKSAAQRIERTPHWLIKQAIFNYLERLENEEKIPEISVFQDNKEEKISEEESQIEAPYQPFLDFAEHILPQSVKRSAITSAYRLPETQAVPMLLQRAQLSEEQAKATHKLAYSIAEKLRQQKHGIGRSGLVQGLLQEFSLSSQEGVALMCLAEALLRIPDKATRDALIRDKISNGNWHSHLGQSASMFVNAATWGLLFTGKLVSTHNEAKLSKSLNRIISKSGEPLVRKGVDMAMRLMGEQFVTGETIAQALANARKLEEKGFRYSYDMLGEAALTEEDAQAYMVSYQQAIHAIGKASNGRGIYEGPGISIKLSALHPRYSRAQYERVMDELYPRLLSLTLQARQYDIGINIDAEEADRLEISLDLLEKLCFEPKLEGWNGIGFVIQTYQKRCPFVIDSIIDLAQRSRHRLMIRLVKGAYWDSEIKRAQIDGLEGYPVYTRKVYTDVSYLACARKLLSVPNLIYPQFATHNAHTLSAVYHLAGQNYYPGQYEFQCLHGMGEPLYEQVVGKIADGKLNRPCRIYAPVGTHETLLAYLVRRLLENGANTSFVNRIADTSLPLDELVADPVTVVQELAQSEGQIGLPHPKIPLPHDLYGKNRVNSSGLDLSNEHRLASLSSALLSSSMETWNSVPLLGGDYAHTGELPTAKPVNNPARPSDIVGYVREATEQEVSHALDVATDAGTIWFATPPSERAAILVRAAELMENNLQSLLGILVRESGKTFNNAIAEVREAVDFLYYYADQVRQDFANDTHRPLGPVVCISPWNFPMAIFTGQIAAALAAGNSVLAKPAEQTPLIAAVAVKMLHQAGIPRDVLQLLPGQGETVGALLVGDERVRGVMFTGSTEVANLLQRNIAGRLDAQGRPTPLIAETGGLNAMIVDSSALTEQVVTDVVASAFDSAGQRCSALRILCVQEDVAERTLTMLKGAMAECRMANPEHLSTDIGPVIDAEAQAGIERHIQTMRTKGRAVYQAVHENEADSQESSQGTFVKPTLIELESFDELKKEIFGPVLHVVRFNRNELDKLLEQINASGYGLTLGIHTRIDETIAQVTAKAKVGNLYVNRNMVGAVVGVQPFGGEGLSGTGPKAGGPLYLYRLLSQRPVNAASQTLERQDEEYQLDANVRVALRSPFNKLAEWATAQNNEALSKVIQEYSLLTQGGTIRLLPGPTGERNTYTLLPRGETLCLADNEQDTLVQLSAVLSVGCQAIWEKDELHQQLLRQLPDEVRHSIRLINDWQNEETEMEAVIYHGDCDQLRHVCGIIAQRQGPIVSVQGFARGETNLLLERLLHERSLSINTAAAGGNASLMTIG

SEQ ID NO: 8258 - protein, 494 aa, Xenorhabdus bovienii
  Coding DNA sequence: Name=SeqID_2150
  Gene classification: Gene name=PutP; Function=1 Na+/proline, Na+/panthothenate symporters and related permeases; Function class=E Amino acid transport and metabolism
  Homolog annotation: Query=1..493bp; Hit=1..493bp; Blast score=654; Percent Identity=74.0; E value=0; Homolog= ZputP COG0591
MTVNSPMLITFIVYISAMLVIGFIAYRSTKNFDDYILGGRRLGSVVTALSAGASDMSGWLLMGLPGLIFLSGISGSWIALGCLMGAYLNWRWVAGRLRVHTEANNNALTLPDYFTHRFEDSSKILRIISALVILIFFTIYCASGVVAGGLLFESTFGMSYEKAIWLGALATIGYTFLGGFLAVSWTDTVQATLMIFALILVPVLILLNVGGFENAIAVIEAKHTSYLDMFNGLNVIAIISLLGWGFGYFGQPHILARFMAADSHQTIHKARRISMTWMFLCLAGTVAVGFFGIAYFELYPEQAAPVLQKNERIFIELGTLLFNPWITGILLSAVLAAVMSTLSCQLLVCSSALTEDLYKAFVRTKASQNELVWVGRLMVLLVAAIAIVIATNPNNKVLALASNAWAGFGAAFGPVVLISVLWKRMTRNGALIGMLVGAITVLVWMQYKWFGLYEIIPGFIFASIAIIGVSLLGKAPSQATQQRFDEAEAHYRTK

SEQ ID NO: 8259 - protein, 468 aa, Xenorhabdus bovienii
  Coding DNA sequence: Name=SeqID_2151
  Homolog annotation: Query=1..453bp; Hit=1..453bp; Blast score=684; Percent Identity=73.0; E value=0; Homolog= ref|NP_927678.1|
MSLSEPAIKRLDHLGLVAAFCHEIGLPRMIDAILPKYAEHTVSHGEALLAMILNGLGFHSRTLHMCPDFFKHKPVERLIGVGIMAEHLNDDVLGRTLDALFDCGVSEIYQVIAERVIDKLALKSDSVHLDITSFHVDGEYKLPDDDETKRLVLVRGYSRDHRPDLNQVVLQLICENQAGIPVYMQAMSGNTNDTKAFAETTKHHIGCLKAAQNSRYLIADAALYTQETLASLHQQNQKFITRVPLTIKEAKQHLLTVNTDQLQPVTEGYAGHWIESCYGGVPQRWLLVNSEAAMQCEHQTFRKNTRISTEKELKQFEKLSKKSFPCGEDALQALCDFEAECQFIGIEAPKVQKIEVHKGRGRPAKGQHPDSVHYQLSASVYSQLGKVAYARLKVGMFILATNEMDDKALNMETLLANYKAQQKVERGFRFLKSPEFLTSAIYLKKPERIEGVINDNDMQFNGLCCTGA

SEQ ID NO: 8260 - protein, 56 aa, Xenorhabdus bovienii
  Coding DNA sequence: Name=SeqID_2152
  Homolog annotation: Query=1..49bp; Hit=456..504bp; Blast score=93; Percent Identity=85.0; E value=1e-18; Homolog= ref|NP_927678.1|
MTCSLMVYAALEHKIRTGLKQNAPFYPDMKGKPTQSPTARWVFLTFEGIRLRPLIR

SEQ ID NO: 8261 - protein, 101 aa, Xenorhabdus bovienii
  Coding DNA sequence: Name=SeqID_2153
  Gene classification: Function=Predicted transposase; Function class=L DNA replication, recombination and repair
  Homolog annotation: Query=8..97bp; Hit=163..248bp; Blast score=61; Percent Identity=41.0; E value=1e-10; Homolog= mll8100 COG3293
MKRRGKAVLADKGYSGGKLRGYLRKLRIKSIIPYKINEKGSTDGRTQFDEQAYRDRNVVERCFGFLKGNRRIATRYEKTARNYLSRVKLGCIRLFYRRLSN

SEQ ID NO: 8262 - protein, 152 aa, Xenorhabdus bovienii
  Coding DNA sequence: Name=SeqID_2154
  Gene classification: Function=Predicted transposase; Function class=L DNA replication, recombination and repair
  Homolog annotation: Query=1..126bp; Hit=1..117bp; Blast score=104; Percent Identity=46.0; E value=3e-23; Homolog= mll8100 COG3293
MARYDIPDDAWIVIEPCLPPVHSERAGRPHVEHRRVMNGMFWVLCSGAPWRDLPERYGPWKTVYNRFNRGSKSGIINKIFNRLLSILDEKGLIDWAEICLDGSNIRASKDAAGAKKPLPISLTIMRWVAHAVVMAPKSIWQPTDGVFPSTCF

SEQ ID NO: 8263 - protein, 152 aa, Xenorhabdus bovienii
  Coding DNA sequence: Name=SeqID_2155
  Homolog annotation: Query=69..152bp; Hit=410..493bp; Blast score=106; Percent Identity=59.0; E value=1e-22; Homolog= ref|NP_929284.1|
MPIVYVNRKNPDWTYLLDAVAAKGLADAVYAVTVTQEQFDNLTAYQFIIDNGDYICIPKSPEPKQAYNWDGEKWVADKPKLKQWQISEAEYQKQNLMTEARDKIAPLQDAVDLNIATDAEKSALTAWRKYRVLLNRVDCTTAPDVKWPEPPK

SEQ ID NO: 8264 - protein, 45 aa, Xenorhabdus bovienii
  Coding DNA sequence: Name=SeqID_2156
  Homolog annotation: Query=1..45bp; Hit=1..45bp; Blast score=88; Percent Identity=80.0; E value=3e-17; Homolog= ref|NP_930108.1|
MSIINKPDYKIFANDAKTGELEMFPDILRGWGVTVDRTAGKPPME

SEQ ID NO: 8265 - protein, 182 aa, Xenorhabdus bovienii
  Coding DNA sequence: Name=SeqID_2157
  Homolog annotation: Query=1..180bp; Hit=38..217bp; Blast score=257; Percent Identity=67.0; E value=6e-68; Homolog= ref|NP_930109.1|
LQLPEILNIDKSVGYGLDLIGRHIGIGRTMKSFVPKDYFGWLGISGALGFNDGLFYRYGDSLQKSVKLDDSDFRFFIRAKIIKNFQKPTIEGITHSLKHLLGEYSFVIDNYDMTMNVIVPADYLTPFRLHAILKLDILSRPVGVKYQFVVVNSDRPFGWASDTRSFGFGDGKFTRIINVNHQ

SEQ ID NO: 8266 - protein, 126 aa, Xenorhabdus bovienii
  Coding DNA sequence: Name=SeqID_2158
MESITILPKGGRLSSKMCRYLERGDLVTHHCLEEHIRQSEVKALENIIDEAFGVETEPRKVLVLKRKPQNDGVNVIANLIVQAKGLSNESQEDSFNNCCLPHVALYSTKQRASNRILESGGVTARG

SEQ ID NO: 8267 - protein, 83 aa, Xenorhabdus bovienii
  Coding DNA sequence: Name=SeqID_2159
MDRNFRRKVVGWFREKIKNNVWVKWGYIPVIVFYPNSLKLWFREHAPDFLPNFVTDIIFSIPIVFAVIYIPPLLIDYLKKTRK

SEQ ID NO: 8268 - protein, 71 aa, Xenorhabdus bovienii
  Coding DNA sequence: Name=SeqID_2160
MALDHGILNIPLHKRSNIDRDIDKWKAEQTKEKSKRLDEINYQREQERKEAERLFKLVDRKLMWAEATRLA

SEQ ID NO: 8269 - protein, 58 aa, Xenorhabdus bovienii
  Coding DNA sequence: Name=SeqID_2161
MEFNVTVPFAVFFGPTFTTTIWLPAFSLEFGAFYHSNQRTDKSEILEKPLLSLFMLGG

SEQ ID NO: 8270 - protein, 468 aa, Xenorhabdus bovienii
  Coding DNA sequence: Name=SeqID_2162
  Gene classification: Gene name=AnsP; Function=Gamma-aminobutyrate permease and related permeases; Function class=E Amino acid transport and metabolism
  Homolog annotation: Query=18..463bp; Hit=19..464bp; Blast score=618; Percent Identity=74.0; E value=1e-177; Homolog= cycA COG1113
MEEKIQSTHTPETEGSHLQRSLTNRHIQLIAIGGAIGTGLFMGSGKTISLAGPSIIFVYMIIGFMLFFVMRAMGELLLSNLHYKSFSDFAADLLGPWAGFFVGWTYWFCWVITGVADVVAITSYVSYWTPDFPEWATSLLCVFILLTLNLATVKLFGELEFWFAMIKIVAIVALIVIGGILIGTHFQSPAGHTAALSNVWNDGGMFPMGLSGFFAGFQIAIFAFVGIELVGTAAAETKDPMKSLPKAINAIPIRIITFYVLALIVIMSVTPWRSIVADKSPFVELFVLIGLPAAASIVNFVVLTSAASSANSGVFSTSRMLFGLAKEGDAPKQFSRLSRRSVPASGLIFTCLCLSCGVILIYFIPDVMRVFTLVTTVSATLFMFIWSMILCSYLVYRKRRPALHKASIYKMPFGIVMSWLCLAFFAFVLVLLSLQPDTRQALIATPVWFIILVIGFQIVKKRRTRLYR

SEQ ID NO: 8271 - protein, 135 aa, Xenorhabdus bovienii
  Coding DNA sequence: Name=SeqID_2163
  Homolog annotation: Query=19..124bp; Hit=19..121bp; Blast score=65; Percent Identity=35.0; E value=1e-10; Homolog= ref|NP_900345.1|
MHQKNSAIFELLKNLEISLHKEKRKNIDWLNTILHDDFLEIAKSGYVYSKKIVIDELTTEFKMVSPIFSQDFNIKWLDENIALITYQSYEINKSDHPFNKALRSSIWQLSVSGTWQLRFHQGTIMAAQPLGNITP

SEQ ID NO: 8272 - protein, 164 aa, Xenorhabdus bovienii
  Coding DNA sequence: Name=SeqID_2164
  Gene classification: Gene name=WecD; Function=Histone acetyltransferase HPA2 and related acetyltransferases; Function class=K Transcription
  Homolog annotation: Query=2..163bp; Hit=3..162bp; Blast score=145; Percent Identity=46.0; E value=2e-35; Homolog= yhhY COG0454
MEIIIRAAESEDAEHFQRIYSHPEVYSNTLQLPCPSREMWQERLKQNKIQGTINFVAEIDGEVVGTVSLFTFANPRRRQVVGIGIGVDAAYSGQGVGSKMMAFAIDYAFNWLAAVRIELEVFTDNEKAIALYTKFGFEKEGVLRKASLKNGQYCDVMAMSIIKN

SEQ ID NO: 8273 - protein, 311 aa, Xenorhabdus bovienii
  Coding DNA sequence: Name=SeqID_2165
  Gene classification: Gene name=LysR; Function=Transcriptional regulator; Function class=K Transcription
  Homolog annotation: Query=11..300bp; Hit=4..294bp; Blast score=135; Percent Identity=32.0; E value=4e-32; Homolog= PA3711 COG0583
MKNKTEQSLVWDDIRVLLAIARTGTLSRAADVLKIGIATVSRKIERLEATFGMPLFLRHQAGYRLTEDGKELLEKAKAMEIAANSFLLEADTRIAISGKVRLATTETFASDLVIPNLPTLQKNYPDLTLEITTDIHTVDLHRRDADLALRIVRPERGHVTVRQLGKLGFGLYGSKDYLATCSPDILRGEYEKARFIGWADTYSYLPSFLWTEKNLKGRPLSVATTSLNAQLAAVKAGLGLAVLPHFIVQYTELQCISHDLGIDQSIWLVIQADLAHSPRIRKVADFLAEIVFQNQGKLSGQTGINSVILPD

SEQ ID NO: 8274 - protein, 307 aa, Xenorhabdus bovienii
  Coding DNA sequence: Name=SeqID_2166
  Gene classification: Gene name=RhaT; Function=7 Permeases of the drug/metabolite transporter (DMT) superfamily; Function class=G Carbohydrate transport and metabolism
  Homolog annotation: Query=10..294bp; Hit=8..292bp; Blast score=150; Percent Identity=35.0; E value=2e-36; Homolog= BS_yyaM COG0697
MRNTPQSAVVLTLFATFFWSSNFQVTKFALESLPPWTASVERFVFAVFPIFIFMALKSGIHGKVLRKNLLAFICLGAIGVAGFNGALFVGLQSSSPITAALIMATTPISANILEAIMNRRFPELIRVLGMGISLLGVVLVITNGQLVGGMVHMASGDAIIFAGSLGWAIYTVGTRKFITNATPLEITSWTMLFGVVILAMIAFFVESPISSMRSGTFESHLASAYMGIAGSFLAYLFWNIGVALRGAGKTAIFFNFVPIFALIIQLMIGNSPSLPQLVGIMLTIVGVLLGQGIITAWFTSKGILEKH

SEQ ID NO: 8275 - protein, 105 aa, Xenorhabdus bovienii
  Coding DNA sequence: Name=SeqID_2167
  Homolog annotation: Query=1..104bp; Hit=1085..1188bp; Blast score =178; Percent Identity=79.0; E value=2e-44; Homolog= gb|AAC38624.1|
MSSENKRRIKRVAVTLPTLLGPYQDIEATLVMDSEIATLSHGTNDDGRFVTDFNDSRFLPFEGRDVTSGELTLNIFHAGKDETQHDLIANLSDIIVYLNYIIREV

SEQ ID NO: 8276 - protein, 92 aa, Xenorhabdus bovienii
  Coding DNA sequence: Name=SeqID_2168
  Gene classification: Function=Transposase; Function class=L DNA replication, recombination and repair
  Homolog annotation: Query=4..92bp; Hit=3..91bp; Blast score=85; Percent Identity=41.0; E value=1e-17; Homolog= insA_g5 COG3677
MTVTIEVTCRYCDQAEPVRKHGTGKAGFPRYYCKDCQRTFQLNYRYNGHKPGMKEKIVDMAMNGSGVRDTGRVLGLGINTVMRTLKNSRQNK

SEQ ID NO: 8277 - protein, 68 aa, Xenorhabdus bovienii
  Coding DNA sequence: Name=SeqID_2169
  Homolog annotation: Query=1..68bp; Hit=947..1014bp; Blast score=132; Percent Identity=94.0; E value=1e-30; Homolog= gb|AAC38624.1|
MAGRLSALYYQMYDVTLPICLQAKAALVQELGEKESDSLFQVPIWNDLWQGLLAGEGLSTELQKLDNI

SEQ ID NO: 8278 - protein, 45 aa, Xenorhabdus bovienii
  Coding DNA sequence: Name=SeqID_2170
MKELVDVFSDFPDPRCQGKVKHRFIDILVIAVCAVIAGANARGYT

SEQ ID NO: 8279 - protein, 479 aa, Xenorhabdus bovienii
  Coding DNA sequence: Name=SeqID_2171
  Homolog annotation: Query=1..479bp; Hit=365..843bp; Blast score=799; Percent Identity=82.0; E value=0; Homolog= gb|AAC38624.1|
MCHGTSYNNDHYCNFTILINEITFTTYGKFSPDGKQFTPPSGSAIALYPPDYVDLNNKLDTSLDSLFNYDVQKQFGGSNPVNNFSGPYGIYLWEIFFHIPFLVAVRMQTEQHFSDADTWYKYIFRSAGYRNDDGDPIMDDNAPRYWNIMPLQIDKEWDTTQPATTDPDVIATADPMHYKLAIFLHTLDLLIARGNAAYRQLERDTLVEAKMYYIQALQLLGTRPDIHITNSWSNPTLNEEANKTSKPTLLSTPEAMTFSTWLNSGDATNIGDGDFLPPYNDVLLTYWDKLDIRLYNLRHNLSLDGQPLNLPLYATPVDPKTLQRQQAGGDGTGNGSLIDEHKTQGWRYPLLIERARNAVSLLTQFASNLQTTLERQDNEKMTLLLQTQQQAILKQQHDIQQTNLKGLQHSLTALQASRNGAALRQKHYSDLVNGGLSAAEIAGLTLRSTAMITNGVATGLLTAGGIANAVPNVFGLANG

SEQ ID NO: 8280 - protein, 158 aa, Xenorhabdus bovienii
  Coding DNA sequence: Name=SeqID_2172
  Homolog annotation: Query=1..152bp; Hit=1..152bp; Blast score=267; Percent Identity=87.0; E value=5e-71; Homolog= gb|AAC38624.1|
MSDSLFSQILKEQRRDALVAHYIATQIPTDLKDSIQTADDLYEYLLLDTKISDLVSTSLLSEAIGSLQLFIHRAMEGYDGTLASSAKQYFADEQFLYNWDSFNHRYSTWAGKERLKFYAGDYIDPTLRLNKTEIFTELEQGISQGKLQNDFLYWADRV

SEQ ID NO: 8281 - protein, 1099 aa, Xenorhabdus bovienii
  Coding DNA sequence: Name=SeqID_2173
  Homolog annotation: Query=1..1099bp; Hit=1..1095bp; Blast score=1562; Percent Identity=72.0; E value=0; Homolog= gb|AAC38623.1|
MVIIMQNKASSLSGLLERPLLDAGYKNIFEIVSISRAAFVQSIPSLPVNEAQAIYLQARQRAENLKSLYRSWQLRHEPVIKRMGKLNTQSNAPILEKTLVDSIGRDGDFSDIMNRASQYADAASIQSLFSPGRYATALYKVARDLHTSSSSLHIDQRRPDLQSLALSETTMNQEITSLDVLLDILQKGSQDINQLSTTFYPMTLPYDDDLSQINAALSAQARTLNGVWNTLADVTAQAVTEQSSTEIPDNSPKFFAAEVKKDQFFDGEIFYVKAIEFQNQPMIYLSHYTNGETVEGVQLIAGNPDNAAAAAIAPLKLTWSMAGQCYYLGIPDGTKTGDGKILNGCFLRGNSPTNPNQDGDFAQVANKSNSTQPLSQFHLPVTLEQNDKDKTQFYLKTHKGYIAVGPSGQTNWKNALVINGEKTDALLLQFSKDNTGTPTVPDDVVPPAINDIPSPPARETLSLTPVSYQLMTDPAPTAEDISNHYGLGSRLQDVSPLTSSLADTLNSIETFCEKTQITFNQLMELTAQSTFSQNGASAHAGSRYFRFGETDPTRVNVYGATYLNNTLAVDADSQYLWVQTDGKKLNFSDSTVVELSGRAEKLVRLAAETGLSFDELDWLIANASRSVPEHYGKIVLDKPVLEALAEYISLRQRSGLDVDTFVTFICAVNPYAPRQTASLYEKTFRSAADGNQVIALGEEVKYTLDEQDELSTLCCKALGVTSDEFFRIGSYCFDDAGHFTVDEYTASQLYRFGAIPRLFGLTFAQAEILWRLMAGGTDILLKQLGQAKSLQPLKILRRTQEVIDWMASTRLNLVYLQGMVSTQWNGTAAADMFNFLQNVYVSVNNNPSNSLKSLDPALQQKILRALSAGFSIKSNVMNIVTVWLEKITADDTLPFTLSDYWNAIQTLFSTNTTTLDDLQSDTNLVIATQRLSQLVLVVKWLSLTEQDLQLLTDFPERLIDNQTSASAPNLSLLLTLSRFKQWQTQVTVPHDEAMRCFEQLNDPTMTIGHAATLIARLHEMDKGTVEQVNILLFGDNNWPKSFTALWQLLTWLRVGQSLNVGSKTLSDLMKMMKADPAAENTALLASVAQNLSAAMTGRQ

SEQ ID NO: 8282 - protein, 163 aa, Xenorhabdus bovienii
  Coding DNA sequence: Name=SeqID_2174
  Homolog annotation: Query=1..145bp; Hit=67..203bp; Blast score=78; Percent Identity=34.0; E value=4e-14; Homolog= ref|NP_930409.1|
LIETKQKIPTIFKNAEFVECYRKDFDSFAHFTIPIDVGSAQEPINQQNTDVYIYSNKKQKIIAELKLTDALIDRINKAKKDLSSLKFNFSVTIHRTKEPINVKALGVFMTNDKGQITPMVYEDFEWSKSKYATFKLSDVAVNSLLTKGKHPLLLEIDYFNKNK

SEQ ID NO: 8283 - protein, 44 aa, Xenorhabdus bovienii
  Coding DNA sequence: Name=SeqID_2175
MRKLSVIALSVLALTGCKVGLDTEVNLSDILAQLPAIPVKSLRV

SEQ ID NO: 8284 - protein, 137 aa, Xenorhabdus bovienii
  Coding DNA sequence: Name=SeqID_2176
  Homolog annotation: Query=6..124bp; Hit=8..126bp; Blast score=113; Percent Identity=51.0; E value=6e-25; Homolog= ref|ZP_00133406.1|
MNKICTLLLSAVMLCSGCATIVGEKNQLIEVNSQPSGAEFSIKDETGKVVAHGNTPQNVMLEKSNGRYFGKKNYQITFAKEHFKSATLPLVARPNGWYIGGNFVFGGLIGWLIVDPLNGGMYTLNPKIANAVLSEAK

SEQ ID NO: 8285 - protein, 532 aa, Xenorhabdus bovienii
  Coding DNA sequence: Name=SeqID_2177
  Gene classification: Gene name=AraB; Function=Ribulose kinase; Function class=C Energy production and conversion
  Homolog annotation: Query=1..524bp; Hit=1..527bp; Blast score=364; Percent Identity=40.0; E value=1e-100; Homolog= mll4918 COG1069
MEQQYFIGIDVGSASVRAAIFDQKGKRLAFSVRSIQQFHPKADFVEQSSADIWSNIGTTVKEAVSHAGIDPTHVKSIGFDATCSLVAVSAEGEPLSVAEDGSPERDIIMWMDHRAIEETIRINLTDDPTLRYVGGEISVEMELPKILWLKNHFPQRYQAAWRFFDLADFLVWKATDADVGSICTLTCKWNYLAHQKQFSKEFLQRIGLEDLTDKIPTIILELGQQAGHLTEQSASALGLHGDVIVASGIIDAHAGGLALIGAKPNGSLAMISGTSNCHMIVSPEPVMVRGVWGPYFGAMLPDYWLNEGGQSAAGALVEWSIRQHEAWPVLEAEAKAAGLHYYQLLNDAVAQLELREKYPTAQLHILADHHGNRSPRANPNAKGMISGLTLEQEREGLARYYLATLQSIAYGTRHIIDTLIKAGHQIDRLVICGGATKNALWLREYANATGQEIHLAEEEDAVNLGAAMLGAVACGAFTDITAAAQSMVREGNVISPEKEMFPFHQAKYQVYLQMYQDQQRYVDMMRSAVSFN

SEQ ID NO: 8286 - protein, 62 aa, Xenorhabdus bovienii
  Coding DNA sequence: Name=SeqID_2178
  Homolog annotation: Query=1..56bp; Hit=1..56bp; Blast score=65; Percent Identity=53.0; E value=3e-10; Homolog= ref|NP_246406.1|
MDKKIIEILQYELKAATGKEFHRIMTEISVPLHEKTGIDVISYGKLINEIICTFVIVGNTIH

SEQ ID NO: 8287 - protein, 111 aa, Xenorhabdus bovienii
  Coding DNA sequence: Name=SeqID_2179
MLARGLKPRQIAVETGCSVRVIYNWVHTWHDFGIAGLLGGHAGGRYLAMTPEMIATAVEIACSESLTLARIALGVEEKHGPLPCTLETLAKTLKKQGLTYKRARLSLKKTR

SEQ ID NO: 8288 - protein, 178 aa, Xenorhabdus bovienii
  Coding DNA sequence: Name=SeqID_2180
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335
LLDKIKAGARAGRYRLVYFDEAGFAASPPVQYGWSPRGKPHETEPQHHDRRSVLGALNYTDNTLFYQAPSGSITRADVIDFLEQVAKQGDNRLTFLVLDNARIHHGIEKKIRNRWLREHNLLLFYLPAYSPELNLIEIIWKQAKYHWRRFITWTQDTVEYELNTLLEGYGAKFAINFS

SEQ ID NO: 8289 - protein, 133 aa, Xenorhabdus bovienii
  Coding DNA sequence: Name=SeqID_2181
  Gene classification: Function=Uncharacterized ACR; Function class=S Function unknown
  Homolog annotation: Query=2..125bp; Hit=5..129bp; Blast score=74; Percent Identity=32.0; E value=2e-14; Homolog= mll0824 COG3791
MNQGRCLCGAVGITTYQNIENINACHCKTCQKWNGGPFLSVDCKNDLQIEGAENISTYSSSAWAERAFCNKCGTHLFYHLLQPSIYYVPVALFENSHSSKLSNQVYVDSKPAYYNFVEKTPMLNKQDILNLFK

SEQ ID NO: 8290 - protein, 219 aa, Xenorhabdus bovienii
  Coding DNA sequence: Name=SeqID_2182
  Gene classification: Gene name=CitB; Function=Response regulator containing a CheY-like receiver domain and an HTH DNA-binding domain; Function class=T Signal transduction mechanisms
  Homolog annotation: Query=1..214bp; Hit=1..215bp; Blast score=311; Percent Identity=72.0; E value=4e-85; Homolog= uvrY COG2197
LINVLLVDDHELVRIGVKGILEDVKGIKVAGEAGSGEDAVRWCRSNSTDVVIMDMGMPGIGGLEAAKKIIRYSPDTRVIMLTIHTESSLPAKVMQAGVRGYLSKAATPQDMINAIRTVYAGQRYISPDIAQQMALDQLSPPKENPLAELSERELQIMTMITQGRKVNEISTLLNLSPKTVNSYRYRMFSKLNIKGDVELTHMAIRCGLLDAQNMVNHSG

SEQ ID NO: 8291 - protein, 588 aa, Xenorhabdus bovienii
  Coding DNA sequence: Name=SeqID_2183
  Gene classification: Gene name=UvrC; Function=Nuclease subunit of the excinuclease complex; Function class=L DNA replication, recombination and repair
  Homolog annotation: Query=1..588bp; Hit=1..588bp; Blast score=973; Percent Identity=79.0; E value=0; Homolog= uvrC COG0322
MYDTTGSVIYVGKAKDLKKRLSSYFRTQVGSRKTESLVKNIVQIDVTVTHTETEALLLEHNYIKLYQPRYNVLLRDDKSYPYIFLSGDTHPRLTLHRGAKHAKGEYFGPFPNSHAVRDTLALLQKLFPIRQCEDSVYRNRSRPCLQYQIGRCLAPCVNGFVTDEEYQQQVEYVSLFLSGKDQQVLTELVGRMEEASKQLQFEDAACYRDQIQAVRQVTERQFVSGEGDDLDVISVAFDTGMACLHVLFIRQGKILGSRSYYPKIPADTKLDEVVQTFLGQFYLQGSQNRTLPTEILLDFSLPEKELLEASLSELSGRKVHIQPRPRGDRARYLKLARTNAATALTTKLSQQSTIHQRLASLAEFAGIKKIHRMECFDISHTMGEQTVASCVVFDGNGPVRSEYRRYNIVGITPGDDYAAMNQVLRRRYGKAIEQTKIPDIIFIDGGKGQLAQALEVFGSLDVEWNKNYPKLIGVAKGSDRKAGLETLFFEAEGGGMTLPPDSPALHVIQHIRDESHNHAITGHRQRREKVKKTSTLESIEGIGPKRRQMLLKYMGGLQPLRNASVEEIAKVPSISYSLAEKIYNALKH

SEQ ID NO: 8292 - protein, 37 aa, Xenorhabdus bovienii
  Coding DNA sequence: Name=SeqID_2184
LCRYSYASIFQPYSIRSLPPWATADPDRRLIIRKEQC

SEQ ID NO: 8293 - protein, 44 aa, Xenorhabdus bovienii
  Coding DNA sequence: Name=SeqID_2185
LRLGFACLKLCVREAPSNFLSCMMRFIGTSLEIRINAFFLLPVP

SEQ ID NO: 8294 - protein, 245 aa, Xenorhabdus bovienii
  Coding DNA sequence: Name=SeqID_2186
  Gene classification: Gene name=SpoU; Function=rRNA methylases; Function class=J Translation, ribosomal structure and biogenesis
  Homolog annotation: Query=1..243bp; Hit=1..243bp; Blast score=396; Percent Identity=79.0; E value=1e-110; Homolog= yjfH COG0566
MSEIIYGIHAVKALLDRDPQRFMEVYVLKGREDRRLTPLLRELEDIGIAVQLANRQWLDTQTESAVHQGIIAKIKPGRQYQESDLPDFLSQLDRPFLLVLDGVTDPHNLGACLRTADAAGVDVVIIPRDRSAQLNATAKKVACGAAENVPLIRVTNLARTLRLLQESNIWIVGTAGEATHSLYQSKLTGPMALVMGAEGEGMRRLTREHCDELISIPMAGSVSSLNVSVATGVCLFEIMRQRSAQ

SEQ ID NO: 8295 - protein, 828 aa, Xenorhabdus bovienii
  Coding DNA sequence: Name=SeqID_2187
  Gene classification: Gene name=VacB; Function=Exoribonucleases; Function class=K Transcription
  Homolog annotation: Query=8..790bp; Hit=6..784bp; Blast score=1193; Percent Identity=75.0; E value=0; Homolog= vacB COG0557
VKHGEQQLADDNRGITMSKDPFQEREAEKYESPIPSREYILDILSKHTTPVSRQELAKELQLTSADAQEAFRRRLRAMERDGQLIFTRRQCYALPERLDLLKGTVIGHRDGYGFLRAEGHKEDFYLPAEQMKMAIHGDVILAQPLQPDRKGRVEVRIVRVLEPKNSQIVGRYFVDAGMGFVVPDDSRLSFDILIPKEEICGARMGNVVVVELTSRPTRRTKAIGKIVEVLGETMGTNMAVEIALRTHEIPHSWPPMVEKQVVDLDENVPESAKKGRVDLRELPLVTIDGEDARDFDDAVYCERKRGGGWRLWVAIADVSYYVRPQTPLDTEARSRGNSVYFPSQVVPMLPEILSNGLCSLNPEVDRLCMVCEMTISAQGKLSSYKFYEAVMNSHARLTYTKVWKILQGDQELREHYQPLVTHIEYLHELYQALEQAREQRGAISFESEEAKFIFNAERRIERIEPVTRNDAHKLIEECMILANIAAARFVEKNNEPALYRVHDRPREESILNLRSVFNELGLSLLGGMKPEPKDYAQLMKDVAERPDHELLQTMLLRSMKQAIYDPENRGHFGLALRSYAHFTSPIRRYPDLALHRAIKYLLAQEQENGAVEQHWTPTGGWHNDMDHMLQLGNHCSMTERRADEATRDVADWLKCDFMQDQVGNVFTGLITSVTGFGFFVRLNELFIDGLVHVSTLDNDYYRYDNVGQRLIGESSGQTYRLGDEVEIRVEAVHMDERNIDFALLSSTRKARNQGKTARDKSKRGTPERNSSKKGRDHKKSANFEPDNASRKKKKAEKPKASKKKTSDKTKKITAKLKAKRVKKTQENS

SEQ ID NO: 8296 - protein, 141 aa, Xenorhabdus bovienii
  Coding DNA sequence: Name=SeqID_2188
  Gene classification: Function=Predicted transcriptional regulator; Function class=K Transcription
  Homolog annotation: Query=3..141bp; Hit=1..141bp; Blast score=210; Percent Identity=75.0; E value=3e-55; Homolog= yjeB COG1959
VSVQLTSFTDYGLRALIYMASLPEGQMTSITEVTEVYGVSRNHMVKIINQLSNLGLVNAVRGKNGGISLGKPASEIKIGDVVRSLEPLPLVNCSACYITPACRLKLVLNQAVENFLQELGKHTLADMVKDNRPLYQLLLAK

SEQ ID NO: 8297 - protein, 432 aa, Xenorhabdus bovienii
  Coding DNA sequence: Name=SeqID_2189
  Gene classification: Gene name=PurA; Function=Adenylosuccinate synthase; Function class=F Nucleotide transport and metabolism
  Homolog annotation: Query=1..432bp; Hit=1..432bp; Blast score=764; Percent Identity=85.0; E value=0; Homolog= purA COG0104
MGKNVVVLGTQWGDEGKGKIVDLLTERAKYVVRYQGGHNAGHTLVINGEKTVLHLIPSGILRENVISIIANGVVLAPDALMKEMNALESRGVPVRERLLISEACPLILPYHVALDNAREKARGAKAIGTTGRGIGPAYEDKVARRGLRVGDLFDKETFAVKLKEIIEYHNFQLVNYYNEPAVDYQKTLDDILAVADILTNMVVDVSDLLYKATQKGELVMFEGAQGTLLDIDHGTYPYVTSSNTTAGGVATGSGLGPRYVDYVLGIIKAYSTRVGAGPFPTELFDETGEYLRQKGQEFGATTGRSRRTGWLDIVAIRRAIQINSLSGFCMTKLDVLDGLKEVKICIGYRMPDGSLIDTTPLAAENWEGLEAVYETLPGWDESTFGVKDHSLLPEAALSYIKRVEELTGVPVDIISTGPDRAETMILRDPFDA

SEQ ID NO: 8298 - protein, 47 aa, Xenorhabdus bovienii
  Coding DNA sequence: Name=SeqID_2190
LGAQYDNVLTHFKSSLGCLKMDSTISFSTFQYFFSLLLFRFVILTGC

SEQ ID NO: 8299 - protein, 30 aa, Xenorhabdus bovienii
  Coding DNA sequence: Name=SeqID_2191
MNDRCLSHCKKTCSGFFVTSIITNAYLTAR

SEQ ID NO: 8300 - protein, 336 aa, Xenorhabdus bovienii
  Coding DNA sequence: Name=SeqID_2192
  Gene classification: Gene name=HflC; Function=Membrane protease subunits, stomatin/prohibitin homologs; Function class=O Posttranslational modification, protein turnover, chaperones
  Homolog annotation: Query=1..327bp; Hit=1..329bp; Blast score=412; Percent Identity=72.0; E value=1e-115; Homolog= hflC COG0330
MRKSFVFAIAVILVVLYTSIFIVYEGQRGIVLRFGKVARDAENKPLVYQPGLHFKIPFIETVKTLDARIQTMDIKADRFLTRENKDLIVDSYLKWRIKDFSRYYLATGNGEIAQAELLLKRKFSDRLRSEIGRLDVRGIVTDSRGRLTTDVRNSLNLGTSDGDTAETADNPVASAAASVGQETKGKQPVLNQNSMAELGIEVVDVRIKQINLPQEISEAIYQRMRADREAEARLLRSQGLEEAEKIRAVADKTATEIKAKSNSEALILRGEGDAEAAKLFADAFNKDPEFYAFIRSLRAYEKSFKNDGNNIMVLSPDSDFFRYMKAPVKQHSNTND

SEQ ID NO: 8301 - protein, 414 aa, Xenorhabdus bovienii
  Coding DNA sequence: Name=SeqID_2193
  Gene classification: Gene name=HflC; Function=Membrane protease subunits, stomatin/prohibitin homologs; Function class=O Posttranslational modification, protein turnover, chaperones
  Homolog annotation: Query=1..367bp; Hit=1..372bp; Blast score=459; Percent Identity=68.0; E value=1e-129; Homolog= hflK COG0330
MAWNQPGNNGQDRDPWGSSNNNGGNSGGNNKGGRNRGATDLDDLFRKLSEKLGGFGGKKGGNGSEQGPKFGGRIIGLAVAAAVAIWVVSGFYTIKETERGVVIRLGKFSHIVQPGLNWKMTFIDRVRAVNVESVRELATSGVMLTSDENVVRAEMNVQYRVTDPAAYLFNVTSPDNSLSQATDSAVRGVVGKYTMEKILTADRTIVRNDTQKVLEETIRPYNMGITLLDVNFQTARPPEEVQVAFDDVIAAREEEQKTIREAESYKNAVLPMAKGDAQRMIEDARAYKVSVVLNAQGEVASFAKILPEYKAAPEITRERLYIETMEYVLSNTRKVIANEKSNNMLVLPLDQVFRKQAEVPKTQSSDAKVAPEKSGSTHFAPEQGQTGYNNSSNNHSSYGNPSSLRGETLRQGRP

SEQ ID NO: 8302 - protein, 56 aa, Xenorhabdus bovienii
  Coding DNA sequence: Name=SeqID_2194
VTESVLSKTSPKNIGCLLKRRNLSFLTTEAAVRPVRDRQWPVKWEASSVRVESSHL

SEQ ID NO: 8303 - protein, 44 aa, Xenorhabdus bovienii
  Coding DNA sequence: Name=SeqID_2195
MFLTVLILSLQFWHSHSITAIPLQLLHDYKRLEMADKMIPCLSS

SEQ ID NO: 8304 - protein, 426 aa, Xenorhabdus bovienii
  Coding DNA sequence: Name=SeqID_2196
  Gene classification: Gene name=HflX; Function=GTPases; Function class= R General function prediction only
  Homolog annotation: Query=1..426bp; Hit=1..426bp; Blast score=675; Percent Identity=80.0; E value=0; Homolog= ZhflX COG2262
LFDRYEGGELAVLVHVFFSQEKDTENLSEFESLVTSAGVSPVQIVTGSRKAPNPKYFVGEGKAEEIAEAVKNSGADVVLFNHTLSPAQERNLERLCQCRVVDRTGVILDIFAQRARTHEGKLQVELAQLRHLSTRLVRGWTHLERQKGGIGLRGPGETQLETDRRLLRDKIKQILGRLGKVEKQREQGRQARNKADIPTVSLVGYTNAGKSSLFNRITSAEVYTADQLFATLDPTLRRIDVNDVGTVVLADTVGFIRHLPHDLVAAFKATLQETRQARLLLHVVDAAGSRLDENIVAVNSVLEEIEANEIPSLLVMNKIDMLEDFVPRIDRDEENRPIRIWLSAQTGEGIPLLFQVLTEYLSGEIAHYELHLPPDAGRLRSRFYQLQAIEREWIEDSGQIGIEVRMPMVDWRRLCKQELNLLDYVV

SEQ ID NO: 8305 - protein, 44 aa, Xenorhabdus bovienii
  Coding DNA sequence: Name=SeqID_2197
MLALTQQHNRKVMALNKSVSVPDVNKNIGRETLPMFFPMDFYLA

SEQ ID NO: 8306 - protein, 100 aa, Xenorhabdus bovienii
  Coding DNA sequence: Name=SeqID_2198
  Gene classification: Gene name=Hfq; Function=Uncharacterized ACR, host factor I protein; Function class=R General function prediction only
  Homolog annotation: Query=1..100bp; Hit=1..102bp; Blast score=145; Percent Identity=80.0; E value=1e-35; Homolog= hfq COG1923
MAKGQSLQDPFLNALRRERVPVSIYLVNGIKLQGQIESFDQFVILLKNTVSQMVYKHAISTVVPSRPVSHHGNNPNVTTGVGNYHAGANPAAQPESDGAE

SEQ ID NO: 8307 - protein, 32 aa, Xenorhabdus bovienii
  Coding DNA sequence: Name=SeqID_2199
LFLTKNLLVRKSNYSKITLCTDQLYTINEFMY

SEQ ID NO: 8308 - protein, 313 aa, Xenorhabdus bovienii
  Coding DNA sequence: Name=SeqID_2200
  Gene classification: Gene name=MiaA; Function=tRNA delta(2) -isopentenylpyrophosphate transferase; Function class=J Translation, ribosomal structure and biogenesis
  Homolog annotation: Query=1..311bp; Hit=1..311bp; Blast score=488; Percent Identity=79.0; E value=1e-138; Homolog= ZmiaA COG0324
MSDLKTQHLPTAIFIMGPTASGKTALSIALRQHLPVELISVDSALIYREMNIGTAKPTAAEQAQAPHRLVDILDPAEIYSAADFRRDALKEMADIMAAGRIPLLAGGTMLYFKALLEGLSPLPSSNPDIRAQIEQQAAEHGWEALHRQLQEIDPVAAARIHPNDPQRLTRALEVFRISGKTLTALTETSGEILPYRVHQFAIAPASREILHQRIAARFEQMIKSGFEDEVKALYARSDLHTDLPSIRCVGYRQMWSYLSGEISHDEMVYRGICATRQLAKRQITWLRSWDNVTWLDSDQPEQALNTVMQVIST

SEQ ID NO: 8309 - protein, 647 aa, Xenorhabdus bovienii
  Coding DNA sequence: Name=SeqID_2201
  Gene classification: Gene name=MutL; Function=DNA mismatch repair enzyme (predicted ATPase); Function class=L DNA replication, recombination and repair
  Homolog annotation: Query=1..647bp; Hit=1..615bp; Blast score=728; Percent Identity=62.0; E value=0; Homolog= mutL COG0323
MAIRILPPQLANQIAAGEVVERPASVVKELVENSLDAGATRIDIEIERGGAKLIRIRDNGCGIDQQDLTLALARHATSKIASLDDLEAIVSMGFRGEALASISSVSRLTLTSRTESQTEAWQAYAEGRDMEVTVKPAAHPVGTTVEVLDLFYNTPARRKFLRTEKTEFGHLDEVVRRIALARLDVAINLHHNGKLVRQYRPAKEESQHERRLAAICGMAFVQQALALSWQHDSLSIKGWVADPMNDTAGSDIQYCYVNGRMMRDRLINHAIRQAYQDLLQGEKQPAYVLYLEIDPHQVDVNVHPAKHEVRFHQARLVHDFIYQGVAAVLKQREKGAELALGCEEPAASWVPENRPSAGENHFLQQNTTSPKASPPSRAATSPLVSSGGHDKEQPQLDRPHSGNDTRQLHHGENYQKKQGELYQKMMQFAPEEKRLLFPEKAVSVREKAAPVPVYAALLQGKNNSYSFGKVLSIHAASYALIESPLGIGLLSLPVAERWLKQVQLTPGELGLKSQPLLIPLKLSLSQAEIDALKQNSELLKTFGIESTVAHGKVTIHAVSLPLRQQNLPKLLPELLNYLVEQPSVCAEQVAIWLSRHVGSEHETWNVAQAVQLLADVERLCPQLVESPPGGLLQLIDLQAVVALLNHE

SEQ ID NO: 8310 - protein, 441 aa, Xenorhabdus bovienii
  Coding DNA sequence: Name=SeqID_2202
  Gene classification: Gene name=AmiC; Function=N-acetylmuramoyl-L -alanine amidase; Function class=M Cell envelope biogenesis, outer membrane
  Homolog annotation: Query=26..440bp; Hit=9..425bp; Blast score=426; Percent Identity=56.0; E value=1e-119; Homolog= ZamiB COG0860
MMNAFFVKVIKKWQAHWVMSCALFVMLSQLIMMTATAATLSNIHVNNSPSEATVTLEFTGGHPDYRFFPLHAPERLVVDIRQSGHVIGLPMRLSGQDLVKVIRTSQSPDAQHKRFVLELAHQATATSSVKGSASEYQVVFTLQANSAAAKSTANSTSMLKGNTSLHESKQLLANNVQSPKQETKPTPAHHGQGVKKQAAKAAQGKYPIVIAIDAGHGGTDPGAIGQGGLKEKNVTISVARKLEVLLRNDPMFKPVLTRDGDYFISVAGRSEVARKHKANMLVSIHADAAPNRSARGASVWVLSNRRANSELGNWLEQHEKQSELLGGAGDVLSNGVNPLLSQAVLDLQFGHSQRVGYDVAVQVLSQLTSIGSLHKRTPEHASLGVLRSPDIPSILVETGFISHLSEEKLLGSNDYQARLAQAIHFGLRHYFQANPLQTSPM

SEQ ID NO: 8311 - protein, 154 aa, Xenorhabdus bovienii
  Coding DNA sequence: Name=SeqID_2203
  Gene classification: Function=Predicted ATPase or kinase; Function class=R General function prediction only
  Homolog annotation: Query=1..151bp; Hit=1..151bp; Blast score=213; Percent Identity=70.0; E value=8e-56; Homolog= yjeE COG0802
MKELVLLLPNENTTVALGNAVAAAGDRGYVIYLYGDLGAGKTTFSRGFLQALGHQGHVKSPTYTLVEPYALQPRPVYHFDLYRLADPEELEFMGIRDYFHQDAICLVEWPQQGAGFLPDADIELHLSYDSEGRHARFVALSEYGENLLDNLKSL

SEQ ID NO: 8312 - protein, 50 aa, Xenorhabdus bovienii
  Coding DNA sequence: Name=SeqID_2204
LLPEDSDREGLPLNIKLLLQRGRSLAHSGLNTKSAVRGSTAEQKMLNDNG

SEQ ID NO: 8313 - protein, 385 aa, Xenorhabdus bovienii
  Coding DNA sequence: Name=SeqID_2205
  Gene classification: Function=Uncharacterized Fe-S protein; Function class=C Energy production and conversion
  Homolog annotation: Query=1..385bp; Hit=1..379bp; Blast score=623; Percent Identity=77.0; E value=1e-178; Homolog= yjeS COG1600
MATPLDLNLLAANIKQWGLSLGFQQVGICDTDLSTEEPKLQEWLDKQYHGEMDWMARHGMMRARPHELLPDTLRVISVRMNYLPTKAAFASTLNNPELGYVSRYSLGRDYHKLLRQRLKKLGEQIQDYCSAHEYQGTLNFRPFVDSAPIMERPLAAKAGLGWVGKHSLILNRESGSWFFLGELLINLPLPIDAPQEEQCGRCVACMTTCPTGAIVEPYIIDARRCISYLTIELDGVIPEELRPLMGNRIYGCDDCQLICPWNRFSQLTDEVDFSPRAALHTPKLLDLFSWSEEKFLRITEGSAIRRIGYLRWLRNISVALGNALYQDDIVLALEKRIGLSEVLDEHIHWAIDQQITRRNANTIEVQTSQQKRLIRAITKGLPRDA

SEQ ID NO: 8314 - protein, 30 aa, Xenorhabdus bovienii
  Coding DNA sequence: Name=SeqID_2206
MDLLNLDSKCFIDNLFMVVIDSTERAVKGK

SEQ ID NO: 8315 - protein, 474 aa, Xenorhabdus bovienii
  Coding DNA sequence: Name=SeqID_2207
  Gene classification: Function=Aromatic ring hydroxylase; Function class=Q Secondary metabolites biosynthesis, transport and catabolism
  Homolog annotation: Query=6..447bp; Hit=29..473bp; Blast score=254; Percent Identity=34.0; E value=1e-67; Homolog= PM1523 COG2368
VQIISLINLRDGRAIFINGEVVTNHVDHPAFRNTIRSVANLYDYQIEHADRMMFMTEAGNRISLYWQLPSTPEKLIARGRAEYELATQSVGWLGRSPDNVSSVLTGMMTHIEVFEDYSQERADALRNYFTYVSEKNLYLTYALVNPQGDRSKAPGEHTKNIYHTLGVVEKNAKGIIVRGAKMLATGAPLADEILIGVHNPLKPGIDERYAVSFAMPLNAKGIKIISRRSYELGVNPKDYPLSYRFDENDSIIYFDDVLVPWERVFIFEDIEMCRRQFKETAAEVLMDTQSQARYAVKLHFLAGLAQTMAETNGVCEYPTVRESLAKLACYAMNIEGLFNSLIHNPRVDNGFYIPDRTQLYACQVIAQEIYPKVLETIRKLAGGGVLMLPSSEADLENDEILRIIEKTQYSSVASPIERVRLMKLVWDAVGSEFASRHLQYEMFYTGASYFALERLYTKYDWKSSKELVEKIKAL

SEQ ID NO: 8316 - protein, 146 aa, Xenorhabdus bovienii
  Coding DNA sequence: Name=SeqID_2208
MKSKIVLSEPERITLQQLALNHQHRDIRTRGTGLLMLARGLKPRQIAVETGCSVRVIYNWVHTWHDFGIAGLLGGHAGGRYLAMTPEMIATAVEIACSESLTLARIALGVEEKHGPLPCTLETLAKTLKKQGLTYKRARLSLKKTR

SEQ ID NO: 8317 - protein, 178 aa, Xenorhabdus bovienii; identical to SEQ ID NO: 8288
  Coding DNA sequence: Name=SeqID_2209
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 8318 - protein, 31 aa, Xenorhabdus bovienii
  Coding DNA sequence: Name=SeqID_2210
MVLNLQLIFLDYLNHQYIFLRFLSSFLLSYH

SEQ ID NO: 8319 - protein, 30 aa, Xenorhabdus bovienii
  Coding DNA sequence: Name=SeqID_2211
VSEIRKSGNVNERGFSHILRSVIHFLIMEE

SEQ ID NO: 8320 - protein, 78 aa, Xenorhabdus bovienii
  Coding DNA sequence: Name=SeqID_2212
LPDFRISDTILCTGKYRDMFLWINYKSDIKFQHYHINPTFRTTFRNKMIHRVAPIFSAVHFDTPVFPSPYGVPETRKY

SEQ ID NO: 8321 - protein, 538 aa, Xenorhabdus bovienii
  Coding DNA sequence: Name=SeqID_2213
  Homolog annotation: Query=1..538bp; Hit=1..538bp; Blast score=821; Percent Identity=74.0; E value=0; Homolog= ref|NP_927678.1|
MSLSEPAIKRLDHLGLVAAFCHEIGLPRMIDAILPKYAEHTVSHGEALLAMILNGLGFHSRTLHMCPDFFKHKPVERLIGVGIMAEHLNDDVLGRTLDALFDCGVSEIYQVIAERVIDKLALKSDSVHLDITSFHVDGEYKLPDDDETKRLVLVRGYSRDHRPDLNQVVLQLICENQAGIPVYMQAMSGNTNDTKAFAETTKHHIGCLKAAQNSRYLIADAALYTQETLASLHQQNQKFITRVPLTIKEAKQHLLTVNTDQLQPVTEGYAGHWIESCYGGVPQRWLLVNSEAAMQCEHQTFRKNTRISTEKELKQFEKLSKKSFPCGEDALQALCDFEAECQFIGIEAPKVQKIEVHKGRGRPAKGQHPDSVHYQLSASVYSQLGKVAYARLKVGMFILATNEMDDKALNMETLLANYKAQQKVERGFRFLKSPEFLTSAIYLKKPERIEALLMIMTCSLMVYAALEHKIRTGLKQNAPFYPDMKGKPTQSPTARWVFLTFEGISTFEFQEHRMVTGIQVYQNELLKILGQPYESFYS

SEQ ID NO: 8322 - protein, 33 aa, Xenorhabdus bovienii
  Coding DNA sequence: Name=SeqID_2214
VIETFDGRFRERHVGLPVNRSNRSKPKIAVNLI

SEQ ID NO: 8323 - protein, 44 aa, Xenorhabdus bovienii
  Coding DNA sequence: Name=SeqID_2215
LLAVYSGAFSVLTYTLMGITLLAVMVCFMTLRKVQIAFNSSVSK

SEQ ID NO: 8324 - protein, 90 aa, Xenorhabdus bovienii
  Coding DNA sequence: Name=SeqID_2216
MLLDVGYFWINAARVRHMGKAYRPIKETIIGFTRGLMAFAFRDVDLSCLGLACCVPPLGWRQATLKMPEGCLPTYLIISCWLFIAVLSVS

SEQ ID NO: 8325 - protein, 475 aa, Xenorhabdus bovienii
  Coding DNA sequence: Name=SeqID_2217
  Gene classification: Gene name=GatA; Function=Asp-tRNAAsn/Glu-tRNAGln amidotransferase A subunit and related amidases; Function class=J Translation, ribosomal structure and biogenesis
  Homolog annotation: Query=3..453bp; Hit=1..448bp; Blast score=153; Percent Identity=31.0; E value=3e-37; Homolog= mlr0229 COG0154
MVMSREDLSILSATEISKLVHQKDVSVREVATAVIARLDGVNPHINAVVEYRPEEIIRRAEELDIALAKGESVGTLAGVPVTIKASIDQIGFATTDGVRAREHEFPPSNSAVVDHLLKSGALLIGRTNTAAFSYRWFTENRLYGSTRNPHNPSLTPGGSSGGAAAAVAAGLGAIAIGTDLAGSIRYPAYACGVHGLRPSFGRVARFNPTDPEKVPIGVQLMAVTGPVARTVNDLRLAMDVIAREDIRDPWWVPAPMVGYDAPKCAAFCVRPNGLDTQPDVADALYDAAGKLRDAGWTVVELEDIPSLRSASDIQLTLWLGEDYEGQLLAVQEDGDPGALNFLNMYREFAHSVSLVNYSSALSRLHTIACEWQQFLSEKFAVILLPTSAELPFSNNLDLECETSFMRVWNSQMPMLTLPVTGLPCVNLRTNLISTPSGETIPVGIQIVSARFREDLCLKAAEDIEKRGEPVEVVTP

SEQ ID NO: 8326 - protein, 31 aa, Xenorhabdus bovienii
  Coding DNA sequence: Name=SeqID_2218
MSSPIRCRETCNLVLQGYGLISNINIGYGDV

SEQ ID NO: 8327 - protein, 83 aa, Xenorhabdus bovienii
  Coding DNA sequence: Name=SeqID_2219
  Gene classification: Function=Uncharacterized proteins of WD40-like repeat family; Function class=S Function unknown
  Homolog annotation: Query=1..83bp; Hit=720..801bp; Blast score=86; Percent Identity=50.0; E value=4e-18; Homolog= PA2290 COG1520
MGGPLVTKRGVTFFSGSMDYYLRAIDSRSGSELWRSRLPVGSQAAPITYIGKKTRKQFVVVTAGGAQRSDKDRGDYVIAYTLP

SEQ ID NO: 8328 - protein, 67 aa, Xenorhabdus bovienii
  Coding DNA sequence: Name=SeqID_2220
VTPLLVTRGPPMVGNPIGKCNLLWPVLSGRGTIRDQSNRSRYYMTRMEPRLGFHCDCTISALINGNH

SEQ ID NO: 8329 - protein, 302 aa, Xenorhabdus bovienii
  Coding DNA sequence: Name=SeqID_2221
  Gene classification: Gene name=AraJ; Function=Arabinose efflux permease; Function class=G Carbohydrate transport and metabolism
  Homolog annotation: Query=1..300bp; Hit=172..472bp; Blast score=144; Percent Identity=32.0; E value=8e-35; Homolog= mll6183 COG2814
MANIASATATSMNWLLAARVIVGFCMGGIWAIAGGLAGRLVSPGSVGLATSIIFGGVAAASVFGVPLGAFIGDAFGWRAAFLAMAILAMLVLILLIKSLPSLPVNNSVTIGQFAEVLANRKVLVGLLVTFFLVAGHFMAYTYVRPLLRTVSKFDNSWISPLLFAYGLAGIAGNFLAGSAATKQLRWTLVFIAIGITAAVLLFSPLGGSITGGSLITLLWGVAYGGVSVSLMTWMMIAASKSIEVATSLYIAIFNIGIASGSFLGSQVVDKYGLLTNTTLAGVVAILALAVLIFSNIKADPAH

SEQ ID NO: 8330 - protein, 294 aa, Xenorhabdus bovienii
  Coding DNA sequence: Name=SeqID_2222
  Homolog annotation: Query=1..283bp; Hit=1..283bp; Blast score=353; Percent Identity=60.0; E value=1e-96; Homolog= ref|NP_927686.1|
MSNLEELYCCVDDFCQKFIPLWHQQLIENGLRKRHREASLSLSEVMMILILFHMSHYRDFKTFYIEHVKQYFTADFPGLVSYTRILTLKKRALIPLCAFLSSRKAQTQGIAFIDSTKIAVCHNLRIPRHRVFEGMAQRGKTSTGWFYGFKLHLVINDCGELLAVKLTTGNQDDRQPVRALTKGLTGCLYGDKGYLSQALCDELEAEGITLITNVRSNMKTKALSLWDRLMLRRRFLIETVVDQLKNISQIAHSRHRSQLGFLLEVAAGLIAYTFQPKKPSLNLRDNEIAIFKRS

SEQ ID NO: 8331 - protein, 96 aa, Xenorhabdus bovienii
  Coding DNA sequence: Name=SeqID_2223
  Homolog annotation: Query=8..87bp; Hit=13..92bp; Blast score=64; Percent Identity=42.0; E value=4e-10; Homolog= ref|NP_744791.1|
MNRSHPVEEQTGNVMRPWLAVTAIGLSTFSVVTTEMLPVGLLNPIADTLNSTVGTAGLMISLPALLAALFAPLAVLASGGINRRTILCFLINLSFV

SEQ ID NO: 8332 - protein, 303 aa, Xenorhabdus bovienii
  Coding DNA sequence: Name=SeqID_2224
  Gene classification: Gene name=LysR; Function=Transcriptional regulator; Function class=K Transcription
  Homolog annotation: Query=4..287bp; Hit=2..284bp; Blast score=201; Percent Identity=39.0; E value=9e-52; Homolog= mll2784 COG0583
MPFDHLSDILVFVRVADAHSFTMAAEKLGISRSAAGKCITRLEKCLTTRLIHRTTRSVSLTEEGQVFYEHAIRILAEVDEAGNVINKRNQTPKGRLRIDLPVAFGRLHVLPILRNFLERWPEVDAEVTFSDEYSDLVRDGIDLTIRIGGNDDSRLVRKVLAPHRLITCASPHYLETYGIPEVPDDLLHHDTLVFSHRGMPVPWHYEVNNQHRDYPAKGRMRFNNTEALRDAALAGCGLCQVGAFLVGEQVAAGTLVPVLDRFCRTEPPICAVYPTKRHLSPKVKGFIAAIEDCWHGQAVWEPT

SEQ ID NO: 8333 - protein, 40 aa, Xenorhabdus bovienii
  Coding DNA sequence: Name=SeqID_2225
LPQLKIVGTGKLYGNPLDKFLSTISVLKNLILKNPSMNIA

SEQ ID NO: 8334 - protein, 36 aa, Xenorhabdus bovienii
  Coding DNA sequence: Name=SeqID_2226
LVEHNLAKVGVASSSLVSRSNILSINFKLLLIFTPL

SEQ ID NO: 8335 - protein, 43 aa, Xenorhabdus bovienii
  Coding DNA sequence: Name=SeqID_2227
MFLKWMYTLIGECFLNVWHKSACKGLVIFSEQVHNSAYSGHAD

SEQ ID NO: 8336 - protein, 1122 aa, Xenorhabdus bovienii
  Coding DNA sequence: Name=SeqID_2228
  Gene classification: Gene name=PorB; Function=Pyruvate; Function class=C Energy production and conversion
  Homolog annotation: Query=406..670bp; Hit=54..317bp; Blast score=340; Percent Identity=59.0; E value=4e-93; Homolog= mlr5175_2 COG1013
MTRHYPSKFVTGTDALAELLLAQAELDKSHNLNTAGFVSGYRGSPLARLDQALWQHGKELAQANIRFQPAINEDLAATALIGTQKVESDPDRNVIGVFGMWYGKGPGVDRSGDALRHGNAYGSSPHGGVLVLLGDDHGCVSSSMSHQSDLALMAWSMPILHPASVSDYHDVGLWGWAASRASGAWVGFKAISEVVESSAIRESKPFPEYETPEIDSGPDGLHWRWPDLPGPQIEKRLAYKLKAVEAFARANPIDQLLAPCAHPRALLVTVGKAHRDVLEALRAGGLTPSQLAKQGVAFVHVRLVYPLSPLLSDLASQVTDIFVIEEKNAVVEILLARHLVNSQKNIKLIGKHNHLGQQLLPADIELRPSLITPLLSGWLHKLDLFLSVPLEWATKTTPHDLTLPKRTPYFCAGCPHSTSTRLPDGSQAHIGIGCHVMAAWMDRNTGFGFVQMGGEGADWVGHSPFINRPHVFQNLGDGTYFHSGHLSIRQSVAAGNRITYKLLFNQAVAMTGGQPLDGNLTISQIAALMLAEGVKKVAIVTDNIDKYQDKNLLPAKVTLYQRDYLEEVQKRFREIAGVTVIIYDQACATELRRKRKRGLEPKATRRAVINELVCEGCGDCQVQSNCLAVIPVKTPLGTKRKIDQHVCNSDLSCLKGFCPSFVTVENANPRHDLSKIIPQGDLDKLLRELPQPTPIISDNPYEILLVGVGGTGIVTAGNLLAIAAEADNYSVSLLNFTGFAQKGGEAITHVRLCHDMNKLHQVRIDRGRANLVIAADLVATTGQNSLTVMSKNATKCVLNTHETQIGTMLRAPTLNLDHPKMMTTLHQHCQTLNSIDAEIMAADLVGDRNQTNIVLIGYAWQLGKIPITLSAIDHTIQALGNATDSARRAFHIGRIAAVQPDILNERLHIKPQKSIKTLDDLIMHRYQFLVDYQNERYAQRYLSRVAQIQLVTQQIDAEEIVKSVSENLFKLMAYKDEYEVARLYAKSDFFENLRSQFDNTDNIRFHLSLPLFNRKDPRTGERGKKEYGTWIIPILRVLAACKPLRGTMFDIFGYQEERKQERNLLLEYERLLDFLIEKLNRDNLAICQQLAELPDQVRGFGHVKQKAIKNMMERKEALLEEL

SEQ ID NO: 8337 - protein, 40 aa, Xenorhabdus bovienii
  Coding DNA sequence: Name=SeqID_2229
MNERLRKHRSHCWQVFMQPFSLTQIMRHYQYAFFDMTSPC

SEQ ID NO: 8338 - protein, 393 aa, Xenorhabdus bovienii
  Coding DNA sequence: Name=SeqID_2230
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=3..385bp; Hit=1..384bp; Blast score=283; Percent Identity=43.0; E value=3e-76; Homolog= PA3328 COG0654
MLMSRKPSALIVGTGIGGLSCAIALKKIGWSVRLFEKTDSLRATGSGLSVMSNASSAMKKLLDIDLGLKNYGAEVRDFEIRHSSGLLLKRLPVQKISDEQGAPSICISRENLQRALLDQLGDADISFGKRVTGYNETSDAVHINFEDGTVSSGDIIVGADGFYSAIRDAIGTESIIQEAGYICWLALVKYSHPKITPGYVAHYWGRGKRMGIVDIGDGWVYWWGTANMSNDDAKKWKGTNRDVAEFYAGWPDLVQDIINSTDSESIITVDAKDRTFPENWTKGRVTLLGDAAHPMLTSLGQGAGISIEDAAVLGYVLKNTEDYSAALRRYEAIRQPRARAIVNTSRSLSDIEQHDRFFPCLERDVGMLLTSKKSMRKRLQDSLLFDDLAIQAQ

SEQ ID NO: 8339 - protein, 2380 aa, Xenorhabdus bovienii
  Coding DNA sequence: Name=SeqID_2231
  Gene classification: Gene name=EntF; Function=Non-ribosomal peptide synthetase modules and related proteins; Function class=Q Secondary metabolites biosynthesis, transport and catabolism
  Homolog annotation: Query=1054..2098bp; Hit=7..1030bp; Blast score =741; Percent Identity=41.0; E value=0; Homolog= PA3327_2 COG1020
MSIAEPTSYERDLWVEELHDPHCHQFTVALSELLPRSIDLVNLKRVAEQVLESEQASHKSFHEQEGHLVLRKAPVVVCAELYEFKNEDDFASFFKEWPRKIWDLSVPPLLDIAIGQTDQATILMIRAHHIVADGWGLNLLSKKILGAYADNHLGLNEQLKGVKRYATKYPTLEGSKLDEAIDDVVVKIADTDPVLFPKSGATLSTSPSYIRPFKISAHEVAHGIENGFTPFLAVSTALAVLLSNAYGSEKFFIGVPFLNRTDTEITSVSHRANILPVKVEVLPQNTLRAIYSQIKDFIVFLKDKESVPLGGIISALASSSRQLFDVTMSYLRYPEWGAIAGFEEKTQNIAHIHTQDAIAIHLYTYGNNADVWGDVCLNSSVFDTEESANAFLDTFIHLIDNFGNNVDKRVSEVNLLTFKQTEQLRQYENGPTKPYSVNETVVSLFEAKAEQFPENIALRDHTGTSLSYSQLNAWSSTIAAALEERGIGQGDIVAVSVERSPEMLAAIFGVLKTGAAYLPIDSDYPEDRIQYMLNDSNAKLVISNLPHVMKSDDPRWFDLDALPTELPSHYKYKSKAQPNEPAYVIYTSGSTGRPKGVIVEHHSVVNRLEWMQEIHPLTSDDVILQKTSISFDVSVWELFWWAMTGASVALLKQGAQRDPRELIQTISTHGVTVAHFVPSMFEPYVQTLNDDRQSLLSVSSLKCLFTSGEALTPAVVNKYRKIFSHDICPPRLINLYGPTEATVDVTYYELNLEQDSDINAVPIGFPINNTSVRIASLHGVRQPIGISGELQIGGVQLARGYLNRPELTAERFIIDQNDSCSRWYRTGDLAAWAEDGSILYLGRMDGQVKIRGNRIELGEIKNALLNLPEVLNAEVIVEDDARGKHLVAVYVGRRDLNERDIRAKLGKQLPSFMVPARFVRLGCIPLTPNGKFDRVSALREVSGNKTSPQTVKLDESETIVAKIWEKVLGRSNISADDDFYALGGDSILMLKVRSELESHGYGVGLSDLAQYTTVRSLGNVLESVSRVLSSPKEALPPFALISEIDQKRLSSAYDDAYPVSQLQLGLLFHSREMEGARTYKDVFRYTLKLAWNEVAFRSALQGLARRHPALRTVFNLSDYHLPLQLIRPEILIDDVLSIETPDVVEYEHTVLAHMDKWSRYNYSFASGPLFHVAIFANSESNYIDLVFSFHHAILDGGSVANLIRELLLSYSQGNDGANLGYPEDELPNPSVFVQNEIEVLEASEPRSYWKEYLSGATNTLPIGLAGYSTAPVKRIFSYRFLIDPVLDAALNQLARTIRVPIKHLYLAAHCTAIALMSGKEDIVTGVVTHTRPEIKHSERILGLFLNTLPLRVDIKSLNWLQVVEGLYRNEKRSHKHRCFPLSQIQADNELFSLQTAFNYVHFHILQDISEKTDIEIVAFDPKEETNFDILVNVMRDVDGKRTSVRMDINGSVYAREQGAVFSRLFNRALERIAYQPEMPVSLSRPITEVGCLVERISDKAFISLPATIRNSVQRDPDAVAITYGDSEWSYQQLWDAATRIAFLLSERGVNKQDVVGIALPRSFEQIATVVAILRIGAICLPIDLSYPASRIELILKIANPAVVVTDRSVTELPASERVLFLEYDSIEAVAERDDAAIDSTDAAYILFTSGSTGTPKGVTMLHRGLSNLVGWQNKIRSGAKVTSTLQFSPLSFDVSFQEILSTLSSGATLHLISEMERRDPVALVRHLDHKGVERIFLPYIALQQLAETAVMLGFFPKKLRVIVSSGEQLRVTKEIRTLVDNLPGGILENQYGPTETHVVTSYTMSSDPSQFPALPPIGIPITGVGIVILDESSNVVPDGVPGEICVFGEALASGYYRSPEETKKKFIAHADVPGGMFYRTGDIGIRSACGEIISLGRKDTLVKVRGYRVELSEIELKILEFFENRRESVEVAVVARPRDDLDSYLIAYLVGKEDRIALEELRQFIGAELPAYMVPTHITWINELPKTPSGKRDDAMLRKLDIQLVSEKNYRGPEGEYESRLCELTAELLKIPEIAPEQSIFDCGATSLTAMRIVVLVEKLYGINVPLSAFVSAPTIAKLAMLIQDGGGQFKFDPLVPLREAGNRRPLFLVHPMGGNILSYLRMLPHLPSDQPLYALQASGVDAGSSPITTIEEQAAFYIDAIKRIQPTGPYVIGGWSYGGFIAFEMANQLIRSGETVSNVLILDTMALSSQAKGQASDDALLSWFFWELLWTSKGSSLPVQVVPSYIESLQEKFEYITDHATQIGAIPEGSTKAVMQRLFEVYNANWQAAAEYNAQCPNLDVTLIRARQPLPQILQEMHNTIRSEYHDPLNGWGGKTSGRVNLIEVDGDHLTIMEEPFVGPMVSAIITEINKVKGVDANV

SEQ ID NO: 8340 - protein, 63 aa, Xenorhabdus bovienii
  Coding DNA sequence: Name=SeqID_2232
MTLALRITTQTEYFWAEAVPLIQPSQTAPSRLLIFEKIISDDIICYRTHNMSLNDILCQMTFC

SEQ ID NO: 8341 - protein, 253 aa, Xenorhabdus bovienii
  Coding DNA sequence: Name=SeqID_2233
  Homolog annotation: Query=47..235bp; Hit=20..214bp; Blast score=107; Percent Identity=34.0; E value=1e-22; Homolog= ref|NP_626620.1|
VSNDILLIVSLVNYYISVLLCNNGGSNTDHLFQTGGNRRVTDREKVGRRERKKLMLRDALIKTSYELFAIKGFDETRVEDITEKVDVSTRTFFRYFSSKEDVVLDYQEAEHKDFIAALIRRPPHEPALSALRHTAVEIMKRCEGGSYGFNTNCFMTLQDLIRNHPLIRAKNLQRGEDRKPPIISLIAQRMGTDPKIDIRPGVLAGVLDYAHWATYDVWKRKKHSSMLYSDVLDEVFLIIENGLNFPANNQPDI

SEQ ID NO: 8342 - protein, 35 aa, Xenorhabdus bovienii
  Coding DNA sequence: Name=SeqID_2234
MVSTFQQTISQISSDLTLDNRKVRVNAGRGLLTTG

SEQ ID NO: 8343 - protein, 58 aa, Xenorhabdus bovienii
  Coding DNA sequence: Name=SeqID_2235
LVEHNLAKVGVASSSLVSRSKFRTVDFYEILQVTEKRTERSFFRSSDNDQNPLASCAF

SEQ ID NO: 8344 - protein, 81 aa, Xenorhabdus bovienii
  Coding DNA sequence: Name=SeqID_2236
LCAKGLPSSPNKSIIAPILVRKYRKIPLNQMVIGCSYLEIKADSSHQQCGNSSVGRAQPCQGWGREFESRFPLQIQDCRFL

SEQ ID NO: 8345 - protein, 49 aa, Xenorhabdus bovienii
  Coding DNA sequence: Name=SeqID_2237
MRQKNEGNNGCKMSMSRQLECILNVWYWVVCKGLAIFSKQVHNSAHLGT

SEQ ID NO: 8346 - protein, 32 aa, Xenorhabdus bovienii
  Coding DNA sequence: Name=SeqID_2238
MDILHPLLPSFFCRIAGSICHSLLTIDERLKS

SEQ ID NO: 8347 - protein, 71 aa, Xenorhabdus bovienii
  Coding DNA sequence: Name=SeqID_2239
MAAYRSIFGWTPLMTATAFLPFAIALIATGRIATPLVGRIGAARVTSTGPMVNSVHVSVINSGLALPMDSH

SEQ ID NO: 8348 - protein, 95 aa, Xenorhabdus bovienii
  Coding DNA sequence: Name=SeqID_2240
LFADLIINQRKERDFLCWGACQGNDFSYNALPVPMKNFNSTAYRKYYAKSTTHRYVSGNSSVGRARPCQGRGREFESRFPLQFLLCKPPRKSAIL

SEQ ID NO: 8349 - protein, 181 aa, Xenorhabdus bovienii
  Coding DNA sequence: Name=SeqID_2241
  Gene classification: Gene name=Orn; Function=Oligoribonuclease (3' ->5' exoribonuclease); Function class=F Nucleotide transport and metabolism
  Homolog annotation: Query=1..180bp; Hit=24..203bp; Blast score=320; Percent Identity=85.0; E value=3e-88; Homolog= orn COG1949
MSKNENNLIWIDLEMTGLDPERDRIIEIATIVTDSELNILAEGPVIAVYQPDEQLALMDDWNVRTHTASGLVERVKQSQFGDVEAEKATIAFLEQWVPAGKSPICGNSVGQDRRFLFRYMPELEKYFHYRYLDVSTLKELARRWKPEMLSGFSKKNTHQALDDIRESIAELVYYREHFIQK

SEQ ID NO: 8350 - protein, 51 aa, Xenorhabdus bovienii
  Coding DNA sequence: Name=SeqID_2242
VIGLNTALLPFGEFILSHRTSLISSILLIIAVSDQKRYDTPLIQTICFEGN

SEQ ID NO: 8351 - protein, 355 aa, Xenorhabdus bovienii
  Coding DNA sequence: Name=SeqID_2243
  Gene classification: Function=Predicted GTPases; Function class=R General function prediction only
  Homolog annotation: Query=14..352bp; Hit=1..334bp; Blast score=518; Percent Identity=74.0; E value=1e-147; Homolog= ZyjeQ COG1162
VAKNKLSKGQQRRVQANHQRRLKQPLDRAANKPEMDDSLFGEPQEGLVISRFGQHADIEAVDASIQRCNIRRTIRSLVTGDRVVWRPTLQLQTDVKVNGIVEAVHERTSVLTRPDYYDGIKPIAANINQIMIVSAILPELSLNIIDRYLVACETLNIEPLIVLNKIDLLDAESRAWVNSVMDIYRHIGYRVLEVSSHTGEGVSELVSQLVDKISIFAGQSGVGKSSLLNTLLPDDEKDILVNEVSDNSGLGQHTTTTARLYHFPQGGDVIDSPGVREFGLWHLTPEQVTQGFIEFREYIGECKFRDCKHQTDPGCALNAALEQGAIAEERFENYHRILESMAQVKPRRNFTDVQK

SEQ ID NO: 8352 - protein, 328 aa, Xenorhabdus bovienii
  Coding DNA sequence: Name=SeqID_2244
  Gene classification: Gene name=Psd; Function=Phosphatidylserine decarboxylase; Function class=I Lipid metabolism
  Homolog annotation: Query=21..304bp; Hit=1..284bp; Blast score=404; Percent Identity=66.0; E value=1e-113; Homolog= psd COG0688
MAGTIVDFCPICLSKIQEVDVLDNIKIKLQYLLPKQCITNLAGWFANKKAGWLTQLAIQSFAKVYKVDMNEAKNSSFTAYSTFNEFFVRPLKEGIRPIVNEAHQLALPADGTISQLGIIRDDQIIQAKGHYYTVEALLAGQHQLAEQFRNGHFVTTYLSPKDYHRVHMPCDGVLKEMIYVPGELFSVNPLTAANVPNLFARNERVICLFDTAFGPMVQILVGATIVGSIETVWSDCVTPPREGIIKRWAYPAAGQEGAISLKKGEEMGRFKLGSTVINLFAPNQIQFANNLYSGSQTLMGDLLAQAVTANEEQAANADDESMNKDIIS

SEQ ID NO: 8353 - protein, 1114 aa, Xenorhabdus bovienii
  Coding DNA sequence: Name=SeqID_2245
  Gene classification: Function=Small-conductance mechanosensitive channel; Function class=M Cell envelope biogenesis, outer membrane
  Homolog annotation: Query=1..1114bp; Hit=1..1107bp; Blast score=1258; Percent Identity=61.0; E value=0; Homolog= yjeP COG3264
VRLIISLLFSLFLANPAFASIAQLDETQLKQELKQVGGSKNPQDAEIAQALQGAINWLNDAKSTNERSQTYQQTIDDFPKIIKELRQKTLTESDIVPSIPANQSIGELEQQTLQTSSQLLEQERQLQQEQDKIREISDSMNLLPQQQVEARRLLAEATSRLQSLGTPPTPLTEAQLKLVQAEVSARKAATNELEMSQLSANNRQEIARMRADLFKKRYQRLDLKLQQLRNQLNIQRQQKAESALEHTEMLAEQAGGKLPQFLLDELHQNRQLSQLLSQQTQRMEAIGSQQRKAANDILQVRRTLNTIREQAEWLSDSTALGEALRTQLTRIPDVPKSQQLDRNIVELRVERLKYEEMQERSQQENDQALPSPQNLTSGQKQVYESLIRTRKELLNSLLSGYDNEILELTKLKVATNQLNDALKEIKDATHRYLFWVTDVNPISLDYPLLVVQDLTRLLSLDTLSQLGVAIHVMLTTKDTLLYLLGTLLLVIFSISSHRQYHAFLERSSNRIGKVTQDHFSLTLRTVFWSIVAALPLPILWSAIGYGLQNAWQYPMATAIGLGVSETTPVLWVFMLSASFANPNGLFISHFRWPEERIKRAMRFYRLSIFLVVPLMMALITFNNYSDREFAATLGRLCFLMLCVSLSLVTSSLKRAGVPLYMDKHGSGENIINSVLWWILLSAPILAALASILGYLQTAQALLGRLETSVAIWFSLLVIYHIIRRWMLIQRRKLAFERAKQRRAEILAQRAKSEEETANTNSSVEGSIEVEEPVIDLDAISAQSLGLVRSILTMIALVSLILLWSELHSAFSFLENIRLWDVSTTVNGVNTIQPITMGSVLIAILVIVITTQLVRNLPALLELALLQHLELTPGTGYAITTLTKYGLTLIGGIVGFSLVGIEWSKLQWLIAAMGVGLGFGLQEIFANIISGLIILFEKPIRIGDTVTIRNLTGSITKINTRATTLSDWDRKEIIVPNKAFITEQFINWSLSDTITRIVLTIPVPAETDSAEATDILMTASRRSPLIIDNPMPEVYLVDLQNGIQIYELRAYAAEMGHRMPARHEVHQYILQEFHKHGITLPFPPFQARVDIFGQEIRSATTNISGRNPPRKPGEL

SEQ ID NO: 8354 - protein, 401 aa, Xenorhabdus bovienii
  Coding DNA sequence: Name=SeqID_2246
  Gene classification: Gene name=ProP; Function=77 Permeases of the major facilitator superfamily; Function class=G Carbohydrate transport and metabolism
  Homolog annotation: Query=6..392bp; Hit=9..382bp; Blast score=72; Percent Identity=23.0; E value=8e-13; Homolog= BH3886 COG0477
MMRRIPFQISGLLALNGVSILGNAITDIAIPWLILEISGSPLLVAAVMSAKIVPLILSIFFSAQLVDKYGAFHISVLSDLVNFLSVLLIPVFYTMDIMHFYLLATLLIFSTILDSPGRLAKDVMLAKEIKQNKSEHELINGINSTIENICDLTGPVLGSLIIALFGTINALYFDAVSFLVVALGLIILKKHFVTIINEVTEVPSLPHHYFLEALKYVKSEKELFSILILSSVVNFVIAPFLIVYLPYVNKVEFNSVVSLGVSMTCFGLGTTFSSLLYGIYGKHFSSNQIILSGYSLLVLSLVSLNLFNGQYILFAQLFAIGCCIGFSAPVEITLIQRQVPENLFSRIMTLFSSTRFLAVPVGYVCFGTLLGSSLAKQTPLLMAAMVLGGLWIYLVMRRRAK

SEQ ID NO: 8355 - protein, 484 aa, Xenorhabdus bovienii
  Coding DNA sequence: Name=SeqID_2247
  Gene classification: Gene name=ARO8; Function=Transcriptional regulators containing a DNA-binding HTH domain and an aminotransferase domain (MocR family) and their eukaryotic orthologs; Function class=K Transcription
  Homolog annotation: Query=18..476bp; Hit=1..443bp; Blast score=357; Percent Identity=44.0; E value=1e-98; Homolog= Z3973 COG1167
MKTTLFQIDKLLQRHVSLPLYRQIYQRFIQAINQGILRPEQRVPSIRALSSELQVSRSTVESAYALLLNEGYLEARGQAGTIVSPRLADRVLQPPETLISSSIDVTSISLFDSASSIHPSPYQLGLPALDLFPRKLWNTLTVKQLRLQSRYMSYPQPEGYLPLREALAAYLQLSRGVSCSPQQIFITAGYRGALNLIAHTLIQPRDQVWLEDPCFPPSQHFLSQIGAEIIPVPVDQEGMNISVAQELAPNARFALVTPAHQSPLGVTLSMARRQMLLAWAEQNNAFVIEDDYDSEYQYDGRPHPALASLGSNNVLYIGTFSKVLTPTLRLAYLVVPPHLLTRFNAVCHTRQDGCPLLQQAVVTDFMQGGHFARHLRKMRTAYAQRRQIVIESLNQVFDSRLRFDIPAGGLHLLARLAHYEDDVALAQLAREHGLGITALSARRLSSDCGKGLLFSFANETTPENALKHAQLLQKCLPTTSRTSN

SEQ ID NO: 8356 - protein, 143 aa, Xenorhabdus bovienii
  Coding DNA sequence: Name=SeqID_2248
  Gene classification: Function=Uncharacterized ACR; Function class=S Function unknown
  Homolog annotation: Query=1..142bp; Hit=1..142bp; Blast score=152; Percent Identity=53.0; E value=2e-37; Homolog= Z3974 COG2128
MSSLRLAYYDLSPELLQGFRTIKQELEESPLGLALIELVYLRISQISGCAFCLNKHSQSLRENQETERRLSELAGWRVSGQFTLREKVALEWAESLTHVVTTHADDYAYLPLKDHFTDKEITDLTFAIALMNGMNRLAIGMRQ

SEQ ID NO: 8357 - protein, 46 aa, Xenorhabdus bovienii
  Coding DNA sequence: Name=SeqID_2249
LFICFLSKLNNLSWLKTLILSLIRIDGLLYRLPYSQRYEIRSFIHE

SEQ ID NO: 8358 - protein, 117 aa, Xenorhabdus bovienii
  Coding DNA sequence: Name=SeqID_2250
  Gene classification: Function=Uncharacterized membrane protein; Function class=S Function unknown
  Homolog annotation: Query=1..114bp; Hit=1..114bp; Blast score=105; Percent Identity=54.0; E value=6e-24; Homolog= yhaI COG3152
MNWYLNVLKNYANFSGRARRKEYWIFTLFNYIAIIVLCVLGSAISETLGVGLLGIYAIVIFIPSLAVMIRRLHDTNRSGWWFLLAFVPILSIALLVFFCLEGSKGDNDFGADPKGML

SEQ ID NO: 8359 - protein, 35 aa, Xenorhabdus bovienii
  Coding DNA sequence: Name=SeqID_2251
VPEVSMYIVFLVWYLGEFLNSFPYDTVINNQILLF

SEQ ID NO: 8360 - protein, 31 aa, Xenorhabdus bovienii
  Coding DNA sequence: Name=SeqID_2252
LVISVKNKIITSKDNPQYLQPKLPLSFLKTN

SEQ ID NO: 8361 - protein, 37 aa, Xenorhabdus bovienii
  Coding DNA sequence: Name=SeqID_2253
MGTWKASFMKGRLYDIDCHNRDERNYSHGHTEKSVCF

SEQ ID NO: 8362 - protein, 337 aa, Xenorhabdus bovienii
  Coding DNA sequence: Name=SeqID_2254
  Gene classification: Gene name=PurR; Function=Transcriptional regulators; Function class=K Transcription
  Homolog annotation: Query=12..324bp; Hit=7..321bp; Blast score=174; Percent Identity=31.0; E value=2e-43; Homolog= BH3241 COG1609
MNSHLKRVTRSDVAKEAGTSVAVVSYVINGGPRPVAEATRQRVLAAIKKIGYRPNNIAKALVSGTTQSYGLILPDISNPFLSSVAYALQQEAFKHGQVLLPGDSGDNRTREKELINNLLNRQIDGLLYTSVDRHPYIDLIQASGTPCVMLDWVNADLNVSAIRVNERLAAFKVTQHLIQHGYRDIAIICGPRIMLNTQDRLSGWSDALEQANLTVREEWIFSTEYTRQGGYEATLRMLKGKRPRALFASNELQAFGCLRALAEHRLTVPDDIALVCFNATQQSLFNVPSLTAVRQPIDKMAQTAIEILRTWNGKAQEREFEFELQIGESCGCGLEQS

SEQ ID NO: 8363 - protein, 465 aa, Xenorhabdus bovienii
  Coding DNA sequence: Name=SeqID_2255
  Gene classification: Gene name=ProP; Function=77 Permeases of the major facilitator superfamily; Function class=G Carbohydrate transport and metabolism
  Homolog annotation: Query=23..465bp; Hit=16..453bp; Blast score=583; Percent Identity=69.0; E value=1e-166; Homolog= Cj0339 COG0477
MPSESAIIAGTYVQHASEVCLTTEEGRKDFRRAIFSCWLGTTMEYADFALYGLAAGIIFGDVFFPDATPTAALLASFAAYSVGFVARPIGALVFGWLGDRKGRKIVMMMTVMLMGISTTLIGLIPSYAQIGVLAPVCLVILRFMQGLGAGAALSGGAVILGEFAPPEKRGLISSIIALGSNSGTLLASLVWLLVLTMDKERLLDWGWRIPFLFSFLIAIVALFIRRHMNETPVFERHQAELKAQRLQTLSEGKAYQADCERCRFWKRTKAFWIMVGLRVGENGPSYLAQGFIIGYVAKVLMVDKSVPTIAVFIASVLGFLIIPLAGYLSDRFGRRITYRWFCLLLMMYAFPAFILLDSREPIIIIPTIVVGMGLASLGIFGVQAAWGVELFGVANRYTKMAFAKELGAILSGGIAPLMASALLSFAGHWRPIACYFILMAGIGFLTTFFAPETRGRDLNLLEDAI

SEQ ID NO: 8364 - protein, 30 aa, Xenorhabdus bovienii
  Coding DNA sequence: Name=SeqID_2256
MISRKTLSLLINVFYIKTIYSRRILKKKVR

SEQ ID NO: 8365 - protein, 266 aa, Xenorhabdus bovienii
  Coding DNA sequence: Name=SeqID_2257
  Gene classification: Gene name=Cof; Function=Predicted hydrolases of the HAD superfamily; Function class=R General function prediction only
  Homolog annotation: Query=1..264bp; Hit=40..303bp; Blast score=366; Percent Identity=64.0; E value=1e-101; Homolog= Z5347 COG0561
MYHVVASDLDGTLLSPDHKLTPYTKETLNLLTNKGIHFIFATGRHHIDVGQIRDGLGIDAYMITSNGARVHNTQGKLVFSHNLAPDIALDLCLMEFDNPNTLTNYYRNDDWFINRESPEQNEFFQESVFQYQIFPRDNFPTDGVCKVYYVSEDHDYLEQLEETIKARWGDSVNVSFSLRNCLEVMAGGVSKGHALEQVCQAIGYQLSDCIVFGDGMNDQEMLSVAGKGCIMQGAHQRLKDILPEMEVIGANADDAVSYYLRSMYQV

SEQ ID NO: 8366 - protein, 336 aa, Xenorhabdus bovienii
  Coding DNA sequence: Name=SeqID_2258
  Gene classification: Gene name=PldB; Function=Lysophospholipase; Function class=I Lipid metabolism
  Homolog annotation: Query=10..336bp; Hit=8..329bp; Blast score=365; Percent Identity=55.0; E value=1e-101; Homolog= ZpldB COG2267
MAPEILKASWLNREPQFSAFTNGLLLDFWKTRDEREFMGVDDIPIRYVSFRSLHHDKTLLILPGRSESYVKYPEIAYDFYHLGYDIFIIDHRGQGRSGRMLDDPQKGHVEKFDHYVDDLAKFVELEITPRQSHRCYALAHSMGAAILSRFLLRQELVRQEPDFRAVALCAPMFGINLPMPRWLANFLVNQAEPYPKRRNSYAVSTGQWRPLPYLINLLTHSYARYQRYLRYYADYPELRLGGPTYHWMRESMQMGDELIENAGVIQTPLIVLKASEDKVVNNRELLAFCESRQKARTGKAEKKPLVIQGAHHEILFEKDALRAQALNAICDFFDQH

SEQ ID NO: 8367 - protein, 608 aa, Xenorhabdus bovienii
  Coding DNA sequence: Name=SeqID_2259
  Gene classification: Gene name=RecQ; Function=Superfamily II DNA helicase; Function class=L DNA replication, recombination and repair
  Homolog annotation: Query=1..608bp; Hit=3..609bp; Blast score=983; Percent Identity=77.0; E value=0; Homolog= ZrecQ COG0514
VSTAEAISTASLAEQVLRKTFGYQQFRPGQQQVIDAVLDGRDCLVVMPTGGGKSLCYQIPALINNGLTLVVSPLISLMKDQVDQLRANGVEAECLNSTQNREQQIDIVQRCRQGSIKLLYIAPERLVTDNFLDQLHDWHPVLLAVDEAHCISQWGHDFRPEYRALGQFRRRFPELPFIALTATADKTTRQDITRLLELHDPLIHLSSFDRPNIRYTLVEKYKPLDQLWSFVRGQQGKSGIIYCNSRTKVEETAERLQKRGLSVAPYHAGLDNNQRAWVQDAFQRDDLQVVVATVAFGMGINKPNVRFVVHFDIPRNIESYYQETGRAGRDGLPAEAILFYDPADMAWLRRCLEEKPAGEQQDIERHKLNAMGAFAEAQTCRRLVLLNYFGESQQTSCGNCDICLDPPKRYDGLVDAQKALSCIYRVGQRFGIGYIVEVLRGANNQRIRDFGHDRLPIYGIGKEQSQEHWMSILRQLIHLGLISQNIANYSALQLTEAARPVLRGEASLQLAVPRIQSLKSRNQQNKSYSGNYDRKLFAKLRKLRKSIADENNIPPFVVFNDVTLIEMAEQCPITPNELLLINGVGQRKLERFGDVFMALIRDHFEGSE

SEQ ID NO: 8368 - protein, 46 aa, Xenorhabdus bovienii
  Coding DNA sequence: Name=SeqID_2260
LFSQRCRADGFCGRHAFPQSFKKTGSKKYRRDSGACTYYAISLLKQ

SEQ ID NO: 8369 - protein, 47 aa, Xenorhabdus bovienii
  Coding DNA sequence: Name=SeqID_2261
VTFLFWDSRFYTQLFSGYGESMIDDDFGKIRFGIGTMLNDMLSLFQQ

SEQ ID NO: 8370 - protein, 43 aa, Xenorhabdus bovienii
  Coding DNA sequence: Name=SeqID_2262
MVNNLLSLCFYNSSYQFAKHLGKQFIEGKLTTENYHSVCRINR

SEQ ID NO: 8371 - protein, 161 aa, Xenorhabdus bovienii
  Coding DNA sequence: Name=SeqID_2263
  Gene classification: Gene name=PaaI; Function=Uncharacterized protein, possibly involved in aromatic compounds catabolism; Function class=Q Secondary metabolites biosynthesis, transport and catabolism
  Homolog annotation: Query=11..161bp; Hit=11..161bp; Blast score=201; Percent Identity=64.0; E value=3e-52; Homolog= yigI COG2050
METIQRSTQPLTQEEARKIIGELFVYHMPFNQLLGFELLRFDHDYAELRFRNQDKLVGNMAQKILHGGVIASILDVAGGLICAGNALTAMETITIAEMEKRLPTIGTIDLRIDYLRPGRGEVFTASSNIVRSGNKVSVARVELHNERQVHIASAMATYLVG

SEQ ID NO: 8372 - protein, 61 aa, Xenorhabdus bovienii
  Coding DNA sequence: Name=SeqID_2264
VATKCQWPELNCTMSGRCISPAQWQRIWLGDTLLTPKSQNKGMCHKNTFLFYRISTPIIGL

SEQ ID NO: 8373 - protein, 53 aa, Xenorhabdus bovienii
  Coding DNA sequence: Name=SeqID_2265
METLYILQHRGFYIKKGGFGNRDVCLLSGNIGIHYLSETDRNIYSAELSCEIV

SEQ ID NO: 8374 - protein, 30 aa, Xenorhabdus bovienii
  Coding DNA sequence: Name=SeqID_2266
MKNELGCINIVNYVINKYKLSIKRGHVLNS

SEQ ID NO: 8375 - protein, 56 aa, Xenorhabdus bovienii
  Coding DNA sequence: Name=SeqID_2267
MLIVVIVTNQKMSKDMEKVIEVIPATAAMPAVKSFSWHTPIKPANRESKSRLLIWR

SEQ ID NO: 8376 - protein, 92 aa, Xenorhabdus bovienii
  Coding DNA sequence: Name=SeqID_2268
MCHYPFHTRLPGIPEPALIFLTAHKRPLLIHFTDKMYVIPVKRKRRHVPGVEFLSVFITVAVATFNTRAVSRMPLLFIAISIICSLTPGLQA

SEQ ID NO: 8377 - protein, 140 aa, Xenorhabdus bovienii
  Coding DNA sequence: Name=SeqID_2269
  Gene classification: Gene name=InsB; Function=Insertion element IS1 protein InsB, putative transposase; Function class=L DNA replication, recombination and repair
  Homolog annotation: Query=1..139bp; Hit=27..166bp; Blast score=122; Percent Identity=43.0; E value=8e-29; Homolog= insB_g4 COG1662
VTTLPLDGDNIHLICEVDEQWSFVGSKKNQRWLWYAWEPRMKRIVAHTFGDRSRKTWEKLLALLSPFNIRFYCTDDYAVYDCLPEEVHLTGKIFTQRIERTNLTHRTRIKRLNRKTIGYSKSEEMHDKVIGTFIERENYI

SEQ ID NO: 8378 - protein, 43 aa, Xenorhabdus bovienii
  Coding DNA sequence: Name=SeqID_2270
VAKFYSSLTALTPCKSFIPVTHCMSANDSQALLIFFYIQGYYD

SEQ ID NO: 8379 - protein, 296 aa, Xenorhabdus bovienii
  Coding DNA sequence: Name=SeqID_2271
  Gene classification: Gene name=RarD; Function=Predicted permeases; Function class=R General function prediction only
  Homolog annotation: Query=1..293bp; Hit=1..293bp; Blast score=329; Percent Identity=63.0; E value=2e-90; Homolog= ZrarD COG2962
MTDQQTAKGVLYALGAYLIWGLAPIYFKTIQQVPPDEIVSHRVIWSVFFMVLLLTLTRHWRKVWVVARQPKKLLLLGITAFTIASNWLVYIWAVNNGHLLEASLGYFINPLVNVLFGMIFLGERFRRMQWIAVGLAFTGVLIQLWQFGSIPVVGLYLAMTFAVYGLIRKKLGVDSQTGMMIETVWVFPVAMIYLFCFTSSPTSNMLDNTLSLNMLLIAAGIITTVPLLFFTAAAAHLRLSTLGFFQYLGPTLMFLLATLVYGEQIGPERLITFGFIWAALILFTLDALYTQHRLRK

SEQ ID NO: 8380 - protein, 316 aa, Xenorhabdus bovienii
  Coding DNA sequence: Name=SeqID_2272
  Gene classification: Gene name=CorA; Function=Mg2+ and Co2+ transporters; Function class=P Inorganic ion transport and metabolism
  Homolog annotation: Query=1..316bp; Hit=1..316bp; Blast score=514; Percent Identity=84.0; E value=1e-146; Homolog= corA COG0598
MLNAFKLENNRLLRLELENGDQLSDSMWVDLVGLGDEDRLRVQNELGQVLATRTELDDIEASARFFEDEDGLHVHSFFYFEDAEDHAGNSTVAFTIRDSRLYTLRERELPAFRLYRMRARNQTMVDGNAYELLLDLFETKIEQLADVIENIYSVLESLSRVIMEGKQGDEFDSALSNLAEQEDIGWKVRLCLMDSQRALNFLVRRARLPANQLEQAREILRDIESLLPHNESLFQKVNFLMQAAMGFINIEQSRIIKIFSVVSVVFLPPTLVASSYGMNFEFMPELHWTFGYPAAIGVMIAAGLAPYLYFKRKNWL

SEQ ID NO: 8381 - protein, 724 aa, Xenorhabdus bovienii
  Coding DNA sequence: Name=SeqID_2273
  Gene classification: Gene name=UvrD; Function=Superfamily I DNA and RNA helicases; Function class=L DNA replication, recombination and repair
  Homolog annotation: Query=4..722bp; Hit=1..719bp; Blast score=1255; Percent Identity=85.0; E value=0; Homolog= ZuvrD COG0210
MVIMDVSYLLESLNDKQREAVTASRTNMLVLAGAGSGKTRVLVHRIAWLLSVENASPFSIMAVTFTNKAAAEMRHRIENLIGTSQGGMWIGTFHSLAHRLLRFHHLDANLPQDFQILDSEDQHRLIKRIIKAMNLDDKQWPARQGMWYINGKKDEGLRPQHIESYGNPVEATWLKIYQAYQEACDRAGLVDFAELLLRAHELWLNKPQILQHYRERFTNLMVDEFQDTNSIQYAWIRLLAGDSGKVMIVGDDDQSIYGWRGAQVENIQRFLRDFPGAETIRLEQNYRSTSNILKAANALIAHNSDRLGKSLWTEGGEGEPIALYCAFNELDESRYVVSRIKHWLDNGGALKECAILYRSNAQSRVLEEALLQVSMPYRIYGGQRFFERQEIKDALSYLRLVSNRYDDSAFERVVNTPTRGIGDRTLDVVRQVARDQQKTLWESCLLLLQQKVLAGRAASALQRFIELIDALETETQEMPLHVQTDRIIRDSGLWAMYQQEKGEKAQARIENLEELVTATRQFSYKDEDENLMPLQAFLSHAALEAGEGQADVYQDAVQLMTLHSAKGLEFPQVFIVGMEEGMFPSQMSLDEGGRLEEERRLAYVGVTRAMQKLTLTYAETRRLYGKSVYHRPSRFVGELPTECVAEVRLRATVSRPVSHKQLGTPISADDSGYALGQRVRHPKFGEGTVINIEGSGEHCRLQIAFQGEGIKWLVAAYARLETGQ

SEQ ID NO: 8382 - protein, 238 aa, Xenorhabdus bovienii
  Coding DNA sequence: Name=SeqID_2274
  Gene classification: Function=Predicted hydrolases of the HAD superfamily; Function class=R General function prediction only
  Homolog annotation: Query=1..238bp; Hit=1..238bp; Blast score=279; Percent Identity=59.0; E value=2e-75; Homolog= yigB COG1011
MRFYRPLAPFAAMTFDLDDTLYDNHPVIDKTEKEVLCFIRRYDVKFNHFEREDLYVYRQAVLESEPEIYHDVTSWRRQSVELMFSHHGFNREETLRGADELMACFTYWRNQIIVPESTYNTLSVLAKKMPLVAITNGNAELAACGLEPYFEFVLKAGVDGRAKPYPDMYHLAAERLNLPISQILHVGDNLKTDVEGALCSGMQACWINLENKNLMQEPEGRRVPHVEISDLASLIALI

SEQ ID NO: 8383 - protein, 304 aa, Xenorhabdus bovienii
  Coding DNA sequence: Name=SeqID_2275
  Gene classification: Gene name=XerC; Function=Integrase; Function class=L DNA replication, recombination and repair
  Homolog annotation: Query=12..303bp; Hit=8..298bp; Blast score=408; Percent Identity=69.0; E value=1e-114; Homolog= ZxerC COG0582
MTQPIDLLLEPVETFLHYLRVERRLSLLTITNYRRHLVVLASISLDMGIHEWQALDPAKVRMFASRSRRAGLQSASLALRLSSLRTFLDWMVIQGKLDANPAKAVSAPRKKRHLPKNMDVDEVNQLLNINLNDPLSVRDRAMMEVMYGAGLRLSELVGLDCRHLELESGEVWVHGKGSKERKVPVGRTAREWLQRWLEMREWFEPEDNAVFISTKSGKRISARNVQKRFEQWGVRQGVNSHIHPHKLRHSFATHILESSGDLRAVQELLGHENLSTTQIYTHLDFQHLAKVYDVAHPRAKRGKS

SEQ ID NO: 8384 - protein, 239 aa, Xenorhabdus bovienii
  Coding DNA sequence: Name=SeqID_2276
  Gene classification: Function=Uncharacterized BCR; Function class=S Function unknown
  Homolog annotation: Query=19..239bp; Hit=15..235bp; Blast score=252; Percent Identity=57.0; E value=3e-67; Homolog= yigA COG3159
MGHWKMGKNDDPLHLENWLNDQAVVDYLLNNPKFFVRNANRVDKIRVPHPVRECVSLMEWHMDRQRKRICHLEDDLIHLVEQAKQNEILFCRLLQLLADLSAAKSLQDFLSRLSSWSKTLGLSNSYVRLFSDKWRLGAPLNSPELAISRNFFEPVRIQRFGDSNHYLGTLYGPEILLLIPQARYVGSVAISLLGSQGELGMVIFNSRDKQHYHEGVGTDLLDHLAKLLPGLLSRWVERV

SEQ ID NO: 8385 - protein, 308 aa, Xenorhabdus bovienii
  Coding DNA sequence: Name=SeqID_2277
  Homolog annotation: Query=100..308bp; Hit=88..284bp; Blast score=65; Percent Identity=27.0; E value=1e-09; Homolog= gb|EAA20211.1|
MYQIVFQMTDALSLAIHVPFHQGDTFTHRMRNSYLIDPIGIADKKLRIIQQIIHYRLIIQPIFQVQWIVIFTHFPMPHISIMTQIKLNQSQMNRTFINVSCRPRHIERLARPVPTDLQSPPRQINANLAIQQVLLDTDGDSCTCTAATSPCLSCTTLKDTQSNMTTMHDLHETNIRPLRETVMIFQYWPQNLHFCGVDIFNLYHTMRISHRHNTAEHGALNSTDNIGFLRLIGTKRNMLWFKVRFSHIDTDLIIIGDAQYHTACLRTDLNITLIGQPFQANKTGKAARPVATLGNFTAISIKNAIVKV

SEQ ID NO: 8386 - protein, 49 aa, Xenorhabdus bovienii
  Coding DNA sequence: Name=SeqID_2278
LGHRINDHKIIAKTMHFGELHILLQHILLQEKPHKSALFLLSIRLCIVF

SEQ ID NO: 8387 - protein, 71 aa, Xenorhabdus bovienii
  Coding DNA sequence: Name=SeqID_2279
LAHELQALIIMMKKQFRWSLAIITLLAVSGCGLKGPLYFPPAEPTVTQQAPADQANKAQLEHNTQSDTQQK

SEQ ID NO: 8388 - protein, 105 aa, Xenorhabdus bovienii
  Coding DNA sequence: Name=SeqID_2280
  Gene classification: Gene name=CyaY; Function=Protein implicated in iron transport, frataxin homolog; Function class=P Inorganic ion transport and metabolism
  Homolog annotation: Query=1..105bp; Hit=1..105bp; Blast score=135; Percent Identity=70.0; E value=6e-33; Homolog= ZcyaY COG1965
MNDSEFHQLADQLMQRIEEQLDNYDGDADIDCETNGGVMTLTFENGSKIIINRQEPFHQIWLATKSGGYHFGCQENRWICDRSGNDFLSMLEQAITEQSGESFQF

SEQ ID NO: 8389 - protein, 84 aa, Xenorhabdus bovienii
  Coding DNA sequence: Name=SeqID_2281
VATTLVVRKTDGFVTAVVTIFYLCWNRRSQNRAANHFSFSIFLLLRNPSTAYAVLKYGIFITVHKPNRHKANRNNIKYKISQII

SEQ ID NO: 8390 - protein, 36 aa, Xenorhabdus bovienii
  Coding DNA sequence: Name=SeqID_2282
VIRSGSERTIFDFISGRGKSVYCITDYNKSADNFID

SEQ ID NO: 8391 - protein, 146 aa, Xenorhabdus bovienii; identical to SEQ ID NO: 8316
  Coding DNA sequence: Name=SeqID_2283

SEQ ID NO: 8392 - protein, 178 aa, Xenorhabdus bovienii; identical to SEQ ID NO: 8288
  Coding DNA sequence: Name=SeqID_2284
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 8393 - protein, 78 aa, Xenorhabdus bovienii
  Coding DNA sequence: Name=SeqID_2285
MVCFHRIIRNIMISRAVLMYIWMTRVGHTILVIRCIPIDIKRIICKIREFSAYHLLYSKRILLLVELIKYRFTLYFTK

SEQ ID NO: 8394 - protein, 866 aa, Xenorhabdus bovienii
  Coding DNA sequence: Name=SeqID_2286
  Gene classification: Gene name=CyaA; Function=Adenylate cyclase; Function class=F Nucleotide transport and metabolism
  Homolog annotation: Query=1..840bp; Hit=1..839bp; Blast score=1347; Percent Identity=75.0; E value=0; Homolog= cyaA COG3072
LYLYIETLKQRLDAINQLKLERATSSMSPVFKQVYNLIPVLLHYHHPMMPGYIKSNVPHGVCFFTSDESQQFWINDLAGQSTGILSHTPNGELPITGIYSMGSTSSIGQSCSSDLDIWVCHQSWLDHSEKALLEQKCTLIEQWAESLGIEVTFFLVDENRFRHNACGSLNGEDCGTTQHILLLDEFYRTAVCMAGKRLLWMMVPVEEEGQYDEYVLSLYAQGVLTPNEWLDLGGLNELSAEEYFGASLWQLYKSVDSPYKAVLKSLLLEAYSWEYPNGKLLSMEMKQHFHDGSIVSFGLDSYSMMLERVTRYLTATNDFTRLDLARRCFYLKVCEKMLGSHEDKGCTGWRHQVMSQLAHEWGWDASKLAMLDNRNSWKIGLVRDAHNELLDTMMMSYRNLIRFARRNNLSVSASPQDIGVLTRKLYAAFEALPGKVTLVNPQISPDLTEQDLTFIYVPPGRVNRSGWYLYNHAPTIETIIGHQPLEYNRYLNKLVAWTYFNGLLTKGSRIHIHHGKSQCDWNNLCDLVSDIATHFPIRLPAPTPKALYSPCEIRHLAIIVNLEKDPTTDFSNRIVHFDFRKLDVFSFGELQQCLVGSIDLLYRNSWNEVRTLHFSGEQSMLEALKTILGKMHQDAAPPAEVDVFCYSEHLRGLIRTRVQQLVSECIELRLCSNRQDPNRFKALRISGQTWGLFFERLNVSVQKLENAMEFYGAISNTKLHGLPVKIDPKEKHLPPVIDGFACEGIIQFFFEDIERSQGFNIYILDESNRVEIYSHCEGSKEELVRDVSRFYSSSHDRFTYGSSFINFNLPQFYQIIRKGERTHVAPFRDGVFPPDNTEHNDIACSIDVHLDDSCRSHDPCHSLYPY

SEQ ID NO: 8395 - protein, 53 aa, Xenorhabdus bovienii
  Coding DNA sequence: Name=SeqID_2287
VPKVAPVSDKASYCKMTFKNFYKIIVGNVINLTPCGRSVKYALPPFRLLRNSQ

SEQ ID NO: 8396 - protein, 30 aa, Xenorhabdus bovienii
  Coding DNA sequence: Name=SeqID_2288
MLKLTLFSRDLAAQKPLNTVINTITQYNYQ

SEQ ID NO: 8397 - protein, 313 aa, Xenorhabdus bovienii
  Coding DNA sequence: Name=SeqID_2289
  Gene classification: Gene name=HemC; Function=Porphobilinogen deaminase; Function class=H Coenzyme metabolism
  Homolog annotation: Query=1..312bp; Hit=8..319bp; Blast score=442; Percent Identity=74.0; E value=1e-124; Homolog= ZhemC COG0181
MTMKIIRIATRQSPLAMWQAQYVQKQLEQFHPELKVELVPMVTRGDVILDTPLAKVGGKGLFVKELELALLENRADIAVHSMKDVPVGFPDGLGLVTICERGDPRDAFVSVKYASLNELPIGSVVGTSSLRRQCQLRQLRPDLVVRDLRGNVGTRLGKLDNGDYDAIILAAAGLKRLGLEDRIRIPLAPELLLPAVGQGAIGIECRLDDKQTRELLAPLNHIGTEICVLAERAMNTHLEGGCQVPIGSYAIWQGNTIWLRALVGAPDGSMTVRGEKTVSPEEACRAGVELAEELLEKGARQILADVYQRNSPE

SEQ ID NO: 8398 - protein, 246 aa, Xenorhabdus bovienii
  Coding DNA sequence: Name=SeqID_2290
  Gene classification: Gene name=HemD; Function=Uroporphyrinogen-III synthase; Function class=H Coenzyme metabolism
  Homolog annotation: Query=1..246bp; Hit=1..246bp; Blast score=249; Percent Identity=52.0; E value=1e-66; Homolog= ZhemD COG1587
MSILITRPNPAGEQLVKRLRAIGKMAFSAPLIAIYPGGDLPLLSQKLQRLSAGNLVFLLSKNAVHYANEQLMQEGLSWPDKLSYYGIGKSTSLMFYQKTGLEILWPEQGEISEDLLQLPILQQVNDKKILLLRGNGGREVIASTLRSRGGEVDYCECYSRQPIKYHVADFSRHWQQYGIKTLVVTSGEMLQLLYSLVTDGDGKTWLLSCDLIVVSERLANIAQTLGWQAIKIAKSADNDALMQALE

SEQ ID NO: 8399 - protein, 398 aa, Xenorhabdus bovienii
  Coding DNA sequence: Name=SeqID_2291
  Gene classification: Gene name=HemX; Function=Uncharacterized enzyme of heme biosynthesis; Function class=S Function unknown
  Homolog annotation: Query=4..367bp; Hit=1..367bp; Blast score=305; Percent Identity=49.0; E value=6e-83; Homolog= ZhemX COG2959
MSIMTEQKQSTDAVEPKYPQQPETAPHKPKRYGWVGNTLSIAITLAIGAGAIYLYHYGKQQNAVLTAENLALQQQVASLAQQQSSDKQDFATQFRKLESDLQQAKLQNKQTDSRMLELQTRLSKISNTDLENWHLAQANYLVKMAGRKIWAEQDTTTAIALLKNADQSLAEMDDPSLLHIRQAIMEDINTLSKINQLDLDGIILTLNRLSNQIDNLRLEDNGEQEAPMDEDDGGISASLSDWRKNLSKSWDSFMENFITIKRRDSSVVPLLAPNQDVYLRENIRSKLLVAAQAVPRHQNEVYKQSLEAVSSWVRSYFDTASPDTKTFLQDIDSLAQKPLSIELPEHLSSQPILADLVRKRIYNLPHQSDTQVQPQSEVQPQPKPPETSGQAETPVQEG

SEQ ID NO: 8400 - protein, 401 aa, Xenorhabdus bovienii
  Coding DNA sequence: Name=SeqID_2292
  Gene classification: Gene name=HemY; Function=Uncharacterized enzyme of heme biosynthesis; Function class=H Coenzyme metabolism
  Homolog annotation: Query=1..394bp; Hit=1..393bp; Blast score=466; Percent Identity=64.0; E value=1e-131; Homolog= hemY COG3071
MLKVLLLFIILIVGVVLGPLLSGHQGYVLIQTDNHNITTSVTAMVIIFVLLQFLLILIGWCYRRLIRTSTFTHSWLFGGYKRSRARLQTKQALLKLAEGDFKQVEHLMTRNADHAENPVVNYLLAAEAAQQRGDYLRTNQYIERAAEVADKDQLPVDITRVRIQLAQGEVHAARNGVDKLLNHAPRHPEVLRLAEQAYTQSGAYQSLIDILPSLIKVGLCDEEHIHQLRQQAYIGLMNQIMAEKGSTGLKAWWKDQSRKLRNDIVLQVAMAEHLIECNDHDTAQQIVLNGLKQQYDERLLLLIPHLKTDDAEAVQKSLAYLLKQHGATPLLNSTLGQVALHHGQWAEAETAFKAALAQRPDAHDYAWLADAFDRQHKREEAAQTRSKGFMLTLKRESDAEE

SEQ ID NO: 8401 - protein, 52 aa, Xenorhabdus bovienii
  Coding DNA sequence: Name=SeqID_2293
MLDENSPRLTVAIPIDTIESLTLVHHANLRIQAKKTPIKKDRCINTIRSTDG

SEQ ID NO: 8402 - protein, 37 aa, Xenorhabdus bovienii
  Coding DNA sequence: Name=SeqID_2294
VYKYNQVYRRIVPHSTLCPVGDEKTKCLFIYNVDHRH

SEQ ID NO: 8403 - protein, 38 aa, Xenorhabdus bovienii
  Coding DNA sequence: Name=SeqID_2295
LHFYRCYNYLFLNVFYVWCCISATNILLNVSVWRHLTH

SEQ ID NO: 8404 - protein, 92 aa, Xenorhabdus bovienii
  Coding DNA sequence: Name=SeqID_2296
MTKRNEGLFDSWEITIRNSISPRDTKRKSPTKIAGLSQNLVGERGFEPPTHWSQTSCATKLRYSPKCTSSTISFLWCEGGELNPHVRKDTNT

SEQ ID NO: 8405 - protein, 33 aa, Xenorhabdus bovienii
  Coding DNA sequence: Name=SeqID_2297
VIPVVVGSSPISHPIFFMTRDGGGIGRRASFRC

SEQ ID NO: 8406 - protein, 45 aa, Xenorhabdus bovienii
  Coding DNA sequence: Name=SeqID_2298
VANGTRTHDNWNHNPGLYQLSYSHHNNYLFESYLFINCLQRRSPR

SEQ ID NO: 8407 - protein, 48 aa, Xenorhabdus bovienii
  Coding DNA sequence: Name=SeqID_2299
AVAQLDRALPSGGRGLRFESCRARHLKRARAVAVGYRGERRCKQFMKR

SEQ ID NO: 8408 - protein, 67 aa, Xenorhabdus bovienii
  Coding DNA sequence: Name=SeqID_2300
  Homolog annotation: Query=1..66bp; Hit=138..203bp; Blast score=104; Percent Identity=72.0; E value=4e-22; Homolog= ref|NP_927404.1|
TWYLLDAQGNNIQDGLWLVDIEGMHSIKRIAKIPVSKIRVSDDDVTFDCSVSDIQFIGRVALVISRQ

SEQ ID NO: 8409 - protein, 180 aa, Xenorhabdus bovienii
  Coding DNA sequence: Name=SeqID_2301
  Gene classification: Gene name=RimL; Function=Acetyltransferases, including N-acetylases of ribosomal proteins; Function class=J Translation, ribosomal structure and biogenesis
  Homolog annotation: Query=5..178bp; Hit=4..179bp; Blast score=135; Percent Identity=42.0; E value=3e-32; Homolog= mlr1450 COG1670
MIITLETERLLLRGWKEEDREPFFRLNSNPEVMEFFLKRPNKEQNNTFVDNLIRKFETQGGWGLWAVERKQDGEFIGMIGLNIPSDELPCYPCVEIGWQLDKPFWGKGYTCEAARRIFDFAFTEVGLDEVVALTSVLNYRSESVMKKLGMIRDEKTFLHPLVPEGHRLREHVLYRIRRSS

SEQ ID NO: 8410 - protein, 221 aa, Xenorhabdus bovienii
  Coding DNA sequence: Name=SeqID_2302
  Gene classification: Function=Uncharacterized BCR; Function class=S Function unknown
  Homolog annotation: Query=75..188bp; Hit=3..111bp; Blast score=59; Percent Identity=35.0; E value=2e-09; Homolog= VCA1042 COG1664
MEKYRFSDNAFLYSVWLLWGVALGLYLYGAHLGCAITAIISFLALVLYFTNMKLRINAMFGKKTEAPVASPVTPIISTQPEEKKNLSVETRSNTIIAKNSVFKGDIEMEGDIQVWGKIVGNIRVKGGAIRVMHAGKVEGELNAPEIIIDGHVDGTCCAETLDILEHGELRGISRCGSMSIRRGGLFIGQSEPVENKKKPDIERVVSIKENQADKAKAKNSA

SEQ ID NO: 8411 - protein, 30 aa, Xenorhabdus bovienii
  Coding DNA sequence: Name=SeqID_2303
MDFLFWKYGIIKREFRVLNSSSNVILVIAL

SEQ ID NO: 8412 - protein, 38 aa, Xenorhabdus bovienii
  Coding DNA sequence: Name=SeqID_2304
MTIFIIKNLSVNICNYLILKINYNLFDLLGRSIGSYNE

SEQ ID NO: 8413 - protein, 48 aa, Xenorhabdus bovienii
  Coding DNA sequence: Name=SeqID_2305
MLRMLFRYLSILFHPALDAISIIRVPNERLFQHLLINKINTPCTHHKK

SEQ ID NO: 8414 - protein, 271 aa, Xenorhabdus bovienii
  Coding DNA sequence: Name=SeqID_2306
  Gene classification: Gene name=AraC; Function=AraC-type DNA-binding domain-containing proteins; Function class=K Transcription
  Homolog annotation: Query=1..271bp; Hit=1..271bp; Blast score=326; Percent Identity=58.0; E value=2e-89; Homolog= PA1713 COG2207
MKRTTGLNQKSICTHLLTIPDFNTLEHKQRGLYVLLDGEMIWKDCTNTYHITSNEILFTHPGSYVAKTNTENCQVLWLPLQMEFLRSFLKRFGSLLSKIERHDFPARRLIPFNQFPLLTESIRGLANLLAHDYPPALIQLRVEELLLLLSLSKQGALLMSVLRQLSNRQVERLQTFMDAHYLKEWRLNDFAREFGMGLTSFKELFNSVYGTSPRAWISEQRILYAHQLLLNSEMSIADISLESGFSSQSYFTQSYRRRFGCTPNRARYGKD

SEQ ID NO: 8415 - protein, 37 aa, Xenorhabdus bovienii
  Coding DNA sequence: Name=SeqID_2307
MPASYSPVFRGITGVIVGKYKSKKKGLHRQAKGYGEA

SEQ ID NO: 8416 - protein, 226 aa, Xenorhabdus bovienii
  Coding DNA sequence: Name=SeqID_2308
  Gene classification: Function=Uncharacterized BCR; Function class=S Function unknown
  Homolog annotation: Query=7..214bp; Hit=8..214bp; Blast score=365; Percent Identity=81.0; E value=1e-101; Homolog= XF2273 COG1636
MSLNYERNPLPLPNGHNKVLLHSCCAPCSGEVMEAMLVSGIDFTIFFYNPNIHPLKEYELRKDENIRFAEQMGIPFIDADYDRDNWFERAKGMENEPERGIRCTMCFDMRFERTALYAHEHGFPVISSSLGISRWKNMQQINECGVRAASRYPDLTYWEYNWRKGGGSSRMIEISKREEFYQQEYCGCVYSLRDTNRHRLSTGRERIKLGTVFYQAESDKKDHESN

SEQ ID NO: 8417 - protein, 249 aa, Xenorhabdus bovienii
  Coding DNA sequence: Name=SeqID_2309
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=3..245bp; Hit=4..248bp; Blast score=214; Percent Identity=51.0; E value=1e-55; Homolog= mll6717 COG1028
MFNLTDKIAFISGGTKGIGKGIAQVFKRAGAITIISGTDRTRGEAIAKELDIDFIPLDVTDQAACKNVIDEIVEKYGRLDILCSNAGIFPQHYLKDMTAEDWDLVNTVNLKGTFLLVQAALNVMEKQRYGRVVLTSSVTGEMTGIPGYSHYGASKAGQLGFMRSAALEYAGRGITINAIMPGIIMTEGLQTFGEDYLQHVQSTTPMRVLGLPEDIGYTACFLASDEAKYITGQAIVVDGGQILPEVQGA

SEQ ID NO: 8418 - protein, 49 aa, Xenorhabdus bovienii
  Coding DNA sequence: Name=SeqID_2310
MPLPIPFVPPEINAILSVKLNIVVSLYMSGYSIFVTNNITFQYILNKIH

SEQ ID NO: 8419 - protein, 536 aa, Xenorhabdus bovienii
  Coding DNA sequence: Name=SeqID_2311
  Gene classification: Gene name=CaiC; Function=Acyl-CoA synthetases (AMP-forming)/AMP-acid ligases II; Function class=I Lipid metabolism
  Homolog annotation: Query=14..530bp; Hit=16..534bp; Blast score=408; Percent Identity=42.0; E value=1e-114; Homolog= PA4198 COG0318
MTLNNSFLYEYDGIALSPILFLKRAVLSNSDDIAVIDGDHCWTWRQYAERCEKVAIALQQMGIGKGSIISALLPNRHEMLELHFAVPLAGGILNALSTRTDSATLNFIFEKLSPQILLIDRNYISLLDNIAINNQMKIIIVDENNSCIPESTFDHEYIQYESLITQYPSATLSFPQIDEQEAISINSTSGTSGQPKLVVYSHRGAFLNAVSNILDWDMPKQPTFLWALPMFHCNGWCFPWAIAARAGTHICMRRFDAEKAIQLMQQHQVTHYCGAPIVHYSLGKAAQNQGIDFDNKVYGLIAGAPPTAMVFSLLDAVGITVTHVYGLTETYGPVVVSEDKHDWKALPESERILKRMRQGIVSNLQGQVSVIGEHSGLPVPFDGKTVGEIAIRGNIVAAYDPIRHVTPSTTSQWFFTGDLAVVDNDGYIKITDRKKDIIISGGENISSLELENALSGYPGILAVAIVAKPDPYWGEVPHAFIELDQHTLVTEQELDDYICTLVARYKRPKGYTFSTLPRNVNGKIIKEQLRNIVRNL

SEQ ID NO: 8420 - protein, 351 aa, Xenorhabdus bovienii
  Coding DNA sequence: Name=SeqID_2312
  Gene classification: Gene name=CobT; Function=NaMN; Function class=H Coenzyme metabolism
  Homolog annotation: Query=3..351bp; Hit=4..354bp; Blast score=379; Percent Identity=59.0; E value=1e-105; Homolog= cobT COG2038
MTLQSLLDAIQPLNQAKMETAAQHIDSLVKPLGSLGRLEALAIQLSGMPGIWDLRNLQKEIIVMCADHGVYDEGVAISPKNVTAIQARNMLQGITGVCVLAKNSGTHVLPVDIGIDGDPIDNLLSLKLARGCGNITQGAAMEYAQAETLLLASAQLVQQRIAAGVSVLGVGELGIANTTPAAAVISVLTGSDPHDVVGQGANLPTERLMHKGSVVRQSIIVNQPNGNDALDVLAKVGGFDLVGMTGVILGAAASGVPVVLDGFPSYASALAACQMAPIARNYCIPSHLSAEKGAVLALQHLRLQPYLHLDLRLGEGSGAAIAMSLIDAACAIYCNMGQLASSGISLPSYTS

SEQ ID NO: 8421 - protein, 200 aa, Xenorhabdus bovienii
  Coding DNA sequence: Name=SeqID_2313
  Gene classification: Gene name=GpmB; Function=Fructose-2,6 -bisphosphatase; Function class=G Carbohydrate transport and metabolism
  Homolog annotation: Query=1..193bp; Hit=1..196bp; Blast score=176; Percent Identity=45.0; E value=1e-44; Homolog= phpB COG0406
MRLFLVRHGQTEANINGVFCGSTDLPLTEMGIKQAQQVAAALKHVDFQSLHCSEMQRAQHTARIISPFAIEPEHRLNELNFGAWELCHHEMIAKGDPQAWARWLSDWQNACPTGGEAFRDFAARVESYADEVRSATAEGNQLIVAHQGVLALLLTRLLNLPTEAMWSFPFQQGAYSVVDNHTGFTTLRVFNGRTEYRPEE

SEQ ID NO: 8422 - protein, 252 aa, Xenorhabdus bovienii
  Coding DNA sequence: Name=SeqID_2314
  Gene classification: Gene name=CobS; Function=Cobalamin-5-phosphate synthase; Function class=H Coenzyme metabolism
  Homolog annotation: Query=5..250bp; Hit=4..247bp; Blast score=197; Percent Identity=49.0; E value=7e-51; Homolog= cobS COG0368
MKLNLFWATLQFMTRLPVPAKWAEGVDFSQYWRGVPNFPVIGLIIGGLAALISLSISQSGGGMYIGSIGYVLALALLTGGLHLDGLADTCDGLFSARRRETMLAIMRDSRLGTHGGLGLIFCLFLKVFAVAELSDHPPLELFALLTCAPIVGRTAVVLLMYEQRYAREGEGMGSSYIGRMTPRSTALTLLGGAVLVIALGDWQGLIAMMVTLIVIYGLAFYFNYRLGGQTGDTLGASIEAGEVIFLLVMIWK

SEQ ID NO: 8423 - protein, 181 aa, Xenorhabdus bovienii
  Coding DNA sequence: Name=SeqID_2315
  Gene classification: Gene name=CobU; Function=Adenosyl cobinamide kinase/adenosyl cobinamide phosphate guanylyltransferase; Function class=H Coenzyme metabolism
  Homolog annotation: Query=1..181bp; Hit=2..181bp; Blast score=228; Percent Identity=65.0; E value=3e-60; Homolog= cobU COG2087
MILVTGGARSGKSAYTERLIAGQCEQVLYIATAQVTDEEMAARIERHRQERPSHWRTWEGYQDLASVIRQHRQPEEGVILECVTTLIANLLFDKSAGASPDEWDFSSLEVFIQRQIDDLIVACLHCPTPVYLVTNEVGMGIMPENRLARHFADIAGRVNQKLAQAAKEVWLMVSGIGVKIK

SEQ ID NO: 8424 - protein, 36 aa, Xenorhabdus bovienii
  Coding DNA sequence: Name=SeqID_2316
MKSITDCKNRAYRVSIVALRSLGSQNDFGDGRCAER

SEQ ID NO: 8425 - protein, 513 aa, Xenorhabdus bovienii
  Coding DNA sequence: Name=SeqID_2317
  Gene classification: Gene name=CobQ; Function=Cobyric acid synthase; Function class=H Coenzyme metabolism
  Homolog annotation: Query=5..507bp; Hit=16..513bp; Blast score=392; Percent Identity=44.0; E value=1e-109; Homolog= MTH787 COG1492
MTLSLMIQGTASDVGKSVLVAGFCRIFLQDGHRCIPFKAQNMALNSGITADGKEMGRAQIFQAEAAGIEPDVRMNPVLLKPTSDRKAQVIFMGKVVCSMNAVEYHVYKPQLQQQILAAYDSLAAETDIMVLEGAGSPAEINLRDRDIVNMGMAELADVPVILVADIDRGGVFAAIYGTLALLRPEERARVKGVIINKFRGDPALLQSGIDQIEALTQVPILGVLPWLDLDLEDEDSVALQVGKYDHSGKHAENWLNIAVIQLPHIANFTDFKALAAQSDVHLRYVSDPSALHGADLIILPGSKNTLGDLAWLKIHGLDQAIIAAHQSGIPIIGICGGYQMLGKQIIDEVESGLNRMAGLGLLDANTQFASEKHTAQVKGVVMPELTGMLNSCSEQPIAGYEIHMGITQLGEQARPFAKMYLRNGEETVWFDGAVNQSGSVMGSYLHGLFDQNTFTRPLLNQLRRQKGLAPLENVMFNYVQHKEKQFNILAASMREHLDIDRIYQLMKEHEEHH

SEQ ID NO: 8426 - protein, 270 aa, Xenorhabdus bovienii
  Coding DNA sequence: Name=SeqID_2318
  Gene classification: Gene name=CbiO; Function=ABC-type cobalt transport system, ATPase component; Function class=P Inorganic ion transport and metabolism
  Homolog annotation: Query=1..238bp; Hit=3..241bp; Blast score=193; Percent Identity=40.0; E value=2e-49; Homolog= MJ1088 COG1122
MLATQALHFSYQDEPILQDLTLDFSHHQVTGIIGANGCGKSTLLMNLSGILRPQQGAVWWDNAPLDYSKKSLMALRQRVVTVFQDPDQQIFYTDIDSDLAFSLRNLGVEEAEIQRRIERALTLVDAHAFRNKPIQYLSFGQKKRVAIAGALVMEFDYLLLDEPTAGLDPSGRQQMLEIITMIAAGGKRIIISSHDIDLIYQICDGLYVLAKGRVISSGKPETVLLQKDLLEQAGLVQPWLVKVHSEAGLPLCKTEQALFAILHRTREKRQ

SEQ ID NO: 8427 - protein, 225 aa, Xenorhabdus bovienii
  Coding DNA sequence: Name=SeqID_2319
  Gene classification: Gene name=CbiQ; Function=ABC-type cobalt transport system, permease component CbiQ and related transporters; Function class=P Inorganic ion transport and metabolism
  Homolog annotation: Query=2..221bp; Hit=6..219bp; Blast score=71; Percent Identity=26.0; E value=8e-13; Homolog= MTH132 COG0619
MIGIDKLSDQSRWHNKDPRAKFALYLLFMVLAMGLSPVWQAALLFGLALFTCYLLRISLLRYLKWLLIPLGFLGIGLIAIVLSASLQPDSLLWGFKVGQYWLGIDSQGVNMANQTLWRSLATLAATFWFMLNMPFEQMIKLLKFCRVPHLLIEQILLTWRFIFIFVEEAAAIHRAQSLRFGYRSLRTSYRSLAMLVGMLFARVMSRYQQMSVALTLKLYQGDFHL

SEQ ID NO: 8428 - protein, 93 aa, Xenorhabdus bovienii
  Coding DNA sequence: Name=SeqID_2320
  Gene classification: Gene name=CbiN; Function=ABC-type cobalt transport system, periplasmic component; Function class=P Inorganic ion transport and metabolism
  Homolog annotation: Query=1..87bp; Hit=1..83bp; Blast score=69; Percent Identity=45.0; E value=5e-13; Homolog= VNG1634G COG1930
MKKTLILLSLLIALCVIPFFIDHGGEFGGADGQAEAQIMEIAPHYTPWFESLYEPASGEIESLLFTLQGSLGTAVIFYILGYYRRDRKDHDRH

SEQ ID NO: 8429 - protein, 243 aa, Xenorhabdus bovienii
  Coding DNA sequence: Name=SeqID_2321
  Gene classification: Gene name=CbiM; Function=Cobalamin biosynthesis protein CbiM; Function class=H Coenzyme metabolism
  Homolog annotation: Query=29..234bp; Hit=1..204bp; Blast score=191; Percent Identity=50.0; E value=6e-49; Homolog= MJ1091 COG0310
MQQKLTKFSLSGAAIALLLALAPQEAFAMHVMEGFLPPMWAVAWWLAFLPFLAAGIMRLRQIVQEDSNQKVLLALCGAFIFVLSALKIPSVTGSCSHPTGVALAVILFGPSVVAVLGAIVLLFQALLLAHGGVTTLGANGMSMAVIGPLVGYLVWRFSCKMGVRKDIGVFFCAFIADIVTYAVTSIQLGVAFPDPQLGMGAAIIKFMGIFCITQLPIAVAEGLLTVLIYDQLVKRQLIQARSF

SEQ ID NO: 8430 - protein, 237 aa, Xenorhabdus bovienii
  Coding DNA sequence: Name=SeqID_2322
  Gene classification: Gene name=CobF; Function=Precorrin-2 methylase; Function class=H Coenzyme metabolism
  Homolog annotation: Query=1..229bp; Hit=1..226bp; Blast score=117; Percent Identity=35.0; E value=8e-27; Homolog= MTH1348 COG2243
MSGKLYVIGVGPGASDLITVRAARILARLDVIYAPSGKKGVQSLAHSIVEEYLSPETEVCTYHFLMKSDRGEKEVVWDRVAQALQEEVAKGRKVGFITLGDPMLFSTWVFLLERIGNPPWLEIVPGITSFAAIAARSAMPLAMENQTLSVIAGTAPDAVLEQALLNHDCIVLMKVYSNFERIRGLLQRHQLLQHTLMMADATLPTEQCWRHLGALDSGQGLSYFSTILINKNWQLLR

SEQ ID NO: 8431 - protein, 264 aa, Xenorhabdus bovienii
  Coding DNA sequence: Name=SeqID_2323
  Homolog annotation: Query=1..264bp; Hit=1..264bp; Blast score=349; Percent Identity=65.0; E value=2e-95; Homolog= ref|NP_460970.1|
MKKALLVISFGTSYPETRKNNIEACEQQLASVFPDRELFRAFTSGMIIRKLRERDGIHIDTPHEALTRLYHAGYHDVAVQCLHIIKGDEYEKVLHEVERFRPRFQRLVLGSPLLSNFEDYLQLMRALHHQLPRLGDKEYVVFMGHGTTHPAFSAYACLDHLMTHYHFPARVGAVESYPEIALIIKGLKAEGMRKVHLMPLMLVAGDHAINDMASGESDSWKSQLEKAGMTAIPWLQGLGENPMIRQMFVDHLADAMNEKVGEGA

SEQ ID NO: 8432 - protein, 245 aa, Xenorhabdus bovienii
  Coding DNA sequence: Name=SeqID_2324
  Gene classification: Gene name=CobK; Function=Precorrin-6x reductase; Function class=H Coenzyme metabolism
  Homolog annotation: Query=31..224bp; Hit=87..279bp; Blast score=109; Percent Identity=34.0; E value=3e-24; Homolog= MTH1002 COG2099
MMMDSAGIDYRLSVATPTGAQQAADIRGDIVIGRMEAEGMVDYLQKQRTQRVIDASHPYAERLSQNIVQACQKLDIPLIRYIRPSDIDDVEHALIHKVTTLDQACEVAARLGERILLTTGSKQLADYVSRLAGKTVLARVLPTAEVLALCESCGLSVDQIFALKGPFSADFNRAFYQFCQADVVITKESGEQGGFKEKVEPCLALGLPCIVICRPVHPFNGEGIMQANSLEEMAQLLANFPVIAN

SEQ ID NO: 8433 - protein, 33 aa, Xenorhabdus bovienii
  Coding DNA sequence: Name=SeqID_2325
MPALSIIMQIWRASLVPPKMWICGCFTIGTPLV

SEQ ID NO: 8434 - protein, 241 aa, Xenorhabdus bovienii
  Coding DNA sequence: Name=SeqID_2326
  Gene classification: Gene name=CobJ; Function=Precorrin-3B methylase; Function class=H Coenzyme metabolism
  Homolog annotation: Query=2..239bp; Hit=5..243bp; Blast score=198; Percent Identity=43.0; E value=4e-51; Homolog= TVN0921 COG1010
MLTVIGIGPGSEAMMTQEAIAALKAADIVVGYKTYTHLVKPLVGDKEIIKTGMCKEIERCQVAIDLAEEGKNVALVCSGDAGIYGMAGLVLELISQHERHVEVRLVAGVTASTACASLLGAPLMHDFCHISLSDLLTPWAVIEKRVRAAAEADFVVCFYNPRSRGREDHLARAFALMAPWTPAETPVGVVKAAGRKKEEKWLTTFGEMDFSRVDMRSLVIVGNQSTYVRDGLMITPRGYRL

SEQ ID NO: 8435 - protein, 360 aa, Xenorhabdus bovienii
  Coding DNA sequence: Name=SeqID_2327
  Gene classification: Gene name=CbiG; Function=Cobalamin biosynthesis protein CbiG; Function class=H Coenzyme metabolism
  Homolog annotation: Query=27..356bp; Hit=10..322bp; Blast score=126; Percent Identity=32.0; E value=4e-29; Homolog= MTH1408 COG2073
MMRGSAMNIVKHSKRIALFCLTMGGMELAHRLRSHLAVDCFTSPELVETGFSAFDSGFANTVRKAFSQYGSLVMVGATGIAIRVIAPLLRDKLTDPAVVVLDEKGQFAISLLSGHMGGANDLARQVADLLGGQAVITTATDVNQLAALDVLSQQIDGEMADFRASVKTVNQMLVNGKRVGMWWHPALIGEKRQCDTRGFIPVESLDDLPELDALVYVSHRRAIPVLAIPTFKLVPRRIIAGIGCRRGVAAERVAQLLDRHLAEHDFDPLALKAIGSVELKQEEPALVQLAEKRRIPFQIFSVNQLAQCEQAFPASEFVRKTVGVGCVSQPVAWLMSQGQLVGHTLREQGVTITLGVLQPC

SEQ ID NO: 8436 - protein, 264 aa, Xenorhabdus bovienii
  Coding DNA sequence: Name=SeqID_2328
  Gene classification: Gene name=CobM; Function=Precorrin-4 methylase; Function class=H Coenzyme metabolism
  Homolog annotation: Query=16..264bp; Hit=6..255bp; Blast score=279; Percent Identity=56.0; E value=3e-75; Homolog= MJ1578 COG2875
MTEHVDTEPARFDAGKVWFVGAGPGDKTLITLKGYQLLQQAQVVIYAGSLINRELLEYCRADAECHDSAGMTLQEITDLMVNSVKAGKLVVRLQTGDLSLFGSIREQAEVLASQGMGFVSVPGVSSFLGAAAQLGVEYTVPEVAQSLIITRMAGRTPMPPRETLEAFAAHQTSMAIFLSVQDIAGVTVRLIQGGYPQETPVAVVYKATWPDCRIVRGTLDTIAEQVCTAGIQKTALILVGAFLGEEYHYSKLYDAGFSHEYRQA

SEQ ID NO: 8437 - protein, 198 aa, Xenorhabdus bovienii
  Coding DNA sequence: Name=SeqID_2329
  Gene classification: Gene name=CobL; Function=Precorrin-6B methylase 2; Function class=H Coenzyme metabolism
  Homolog annotation: Query=3..184bp; Hit=42..225bp; Blast score=84; Percent Identity=32.0; E value=6e-17; Homolog= slr1368 COG2242
MKDELFLRGHRIPMTKETVRALALERLELNKARHLIDVGAGTGSVSIEAALRYPTLDVLAIERKEEALALIYENVRHFGCHTVRIQAGVAPLPLEEAADAIFIGGTGGHLTELIDWALTHLNQGGRLVMTFILLENFMQALVHLQSCQVVSLDGREIQIGELTPLGQGHYFKPNNPTYLISCQKFVEHLSDPKESAYD

SEQ ID NO: 8438 - protein, 206 aa, Xenorhabdus bovienii
  Coding DNA sequence: Name=SeqID_2330
  Gene classification: Gene name=CobL; Function=Precorrin-6B methylase 1; Function class=H Coenzyme metabolism
  Homolog annotation: Query=1..206bp; Hit=1..214bp; Blast score=96; Percent Identity=31.0; E value=2e-20; Homolog= sll0099_1 COG2241
MITVVGIGPGAIANQTLAALDAIKQAEILVGGARHLAEFPHFRGETRRLNADMDGLMQWLEQRQYQQVVVLASGDPLFYGIGKRIAEHFVGEPQNIRIISGITAIQYLCARILLDMNDIYLTSSHGRKPDFDWLLQHEKIAMVTDELIGPRQIAEEILAHGQHRRMVIGENLSQENERIVCLSAQQVAECGDINYGLNVVVILNER

SEQ ID NO: 8439 - protein, 387 aa, Xenorhabdus bovienii
  Coding DNA sequence: Name=SeqID_2331
  Gene classification: Gene name=CbiD; Function=Cobalamin biosynthesis protein CbiD; Function class=H Coenzyme metabolism
  Homolog annotation: Query=24..374bp; Hit=7..355bp; Blast score=214; Percent Identity=36.0; E value=9e-56; Homolog= MJ0022 COG1903
MNETLNETPHTQAESLGTVWHRGKQYRKGYTTGSCATAAARVAALMILRQQIIHQVSIVTPSGVTLALNVEQPLIEGQQAVAAIRKDGGDDVDATHGMLIFARVSLNDSGIITLDGGEGVGRVTRVGIGLPIGWAAINKTPRHTIEEAVREVIGLQRGADIVIFAPEGEERAKKTYNDRLGIKGGISIIGTTGIVMPMSEESWKRSLALELEAKRASGLDRIIFVPGNHGERFVSQQLGIDGNYVVTMSNFVGYMLQEAVRLQFSHVVLVGHVGKLVKIAAGIFHTHSHIADGRMETLIANLAVMGAPFELIQAVDHCDTTEAAIELIAERGWQAVHQQIAQKICGRVDQMLRFSSGRPQCDAILFSFDNQVLGCNRPVDEIVEGFR

SEQ ID NO: 8440 - protein, 217 aa, Xenorhabdus bovienii
  Coding DNA sequence: Name=SeqID_2332
  Gene classification: Gene name=CobH; Function=Precorrin isomerase; Function class=H Coenzyme metabolism
  Homolog annotation: Query=8..207bp; Hit=6..205bp; Blast score=107; Percent Identity=36.0; E value=9e-24; Homolog= mlr1379 COG2082
MNYPQRSYIQQPQQIEQHSFDIITEIIRESRPDYRFVDAGQEAVIKRVIHTTADFDWLDILHFSPDALHRIRDGILRGCTLYTDTTMVLSGINKTRLAQYGSECRCYVSDPRVVQMAKVQQITRSMAAVNIALQEAGEKIFVFGNAPTALFRLLEHQSAPIAVVGVPVGFVGAEESKNALIYSGLSCIAARGRKGGSNIAAAIINAVLYRMPEVRHE

SEQ ID NO: 8441 - protein, 324 aa, Xenorhabdus bovienii
  Coding DNA sequence: Name=SeqID_2333
  Gene classification: Gene name=CbiB; Function=Cobalamin biosynthesis protein CobD/CbiB; Function class=H Coenzyme metabolism
  Homolog annotation: Query=3..297bp; Hit=6..297bp; Blast score=206; Percent Identity=44.0; E value=2e-53; Homolog= BH1588 COG1270
MTVLLWFAAFVLDMKLGDPSHWPHPVRWMGRLINQAEHVIRGRCKTEADLKWGGVALWLVVVGSVWLMSYLVLWLAYGVAFWFGLLVEVWLIYTVLAGRSLSDAANAVYQPLKQGDLAASRQQLAQIVGRETSQLQPPQISRAAIETVAENSVDGVIAPLFFLMIGGAPLAMAYKAVNTLDSMVGYKTPRYRALGMFSARMDDVANGIPARLGWLLLALAAKWQGLDFRQALRIGWRDRYQHRSPNSGWPEATVAGALGIRLGGPSVYFNQRVEKPWIGDARREVTPEDIPQSVQMMWVASVMALLLFALLHSLVSVTPFNVVL

SEQ ID NO: 8442 - protein, 464 aa, Xenorhabdus bovienii
  Coding DNA sequence: Name=SeqID_2334
  Gene classification: Gene name=CobB; Function=Cobyrinic acid a,c -diamide synthase; Function class=H Coenzyme metabolism
  Homolog annotation: Query=8..452bp; Hit=6..447bp; Blast score=323; Percent Identity=40.0; E value=2e-88; Homolog= BH1898 COG1797
MRQKYAFVIAGTGSGCGKTTVTLGIMRALMCRQLRVQPFKAGPDYLDGGWHRAVTGVASRNLDAFMLPVPILNGLFNQAVADKDVAVIEGVMGLYDGYGSDPDYCSSAALAKQLGCPVILVVDGKAVSTSIAATVMGFQHFDPSVNIAGVLLNRVNHDSHFQLLKQAIEDYCGLPVLGHIPVMPDIALPSRHLGLIPAQERNNQHDEQWQNLAHQIETTVDLDKLLALTPLPTLPQGDIASLVDPASGQGLTLALAEDEAFHFYYSDNLLLLEHAGVTIKRFSPLHDSQLPECQMIYLGGGYPEMYAQSLAANYAMHEALRQAQRKGIAIYAECGGLMYLGEALTDVQGVRHPMVGLIAGESQMGKSLKRFGYCEATAICDTLLVAKGETLRGHEFHYSDFTSAQTPVFHCTKQRSGMAQKSWFGGYQNGNTLAGYLHIHFAQRPDLLHRWLTIAREQMARGQS

SEQ ID NO: 8443 - protein, 32 aa, Xenorhabdus bovienii
  Coding DNA sequence: Name=SeqID_2335
MTKAYFCRIGFPQTIYFKLFTLNHLAKTIPCH

SEQ ID NO: 8444 - protein, 63 aa, Xenorhabdus bovienii
  Coding DNA sequence: Name=SeqID_2336
MDSFDSYDNYQKIFFCMKVFCHINDLYFSLFYCFHIKNKYYSICYVYFCCRYICFSIIIFIYL

SEQ ID NO: 8445 - protein, 266 aa, Xenorhabdus bovienii
  Coding DNA sequence: Name=SeqID_2337
  Gene classification: Gene name=CysG; Function=Uroporphyrinogen-III methylase; Function class=H Coenzyme metabolism
  Homolog annotation: Query=1..236bp; Hit=3..240bp; Blast score=226; Percent Identity=47.0; E value=2e-59; Homolog= BS_nasF_1 COG0007
MNKGKVWLIGAGPGEAALITVKGLHYIQSADVIVHDRLVNPELIAQAPEHCDIINVGKERNHHPIPQEEINQILVKHALAGKQIVRLKGGDPYVFGRGGEEAETLAQQGIEFEIIPGISSAIGGLAYAGIPVTHRDYASSFHVVTGHLSQGNEPQNWRALAQLGGTLIILMGMSRLAEICQQLIQFGKPPATPAAVIMYASQPRQEMTIATLATLATEVEHHQLHAPALIVIGNVVRLTEILAFTSIPIALSSTAVMMNPLTRQVT

SEQ ID NO: 8446 - protein, 357 aa, Xenorhabdus bovienii
  Coding DNA sequence: Name=SeqID_2338
  Gene classification: Gene name=HisC; Function=Histidinol-phosphate aminotransferase/Tyrosine aminotransferase; Function class=E Amino acid transport and metabolism
  Homolog annotation: Query=16..355bp; Hit=3..347bp; Blast score=172; Percent Identity=33.0; E value=3e-43; Homolog= sll1713 COG0079
MSEHGGNIIEVAQQFGIPANELIDFSANINPLGAPERVKALIKDNLACIEKYPDIEYRHLHQALADAHQCDTTSVIAGNGATELIYAVVRYLNPKRALLLTPGFAEYRRALQHVGAEIIAYPLTEDAGFQPDLRLLDTLTMTQPDCVFIATPNNPTGLMPDSRFLQSLVQHCEEHRIALIVDEAFIDFLPDNRSLIPHIAATRHLYVLRSLTKFFAIPGLRLGYLVSGDSTGVAWMKNQREPWSINALAARVGEVLLDDQAYITATHQWLKSQQHYLWTHLSSCPELTVWPPSANFLFFRCHQPNLDLWHTLLEHRLLIRHCKNYVGLDESYYRIAVRNEWENRRLIAAIQHVFAHG

SEQ ID NO: 8447 - protein, 286 aa, Xenorhabdus bovienii
  Coding DNA sequence: Name=SeqID_2339
  Homolog annotation: Query=1..286bp; Hit=16..301bp; Blast score=351; Percent Identity=61.0; E value=1e-95; Homolog= ref|NP_930200.1|
MAEACCPASCGELLQGWLFGGEKLISCPINWFSCVAVSEGHASADERPRMRQMVELLLEHWNEPTELSACLHIEYQSTIPIAKGMASSTADIAATAHATAKLLGKSLNSTTLAQLCVKLEPTDSTVFAPLTLFDHLTAQTQIPFAWQPDIDILLLGSRQTILTEEYHRRDRHQLLLESAPLLQQAWRQFRIANKYHDNYRLGEACTLSAIASQPILPKPRFYQLLDLVERSGIYGLNVAHSGSVIGLLCNNHQHDVDYLRWQLGQKLIADYYPQIHPVKMITGGVR

SEQ ID NO: 8448 - protein, 64 aa, Xenorhabdus bovienii
  Coding DNA sequence: Name=SeqID_2340
MNESENHTNFMPIFGDLTDKRYLITEEDHIAEHKLITSQPADMGYTNARSKWVEINPFRVEMNM

SEQ ID NO: 8449 - protein, 46 aa, Xenorhabdus bovienii
  Coding DNA sequence: Name=SeqID_2341
MLISYRVFLLPERSDHTRFAAIQPTSPQTLLTGVTSTPSLYQDKDK

SEQ ID NO: 8450 - protein, 63 aa, Xenorhabdus bovienii
  Coding DNA sequence: Name=SeqID_2342
  Homolog annotation: Query=1..60bp; Hit=1..60bp; Blast score=86; Percent Identity=71.0; E value=9e-17; Homolog= ref|NP_930677.1|
MNITCNHCQKPVEEMNLKQAKIIQSAEFIEKIVDLVLACPHCSQEYSVFVPTWDLQPLETACM

SEQ ID NO: 8451 - protein, 38 aa, Xenorhabdus bovienii
  Coding DNA sequence: Name=SeqID_2343
MCTYFIQSGEWSVPLNDWLGNGLTLFTYRRFLAAVNPM

SEQ ID NO: 8452 - protein, 32 aa, Xenorhabdus bovienii
  Coding DNA sequence: Name=SeqID_2344
MPAEYCGHCCFNHKRTSSSLRSTFHKSEAILP

SEQ ID NO: 8453 - protein, 117 aa, Xenorhabdus bovienii
  Coding DNA sequence: Name=SeqID_2345
  Gene classification: Gene name=ARC1; Function=EMAP domain; Function class=R General function prediction only
  Homolog annotation: Query=9..107bp; Hit=2..100bp; Blast score=123; Percent Identity=64.0; E value=3e-29; Homolog= BH1785 COG0073
MENIHLEPATFDAFMSLDIRVGKIIKAEKNEKAIKPAYKLYIDFGSDIGEKQSSAQICQNYTEEQLIGKQVLAVVNFPPRRVAGFKSEVLVLAAVCDDQGTVLLQPERDVTLGTRML

SEQ ID NO: 8454 - protein, 461 aa, Xenorhabdus bovienii
  Coding DNA sequence: Name=SeqID_2346
  Homolog annotation: Query=8..457bp; Hit=5..454bp; Blast score=565; Percent Identity=62.0; E value=1e-160; Homolog= emb|CAC38402.1|
MSHPDYTLYTKTPTVMVLDNLGQMVRDIHYHRHPNTPQTTDKRITRHQFNALGQRIQSIDPRLFELQQTDATVKPNFAYFHALTGEVLRTDSVDAGSNVSLDDIANRPVLNVNTTNVIRTWQYEDSTLPGRLLSITEQSEEGASRITERFVWAGNSPSEQAQNLAGTYTRHYDTAGLNLTNSISLTNVPQSVSRQLLKDDVNADWQGNDEPAWNALLSPEVFTTTTTTDATGTLLTQADAKGNRQRMAYDVAGLLRGSWLTLKGQTEQVILKSQTYSAAGQKLREEHGNGLVTTYRYEVETQRLIGIKTERPAGHAAGAKVLLDLRYDYDPVGNVLSVGNDAEATRFWRNQKVDATNTYTYDSLYQLVVATGRELANIGQQNTSLPHPVIPLPTDNSSYTHYTRNYIYDEGGNLTQIRHSAPISNNNYTTDITVSNRSNRAVLNTLTKDPAQVDTLFVDTL

SEQ ID NO: 8455 - protein, 42 aa, Xenorhabdus bovienii
  Coding DNA sequence: Name=SeqID_2347
VTHNCFSSRGCVGYRFGLGGNSVRTDIVFILNVIMGVILVAL

SEQ ID NO: 8456 - protein, 37 aa, Xenorhabdus bovienii
  Coding DNA sequence: Name=SeqID_2348
MDICGINEFLFYIFSCVKFRSVKPFSYYLFQIKYYYR

SEQ ID NO: 8457 - protein, 138 aa, Xenorhabdus bovienii
  Coding DNA sequence: Name=SeqID_2349
MNKLIELASKYGEVYQEKLDMANCANFLLNEGYNIFSLYLEFVTNYGGIKGYHSAYKDNEAKPEKFHTDPIEASKLIPMDWVEEYEDRTSCKLIPFGECCNGYITLMLGSDGKIYGAFDDSLFQYGNDILSGGMSFIQ

SEQ ID NO: 8458 - protein, 1619 aa, Xenorhabdus bovienii
  Coding DNA sequence: Name=SeqID_2350
  Gene classification: Gene name=RhsA; Function=Rhs family protein; Function class=M Cell envelope biogenesis, outer membrane
  Homolog annotation: Query=388..1455bp; Hit=393..1490bp; Blast score =327; Percent Identity=27.0; E value=7e-89; Homolog= Z0705 COG3209
MAKGARSDSPTGTGNTVGVIVGQAPQANKSPQESNPVVKRKKRKVADFSEKLGRENENEKSDYKEHGDINKDTDGTVPEHKNFSQRFGDKFSDGFHWGKKKISDGFHWGINKGSTVAHQLVSESAEEAHWLLDKAPDFRGKDLAHRLIDNAADDAYWLVNKGSDASRWVVDKAPSLVGHWVNEQGYNLIEAVKHPVEAIKGGGKDFFNTVVDLAQIIEKIPEMEMKALGKTLSLIGAKNAGAAVFNFGQGYGDTVQGALGALHMELSNPAQQGGALIGNIAMFFIGPGEVKTVMKVGAESVTFLSKVVKGEGVITKVLETEKGLSGVRTVTGAKKLTQTEQTGIRSARTEKEPLISSKKPKKTKKDPPDDSGKNDSSKCEGGSCGKGEPVDITSGDYLQTFSIITIPGLLPITLTRTYRSAACLSGLLGRKWADDWSRQLVLDDEKVHFTDADGQVYDFSTPEKQVLARNRHLLHCLLTGELDGELCLVNKQIQKTFHFNHIVGNRRRLSAITDRHQNHIQFIYNDQHQLMEVVRNDGFRLTLHYQDNQLQTVDYHFQQIQQRLVTCRYDQYGYLAECDAFQQNHLWHEYTAQGFMIRWHDTDKTDFYIHYDERGRVVSTHSSAGYWDDRFIYDDEARVTTYLDAEGGKTLSYYNQNNQVIREVDPLGRETRTQWRYNQKVWEIDPLGGYTTFGYNNDGALTEIVLPTGDAFYYDYDEHGQLIEATQPTGDTWHFHHDEQGNLAAVTNPQGHKEEYQYGTHGELRQHLLPDGRQWHYAYDEHQRLAAIMTPDGQTTGLELDELGRLRRITNALKQESRYRYSNVHASLNGSVTEIELPDGVTQHMEYDSERRIAAVTDGEGRITRYSYGAFDLLTQVTRPDGTTLHFGYDRLTRFCSVTASTGETYRYERDVAGQIIREIDFTGRTIDYQYDELGRRIQAHYPDNHLLRWHYSSSGLLTRQETWYQDGDRSELKASTTYEYNARHQLTRAVNDDAVVEYEYDAVGLPVCERINGREITREWNSLTGQITTETIGEHALHFGYSVMGGLNHFQFNQHMPLTLNHDALGRETVRESAEGFILVSRYNATGLLAHQSAGRVTALFRETLAQNDPHFPPQATAVNRSWQYDRAYSVRVIDDGIWGQTRYRYNQNDQIVSATFNGRLPYEEQFGYDANGNLNQHLPVDARGAVEQIEQRQQAGRVVKRGNVSYRYDDNGRQVEKTEHHDGFRPQVWRYRWDTQNQLTHCETPDGSRWHYRYDVFGRRIRKLKVHDGKLTAVNLQRWLDGKPDLTAKPDTITGYDYLWSGNQLVEETPLYADGSLAHDHSIRWLYAPGAFTPSARYEKGKLHYIVSDHQGTPREILSEAGKLVWASRLTTWGKAERMPLLAANDEDYYVSCNLRFAGQYEDEESGLYYNRFRYYDRDTGQYLTPDPIGLQGGLNPYGYVYNSVNFIDPLGLMDSCKGESSNSRTEHDRFTDRYLSGYADQEARDRWRYRLPSKPRATSVAVDILNGKHYRGYSGAGKNSSEFPQNIHPHLQGRIDHMQNKSLKFWDIRNCAEFQCLNNALLDGAKIENLNVYTVKTTDLSHEPFAMCENCRVTVGGYGNSKLGIPSSIGANVRSG

SEQ ID NO: 8459 - protein, 118 aa, Xenorhabdus bovienii
  Coding DNA sequence: Name=SeqID_2351
MAQCQFTARPHRLSMFFRVTLPPHRATFNPCSRTRFIPQCLWDETLPKYHHWLPVCPYRCDWCRGIFQFGDNRIRNWRSGRSHRGFTDIRNQTDNQPLGIFTGNIVIRHDSAPVGVQM

SEQ ID NO: 8460 - protein, 406 aa, Xenorhabdus bovienii
  Coding DNA sequence: Name=SeqID_2352
  Homolog annotation: Query=1..369bp; Hit=96..409bp; Blast score=137; Percent Identity=31.0; E value=3e-31; Homolog= ref|ZP_00005220.1|
MEFRNLTPFSVMNYRMLDTEDQEYDVIAMKVGYQLLPAGKGEYLAELLPVMSLCVQDQYRGALNISQVLQESDLAPFKPKCDVIVNGTAYAPEGKPCPAFPVRLLLTDANGDTLLDKTLEISGEREFFRTDNGQWQLSEPKPFDRLPLDYRYAFGGECRIEADDDEVANALTEDDKLSPEQRSQHPDGEQAPIAHAVLEYNPIGSGFILPWYAQAKDLPRYAAPRITRPDAPITAQHFAAMLSGHLPTTEPVCQPQGMGVIGRAWLPRRTLAGTYDQTWLDERHPYLPQDFDFGYWNGAPQDQQIDWPSTDITLQLTNLTPDGSLQTELPGHRPFILFRMEDGDLLPVLMNLDTLIIDTDAMTLELTFRLHFSIDLLIRVTEARFEINPKAPLITFAPQPEQNHGG

SEQ ID NO: 8461 - protein, 629 aa, Xenorhabdus bovienii
  Coding DNA sequence: Name=SeqID_2353
  Gene classification: Gene name=VgrG; Function=Uncharacterized BCR; Function class=S Function unknown
  Homolog annotation: Query=3..629bp; Hit=16..689bp; Blast score=424; Percent Identity=37.0; E value=1e-118; Homolog= ZvgrE COG3501
MDGLVFTCQIGALPATTFQVVSFSLQEGLSQLYHLYLTVVSPLNSVVLNDQLGTYASLTVTRNGKVDRTVKGIVAGAAQGNTDGRQTYYTFTVRPEMWRMSLHQDSRLFQRESVPDILKKLLKEHRVKSDSKFYDDSDHHPVREYTTQKRESAYDFWCRLAAEEGVVFWFEEEQLFFSDSHLGMTADLNLTYNVQPSTDDKDTTAWQWQYAEYLCPDEYIHKDYNYLRPSQPLQTQATLPQGGRHAVFESYGRFPGSKEGKPLGEVRLNQLNSESKLGSAQTNCIQLRPGKIFILKSHPIATMNDRWQVVTVNHYGSQPQAAGLAGEGTTLTNNVTFIPGKDDWRSPYRYKPLADGDELATVVGPPGEEIFVNEHGAIKVHFHWNRHDTPGDGSSCWVRVAQGWNGNGFGFMAIPRIGQEVIVSYLNGDIDRPIVTGCNYNGLNRPPLDLPAQKTRTTFKTRTHKGEGFNELRFEDAKGSEEVFIHAQKDMNTKVLNNRTTQVQGNHTETIDGNQAVIVKKNKQEVVQHTSTEVVGLAKTLTVGQSYTISVGANMNTSVSMSQTETVGTQKTVSVGQTLTISAGKVIELKCGNSTLRMDKDGKITIKGKAFLFDASGPVQIHGKDIDLN

SEQ ID NO: 8462 - protein, 578 aa, Xenorhabdus bovienii
  Coding DNA sequence: Name=SeqID_2354
  Gene classification: Function=Uncharacterized BCR; Function class=S Function unknown
  Homolog annotation: Query=7..540bp; Hit=6..553bp; Blast score=160; Percent Identity=26.0; E value=2e-39; Homolog= VCA0110 COG3519
MEAFQFYYHWELDYLRQLEKLVGEEKPHLADHFNGNDPDIERLNQGFAALMARLHQKVDDAFPEMTLPLLQRLTAQSIKGIPATSVVQFDRREGFDFSYTLPRGSEVSSGTGATFVTSRDCPIEPLILLARDITYQAETTLITLTFQYIGKDDHWPIRPLSLFLSPDEAVADTLMLSLCRLLQRAELHHGGLTYPVEPFWFEPLSGASRLILSPPIAVAGNWAPQMLMESLYLPHVHHFLTLSLPTVMRSRLSMKESRQFSVTLKLYDALPLSEAQLADAFQLHCVPVVNLERRLQVTQPFAPDTARYPLPLPPGQGLLHMTDLRLKDEPGKERGKRCQFYPMSQFTHFFRNADEEVWFYALDITRDALGHLEYALMFYDSHARPMEQPPEQEFTCHFVAFDTGLPTLAVGDICHASEDIPDGLQVSNLTPTAPSYPPVTDSSRYWGLLSHHAANGFWLNSVSALKQLLWDYDFYADLDRHAHRDIQRLTTGMLAIQSTPGDWLIRGVPYRCIHVELTLDESAYTHQGELFRFANALYQFLPFCLTEDMRMRMTVIGNTSDIRWLLAPCPLQGYRPIM

SEQ ID NO: 8463 - protein, 41 aa, Xenorhabdus bovienii
  Coding DNA sequence: Name=SeqID_2355
MRIILKYSHTDSLFRTYPLGAIIAVSLNTAYAHPPKRTRRM

SEQ ID NO: 8464 - protein, 48 aa, Xenorhabdus bovienii
  Coding DNA sequence: Name=SeqID_2356
MAERSAANIAMHLYHSLIKMHRSAFRRMFFMSQMISGDLFLPTAVVIT

SEQ ID NO: 8465 - protein, 478 aa, Xenorhabdus bovienii
  Coding DNA sequence: Name=SeqID_2357
  Homolog annotation: Query=1..476bp; Hit=1..476bp; Blast score=656; Percent Identity=64.0; E value=0; Homolog= ref|NP_930783.1|
MNYDVIVVGSGTIAGSIAYELAGRQLKVCRLGCLDRSNAASRAAGAMNGCFGEVTSGLIASDYGKLKLKMDRIAKDRWSTWAQRLAASSGDTRPLFTAKGTHVILNTAGMEVVDSVNYDAIESVLREYNEPYEVVEPRSIKGMKPNDLARSLKGLYIPEEHALNSHLLLEMLDAALLREGGEIVDNNVKRVLTENGIIVGVETVDGVRFTANKVIIAAGVQSLDILSDQTSIVQKIPPLFAGYGVSVLLKVKNPDELPTSVIRTPNRAFACGLHCVPRSDGVLYVGATNLLSNQPRTHATVATIQFLLECAYNQLNVDLFESEILAIQVGNRPISADGFPLIGPCGIDGLWLVTGTYRDGLHQSPLLADYVANALMGLPNLEIDLADFTPIRRPLVGLSRDMTISEAAKQTVAMGYEFIWNLKPGWDELIYESLLNSYGAQVESIDDIYTPPPDLIAFSCKDEQITKRLRDYYRCWKK

SEQ ID NO: 8466 - protein, 47 aa, Xenorhabdus bovienii
  Coding DNA sequence: Name=SeqID_2358
MMVTISGVFNLTEGFKISQPQYNAYRIDINIHISISVYVVFSFDPIF

SEQ ID NO: 8467 - protein, 311 aa, Xenorhabdus bovienii
  Coding DNA sequence: Name=SeqID_2359
  Homolog annotation: Query=88..307bp; Hit=258..444bp; Blast score=148; Percent Identity=36.0; E value=1e-34; Homolog= gb|AAL60260.1|AF461393_ 9
MPNVTYLNDKDINSKNGSSYHDNSELGAYSNELSELSEKNKDNRGEYTKNKPKALEYPYNAISSPCRDKVLASESLQETEIQFLMDKFKEGDILYGLDNPRATVLADLAKAGFKRTSKSTVNSGKVFSGCVPFRRKTNNTKRNILIQNDITNATWDASKPREYATDKSIKKEVHDYERVINFREFLSKHPKYNVKDDTELVTALINNPSMTTSVPLWQKTSKAGLDYQLFVNKAPVHFLVDTIGDDINTVISKQGHGASITSSELRWLYRHKDTKEVKENLKFWRDGKAVPHSEIFADTKWSSYQPKHRYS

SEQ ID NO: 8468 - protein, 386 aa, Xenorhabdus bovienii
  Coding DNA sequence: Name=SeqID_2360
  Homolog annotation: Query=145..362bp; Hit=757..960bp; Blast score =162; Percent Identity=42.0; E value=1e-38; Homolog= ref|NP_931365.1|
MTIIEKKIVGSYMPYATYFNDKDINLKNAFSYHDNSEVGAYSNELSELSENNKESRAEYTSNEPRAPERMMTYPYNAISSSWHAQGENRINVGDSVNKQGLNTVLDVLHLDKPDTEKVAADYQRKFFSKEMTTFQNKTDLILTESQKTPKTKSPGMKKYTKNALKDFAAHAGYLHNGSYQDEFVNFKDKNQNLAPGKLFPGVELLPQKTIEINRPAGCWQSKRSYDIEDEFRNNMANEYQVQDTSKFISGLKSMYEKSGQTLHPMTQRLVEEHIAHNGNILPTMAGIAGLHAEVQALNKVFIESDETSCQSSSPLNPARYARAMLQSLIFTKRLTTANAGNDFPACHNCSGIIQSPANVITGMVGSAGSNFSAQRSKRHRSQSLSE

SEQ ID NO: 8469 - protein, 60 aa, Xenorhabdus bovienii
  Coding DNA sequence: Name=SeqID_2361
MVITQSVQLFLVIDQIAKIGLNYLQMNDYLENLFIYKPQIDNLIIILARWVSSGARLRPA

SEQ ID NO: 8470 - protein, 325 aa, Xenorhabdus bovienii
  Coding DNA sequence: Name=SeqID_2362
  Homolog annotation: Query=5..319bp; Hit=7..322bp; Blast score=300; Percent Identity=58.0; E value=2e-80; Homolog= ref|NP_928936.1|
MPIPSNKTIDEKIDMFRSNHSTDEDIDSATSEIGWDTNAMFSNGSVRLDQIKDPGFWKENIADYYKWMVVVKEELKKLDLTLKAMESPKSAVTNTAKNMGVATLKTALSTGSSAASAAIGAAVGTAVFPGAGTVAGAGIGLLVGIGLNILSGIAIDKLKYKLEIAHPYPKTRNMILAINNYDKNFITKVVKKNINKDNLKVTGGGMLISTITGKASPVKIPAYELIDLLVSHDRASEPLRDDKVEHILEVTNYIREVLNESHSDAVMFMRKNYGDSGMSLPGVVAKIKGSKLTLDTMARAKNKIDIRTNSIDKQVKNLSRLNGDQ

SEQ ID NO: 8471 - protein, 96 aa, Xenorhabdus bovienii
  Coding DNA sequence: Name=SeqID_2363
  Gene classification: Gene name=LysR; Function=Transcriptional regulator; Function class=K Transcription
  Homolog annotation: Query=10..91bp; Hit=10..91bp; Blast score=60; Percent Identity=37.0; E value=3e-10; Homolog= VC1588 COG0583
MFTSKELLNFIAVAKNKSINKATQERFITQSPICRSLKKLEFSLGVKLFERKSQGLVLTEEGECLYNKVSSICEQLEHIENDYKNHKSPYHAVYQK

SEQ ID NO: 8472 - protein, 293 aa, Xenorhabdus bovienii
  Coding DNA sequence: Name=SeqID_2364
  Homolog annotation: Query=7..293bp; Hit=11..296bp; Blast score=281; Percent Identity=51.0; E value=1e-74; Homolog= ref|NP_929752.1|
MLKMQTIIDVNKAMDAMLRKYLNKDIEIRFDLPEINTVPPNATVSVFLYDIHEDLQLRSAESRGFNATAGKLLPGWVNVKCNYLITYWESSCPKSDASSPESQPCNQAIQVMSQVLEALINNRQLTDIPGAYTKVIPQQENLNSLGNFWQALGNRPRLSLNYSVTVPISLNSGQDNVTQIIDVSSSVEQTTALSQETISHALRERLITELGKGDDIRLALSKVEIFTVPTNIAQNNLTQMTLSLSISGITHKKYLTDINKILSVWGNNSVVITTINDCNIYIEKIETGNLFGI

SEQ ID NO: 8473 - protein, 695 aa, Xenorhabdus bovienii
  Coding DNA sequence: Name=SeqID_2365
  Gene classification: Gene name=SpoVK (BS); Function=ATPases of the AAA+ class; Function class=O Posttranslational modification, protein turnover, chaperones
  Homolog annotation: Query=436..660bp; Hit=512..737bp; Blast score =196; Percent Identity=44.0; E value=1e-49; Homolog= mlr6544 COG0464
MNIAPVFSDAFKQDNDPNLAFLFSQLERIDLVLQYHFHCISGQRDDLLDEFLLSEEDVIARLDKPLGKPHWLNDDYLAIPQIVNPVASRLTDLIARFELTDFERDVLLLGLLPHFDSRYYRLFVLIQGEQQSRLPCFALALELFCHSLLEKQAQQASFLHRAPLIGCQLLSVDSRQKTLTWLQTSFVTDSGVYHFLLGHHYITPALEHYAEWITPIEIGGYPAGLKQRLGNLLLSDHDDIRPIVLLRGMAGSARAHAVANMMASEKRQTLLVDIAKLADGDDKITLLQIKHILRETRMRGACLLLRNFCLLAEKNRQLLDSLSALLNQPELRVVCLVEPYSPLVWLKKISTLLVEMPLFTSVEKTRLLTASLPDNCSEDIDVITLSQRYTFTPETLPLILQEAQFYQQQRDPSGVLQQCDIRKALNLRAQQNFGQLAQRITPKRSLKDLLVTDEVAQQLQEILTAIKYREQILAGGFKDKIGYGTGISALFYGDSGTGKTMAAEVIADYIGVDLIKVDLSTVVNKYIGETEKNLSRIFDLAEQDAGVLFFDEADALFGKRSETKDAQDRHANIEVSYLLQRLENFPGLVILSTNNRSHLDSAFNRRFTFITRFTYPDERLRKEMWQAIWPKNIKVSQNVDFDKLAQRASVTGANIRNIALLSSFFAAENSNGEVNNEIIEIALARELAKMGRLSF

SEQ ID NO: 8474 - protein, 512 aa, Xenorhabdus bovienii
  Coding DNA sequence: Name=SeqID_2366
  Homolog annotation: Query=14..511bp; Hit=30..548bp; Blast score=182; Percent Identity=29.0; E value=2e-44; Homolog= ref|NP_928998.1|
MEKRHSDKTIEKCSNLFKLKLRHLINEEVEKWSIQNNGSLFKKITLDLGEITFENFEQQFICRLERELKNKTHEFTRNIKQNIDNDLFSSKVVKSTSKISSISQHNFMTTNTLYSEQSVIENIDNYLKHGSWKSPALWQQIKDVEFSYWLIEHVNLQPQQWLPMLAKHCLQPTGLSRLIQICQPDVLSRLCQLFTETTTSECVNSQTIINTKVTPEKLSLAAEYYLLHQMRYINSTQQVKTALQDINNLTPVKSVTGNGNSPLTPDIFETNTLMDVAQSFSQHSMQTNYQINPIQLNYGLVKNSGEQKHPILQNEDQHKIALKSAPPEQVLSIQHGSDNTIHPQLSPSVLPINNAGCMILWPLLPTFFRSFDLLDQNRFTRLEAQREAVCLLDWLIWGEEEIPAWRLTLNKVICGLPINDKTLWRTPEPKQQIAINQWLEKTIVQLPAWKKMGINDVRHLFLQRPGELSELNGIANIYIKPEVYDALLGEWPWPINMASFSWLKQPITMTWL

SEQ ID NO: 8475 - protein, 422 aa, Xenorhabdus bovienii
  Coding DNA sequence: Name=SeqID_2367
  Homolog annotation: Query=17..422bp; Hit=17..405bp; Blast score=355; Percent Identity=51.0; E value=6e-97; Homolog= ref|NP_928940.1|
MKEIRYSATVQEQQALSDTKGVGSETDKLKDKFKDGSIPLQTDFNQLIDIADIGRKACGQSPQQNGPGKGLKLDDSGTLSLKMGTISSQDFSPLILEKDILSVDLGSGLINNANGISVGQGNGIVVNKNDVAVKLVTNKGMVVDANGIAIKPGDGVKFSSDGALAAKSADSTITVDSSGIKVKVNTGKGIKVDNGLQVYLHENGGIGYNSAGICIKTGNGIKIDGDRVAIDPNKVLPKGMIVMFSGSTVPQGWALCDGNNGTPNLIDRFILGGKISDINSKNNATLSGSGNSKKCNKNSDNKVVSVNVKIKDTELTLSQMPKHEHTGGMPYHNSTGFRNGYYKTGENSYQLDNRLENGYMSNNAFIPRSLISYDNKNPYYPYTSSKGDGKGHSHGADATANAHNHITDIMPPYYILAFIIKL

SEQ ID NO: 8476 - protein, 965 aa, Xenorhabdus bovienii
  Coding DNA sequence: Name=SeqID_2368
  Homolog annotation: Query=1..962bp; Hit=1..958bp; Blast score=996; Percent Identity=53.0; E value=0; Homolog= ref|NP_928960.1|
MSNQEALFHSVKDDIHFDTLLEQAHQVVEQQAGKLWSDTAEHDPGITFLEGLSYGVSDLAYRHTLPLEDLLTPAPNEQEQQDGIFPAEFGPHNTLTCGPITTDDYRKALLDLHSSDWAGTKSASEQDKGDFLFRNVQWVREQEEHRYTYWYDATKREYSFVESKEAKKFTLRGNYWLYLEPTRRTQENLTTATQQLTDFLTQNRNIGESVSQIIWSKPVDFPLLLDIELDDDVKVQDVPGIFAAVYTTAEQYLMPEAQRFSTVTLQDAGMRNDEIFDGPQLEHGWITELPAVRDYTKRIILNLSRLVNKLLEIKGIQNVNRLQLDDNFDKTLIERAKEDAWSWSIKEGYYPRLWGKDPLHQLAQHDGPLRVVAKGGISVTVDENQIRDSLPNPPLIQNKPVVLAYGRHRDVDRYSPVSDTLPACYELQQPLSESEHAQRLLSLHQFLLPFEQLLACGCQQAAMLPKLLAFKREGYEVWGDQWPFKPGSVNDEAHQDYAPALKKLLEQIAHNSDHELDIVNYLLGYFGTQRAPRTFTTPIDDFRAVQQGYLAQQPILTYHRANIRIDQVSSLQKRIAARMGLGGELFKPEPDLSKLPFYLVEHRALLPIKPNSQFDKEQKPDSVTEEKESQTGQHYVVIKQAGINGKLTQGQVINLVLYEGAQGENRFTVRGQMIVKTEGDQFWLDVGNSSQLKYNLERVMTAAKAKKLFWQNSVVWMEDMNYRLAYDSDQSKNGRPLPENQRRLTRTTQTPFPALITVGNEITLTKNFGVINLTREYSQDSEKLYAKVVSFDRIKGTLVIERKDNSTLPFPVSEESWRYSWHFSGKEYERTDRFSFVISVVVNSDLIKIPGVDPYKLEEWVKETILTEFPAHISMIIHWMDREPFLNLGNTYQRWQNNGAPLGDAAYSILESLTLGKLPSSLKGIGTMRIATLHQREEVVGKNNDQWNTDKIIQNELFYVPKENE

SEQ ID NO: 8477 - protein, 728 aa, Xenorhabdus bovienii
  Coding DNA sequence: Name=SeqID_2369
  Homolog annotation: Query=311..714bp; Hit=491..892bp; Blast score =397; Percent Identity=51.0; E value=1e-109; Homolog= ref|NP_929001.1|
MELTELNNKLSNLVPMSDFKLDNRTSLQLLQYIEEYTKLIPFNKSDKYWNDFFFMANNTPEKLAELYQGEIESNGELLPHQAFLLAALRLLETPISLFNTLPAAHRNLYYRALLGLSRRPAQPDQVALSVELNATVTEQLLTKGTLFEAGQDDQGNVLQYAQDASLLANRGYISDLYWLRNKEKQQWVTATPWDSQAQLSLPSGGIRLFSETDQDKPVLGGVLITSAQLAMEEGIRKITVTFDKDVSSQNLVAQISSGNQWLTLTAKVDKEGATLTLSDKEPAITAPEDLDNLVFSQPVLRLQGKDSQPLPAVTALKVQKNPVDKAAFETYHLSPFGYSSEIEPLAESPALYLGITDVEPEQTLSLYWKLKSPQQPEKVFWYYLNQNNQWIALDAWVNDQTQHLYQDGTWQVVLPADAAKQATQMPTERYWLKAVVVIPTHKGSWGKNPWLCGLIYNAITATLVNADSINNNHLLTPLLAGSIQRPVEPIIVVASINQPWPSWGGRVPESYNAFFERTAQHLSHRNRALTWGNMATLLKERYVSIFDVKYPGDDELTRVPAREVQQLTIIPANRYNDSDDPFRPVLNPARLQEMAGWLQQKSSPWAEIEISNPQYVDVKINYTVIFKPDVNEDFGYRQLRQQLSEAYMPWSVDEQRPVTLNNSISYYQLLATIQQQPLVERVTCLTLRRSDAAKGSDITASVEAKDNEVLILVWEADDKLQCRGNNDE

SEQ ID NO: 8478 - protein, 141 aa, Xenorhabdus bovienii
  Coding DNA sequence: Name=SeqID_2370
  Homolog annotation: Query=1..135bp; Hit=1..132bp; Blast score=128; Percent Identity=54.0; E value=1e-29; Homolog= ref|NP_929639.1|
MSEAIVVDGDVLQFDPSFGDRQVIISIPAKISGTGHAQVNGKKVCILGDEKQVSVSAIYTTAPHTTPGKGTITISALDASQQALQCTSGAALIIKGQKFTALFTPELPAMNNTVTPPQPDVTTPSSGKGSFMTQQNFATVN

SEQ ID NO: 8479 - protein, 140 aa, Xenorhabdus bovienii
  Coding DNA sequence: Name=SeqID_2371
  Gene classification: Function=Phage baseplate assembly protein W; Function class=R General function prediction only
  Homolog annotation: Query=11..117bp; Hit=9..116bp; Blast score=75; Percent Identity=34.0; E value=2e-14; Homolog= mlr6561 COG3628
MENQILTQLYGRGWAFPPAFSLEKGVEMAEGADDVRQSLHILFSTDQGERLMREHYGCGLNDFMFENIRNELLADIESHIHDNVLRYESRADITDIQVRQSPNNKSTLQVQVMYRLRGSDINQQIQGTLALSEGRVMEVV

SEQ ID NO: 8480 - protein, 538 aa, Xenorhabdus bovienii
  Coding DNA sequence: Name=SeqID_2372
  Gene classification: Gene name=VgrG; Function=Uncharacterized BCR; Function class=S Function unknown
  Homolog annotation: Query=372..536bp; Hit=30..189bp; Blast score=82; Percent Identity=28.0; E value=2e-15; Homolog= mlr6559 COG3501
MSHQLKIIADGKVLSLLAAVDVDTCYRVNSIPSATLKLSVPDRPLSSFSQKDVQAELAHCQAGKTLRLELTNGGRKSVLFNGLITRKTLKIKNKQLLLTLVVKHRLQLLVDTQHSQLFKASNEKTILNTLLNQTGIKAHFERIAALDQKHEQMVQFRCSDWRFLLCRLSATGVWLLPTIEGVRLVQPETLKSNASHTLKSRGDEKKDIVVKDACWQFDNHLNPASLEVSGWDISKQQALSGGRYGSVAMGKAALSPDRLASLNKESWDIRYSSPLTTQESGYLAQGLLLNQRISGVTGEFLLKGDGRYQLGDNIQLTGFGSQLDGTASITAVRHRFNRRIDWETTVNIGLQQEYLPMLPDAPELHTATVAKYQQDDAALNRIPVSLPVLNRPNEFLWARLGKPYASHESGFCFYPEPGDEVIVGFFENDPRYPVILGAMHNPKNKAPLEPSQDNQEKVLVVKKGENQQQLFINGKEKIIQINAGENQITLQQDKDISLTTKKELTLKAQTMNATMDKSVTISGKNSVEIKGAKINLTQ

SEQ ID NO: 8481 - protein, 229 aa, Xenorhabdus bovienii
  Coding DNA sequence: Name=SeqID_2373
  Homolog annotation: Query=1..223bp; Hit=1..223bp; Blast score=299; Percent Identity=65.0; E value=3e-80; Homolog= ref|NP_928984.1|
MSLIERGLAKLTINGYKDREGKIRAGTVQAMYNPDSLQLDYQTDYQQSQAINSEKQSSLYVQAKPAGLSLELIFDATMPGNKTPVEAQLEQLKQLCSVDATSHETRFLQIKWGKMRWDNRGYFAGRAKGLSVSYTLFDRDATPLRARVILTLVADKSLVLQETEQNLKSPAKIALRVQDGVSLALMAASTASTLSGGVDYLTLAWQNGLDNLNGFVPGEILQATREDAS

SEQ ID NO: 8482 - protein, 60 aa, Xenorhabdus bovienii
  Coding DNA sequence: Name=SeqID_2374
MTVEIRELIIQAKVVSSAQPTESERQGHSLVQESLDEATWVEKIKREVLAALRDEEGWRP

SEQ ID NO: 8483 - protein, 152 aa, Xenorhabdus bovienii
  Coding DNA sequence: Name=SeqID_2375
  Homolog annotation: Query=1..152bp; Hit=1..152bp; Blast score=250; Percent Identity=80.0; E value=4e-66; Homolog= gb|AAN64221.1|
MNDFYTPVVSHRFMASFIFNGIPDPLDIHFQRISGLSRELHVTQHSQGGENARNDYLADKIQHGTLTLERGVMTVSPLTWMFDRVLRGEKIAYADVVVMLLNENSLPLSSWTLSNALPVRWQTSDFDANSNAILVNTLELRYQDMCWLGVKV

SEQ ID NO: 8484 - protein, 402 aa, Xenorhabdus bovienii
  Coding DNA sequence: Name=SeqID_2376
  Gene classification: Function=Phage tail sheath protein FI; Function class=R General function prediction only
  Homolog annotation: Query=210..387bp; Hit=342..515bp; Blast score =111; Percent Identity=36.0; E value=1e-24; Homolog= mlr6548 COG3497
MERIQPGVTLTESITTTGQQEIPSAVPVFIGYTVHDLRPAKTAVRINNLAEYIQLFGDDHLMALTVRLYFDNGGQQAFILPLQGNMPSANITQMEAEILMAALGSDAVREAIGGETQITLILAPDIARLNDSAIDDGSTLVNLWSQGWMTLLQLSQIRANLFVLLDAPDEVKQAQQCLESLSSEYRQWGAAYWPRLETTYQDKFSQKGIVLSPTAAIAAVIQRTDSEAGVWKAPANIALSQVIRPVKPYLQGAVLFNTNGTSLNVIRSFPAKGIRVWGCRTLENSDNTPWRYLQTRRLVSYVTVHLAQLARMYVFEPNNELTWMKCKGQSYNWLRQLWLQGGLYGSREDEAFTVQLGVNETMSEEDVRAGKMIMKVALAVLFPAEFIEISLVFDTQTGALLS

SEQ ID NO: 8485 - protein, 464 aa, Xenorhabdus bovienii
  Coding DNA sequence: Name=SeqID_2377
  Gene classification: Function=Phage tail sheath protein FI; Function class=R General function prediction only
  Homolog annotation: Query=212..464bp; Hit=269..525bp; Blast score =159; Percent Identity=33.0; E value=6e-39; Homolog= mlr6548 COG3497
MPATLKAPGVYIEEDASLALSVSNSATAVPVFIGKFTPKKENPAQVCTRISNWLEFTSAFSLAPTTEIVIRSSIEPPANPETKEETDNKETPKARTLSEAENKKNWIHDIEKVNLSPAVQALQLYFQNGGGACYIYPLNDVKDESILASIPDVIEQKGDITLLVCPETDLDYKTKVYSVLLPLLDDKKVGYFLIADSNDGESVSGVGNNAKAAAYYPQLQTDLKFSLLPEDKDIRISGYEDDSGKDEPKNLADLRKTNASIAKRIDETLQVEQQSALILSPSAAIAGIYCRTDSSRGVWKAPANVALTGVKSLLDKVDDERQGAMNDKGINVIRSFTGRGLMVWGARTSVEANNTDWRYIPVRRLFNSVERDIRQALRAVLFETNNQPTWMRAKAAVDQYLYTLWQKNALMGNSPEEAYFVQIGQNITMSDADIKQGKMIMKVGLAAVRPAEFIVLQFTQDVAQ

SEQ ID NO: 8486 - protein, 355 aa, Xenorhabdus bovienii
  Coding DNA sequence: Name=SeqID_2378
  Gene classification: Function=Phage tail sheath protein FI; Function class=R General function prediction only
  Homolog annotation: Query=61..354bp; Hit=229..525bp; Blast score=165; Percent Identity=33.0; E value=7e-41; Homolog= mlr6548 COG3497
MTTVTSYPGVYIEELNSLALSVSNSATAVPVFAVNEQNKHINEDTATRINSWMDYLNLTGEFDNKDKLAVSLRAYFANGGGYCYLIQTKSLEKIIPTLDDVTLLVAAGEEIKTSVDILCQAGKGLFAIFDGSETELTINGAEEAKGKYTATQFAAVYYPWLKADWAKAAIPPSAAMAGVYAAVDLSRGVWKAPANVALKGGLEPAFLVTDELQGVYNSGRAINMIRNFSNTGTTVWGARTLEDSDNWRYVPVRRLFNTVERDVKRAMSFAMFEPNNQPTWERVRAAISNYLHGLWQQGGLAGSKEEEAYFVQIGKGITMTPDQINQGQMIVKVGLAAVRPAEFIILQFTQDVEQR

SEQ ID NO: 8487 - protein, 149 aa, Xenorhabdus bovienii
  Coding DNA sequence: Name=SeqID_2379
  Homolog annotation: Query=1..148bp; Hit=1..148bp; Blast score=241; Percent Identity=79.0; E value=2e-63; Homolog= ref|NP_929011.1|
MSTSTSQIAVEYPIPVYRFIVSVGDEQVPFSSVSGLDISYDTIEYRDGTGHWFKMPGQRQPTNITLRKGVFPGKTELFDWINSIQLNQVEKKDITISLTNDAGTELLMTWNVSNAFPTSLTSPSFDATSNDIAVQEITLTADRVTMQAV

SEQ ID NO: 8488 - protein, 49 aa, Xenorhabdus bovienii
  Coding DNA sequence: Name=SeqID_2380
MINKQIIYSSSFWCKWNCIKSKMHKKQIALLAMYLLWIFRHDITDVRIM

SEQ ID NO: 8489 - protein, 52 aa, Xenorhabdus bovienii
  Coding DNA sequence: Name=SeqID_2381
MNGFIYLSIINFYAIAIGLKLIAILYLFYIATSVIILDAFNQIGLLLNFSAV

SEQ ID NO: 8490 - protein, 78 aa, Xenorhabdus bovienii
  Coding DNA sequence: Name=SeqID_2382
MNVHTFFTVGNGFSCKFVWNAHIEGKAFSLATLVRVIRIRSDTVNPMPASTSAASFFSVSSIRARTIAFAAMLKPPFG

SEQ ID NO: 8491 - protein, 66 aa, Xenorhabdus bovienii
  Coding DNA sequence: Name=SeqID_2383
MAGILIAPNDDENRLGLLMNRALINNSTQFPFVSWSIRYPVYQRDHQRFSLYERPHLFHCWQWFQL

SEQ ID NO: 8492 - protein, 3834 aa, Xenorhabdus bovienii
  Coding DNA sequence: Name=SeqID_2384
  Gene classification: Gene name=EntF; Function=Non-ribosomal peptide synthetase modules and related proteins; Function class=Q Secondary metabolites biosynthesis, transport and catabolism
  Homolog annotation: Query=2323..3589bp; Hit=1..1276bp; Blast score =604; Percent Identity=32.0; E value=1e-172; Homolog= PA2400 COG1020
MRVVEAFLFPFIARTDSKSHYLISGQVSKFLFNKKSEGSIDMDNILASPFTRLFWNEWILEPDSVKYNMVMDQTIQGDLDERKLRSAIQGLMNQYPLFQYQLDEENGELYWKPGPNSLNTLQIFDSEEKLRQFALQPFDLRQGTLIRFGLFQQAERQFQLVIVLHHIVVDGGSTEEFYHAISDLYNQRPLRHTPLTLDQIAEKFAQYRQQIKTLEEHQPAQFWKTCLTEVAATNPLPYLSEPAKDEQELVGEVRFNLSLSDWQQLKRSLRHCTPFLVFKTLWAALIAQYMPDGKVHVSYPVAVTGGESLSLGAQINTAVFPLQLDDTVSFASLYQQTLHYTSSLKTPSGLRFSYWPLFKVLPLTPIRKLNVVVNQAHFKDFCLELESCEVHYNHRFDNDLADSEWALEYQQQGDQWSFRIRYPRRRFHPEQITALAEQFQQLLVNALTNPEKPIRQFPFLTQDQRMALLKCGHQGEQGDVPETTIHEKFQQQACLHPQQIALIDNQQQLSYAELEQRSNQLAHLIRERYLQATGQSLPPDTLLPIFMNRGVDMVIAMLAVMKAGAAYLPLDPQVPTQRLAYILTDSQSRLAITDMTHQPILRDYGQNLALLTFGNDRDDYRDQPDSAPQTASEPNSLAYSIYTSGTTGRPKGTLLEHRGVLLMLDGLYARVIEGIERPQRWLQFASLAFDAHVFETFMALCFGHTLVIASEEERHDPDLLIKLIENYQVEVATFPPTLLKTKPALPARLQNILVGGEATPQAILDHYAMQGRRIFNAYGPTEASVCVTMHHYQWDGAQNIGRPFPGIQAYVLDEQLQLVPMGMSGELYLSGAVLARGYLGQPELTAKTFIANPFAQHTDDQRLYRTGDQARWLPNGELEYLGRKDFQVKIHGYRIELAEIEQVFIAASGLSQCTAQVRGQDRSHIVLYYVSEMTLNEDNLRRTLQLSLPDYMMPSAFVQLASLPMTISGKLDAAALPEPDFKQSRYVYRAAETELEHRLQNIWHGILGLDEIGIDDDFFHLGGDSISAIRLVSEMRRQQLPCSTKLLYQCRTIAELAVQLATTPDSQMMHSEQGILQGDFPLHPIQHWFFEQVFSEPHHWNQAFLIRVPPLQPQKLETAIQALVERHDMLRARFIPAERQLYLDINQVAPTALEIWHYDPLTDDAFHDCLDSWQSDFDITAGPLWRFAYIDGYPDGSARIYCALHHLIVDAVSWRILLDDLKQLYHGKNLGAKTASYRQWQAALTEQLSGFESQREFWQQQCVSQSDYRPLLEASHTRQFLQQSLDPATSIRLLDVTTGAASFAPNEVLLTALLHALGHLSGITNHTLLLEGHGRHLPSVQLDVGRTVGWFTALYPLHFSVEGEETISLQQVHTTLGGVPDSGISYGALRHLGAEASALSLPYPGVIFNYLGQLQAPENDWQISAESAGQTISPHNVDSGLLTLNIWLIGQELHYRWDGLLSQSQLAQLDHGFQTALISLIDTMAPSASKIQQAVDDGIDAALLARLPAGLAPVVAYPANSLQQGFIHHYLSYPDNSTYHFQFVLDYEQPIDLNDYYRAWEYAQQRYPVLRTGFDWQEQPQQIVFRQAELLWQYHDFSTSPTQEQTLTALCQQQYHESFELNKPELMRVCLVKLAADRYSLIHTSHHIIIDGWSSQILLEYVHRTYQQLQAGQMLDTCIDTAYLATQRYYASQVAECRHHWQELGTQHWESTDISLLLARGARNTSGNETPDTQAVVRQVLPHAVALSLQETARNHGLTLNVMLQFVWHKLLHLFSQQSQTIVGITLSGRNHPVSGIESSVGLFINTLPLVMDWEPQSTCLQQLRTLHQRMIDLDTYSYQPLAELQSAGEKLFQTIFVYENYPTTELDTLRANLRATSDNTTDYPLNLIAEGDVEQGLTLSLSYNQNCLDAERGNAILQMLGTLLARLPSHLHYPHQRLLALSDDKRQQLLEEWAFAVDQDLELMTLHGLLERQARLTPQNPALMDDYRTLSYQELDEITSHQAVRLRAAYRRLFQRELASGELIGLCCERSIDMIVTLLAILKAGAAYVPMDTNVPAERLNYILQDSQIRLVLTEPALAPLFERPDLQQLYLSELADPEATDEIQSRLPQVEPRQLAYVIYTSGTTGKPKGTLVEHRGSAAMARSLFTRMEMTQSGMRFLQFASIVFDAHLMEIFPAFVGGHSLVVASDAQRYDLQELQTLLQKWQIGYAMLPPVLLKLKPTLPDSLQWLAVGGEASSQDVLDHYAAQGRNVFNCYGPTETSVCCTVNPYRYNGACNIGRPLAQCAAYVLDSDLQPLPVGAPGELFLSGVGLARGYLNQSELSREKFIPNPFQQHPDHARLYRTGDIVHWLDGGSLEYLGRNDSQVKIRGHRIELGEIECVLANIDGVDQAVAIIHGKESPKIVCYYTLSDNTLNGSTSTDNELSSEIRQTLAQVLPNYMQPSALIPLPRIPMTINGKLDRRLCPAPVFTDVQQEYTAAETPLQQQCCDIWAELLQCERIGIDDNFFRLGGNSIIAIQLSNRLSQLLQCTIPLVALNRHPTVRSLSAFLSDNCTHLEVIPQAGLQRGVLSFSQMRLWFIETLMQENNVYHIPLLFRLQTDIQMDSFVHSLQAVVHRHQILRCTFEQDEHGESFLQAHDEALAVAHAEVQADEWHDFLQREIFRIFDLRHEYPIRATLLQRVESDGHVSHFCLLNIHHISFDGWSLNVFLKELAEFYGAELDKRPPALPPLSIQYMDYVAWYQQMLSSDKLEQLKQFWLKQLQDCPQLELPCDYPRPDIFDHRGSTTFFSLTPQLSQQLRQLARQLDVTLHAVLLTGMNLLLVRYCGKHDIVIGSPIANRSHPQLEPLIGMFVNMLVLRNQISPEWSVAEQIRQVFASTITSQQHQEMPFEKLVEFLKLNRDLSRHPLFQISFSLEQKATDVDAPFSMQNLAELYDVAKFDLSFGFEEGNDALSGNINYTKALFAPETISEMVRHFQNILMQMVAHPEQLVQDISLYSPEERMALLQPPMETQNAALYSHPLYQGILDWTRQQPNDIALIDTIGQCSYAEMLQTAQILAAQIHQHPRNQSELIVIQVSKGRAQIIAVLAVLLAGRAYVPVDISWPQQRCQQIIDQTETQLVISSKAWTTETCGIIQLDPYGCAIHLTEPQPMSLPVPIPCDSLAYVIFTSGSTGTPKGVAVRHDTACNTLIDINRKLNVVRGDTLLALNALCFDLSVYDMFGILGVGGRLVIPSEEQRYQPETLLRLIREHGVTIWNAAPALFELLLQEVENLVERPTVAMDRVLLSGDWIPVNHIPRCRDWLPGCRVFSGGGVTEASVWSILFEVPQGAGYSQSIPYGKALVNQYFLILDKDLEPVPAQAIGEMYIGGVGVAIGYYRDPARTEERFLQHPISGERLYRTGDLGRWLPDGNIEFLGRIDSQIKINGYRIELGEIENTLMAIPGIRQCALVKVSGLSDSLAAYYVSDEPLDEADVRQRLAQVLPPYMVPAVLTHLPKLPLNASGKIDRKQLSALNYIAPRQHQYQPPETEQEQQLCQLWQQKLELDHVGVNDDFFECGGTSILAIPVCQQMSALLGQAVTVMELFKRRSIRGILASLEYQLIQPLNNGSAKETLWMIHPAMAGCEVYLDIARTLDGKLTCLGVDNYNLYHRPLIMSLRDIASFYLEQMERYQPLTQGPVRMLGWSMGGLIALEIAAQLEARGIRDTHIYLLDSFYRVSLGALHPSWRQMLLQELGLEGDAAVRALEAGPADDAICQHELSQPLQHSPVTLFKATQLPEFHAQLNEQGKIPAALHADDNQIGQACRHLSVIPLLCDHHNIIELKAQIIEGVLERVD

SEQ ID NO: 8493 - protein, 45 aa, Xenorhabdus bovienii
  Coding DNA sequence: Name=SeqID_2385
MGKEMPQLPSYLNWLTDRYRELSSLSEFLIRQASCFRDIFSRLFD

SEQ ID NO: 8494 - protein, 75 aa, Xenorhabdus bovienii
  Coding DNA sequence: Name=SeqID_2386
LIKYGLLLPLFLLVFVLDIAVHRIEGCPSYSIIFLKIINYINSNKWKINLMLLINKMAFHTVIALLFCIAELIQK

SEQ ID NO: 8495 - protein, 37 aa, Xenorhabdus bovienii
  Coding DNA sequence: Name=SeqID_2387
MVLAEEKIADAHFGRYYFIPSTNILFSSPFLSSPFIL

SEQ ID NO: 8496 - protein, 176 aa, Xenorhabdus bovienii
  Coding DNA sequence: Name=SeqID_2388
  Gene classification: Function=CBS-domain-containing membrane protein; Function class=T Signal transduction mechanisms
  Homolog annotation: Query=25..167bp; Hit=45..184bp; Blast score=122; Percent Identity=47.0; E value=2e-28; Homolog= slr0789 COG3448
MSKLRGGGGLPPKPDLVQLMKGLSGGFLGILLLSYLSQTTEYPWLMAPFGATCAILFAAPTSPLAQPRNVIGGHLLTTAVGLVALYTLGNSMIVMSLAVGIAIMLMQLFRVVHPPAGANPLVVLLAGQEAVGFDFLLTPVLTGSLALVIIASFINNIGKENCWPLYWYGFSRRKDS

SEQ ID NO: 8497 - protein, 184 aa, Xenorhabdus bovienii
  Coding DNA sequence: Name=SeqID_2389
  Gene classification: Gene name=AcrR; Function=Transcriptional regulator; Function class=K Transcription
  Homolog annotation: Query=3..179bp; Hit=9..188bp; Blast score=115; Percent Identity=36.0; E value=2e-26; Homolog= mlr7895 COG1309
MSKEEHILDIAESLFNEFGYNAVGVDLIRDKANVSKTSMYRYFGSKNKLIESMLIRRHKRFEEELNTVVFATKGMENKLNAILDWHFSWFRSADFQGCLFMHALAEFKGHDELIVKQAQCHKTWLKSLLFSIFSANQTDAEIKTEALMTFIEGMIVRAEFGEMTGHEEIYRLSAKMIASMCFLS

SEQ ID NO: 8498 - protein, 30 aa, Xenorhabdus bovienii
  Coding DNA sequence: Name=SeqID_2390
MKIICLFKGRSDFPYQDPDKKLNYNLYFND

SEQ ID NO: 8499 - protein, 46 aa, Xenorhabdus bovienii
  Coding DNA sequence: Name=SeqID_2391
VTHSKSVNPSHDDDAKQNKTGFYQKMAWRSSPCHSLVCCFTNPPIK

SEQ ID NO: 8500 - protein, 285 aa, Xenorhabdus bovienii
  Coding DNA sequence: Name=SeqID_2392
  Gene classification: Function=Uncharacterized ACR; Function class=S Function unknown
  Homolog annotation: Query=69..282bp; Hit=1..209bp; Blast score=74; Percent Identity=27.0; E value=1e-13; Homolog= TM0792 COG1738
MGKKYKLLGFNSQDSTANVLILSTGKVLKINVKELEKSEIADDLDNHEIKSLYRKIYSSFPNVPSVYEIEERNEKSWVVYSFLALLLTIFYTFSNIAAAKPVYIDYLDIIVTPGTFIYPFSFLVIDLLSEFYGFRLARKAIYMSLASNLIIVSLLSISTSLPAIANWDLNDQYNALMNHILSAIFASSLSFLVSELVNSYILCKLKDMTNSRFLALRVFFSTFIASILDSFVFCFIAFYGKLPVNQIVVMMLVQILIKIFFALFNIFPAYGSRYLFNRWVGKTAN

SEQ ID NO: 8501 - protein, 204 aa, Xenorhabdus bovienii
  Coding DNA sequence: Name=SeqID_2393
  Homolog annotation: Query=5..178bp; Hit=7..178bp; Blast score=132; Percent Identity=40.0; E value=4e-30; Homolog= ref|NP_928785.1|
MYKKQKMEHLRKNLQYLLDSRGESRVSICDRTGLNRTTIYNILDGRVQNVHSSTIQKVSNFFGVSYREIETIDIAEKERIDAIVSYEGNMNPCAVPLFMQSECIISGFFDSKIGSLIVERKLTYYFGSGPNIVAILLENDFPGKYNAGDLLIIKRGNYQNNNPKLCFDQRQQLFHIKEFNSEVTTNLMVIGDIMEERFGYGKKI

SEQ ID NO: 8502 - protein, 45 aa, Xenorhabdus bovienii
  Coding DNA sequence: Name=SeqID_2394
MIVLLYYYIILFKNKLLSLFMFYDKGIFHSFQTQQKVFILKSHVN

SEQ ID NO: 8503 - protein, 231 aa, Xenorhabdus bovienii
  Coding DNA sequence: Name=SeqID_2395
  Gene classification: Gene name=CitB; Function=Response regulator containing a CheY-like receiver domain and an HTH DNA-binding domain; Function class=T Signal transduction mechanisms
  Homolog annotation: Query=15..220bp; Hit=24..218bp; Blast score=65; Percent Identity=24.0; E value=6e-11; Homolog= PA1347 COG2197
MSFSYKNNEPYLKGLIAMMEHLSDPWGIKDLASRHIYMNKAAYLYTNTPEDFDIEGKLDCEFPTHWSEDQFSQDLKEHDRRTEESKDKVSIIETHYWYGKNSLAPFISEKFPVYNDKKECIGIVWNAKPMSTLSPLKYINRQKPSVLTTEATTDLFTKSELDTIFFMLQRRSNKEIAQIYNVSHKTIENRIYTIYQKANVHSIQQFEEFCRHFQLDSYIPERLIEKGVLFI

SEQ ID NO: 8504 - protein, 431 aa, Xenorhabdus bovienii
  Coding DNA sequence: Name=SeqID_2396
  Gene classification: Gene name=CodB; Function=Purine-cytosine permease and related proteins; Function class=F Nucleotide transport and metabolism
  Homolog annotation: Query=5..359bp; Hit=9..359bp; Blast score=135; Percent Identity=31.0; E value=1e-31; Homolog= BH1882 COG1457
MIVLKIEHCPLSRVPQDQRLSLLCVAVVHMGMLTALDQFMLGAVLGNSMTLIDAFLAVFIGSLIFGVVTFGLGFAGMREGLSGSLLARWCGFGRMGSVLIGLIVAVSLLGWFGIQNAIFAKSLNFASGNKLGFGWAAAISGTLLTTLVAFGFKALRFTASIAVPLFILLVAYISTIVLSGKAGQPLHEVINLPHSGETLSISAGITIVVGGAIVASFMTPDLTRYTKSGKHVFAITLLTIIAGEFVINGLAILIAKALNTADVVTIMSQAAGGAGLLVVVFSTLRVNDLNLYSSSLGIINAVEGIAGKKLRYPPTTVVIGVLGTVLSILGILDRFVDFLTILGVVFPPILGIMLVDYYILRTHRKVLDESRQKGNLPNETPTIGWAAIIASIIGCIVGLATEWGVPTINSLLMASVAYWLFKIAFSRRSLP

SEQ ID NO: 8505 - protein, 276 aa, Xenorhabdus bovienii
  Coding DNA sequence: Name=SeqID_2397
  Gene classification: Function=Uncharacterized enzyme involved in inositol metabolism; Function class=G Carbohydrate transport and metabolism
  Homolog annotation: Query=1..264bp; Hit=1..267bp; Blast score=276; Percent Identity=53.0; E value=1e-74; Homolog= mll4976 COG3718
MSKLLSKYHAPDQDKRTQHITPETANWGYVHFAVYELNAGESITLPASEKETCLVLVAGKATVITPLQRFDQIGERMNPFERKRPYAVYVTPNESIEIIAQTNLELAVCQAKGRGNYPTRLIAPKDINAEQRGNENNRRYVHNILPDDKSADSLLVVEVYTDEGCTSSYPSHKHDTDNEPQETYLEETYYHRLNPSQGFCLQRVYTDDRSLDETMAVYNKDVVMVPKGYHPVATIAGYDSYYLNVMAGPSRKWLFTWEKDHQWVNGAEYAEKHTRR

SEQ ID NO: 8506 - protein, 296 aa, Xenorhabdus bovienii
  Coding DNA sequence: Name=SeqID_2398
  Gene classification: Gene name=IolE; Function=Sugar phosphate isomerases/epimerases; Function class=G Carbohydrate transport and metabolism
  Homolog annotation: Query=1..294bp; Hit=1..294bp; Blast score=330; Percent Identity=52.0; E value=9e-91; Homolog= mlr2437 COG1082
MAVQLGINPLTWTNDDLPSLGAETPLETCLTEGRQAGFAGFELGNKFPRQSQILGPILASHNLKLVSGWYSGNLLTRSVEEEIAAVQPHLTLLRELGASVMVFAEVTDCIHGDQGKPVHLRPLFPVERWQEYGEKLTEFARYTQSQGVQIAYHHHMGTVIESAEDVDHLMEHTGEEVGLLLDTGHLTFAGDDPLAVAKRWCTRINHVHCKDIRPEVLKDVKNRKTSFLDAVLSGVFTVPGDGCVDYPAIFNVLKTSHYDGWLVVEAEQDPTIAHPLTYATLGYNNLHRFAKDAGLI

SEQ ID NO: 8507 - protein, 634 aa, Xenorhabdus bovienii
  Coding DNA sequence: Name=SeqID_2399
  Gene classification: Gene name=RbsK; Function=Sugar kinases, ribokinase family; Function class=G Carbohydrate transport and metabolism
  Homolog annotation: Query=5..331bp; Hit=6..332bp; Blast score=399; Percent Identity=59.0; E value=1e-111; Homolog= CC1298_1 COG0524
MDQYKKFDVICMGRIAVDLYGQQIGTRLEDMGSFSKYLGGSSGNVAYGTARQGLKSSMLARVGDEHMGRFLREELQRVGCDTSHLITDKERLTALVLLGIKDNETFPLIFYRDNCADMAITRNDFSEDYIASARCLAITGTHLSHPQTRDAVLTALQYARRNGVKTAIDIDYRPVLWGLTSLGDGETRYIASEQVTAQLQEVLPQFDLIVGTEEEFHIAGGSTDTVEALRCVRALTEATLVCKRGALGCSVFNASIPDTLDEGITIQGVRVEVLNVLGAGDAFMSGLLRGYLNNESWEQACIYANACGALVVSRHGCAPAMPDKIELDNYLARAKDVLRPDLDVHLNHLHRISRRHKQWGELCVMAFDHRIQFVEMARKVNASLERIPQLKKLLFRASQEVIAEAHLEGQAGILCDSTFGQDVLNSATGKGLWIGRPIELPGSRPLCLEHGDIGSQLVSWPLEHIVKCLVFFHPEDNHPLRLEQEKTVQEVYAACCQSGHELLLEVILPSDMTHSDEFYLRALQRFYNLGIKPDWWKLPPMQSATWDQIEALVVQRDCYCRGVVILGLDASEAILKASFNAAAGKSIVKGFAVGRTLFGQPSLKWLAGEIDDQTLILQIKTNYHNLISYWRQRG

SEQ ID NO: 8508 - protein, 566 aa, Xenorhabdus bovienii
  Coding DNA sequence: Name=SeqID_2400
  Gene classification: Gene name=PutP; Function=1 Na+/proline, Na+/panthothenate symporters and related permeases; Function class=E Amino acid transport and metabolism
  Homolog annotation: Query=2..522bp; Hit=4..523bp; Blast score=417; Percent Identity=45.0; E value=1e-116; Homolog= ZyidK COG0591
MLAFLSFIGFTLLVAGIAYYKTRNKHLIDSTEGYFLGGRSLTGIYIGSSMLLMNLSTEHLVGLNGLAFRTGFIVMAWEVIAALTIVLFAVYFLPRYLKLGISTIPEYLERRFDKNTLLITSILFLAMYVISLLPIVLYTGAIALESLFQVSQVFQVDRTTALWIMVWGVGGLGAVYAIFGGIKAIAVADTVNGVGLIVGGLMVTVFALLYVGDGNAWKGFTDVYQAHPDKFNSIGSEDSLVPFSTLFTGLIVSNMFFWCTNQSIVQKSLGAKNLAEGQKGVMLCALFKLIIPSIIILPGIIAFHIFSGQIDNPDNAYPALVQLVLPKILVGFFAAVVVGAVFSTFSGGLNSSVTLFIVNIYKPRINPNATETQTVAVGKYLGLGLALATMIIAPLVANAPDGLFYLIQQLQGIFNAPILSVVLVGLMTKRVPPIAAKLGLLFGVSAYIICNFILHINIHFFHLVGILFVLNIIFMLTIGYFFPAETYQEVYTKQVDITPWSMVKPMGWLITLAAISMYVFLAHNVPAYVMVLYSVFAAGVLGYVFYQIGSALFKRPVAAKAPYRIR

SEQ ID NO: 8509 - protein, 330 aa, Xenorhabdus bovienii
  Coding DNA sequence: Name=SeqID_2401
  Gene classification: Gene name=MviM; Function=Predicted dehydrogenases and related proteins; Function class=R General function prediction only
  Homolog annotation: Query=1..328bp; Hit=1..328bp; Blast score=310; Percent Identity=48.0; E value=1e-84; Homolog= CC1296 COG0673
MFNIALFGAGRIGQVHAVNIANHKETCLYSVVDPHRASAEMLVQKYQAKIQTIKEAMSDPDVHGVLIASATHTHADLIELAARHNKTIFCEKPVHLDLERVRQCLATVKECQVPLFVGFNRRYDPQFRRLKTLFNAGMIGKAESLLITSRDPSPPPVEYVRVSGGMFRDMTIHDFDMARFIIGEEPCAIYAQGSNLVDPAIGQAGDIDTAFIVMKFPSGAMATITNSRRSGYGYDQRLELHGEKGLLTAGNIKENSVELWGEEGCLAAKPEHFFLQRYREAYIAEWSHFVDVMAGRAIPETTAIDGEQALYLADKALESLLSGQEIKLPL

SEQ ID NO: 8510 - protein, 36 aa, Xenorhabdus bovienii
  Coding DNA sequence: Name=SeqID_2402
MLLNASVSVFGMNKNISSKIFISIFYSLKILFFRDG

SEQ ID NO: 8511 - protein, 32 aa, Xenorhabdus bovienii
  Coding DNA sequence: Name=SeqID_2403
MFLKVILSFIKSDYFNFHDRYDTEFIFFITKC

SEQ ID NO: 8512 - protein, 649 aa, Xenorhabdus bovienii
  Coding DNA sequence: Name=SeqID_2404
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=6..649bp; Hit=1..637bp; Blast score=702; Percent Identity=54.0; E value=0; Homolog= BH2318 COG0028
MNTAAINTKKMTMAQALVKFLNQQYIDVDGEEYPFIRGVFTIFGHGNVVGLGQALEQEPGHLRVYQGCNEQGMAHIATGFAKQKKRRQIFAVTSSVGPGAANMVTAAATATANRIPLLLLPGDTFACRQPDPVLQQVEQYGDGTISTNNCFRPVSRYWDRISRPEQLMSAMIHAMRVLTDPADTGAVTICLPQDVQGEVWDYPHYFFQKRVHRLERRPASLPSIQDALELIQRKKKPLLICGGGVRYSEAHDAFRQFAEIFNIPFAETQAGKSAIVAAHPLNCGGIGTTGCLAANLLAKEADLIIGVGTRFTDFTTASKSLFQNPEVEFLTINVAEFDACKLDAVGVVADAREGLSVIVQSLAKTAWRSGWQQEISQAKAAWQQELERLFAIQYQAGDKPEISGHLDDKLGEYSETLQTNLTQTRVLGLMAHYLEPNAIIVGAAGSLPGDLQRVWQPKEPDTYHLEYGYSCMGYEIAASLGAKLACPDQPVYAMVGDGSYLMLHSELQTAIQENIKITVLLFDNAGFGCINNLQMSQGMGSFATENRYRNQQSGRLDGGLVQVDFAKNAESYGCKSYRVHDEQQLITALLDAQTQPCATLIDIKVLPKTMTHDYESWWRTGTAQIADNPAITQAAENIREYVEKKTRQY

SEQ ID NO: 8513 - protein, 54 aa, Xenorhabdus bovienii
  Coding DNA sequence: Name=SeqID_2405
MEQVKNFVGGQLIGRQSDRRSSVFNPATGQEIRQVTLSTVHETHDSSFVMPAME

SEQ ID NO: 8514 - protein, 64 aa, Xenorhabdus bovienii
  Coding DNA sequence: Name=SeqID_2406
MKYTFHFQWKLKCTLINVINTLFLCNCIHQKVVTCEHLQQACLMSELSISLQFIMEALCLLRRT

SEQ ID NO: 8515 - protein, 277 aa, Xenorhabdus bovienii
  Coding DNA sequence: Name=SeqID_2407
  Gene classification: Gene name=RpiR; Function=Transcriptional regulators; Function class=K Transcription
  Homolog annotation: Query=2..277bp; Hit=9..284bp; Blast score=206; Percent Identity=40.0; E value=2e-53; Homolog= CC1297 COG1737
MSAASNLNELQEQIRSRYGELSKRLQQVAKYVLDNTNSVAFDTVAVIAKAANVPPSTLIRFANAFDFSGFNEMKQLFRLNLVEETASYTDRARLFKELDGDQQIPEDPQHILQEFANSNAQAMQQLAARTPAEDLNKAVDLLVNAHNIYIIGLRRSFSVASYLTYALSHLECRSLLVNGLGGMFREQMNRIGSDDVVVSISFTPYAEETVMVSERAAQAGAKQIVITDSQISPLASFSDVCFVVKEAQVDAFRSQSATLCLVQSLTVALAYRQGNRK

SEQ ID NO: 8516 - protein, 34 aa, Xenorhabdus bovienii
  Coding DNA sequence: Name=SeqID_2408
MLRNYCFWAKRIPDKSGLFCLLSSHFWERVTSLY

SEQ ID NO: 8517 - protein, 427 aa, Xenorhabdus bovienii
  Coding DNA sequence: Name=SeqID_2409
  Gene classification: Gene name=AraJ; Function=Arabinose efflux permease; Function class=G Carbohydrate transport and metabolism
  Homolog annotation: Query=36..411bp; Hit=1..375bp; Blast score=255; Percent Identity=43.0; E value=8e-68; Homolog= mlr2770 COG2814
MRCRRNILLQRQHPKITTECFNNNPIIHHSLGVSPMPAAIWALAIATFGIATTEFIIAGLLPEIATEFNISIPMAGYMATSYALGVFVGAPVLIILGRQVERKKMLAILMLLFIIGNALTALAPTFYLAIVGRIVTSLTHGAFMGIGAIIAAELVPENKKTSAIAFMFSGMTLANLIGIPLGTWIGKVISWRVTFAIITFIGIISLLGILRLLPKFIQQTPTSIKKELLAFTNIHVLLAMGITVLGPAAFFTAITYIAPLMTHIAGFSESAITWILVVLGLGFFSGNIVGGKLADKAMMPLLYWTLGLQALVLFIFWLYGDNPFIACLSIFLMAAFGFATVSPIQRLVMDKAQEAGAPNLVSSVNIGFFNLGNAVGAWLGGVVIAANYGYASLNLVGGLLASTALLLAVISGFLTYNKARVEALKSA

SEQ ID NO: 8518 - protein, 169 aa, Xenorhabdus bovienii
  Coding DNA sequence: Name=SeqID_2410
MKKDNQLCNENCNTNRIDSETDSATVTPFENALGRLQCVLVARRTATNPEGVSWAQYDTLHFLRQFQPMIPSMIGEKLGFTRSKTSKILRSLKEKELIEQESGENDKRELVTRLSHKGLMFLQRAELSRHNMADIVASSMSQGEIAIFTELCNRASNLLYSEMPVKHDD

SEQ ID NO: 8519 - protein, 131 aa, Xenorhabdus bovienii
  Coding DNA sequence: Name=SeqID_2411
MLNVLFDKYIEAVIEKSPLKLASLFCDDGILKLPFRTGRPIIEGNSNILEHYLASFGQAPLVFISIEDVEIYDTADCDTFIVEYRLNGKTLPEKRGFYCLYINVFKIKSGKIKELHDYEDVLNRELILLNN

SEQ ID NO: 8520 - protein, 415 aa, Xenorhabdus bovienii
  Coding DNA sequence: Name=SeqID_2412
  Gene classification: Gene name=ProP; Function=77 Permeases of the major facilitator superfamily; Function class=G Carbohydrate transport and metabolism
  Homolog annotation: Query=26..408bp; Hit=7..393bp; Blast score=176; Percent Identity=34.0; E value=3e-44; Homolog= BS_ydgK COG0477
MAVNESQDKVTEIYIDQIRQSDHREGELSLKLVLVLGMLSAIAALSTDMYLPLFPAISHALNTTPAGVQLSLTSFMAGLAVGQLIIGPWSDVIGRRNLLLGGMVLLTVASIACALSTSIQALIVGRFFQGAGGAAGIVLTRAIVSDLSFGNKAAYYFNLILAIQGVAPIVAPLMGGVAAFFPWPVVFIFMAITSFTLTILAFIYVPESLPEKRNSHAEGDGFLSQFFKLFKNRIYIGYTLIFAATFGMLFAYISSSPFIYQSMFGFTPTSFSIIFAINAGIMMLSSIMSARWVVRVGAKKLVMMGVVSSFGLACMLLGVNYIDAYQSELTIIIFMLLMFTMAFVFGNAASLALAAVPEVRGTGSAVLGAFQFGVASLTAVLAGLGHSISLFPVATVMMGCGALSIFSLMLVRAMK

SEQ ID NO: 8521 - protein, 57 aa, Xenorhabdus bovienii
  Coding DNA sequence: Name=SeqID_2413
MIRLTNLIYVNLSYLILRFIHCHSSHIKKHGTTIALAKYDFNLEIIFYNFPLKIYKN

SEQ ID NO: 8522 - protein, 252 aa, Xenorhabdus bovienii
  Coding DNA sequence: Name=SeqID_2414
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=6..252bp; Hit=2..248bp; Blast score=315; Percent Identity=63.0; E value=3e-86; Homolog= ZentA COG1028
MSTVFDFSGKNVWITGAGRGIGYQIASRFSQAGANVTGFDVAFPDAEIPFTSYVLDISDHLAVSHCCRKLLTPENHLDVLVNGAGILRTGHTETLSWEDWQQCLNVNAGGAFNFFQAVIPQFQRQCSGNIVSICSNAAHVPRVEMSAYGASKAALRSLCLSVGLELAPYGVRCNLVSPGSTDTPMLQSMWQTPASRQHTIDGFPEKFKLGIPLKKIALPDEIADTVLFLASDLASHITLQDIVIDGGATLGA

SEQ ID NO: 8523 - protein, 295 aa, Xenorhabdus bovienii
  Coding DNA sequence: Name=SeqID_2415
  Gene classification: Gene name=EntB; Function=Isochorismate hydrolase; Function class=Q Secondary metabolites biosynthesis, transport and catabolism
  Homolog annotation: Query=1..214bp; Hit=1..214bp; Blast score=296; Percent Identity=65.0; E value=2e-80; Homolog= entB_1 COG1535
MSIPKLNDYPLPAAQELPVNKVNWAFDSKRAALLIHDMQNYFLNFWQPDSQLVTQIIDNIARLKIQCQKLGIPVFYTAQPDHQSDADRGLLNDMWGAGLNKHPEQQSITDALAPEGDDTLLVKWRYSAFQRSDLEQLLKNSERDQLIICGIYAHIGCMTTATDAFMRDIKSFFVADALADFSREEHMMSLRYVAGRSGRVLTTATLLNEMSPSSLGENKWDREHLRAEILPLLDDDCGDIDDHENLLDYGLDSVRIMSLITRWNNQGHQLDFITLVKTPTLSNWLTLLTDKQEVR

SEQ ID NO: 8524 - protein, 542 aa, Xenorhabdus bovienii
  Coding DNA sequence: Name=SeqID_2416
  Gene classification: Gene name=EntE; Function=Peptide arylation enzymes; Function class=Q Secondary metabolites biosynthesis, transport and catabolism
  Homolog annotation: Query=1..529bp; Hit=1..528bp; Blast score=725; Percent Identity=65.0; E value=0; Homolog= ZentE COG1021
MNIEFNHWPEKLAQHYRQRGYWLDLPLSDILSRQVASENIALIAGKHQYSYHQLNCLVDNLAAGLKHRGVQYGQTALVQLGNVAEFYITFFALLRLGVVPVNAIFSHQRSELLAYADQITPSLLIADRSHTLFSDNNFLHELQRRYPTLKKIFLRGDNHSPIDLALLLDEKAHGFTASPTPADEVAFFQLSGGSTGIPKLIPRTHNDYYYSIRASVEICHFNRHTRYLCALPAAHNYPMSSPGALGVFYAGGQLVLANDPSASSCFPLIQQHQINVTALVPPAVSLWLEAISSTGDNSPLKSLELLQVGGARLSESSARRIPSEIGCRLQQVFGMAEGLVNYTRLDDDEQTIFTTQGRPISADDEVWIADKQGNPLPHGVAGRLMTRGPYTFRGYYRSPLHNEQVFDENGFYCSGDIVIQTSEGYLKVVGREKDQINRGGEKIAAEEIENILLRHPQMIHAALIAIPDPLMGEKSCAYIVTREEIKSAVLRRFLREQGIADYKLPDRFERVTHLPMTPVGKIDKQKLRQMTQHTPFQVGETQ

SEQ ID NO: 8525 - protein, 394 aa, Xenorhabdus bovienii
  Coding DNA sequence: Name=SeqID_2417
  Gene classification: Gene name=MenF; Function=Isochorismate synthase; Function class=H Coenzyme metabolism
  Homolog annotation: Query=21..386bp; Hit=21..390bp; Blast score=351; Percent Identity=49.0; E value=7e-97; Homolog= entC COG1169
VPNLATEFRISQLQDFCCDDFVFLSSNKSLHAHGCFTKITTPVGYNTDTDCQLHRDIPELFRQAKNKGIENPIIVGAIPFDKRQPSALFIPEDYSWLEREALSFSSVSSCPKLQQIHSLPDKDEFCQMVTHGVDAIHHGLLDKVVLSRLLNIKFDQQPDATQLFMRLNQQNPYSYNFHVPLGNSTLIGASPELLLCKQGNTIISQPLAGSSRRSSNVMQDNELRQSLLRSAKDQHEHQLVITAMRKALAERCTELAIPETPSLLSTPLLWHLATEIRGELADNQIDALSIACLLHPTPALCGAPRQQAATLISELEPFKRDYFGGIVGWCDARGNGEWVVTIRCGEVFENHIRLFAGAGVVADSKPSAEWHETDVKFGTMLQALGLSYDKERCL

SEQ ID NO: 8526 - protein, 732 aa, Xenorhabdus bovienii
  Coding DNA sequence: Name=SeqID_2418
  Gene classification: Gene name=CirA; Function=Outer membrane receptor proteins, mostly Fe transport; Function class=P Inorganic ion transport and metabolism
  Homolog annotation: Query=10..730bp; Hit=3..745bp; Blast score=435; Percent Identity=34.0; E value=1e-122; Homolog= ZfhuA COG1629
MVMPTKKTLKNKTIKSYNNKVPLILISVLFLSPHAVIANETANEKDTIIVTASTQGGSSGFVESESSAGTKSAAPLIKTPQAITVVNRAQIEAQGATTVADALNYSSGVITNYRGSSNRSDEVITRGFRYAPKFLDGLSYGLNGQGATAGQIDPWFLERVELVHGPASVLYGQVSPGGLVSMTSKRPTAQSIHKVQMKAGNQRLGEFAFDFGGAVHDDIPLFYRLNGILSTQQQFVKDYKKERIAIAPALTWIPNSDTTFTLLTSYQYDPKMGFRNFYPKVGTVTPIPNVGYMPYDMNLSEPSFNQARREQTSIGYILEHDINDIFSFQQTLRYSSSDERTKLFVYTKDVTSSIIGRRPQREHNKAQEFGIDNQLKALFSTANIEHNIISGIDYKWGDRHNKTWNDKNPGREPQYRFDWSNPTRNVHIDEKNLSLDSNDKKKLHQLGLYLQDQLNWENWNLVLSGRYDWTEVKQQDLIKHTSKKQNDSAFTGRAGLLYAFDNGISPYISYSTSFEPNLDTGAPGAPEFKPTMGEQTEIGIKFQPKDHDTLLTLSLFDITQKNVTTRDPVTRISEQIGKIGSKGAEAEIHSQITPEINLMASYTYTDTKTKSDRNPARVGKRVPAVPEHAASVWGSYSFKQSVLEGLTLGTGVRYLGTTSGDFTEKFNVPSYTLYDLMAKYNLGEASPQLKGASVQLNVNNLTDKRYVASCSNDGACFYGSGRSIFATVAYSW

SEQ ID NO: 8527 - protein, 35 aa, Xenorhabdus bovienii
  Coding DNA sequence: Name=SeqID_2419
MSEVYRLMELIRSSQRRIGLESSYRDLGKIRDIII

SEQ ID NO: 8528 - protein, 449 aa, Xenorhabdus bovienii
  Coding DNA sequence: Name=SeqID_2420
  Gene classification: Gene name=Fes; Function=Enterochelin esterase and related enzymes; Function class=P Inorganic ion transport and metabolism
  Homolog annotation: Query=67..441bp; Hit=3..362bp; Blast score=313; Percent Identity=46.0; E value=2e-85; Homolog= Zfes COG2382
MPDRGINGTTRWGNYFEEDKGMKLAFQPSGTISNLLSASYAGSELWWEHIAALGTPLVEARPEHQVQLTFFWRDPAGNEQNSDIRRVYIDINGITDHHSPQPQSLQRLPESDIWYWSVTIDDDWRGSYSLIPATHAHLPSDFYGDTQQRNQQQREWWCSLFPLSIPDPLNLQGCHRNGLGMSLSAAHMPHAPEQSAWVSIGRNSLAQSDTQQPILLNWQSHRLGNQRRIWLYATGEEPERPRPLVILLDGQNWAERTPVFSALEAATEQQHIPGAVWLLIDVIDMSRREQELPCNRDFWLAVQDELLPLAAQHATFSDSPSNTVVAGQSYGGLAALYAALHWPQRFGCVLTQSGSFWWPYSKMMKSSERQIGWLTQQVIEQKVPPSSLKIFQEAGSREDDIEGVNQQMYEALKNAGYHVSYRVFNGGHDSLCWRGGLIDGLSWLLSENA

SEQ ID NO: 8529 - protein, 80 aa, Xenorhabdus bovienii
  Coding DNA sequence: Name=SeqID_2421
  Gene classification: Function=Uncharacterized BCR; Function class=S Function unknown
  Homolog annotation: Query=7..72bp; Hit=4..69bp; Blast score=87; Percent Identity=57.0; E value=3e-18; Homolog= Rv2377c COG3251
MSQEQKNPFDDDNATFFVLINAQQQYSLWPAFAEQPAGWEQVAGPDSRSTCITYIEEHWVDMRPARLRDLLVSRESVNQD

SEQ ID NO: 8530 - protein, 2864 aa, Xenorhabdus bovienii
  Coding DNA sequence: Name=SeqID_2422
  Gene classification: Gene name=EntF; Function=Non-ribosomal peptide synthetase modules and related proteins; Function class=Q Secondary metabolites biosynthesis, transport and catabolism
  Homolog annotation: Query=1574..2625bp; Hit=5..1060bp; Blast score =704; Percent Identity=43.0; E value=0; Homolog= ZentF_1 COG1020
VSSRLQEVGVETINLTLPLVAAQPGIWIADQLADPRNIFTIAHYIEIKGALDQPLFDAALRQGLSEADTIHARYFLNEDGIPVQQIPLYCDPQQVIAPEWIDFSREPAEQAEIASHTLMQEDLSAELPADGERALYRQVVMKIDEQPERWFWYQRFHHLMLDGFSFDALTRRIIQIYNALRAGYQPAETPFCSFTQVVEEYQDWQSSPAKAKAAAFWQEYTREPGACVSLSVEDIAASGNSSPLNYHCHFPAAQLTSLIAEDSLRQFQPAEIVMAALGIYFYRMCGEKYLSIGFPFMRRMGSAALCSTGPVVNLLPLQIKLQDSMTLADVVKAFVAEIKQVRRHQRYDAKQLRCDLGLSGSSNLLYGPVFNYKIYNETLKLDGRPITTHTLATGPVDDLEFELNFQDDVLHLTFIANRTKYSEQTLRWHSERIRYLLDQLLIQPKQPIAFIPMIPPQEQQRLDEWSRGPCVTPPSGRVSVLDFFLSQVKQQPDTFAVRCGDQQLSYHQLMAKSMQLARLLLAQGIGAEDVVAIGVPRSVDSVVAILGVLASGAAYMPLDLDYPRERLQLMSDDAQPALLITCINTLPQMPDIPKVICLDDHQIQERCAGLSSLPVTDEERRETLWDEHLAYIIYTSGSTGKPKGVMSTHGGLLNLLASHAARLFGPVIDNFHLQHQRRMRAGHTASFSFDSSWEPLFCMMLGSELYIFDEELRRDAWGVVQQMNQLPVDLMDITPSFLTQLIDSGLLEEGNHQPAFIMIGGEAATPRLWDLLKQYPQMNIHNYYGPSEYTIDTLGANIQVADQPVIGRPVANTDVWLLDSHLQPVPVGAVGELYLSGPGIARGYLRRPDLTAARFVANPFKNGEVMYRSGDLMRWRPDGQLSFVGRVDHQIKVRGFRVELGEVENALAALPEVSSAVVIAEPMGVTYRLIGYCSVPDNKLRALADISARLLAELAKQLPDYMVPALLVILEELPLTVNGKVDRKALPKPQQQHFSIGRQAENEKEKYICEAFATLLGMVQVSADDDFFALGGDSISAMALGTQLRRVGWQLRPRDIFSERTPARMALKMSPVAIGKRTSSANKISKPVQIGEIDHLPILHWFAESHGINTRFAHGVFIRVPTELRPEHLSSALLALSQTHPVLHAVTRNNRLIIGEKPVQADGSYYSVIQNSGHIETSAEQAFHEAVMRLDPATGHLFHACLLQQDEETQGLVWVIHHLATDGVSWRVLLDELQQAIEAAMAGKTIALPPEEYTLYDWNLQLGQNLASRAGELSFWQAMLDEKIPLLGKRPLDAHRDRQVAVREQRTLLTGKQTTALLGALPQQYHANIEEILLTILAIACNRYFGVSKLRFQLESHGRIELEDDVDLARTVGWLTAEYPVVLALPQAECQSTEIAAENPSKIVRAVKSALRTIPDRGIGYGLLRYLDQTGRQVLAQQDTPEILFNYLGRFATTDNLWAPQRTENLFRDTFAVYQDPQMSPNHSLEINLFVDEQGSIPQLAINWQWVDGIFSEQDISELQRGMEWATDCLINFARQQPQQAAATLVAAEIVLPRLEESDLTQLTERYGPLTTVLPLLPLQQGLLFHAQTATDKGNYNSLTRLSLHGPLDRVKLHRALSGLIRHHPQLAARFDTEQSASPLQLIPLLSEDSEIWPLDFYQLPELSEQEEEAALLELEGTELARDLFHQPQAMLHALLVCHGEGSRYTLLLNIHHLVVDGWSTPILIQDLLTLLNQGEQALPVPRVSYQEIVHQLAARETATARQCWQDVLKGVQPTKLFSDQPHNGKVRELDIVLEPEMEQALFSLCQQRGLTLNTLMQGIWSVLLSIHSGSSDVVFGSPVSGRFGQIEGLDQHVGLFSNTLPVRMTLDITLPLLPQLEQLQAQQIQLIEHDNIGLGEIQHIAGTSTLFDTLLVVENYPETDTESDCTQTIICQQINNRGYTHYPLTLLVLPGKRLRLLMEYRECVKQPELLVQRILLLIQQLLEQPDTALRDWVLQSPDEAALITEVNRTHHEIPSGTLHQFVIEQAEKTPDDLTLLDNQHQLTYRQMRVQTRLLVDRLIEAGVQPGDIIGIALPRSVRLSLALQAILEAGAAWLPLDTGYPDDRLAMMLEDAQPRLVITESELQARFAHQAPLLVLDQLADENQQPVHPAAQVMPQHTAYIIYTSGSTGRPKGVMVSHQSIVNRLLWMQDAYPLTRDDVVLQKTPCSFDVSVWEFFWPLMTGAKLVMAPPEVHRDPEALMQLIDDYTVTTLHFVPSMLATLVDSLASRQQSTLFCHSLRRVFCSGEALSCELARRYQTFIAAPLHNLYGPTEAAVDVTWQPAYGEALDHCTGSGVPIGRPVWNTQLRILDSWLRPVPVGVAGDLYLCGIQLATGYLNRADLTASRFVADPFACGERMYRTGDIACWLPNGEVEYLGRSDDQLKIRGQRIELGEIEQVLLEQPGVAQAAVAACELGKTANTVSNADARQLVAWLIPQPDVSLDTEALHQALTRRLPAYMLPVSYVLQDSFPLSANGKLNRKALPMPQKLTTGRLPVAGTESQMAALFAEILDCDTVWADDDFFALGGHSLLAMRLAAEIRRRFNRSISIGHIMVARSVEKLSALLSDENGQNSAENRGLGEVFPLRDGHGPALFCLHPASGFAWQYSGLLRYLKGDWPIIGLQSPRPLGVIADSDNLEEMCTHHLATLRQIQPHGPYYLLGYSLGGMLAQGMAARLRQEGEEVAFLGLLDTYPPEGQDWTVLSEEEAKEEAAREQAEFMAATEDEHDSLLRAEKQAMFADIVANYKDSVRILSSAANQKYDGEAILFSATRTLPADMDVAATWAPWIRQLSIYWQDCEHADILSPTSLKQLGPLLNTLLKTHRD

SEQ ID NO: 8531 - protein, 267 aa, Xenorhabdus bovienii
  Coding DNA sequence: Name=SeqID_2423
  Gene classification: Gene name=FepC; Function=ABC-type cobalamin/Fe3+- siderophores transport systems, ATPase components; Function class=P Inorganic ion transport and metabolism
  Homolog annotation: Query=3..257bp; Hit=19..273bp; Blast score=335; Percent Identity=64.0; E value=4e-92; Homolog= VC0779 COG1120
MTYRLSASHLTLGYERKIITEDLSISIPDKQFSVIIGPNACGKSTLLRALCRLLKPHHGHILLDGKDIQQIPTKALARQLGLLPQQAIVPENITVSELVARGRYPHQSLLRQWSLDDRTAVAQAMKATGIAQLAERYVDELSGGQKQRVWVAMVLAQQTPLLFLDEPTTWLDIAHQIDLLDLFLQLNQESSHTLVAVLHDINQACRYADHLIVMQAGQIVTQGKPQDIISTELIKSVFGLSCVVIEDPVSHTPLIIPCGRYHSVKDI

SEQ ID NO: 8532 - protein, 343 aa, Xenorhabdus bovienii
  Coding DNA sequence: Name=SeqID_2424
  Gene classification: Gene name=BtuC; Function=ABC-type cobalamin/Fe3+- siderophores transport systems, permease components; Function class=P Inorganic ion transport and metabolism
  Homolog annotation: Query=21..343bp; Hit=7..329bp; Blast score=234; Percent Identity=49.0; E value=8e-62; Homolog= ZfepG COG0609
MPKMLQVGHPEGWINGRIPLRVLLVNTLQLFLIMLLALFAVYYGTLKLSFWQIWQAFQGEGDPGIIAVVTQWRAPRVAIALVVGAALAISGAIFQSVIHNPLGSPDIMGFSTGAWTGVLITLIFLNGGYYQMTLGALIGGSLTAALIYLLAWRQGIHGFRLIIVGIAISAMLTAVNTWLIVTGSLEHVMSAALWGNGSLNGITWQKSASALFVIPLLTFGAFALAKSLKIMEMGDDKASALGCNVETNRMQLILYGILLTAVVTATTGPISFISLAAPQIARRLTGTSYVPLFSAAMTGALLLLTADLVAQHTFSNVQLPVGAVTVSIGGIYLIWLLIREARQ

SEQ ID NO: 8533 - protein, 348 aa, Xenorhabdus bovienii
  Coding DNA sequence: Name=SeqID_2425
  Gene classification: Gene name=BtuC; Function=ABC-type cobalamin/Fe3+- siderophores transport systems, permease components; Function class=P Inorganic ion transport and metabolism
  Homolog annotation: Query=24..346bp; Hit=8..329bp; Blast score=242; Percent Identity=53.0; E value=5e-64; Homolog= fepD COG0609
MPAAPMHREITSSKPLPQFHTYRTRRLTGPIICLLLLIIFSIASLLLGSKYIAPETVWNSLTGELHNNESIIILESRLPRTLVGILVGMALGGAGALIQALTRNPLADPGILGVNAGASFAIVVAITLFGLSSVMAKVSVACLGAFLASLAVWLISMQSGDKSNPVRLTLSGVAISALLTGVTTNIALLNPSTFDQLRIWQAGTLDIRSLQVTLLVAPLILIGCALTLLISRPLNTLSMGEEIATTLGVKILWVKVSAIIAIMLLCGTATALAGPIGFVGLMIPHIARWWCGPDQRWIILHSLLMAPVLLLSADIVGRLLVAGELRVSIVTAFIGAPVLIWQVRKRKY

SEQ ID NO: 8534 - protein, 40 aa, Xenorhabdus bovienii
  Coding DNA sequence: Name=SeqID_2426
MFPEKAVLAYRPLMIMAIQMIITINNEWSLSGYACCPNAS

SEQ ID NO: 8535 - protein, 421 aa, Xenorhabdus bovienii
  Coding DNA sequence: Name=SeqID_2427
  Gene classification: Gene name=ProP; Function=77 Permeases of the major facilitator superfamily; Function class=G Carbohydrate transport and metabolism
  Homolog annotation: Query=1..404bp; Hit=1..403bp; Blast score=309; Percent Identity=50.0; E value=3e-84; Homolog= ybdA COG0477
MAKSSILLDFSLLKNNAHFRAIFIARMLSVFALGMLTVGVPVQMQFLTGSTLQVGIVVALDGIGMFIGLMLGGILADRYDRRKLILFARGTCGLGFVALSFNAFLDSPSLFVLYFLSVWDGFFGALGMTALMAAIPNLVGRENLAAAGALSMITVRIGAILSPALGGLIIVASGPGWNFAIAAAGTLATLIPLVRLPKMKPQSTLQEHPLRALVSGVRFVCQHKIVGSVILIGMLISMAGAVRILFPALSQEVYHQGPSATGLMYSAVPLGAMLGAFTSGWIGRSARPGLLLIIFALGSFLALSLLGVMTHIVPALLALVCYGYLNAFASLLQFTLIQSHTPDHLLGRVNSFVTAQDVTGDSLGALGLGVMGRLLSPLITALSFGSFAAITCLLLAALVKPLRHSTLHDNAASLEGGASEK

SEQ ID NO: 8536 - protein, 348 aa, Xenorhabdus bovienii
  Coding DNA sequence: Name=SeqID_2428
  Gene classification: Gene name=FecB; Function=ABC-type cobalamin/Fe3+- siderophores transport systems, periplasmic components; Function class=P Inorganic ion transport and metabolism
  Homolog annotation: Query=50..341bp; Hit=27..318bp; Blast score=343; Percent Identity=60.0; E value=1e-94; Homolog= fepB COG0614
MQCKFTFSYYRLITVIFAFIALILTSGCDEKSTEVKSGHPQPSGETTSMAGWPRTFETVKGPLTLTQPPKRIVSTSVTLSGTLLAINAPLIASGATGPNTDVADSQGFFIQWAKVAYERGVKLLYISEPNAEAVAAMVPDLIVISATGGDSAMKLYEQLSTIAPILVIDYGDKSWQQLALQLGQITGNEAGAGEIIARFEQRLQKVKQDITLPPNPVSAFVYYADGRGVNLWTPSSAQGQLLHQLGFTLATLPTSLKTETSMGKREDIIQLSAEGLADGLNGQSFMLFATNDSTIQAVNANPFLQHLPAVSTQRLYAMGPDTFRLDYYSANNMLDRIEHYFSNQELKN

SEQ ID NO: 8537 - protein, 34 aa, Xenorhabdus bovienii
  Coding DNA sequence: Name=SeqID_2429
MEFWHGNTQNFHSNYLNKGKEYILPRSKGHITQP

SEQ ID NO: 8538 - protein, 164 aa, Xenorhabdus bovienii
  Coding DNA sequence: Name=SeqID_2430
  Gene classification: Function=Putative transposase; Function class=L DNA replication, recombination and repair
  Homolog annotation: Query=1..153bp; Hit=56..215bp; Blast score=135; Percent Identity=47.0; E value=2e-32; Homolog= mll9070 COG3316
MVKRYRRSQPTVGRRWRMDETDIKIKGQWRYLYRAVDSDGNTVDFLLTAHRDKEDALRFFKKAIRQHGQPDGVTIDKSGANKAAVDELNQGKPKDNDILIRQNKYLNNLIEQDHRNVKWRTHPMLGFKNFRRAQTVLAGIELICMLRKGQYRHHNAQQKHIRHK

SEQ ID NO: 8539 - protein, 53 aa, Xenorhabdus bovienii
  Coding DNA sequence: Name=SeqID_2431
  Gene classification: Function=Putative transposase; Function class=L DNA replication, recombination and repair
  Homolog annotation: Query=3..53bp; Hit=23..73bp; Blast score=71; Percent Identity=70.0; E value=1e-13; Homolog= XF2303 COG3316
MSLIRKAFKRVHYPVDIIAQCVRGYLAYALSLRNLEEIMAECGIAVDHSTLSR

SEQ ID NO: 8540 - protein, 585 aa, Xenorhabdus bovienii
  Coding DNA sequence: Name=SeqID_2432
  Gene classification: Gene name=MdlB; Function=ABC-type multidrug/protein/lipid transport system, ATPase component; Function class=Q Secondary metabolites biosynthesis, transport and catabolism
  Homolog annotation: Query=66..572bp; Hit=74..579bp; Blast score=222; Percent Identity=30.0; E value=1e-57; Homolog= msbA COG1132
MNKFSVLTALIGVPLKGLKSMVCVAIADAFLTSAPYAFLYYIILDMLSAQPDIHYQFMLAAACAVLMLIRILLVRILYFNVSLIGFNAGASLRKHLGEHLRRLPMGFFYRSEMSSVNNTLLKDIDMVERIFTHLYAPMIATVSVLCFFAFGLLLKDWRMALAMLSTLPLAVCAYFLTRRYARLWQTRVQSWMFRLNDGLMEYIDSLKELKAYQMVGGAFQRLNQVLDTTYKKSLTAEKAGVWPIYSFNLLVECGFIVLLVALTWGWLGHSLSLAEVLVFLIAAVRFFRPLLNMSMFLAELNYFGLAVERIQKVFEIPELSQGNLRPDITAMRIRLENIGFAYPDQPALFNNLNLLIEENKITALVGPSGSGKSTLASLIARFWDIEQGNIWVGEQHNPINLAEMDAEYWQRFLSVVFQKNYMLNDTIANNLKIARPDATEEQLLSVCRSAQLLPLLNKLPEGLDTYIGAGGVHLSGGELQRLSIARALLKDAPLVILDEATASLDPENEREIQLAMQSLIQRKTVLVIAHKLSSIQYADKIVVMDQGDIVEEGTHSELIDRQGLYHELWQLQQQTQSWGMRTGRE

SEQ ID NO: 8541 - protein, 595 aa, Xenorhabdus bovienii
  Coding DNA sequence: Name=SeqID_2433
  Gene classification: Gene name=MdlB; Function=ABC-type multidrug/protein/lipid transport system, ATPase component; Function class=Q Secondary metabolites biosynthesis, transport and catabolism
  Homolog annotation: Query=32..576bp; Hit=21..566bp; Blast score=228; Percent Identity=31.0; E value=1e-59; Homolog= BH3891 COG1132
MVGKEPENQQTAFRWLMKLVSSQHKRLAAAMFLAICYSLLALVPYVIVYQLIVDFLNQPEIAAQHVWWMVIMAALALIGKILLQLASGLLSHQAAFQLLFELRKQVIERVGRLPLSTCHQHTSAKLKKIIADDIGRIETFVAHHLPDMAAAVMTPVGAAVLLFFFDWRLALMALLPLPVAIAMQGWMFKGFNQRIGAYHRVVADLHTSVVDFVKSMPLVKAFNMTVNSHQRYTQAVNEHHQLVTNWLRDTRTATALFKISLELGLLCIMPVGIWLFADGQVTLSVLFIFMLLGIGLMEPLYNLSQFANMFSDLLKGVENIREFSTSPAQKEGKQWVAIDNYDICFNQVSFHHPGSETQTINQFSFVAKQGEITALVGPSGAGKTTAAQLIPRLYEYQSGEILLGNTPIDAMPLEQLMSLTAFVFQDAFIFEDTVFNNIRMGNEALSEEQIKAAAQAACADDFIDRLPEKYQTVIRPEILSGGQAQRIAIARAIAKNAPVIILDEATAYADARNESRIQQALAALIKDKTVIVIAHRLNTLTHVNKIVVMDEGKKVSEGTHPQLLSHCALYQKMWSAHQAAKEWHFITRPKAVIHE

SEQ ID NO: 8542 - protein, 422 aa, Xenorhabdus bovienii
  Coding DNA sequence: Name=SeqID_2434
  Gene classification: Gene name=ProP; Function=77 Permeases of the major facilitator superfamily; Function class=G Carbohydrate transport and metabolism
  Homolog annotation: Query=7..262bp; Hit=11..265bp; Blast score=77; Percent Identity=31.0; E value=3e-14; Homolog= PA4218 COG0477
MKYNGNIASLFGLYCGQGAPLGFAIFALPGILRAQGADMQFIGLVGLSMLPWAFKFLWASWIENHKPWGFGSLPAGVGWIQLFKGLSLLLAALLWFFSPDTDIIGLLVLITIINFCYASQDVAVDALAVRVFAGSRHVNVNVSQIAGFSLGMLLGGVLSLYIFSAAGWHMTVLSFLLIQLICHLPFMCHQGSFTQDNQLPVKPGRASLWKIFRRKGWLPIIAMALCFKFTSTMGVALVSPLLVDMGVNLELIALISGGVLIISYIAGAVSSGILHKWFSSPQLTVFGLTGSACCWLGTALSLMASAKSPTMVFLFFILEGFFFNLCCVSLFSWFMRWSEGEKDHTIVQPGTDFTLLQCCEVLGSSMAMVLTGLLAHHLGFTQAFTLAAASGFAVVLLTIVCFRYSRRSYRGFDEPRCITERE

SEQ ID NO: 8543 - protein, 248 aa, Xenorhabdus bovienii
  Coding DNA sequence: Name=SeqID_2435
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=4..240bp; Hit=7..242bp; Blast score=150; Percent Identity=36.0; E value=9e-37; Homolog= PA4229 COG3208
MNDRTFRLIKSGTHQQMVCFHHAGGTAEYFMPWKNGIADDTAVYAVQLPGHGSRIQEPLLHDLHQMADQIAAACSFLPARPTVFFGHSMGAALAFEVALRMQRQGKSIAGLYVSGRLPPHKNTGTDFYRQSEETLLNKIISLQGADMDYRQPELKSLLVPIFRADFAAIETYQRRCEQRLNCPVIACIGEADSEVSVSDFRQWCQISSGTFELNVFSGGHFYLNDQRGSLFDFLNQCLANKNQPVMNV

SEQ ID NO: 8544 - protein, 380 aa, Xenorhabdus bovienii
  Coding DNA sequence: Name=SeqID_2436
  Homolog annotation: Query=1..380bp; Hit=1..375bp; Blast score=554; Percent Identity=73.0; E value=1e-157; Homolog= ref|NP_404400.1|
MSQPLKVVVCGTLFGQVYLSAFKSAFAGFELAGILAQGSERSQQLAQAYGVPLYHRVDELPDDIDIACVVIRSAIVGGKGSEIARALLQRGISVLQEHPVYLRDVAECLKLARQHGCGYQVNTHYPHVPAVRQFIAYLREALQTQQALFIEATCGVQVICGLLDILGRIFGRFTPCGFSQPESYDNKLLGLMNHTPPYTQLRGVIAGVPLTLNLQNQLDPADPDNHFHIMHRICVGLPSGNLLLANTHGPVIWNNCFHIPRVKTASGCRELIAPELAPDYFLPPLNQSFSNHEDNYHQDNLQDILNRHWPSAVRHALREFAGQCQTSAPADAQYLLSLTNAWKSLMEQAGNPESVSLADPMMASPEIARFLSKWKSEREE

SEQ ID NO: 8545 - protein, 360 aa, Xenorhabdus bovienii
  Coding DNA sequence: Name=SeqID_2437
  Homolog annotation: Query=1..360bp; Hit=1..358bp; Blast score=367; Percent Identity=56.0; E value=1e-100; Homolog= ref|NP_404401.1|
MTTRKSVLVIGGQGAVGRAAVDVLSRLGYRVMIAGRTERPEYHDYYQLDLFDRTALAHCCQQADLVLNTAGPASLIEDVIAETALNAGVHYVDVAGDPAVEKKILQQIAMRQEPCRSACVLGAGFIPGLAGMLPLYAAEYLQPVSKIRLYTGGIEAFTATSAQDFFASQQPEREQGKTGYILSGGQLIRAGIEKTKSISTAERMFDALPYFSFEQERVAQKLSLAHLAAYNLLADRTLLLTAPANQADAIQRLITLSQQLVEKEGEQQHLLMEAHGLLAGQPTMLRLQIRFNNSYQLTGSIAALAAHQLLKQPVTGLYWLPDIINIRTLLTQLDELSLFSHFSSDFLPDDEIVLFQEGEI

SEQ ID NO: 8546 - protein, 1816 aa, Xenorhabdus bovienii
  Coding DNA sequence: Name=SeqID_2438
  Gene classification: Gene name=EntF; Function=Non-ribosomal peptide synthetase modules and related proteins; Function class=Q Secondary metabolites biosynthesis, transport and catabolism
  Homolog annotation: Query=11..1563bp; Hit=5..1575bp; Blast score=863; Percent Identity=36.0; E value=0; Homolog= PA4225_1 COG1020
MNQEMQHQATELLFSLENKQARFWLEGETLKFRAPEGVMTPEIISRLKSLKPQLIELLKNWQHHSQFLIHPERQHKPFPLSDVQAAYFVGRQSLFEYGGVGCHGYFEILSPAWEINKLEQVWNQLIARHGMLRAIIMPNGEQMILPYVEPFSIEAVSQSPESLRETMSHRVYQPDTWPLFDLKVSQVNGKACLHFSIDLLIADFLSVQILLAELLNGYSGKTLDQAPLAISFRDVIQYQRQQKHGRDYAQSRQYWLNRIADLPACPQLPVLRTELQDTPQFVRHDYQLLPQQWLELQRICQSQGVSPSALLLTLFSEAIAKWSESRHFSLNLTVMNRPDAHPEIAKLVGDFTSVSLLEVDLRDSRLLRQRVEQIQTRLWQDLEHNAFSGIEVIREWVRQRGKEQAKMPVVFTSALVGEGKTQAQEAIIASQMDIEFSYGISQTPQVWIDCQVMELQSGLRINWDVLADIFPAGMIDAMFAAFIDAVMQVITDETVWQHSLTLSLPQEQQQVRQQVNATAEPIEPALLHHNILRQAEQTPEATALIDSQRVMTYGELVDQAQKLAKKLSGKGRYAILLEKGHPQVVAALAILLAGGAYVPVDASQPWPRIVQILSDALVETVIIAGEEEQETKLTAAGFHALNLHRSEAYPDLPSLEPVSITPQDLAYIIYTSGSTGQPKGVMISHDAAYNTICDLRQRISLSADDCVLALARLSFDLSVFDLFGVLGAGGTLVFPDEGDLQNPAKWAHLVAQHQITLWNSVPAQMKMLTAYLSAENLVLPSLRYSLLSGDWLPVSLPKAMAQTLPNAAQLSLGGATEAAIWSNCWPVDPQVDYQTSIPYGIPLTNQQFRVVDPQGADCPDWVAGELWIGGRGVALGYWHDEEKTEHHFFTDANGVRWYRTGDLGRYAIDGVIEFLGRMDHQVKIRGYRVETGEIEALLLKSSPVAQAAVIKSGDKHQAELHAYVEPAQLPALSPQSQQHADYCRQAVQEIRAIAEQTAESLDKALIEKLFFLLDQVALMQMVKALSAMQTLPMHQTVTLDEIIQKGNIAEENRQLTRRWLRALVQHDYLEQTGDHYRLIKPVSESEINDDWQQCERLMAQLDDDRGLLTYLERSSQCLPELLQGKEDPLNLLFPDGNLDVATHAYQNNLISKFMNRLLISAAEKKAIEVNQQQHRCLKVLEIGAGVGGTSNVLIPHLAGWNVEYTFTDVSTFFLNEAKKRYQQFDFVHYQLFDFNQSPTEQGLDCGQFDLIISANVLHNAIIARQGLDNLRQLLTPGGWMLIIEATRDNYQLMTSMEFKHGLTQFADERLELDSPFMPQQNWLNALHDVGGETVWAYPPADDALYQMGQSFMLAQFNSRRQHCEPQALLASLRDQLPEYMVPAKLAILDALPVSANGKLDRKRLPALPDQTQNRAEIVSPQTDDPLEMTLLTLCREVIGNPAIGADDDFFTSGGDSLLITQWINRIRETLGADHVPWEGSLRQVLQQPTVRALAAYLRSQSEQQETQQSQRTRVTCLKPGDGEPVIILHEGSGTILPYLPLVEKLSGPVYGLSVGDIEAFLSIPADNLIPQLAAHYLQEIQAISPHCHLVGYCMGGLLTFEIARQAMENLTPVRSVTVVSSYQIPYRIEDSLMIDMSIVWALGIASPWPFEKTQLDAIYEEILAEKPDVITHDVVTQRAHAKGLHQLAAAYAQVQQQPEDQRLSQLLAAIQGTASAQSDVSQTQWKQRVEVFRHSIRGVCGYQPEYFAGDMTFACQQGNTHLLPALQQDMKTFWQTNCIGDVTYLDLNGDHFNCMNVSNIDPLVHHIEQGKMREAE

SEQ ID NO: 8547 - protein, 3698 aa, Xenorhabdus bovienii
  Coding DNA sequence: Name=SeqID_2439
  Gene classification: Gene name=EntF; Function=Non-ribosomal peptide synthetase modules and related proteins; Function class=Q Secondary metabolites biosynthesis, transport and catabolism
  Homolog annotation: Query=1233..2622bp; Hit=12..1336bp; Blast score =537; Percent Identity=31.0; E value=1e-152; Homolog= PA4226_2 COG1020
MNSIKNSTRWVRNTLFKQAEQAKEGIALRYCIKNTNGTQDKTEIYTYQDLLSLGCKLASQLTLRSEKQSSALLLMPGDSSFVISFIACIIRGISAIPVHLASHLRINRSSETIDHIIEDSQPEFILTFSHFADEIAERGWNKDRQLIFVDKVIAALVDSEQVFPTEEEYHALYHLSLCHNSDAPVYLQYSSGSTAKPKAVCNYDDNMRVQHEILLELHQHCQPKIITANWLPFYHDLGMFCGLLLPLLSGGCCNFMPPVHLVSEPFRWLKIIHDYQANSVAAPDFAWELCASMVTDEWITQLDLSSVKMAMNAAEPIRAETMNRFACRFSATGFHPQSFTPAYGMAESTLVISYKPIGTDYVSRRFNAEELAKGRAIPSPDGRELISSGQVAHQWQLQIVDPETHRPLPEGQIGEIWVNGASTAGGYWQNQALTETVFKNTLAGDHSGNHYLRTGDLAFLYQGELFICGRLKDVIIVGGQNYMPNDIETVIERFCPGVKIGGICVCQDFDNSELIIMAEVYRHLNHDELDSIAKSMVAEVAKHFQLMVGNVVLLAKGKLSKTSSGKIRRRHMLSQYLAHQLEVVSIYSAEEKSAAITSSPLFDGLQQTLCHLLGIDSFDPHRGFSDAGLNSLLAVKFCQKVNQYLDGKYSDYKLRVTDLFAYPTLAQLAHYIEQHRSQINTNETLAEPKKADKEIAIIAISCRLPGQTDEHWQHYGKWLAAGQSAVRHEQSRYRHFVQPIGAINNIEKFDAHFFNIADREALLLDPQQRILLELSWHLFEQTDWLPKAVKQRDIGFYIGQSGSEYGQLLLQQNNPDYAKSYLATGINTSATSGRLAKFYGTTGPALTIDTACSSSLVALNSAMNALQQKQCSAAVVGGVNLLLSPQIEQALINAGMLSPHGRCATFSREADGYVRGEGAVLCLLKPYQQALADGDPVLAVIEGSVVAQDGESSSLTAPNPKAQAAMMTRLLTDAALTPEDISLLETHGTGTALGDPIEISAINAVYGQRKTPLRLGASKSQTGHLEAAAGLCAVVRAVAQIQQQKAFGHPTFTQCNPLIADYFDHYHFERETVSCEINRVAVNAFSFTGTMAGVVLRKPEVRSENLTDGVPSVFLPSLYPFNRQSYWPEALLIGDGDKAENQPLLPEHSRLNFDFVRSWVADTLSLDISTLSDDEDLLNLGLDSLQMLDLVDECKKLNVSLTLAKLFENTTLSAWRQYWQSINVTHELQKEPAVSSGRWNGEPFALTSVQQAYWQGRQQGQVLGDVACQVYLELDCVSLPDSAINQAVNKLFQRHDLLRMRINEQGLAVIRDDQPVTVSSHQWLHLSDEACSAERMNLRRQLSHRMADLTQESGFQLIASHSAQGTCLHINVDMVIADAMSLQILLDELSEFIRQPELSLTPLNYNFPQYLLDQDLKNVNNTEHAAYWQQRVTAGLPLAPQLPLAVQPAELNEQKFSHRNWRLEAESWGRLKNIARRYGVTPSMLLAGCFAETLRGWAKEPDFSLNLTIFNRRGEHPELSKLVADFTSLLLLACKTQADDSILTHVRRLNQQFMRDLDHADYSAVQVLRDWSQQRGEQVTMPVVFTSNLGRDLLSEKTLGTLSYLTSQTPQVWIDCQVMEHQQELLISWDTVDTLFPVDMVDQMFSFMTRLIMAIVQDETVLHAPVTAYIAPSRLALRRNPPQNEPIPPLAPRLLHQQFWLWAEKTPTNIAVISQGIALTYQEISEQVRELAWRLKDRHIQHGDHIGLLLPKGVEQIVAVLACHSVGAVYVPLDIAIKAQRLQQIISQSDIRLVIGHQECEIQDDQTDYGWLNIAAKSPNMLPIERIVFGHPSDVAYIIFTSGSTGVPKGVVISHQSAANTVDDINFRYSVSQNNEKQRITIFALSALNFDLSVYDIFGPLSLGGTLVLPNAGQEKEAKQWLALLHENQVTHWNSVPALFEMLLVAAEQEPRGLPASLNQILLSGDWVGLDLLPRLRALGSGANFTALGGATEAAIWSNAIDVSVIPSHWNSIPYGYPLAHQYYRVVDNQGRDCPDWVTGELWIGGQGVGLGYYADPDKTAAQFVIQGGERFYRTGDFGRFWSDSCLEFLGRQDRQIKLHGYRIELGEIEAVAERLTEVKHAVALFLDKPQKHIQLFIEGKEQHSSRELTAPAYAVMSELPDHITAIDQRHDEKEITSHLLHHILTDVFALDFTDCQSSEVLLEKAGITAQWQPLFGAWLAWLVEQKMLECHSDRFKATARWQQRRLAIHDERLLSIHHAIEQKATWLVAVLTGNENPLLLLDNPVISPENLVAYSPDTLAMADALCQQIESLSAQLQRPVRVAELNGRSGILASYLLSRLKAESVHYCLMESAGSLRKLAEYRLAGYQHTVDVISAPEQVVFSADIVITNNALHRFSDIAQGIEALKLLCGTDSLIYAYESLTLSPLALLTVLLLQDQNGFSDQRKGAFSPLLNQQDWQQTLSDAGLVLHAVKAVQPHSMLFICQCRQAKTLIHRETLMQHLRQYLPVYMLPAQITSLTPFPLTANGKIDRNALAAQAAAVRPEIFTDPAEKAALSDEREQCVARVWQQILGVVPQADSNFFLSGGDSLHATRIVAQLEKEGVVDVTLAQIFSLPVLRDFASSITFSAKVSPSAQLIHQPELRYAPFEPTDVQRAYLMGRQAGFHLGGVATHYYNEYEYHGNEGTAFDPIRLEKALSQLVARHDALRIVFDEHGAQRVLAQQPSSALTMISCRADEWEIVTATQREYLSHRVLEPAQWPLFHATLIQSDDGRSRFCLGLDNLILDGLSMQIFFTELAVFYANAAVDLPSVDIGFRDYLTATHLKPESENNSENYWRERLELLPDAPRLPLVCDPKSLGTPKFKRWQSVLPAARWQKLAAKARSYQITPSCLLLTCYAQVLAKWSESAALTINVTLFDRQPCHPDINHIMGDFTSLLLLACQQYQDESWFERVQRTQQQLWQDLEHSDVSAVWVIRELNRQRGTTDVTMPVVFTSALGAQVTDYPDVDFPASIWGISQTPQVWIDHQVFEREGELHFNWDGVEALFPAQMIDQMFSAYCQLLEKLADAESWHVPLAVPLPASQQISRQQVNETRAPFDFSPLHCRVATAMQKFAPRTALVEGDSVISYQQLEQAVRKLAQYLTEQGVREKDLVGIVLPRSGEQIIALLAVQWLGAAYVPLSSQWPLYRREQVIEQAEIRYVISHPALTWPDTVTVLSVQGEPDSASRPEPLAVTSEDLAYIIFTSGSTGIPKGVAISHGAAVNTIEAVNRQHHLHEADRGIALSALHFDLSVWDIFGLLSVGGALITVAEQQEKDAAAWLSLVSRHRVTVWNSVPALLEMALLIQQHEETDGALASLRLVMLSGDWVAPALPQRLKTFAPDAQCVAMGGATEAAIWSNYCLADEWLANEWQEDESASGWRSVPYGVPLPNQSFRIVNEINEDCPDWVTGELWIGGKGVALGYFGDRERTERQFVSHQGQRWYRTGDTGRYRPGAVIEFLGRKDQQVKISGYRLELEEIQHVLKTCPDIEDALVFVTQQHDRPLLSAVVMSHDEPNWGDIMDALRQKLPEYSIPTRVGHCQRWPLTDNGKRDHQALETLLHPYVRAVETTRPLTEAEQLLCDQLKLLLDIPHINFHDNFFAIGGDSFIATRLTSALRRHHGIELPLWKIFSLQTISHIAQTIESTFMDEADIQFEEGSL

SEQ ID NO: 8548 - protein, 688 aa, Xenorhabdus bovienii
  Coding DNA sequence: Name=SeqID_2440
  Gene classification: Gene name=CirA; Function=Outer membrane receptor proteins, mostly Fe transport; Function class=P Inorganic ion transport and metabolism
  Homolog annotation: Query=34..687bp; Hit=60..790bp; Blast score=209; Percent Identity=28.0; E value=6e-54; Homolog= PA0192 COG1629
MMIFNRDAVTLAALISIPFNSFAETNEKDQKIELDTITVTAQKIKTEQQKTPVSMSVLTDFDLERQNIENISEAIMRIPNFYMVKAGNPSDAGFFSMRGITPGMEGEQSVGFFIDGVNTNTYDSELLDIDKIEVLRGPQATLYGRNTEAGVVNVITKDPDFSPEYNFGLSYGNYNRTQANAILGGSINQSEDWAYRAALKYLYSDGYFKRDYDGKKNVDNNRDFSGRLKLRWQPSDYNWDVITTFDMQNRRNGNMSFAALDDIKKGRKYVNSNYIGKVNVDSYKGQVKAVYSWDNLDFTSISAYTDEKKIDNQDLDFTKNSISELLMKRKTNYLSQEFRLNSKNEGAFNWLIGAYTFHQKDKNIIDYRNIPNKFSMLRDSDIKTDNYALFGNASYYLLDNVELVAGLRYDYEKKNIDFKLSGMGESQDNNRLSFDTWLPKVGVNYYMTDNVMSYASVSRGYKSGGFNTLGPKSSRSYGAEYTTNYETGFKSEWFDKRVRWNTSFFWIDLKDQQVEVASYPLSYTVNSGKSVSRGIESELAWRITRSLTASVNAGYTHANFKDFPTEIKTTEGKFAAVNYKNNRPANSPDYTYGVGVDYNFLNGYFVRADYNVKGKTYFDNSNSKKQSAYGLLDLGAGYETNDYAVKLWVKNALNQKYATRAFQMDDGKWYARAGEGMNFGVNVNIKFQ

SEQ ID NO: 8549 - protein, 33 aa, Xenorhabdus bovienii
  Coding DNA sequence: Name=SeqID_2441
MNKGDFALLLLTIVNENHLCFNADALDKENIWH

SEQ ID NO: 8550 - protein, 148 aa, Xenorhabdus bovienii
  Coding DNA sequence: Name=SeqID_2442
  Gene classification: Gene name=MarR; Function=Transcriptional regulators; Function class=K Transcription
  Homolog annotation: Query=2..122bp; Hit=7..127bp; Blast score=134; Percent Identity=55.0; E value=5e-32; Homolog= NMB1843 COG1846
MHESLTIALLQARETAMGFFRPILKSYNLTEQQWRIIRVLASSRSIDFHDLACLTCILRPSLTGILTRMERDGLIFRLKPMNDQRKLYVSLTPAGQELYEQARGQVNEGYKAIEDAFSPAKLAQLLALLDEFTSIGNPSQEDIETENE

SEQ ID NO: 8551 - protein, 220 aa, Xenorhabdus bovienii
  Coding DNA sequence: Name=SeqID_2443
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=3..206bp; Hit=11..219bp; Blast score=169; Percent Identity=42.0; E value=3e-42; Homolog= PA4121 COG0179
MKGTVFAVALNHRSQLDFWHEAFDELPYKTPPKTPIWFIKPRNTVIGSGDIIPHPIGETVQSGATLALLIGKTARKVSIQDAEQYIAGYALANEVSLPETSFYRPAIKAKCRDGFCPIGQIITTKSVNSLEIITEINGQEVDRWSTRDLMRSAPELLAALSDFATLNEGDVILLGTPHQRVTLHPNDTVTVKAEGFPALENTVVSEDIVLEGMAQAGGQS

SEQ ID NO: 8552 - protein, 254 aa, Xenorhabdus bovienii
  Coding DNA sequence: Name=SeqID_2444
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=1..249bp; Hit=1..249bp; Blast score=343; Percent Identity=70.0; E value=1e-94; Homolog= PA4122 COG0179
MRQARVRYQNQEMSVIVDEQENVLLSDGCVVSGHDVLWLPPANGTLFALGLNYADHATELEFKPPEEPLIFIKAANSLTGHRQVSVRPDNVEYMHYEAELVVVIGKPTRNVSREQAMDYVAGYTVCNDYAIRDYLENYYRPNLRVKSRDTLTPIGPWIVDKNEIADPHNLILSTWVNGELRQRGTTADLIFDIPFLIAYLSSFMTLQPGDMIATGTPKGLSDVVPGDEVIVSVEGVGRLVNHIVSQQEYKENLS

SEQ ID NO: 8553 - protein, 488 aa, Xenorhabdus bovienii
  Coding DNA sequence: Name=SeqID_2445
  Gene classification: Gene name=PutA; Function=NAD-dependent aldehyde dehydrogenases; Function class=C Energy production and conversion
  Homolog annotation: Query=4..488bp; Hit=2..486bp; Blast score=808; Percent Identity=79.0; E value=0; Homolog= PA4123 COG1012
MTTINHWINGKNVASNTYFETTNPATGEVLAQVASGGQAEIDQAVAAAKEAFPKWANTPMKERARLMRRLGELIDQNVPDIAAMETKDTGLPIHQTQNVLIPRASHNFDFFAEICQQMNGRTYPVDDKMLNYTLIQPVGVCALISPWNVPFMTATWKVAPCLALGNTAVLKMSELSPLTANRLGELALEAGIPAGVLNVVQGYGNTAGDALVKHHDVRAISFTGGTATGRRIMQSAGLKKYSMELGGKSPVLIFEDADIERALDSALFTIFSLNGERCTAGSRIFIQESIYPEFVKRFAERANRLRVGDPQDPNTQVGSLISQSHWEKVSGYIRLGIEEGATLLAGGPDKPADLPEHLKNGNFLRPTVLADVDNRMRVAQEEIFGPVACLLPFKSEEDGLRMANDVEYGLASYIWTQDVSKVLRLARNIEAGMVFVNSQNVRDLRQPFGGVKASGTGREGGEYSLEVFAEVKNVCISMGDHPIPRWGV

SEQ ID NO: 8554 - protein, 296 aa, Xenorhabdus bovienii
  Coding DNA sequence: Name=SeqID_2446
  Gene classification: Function=Uncharacterized ACR; Function class=S Function unknown
  Homolog annotation: Query=1..281bp; Hit=1..281bp; Blast score=469; Percent Identity=76.0; E value=1e-132; Homolog= PM1531 COG3384
MGKLALAAKITHVPSMYLSEMPGKHHGCRQGAIDGHKEISRRCHEMGVDTIIVFDTHWLVNSAYHINCAEHFSGIYTSNELPHFIRDMTYEYNGNPELGRMIAEEARQMGVRAQSHEISSLKLEYGTLVPMRYMNSDRHFKVISISAFCTVHAFEDSRKLGEAVLRAIEKYDGMVAVLASGSMSHSFIDDQRAEEGMNSYTREFDEQMDRRVVQLWKEGQFREFCKMLPEYAQYCRGEGNMHDTVMLLGLLGWDKYNGKVEFLTELFASSGTGQVNAVFPLSDDAVNEQTAEKIRA

SEQ ID NO: 8555 - protein, 129 aa, Xenorhabdus bovienii
  Coding DNA sequence: Name=SeqID_2447
  Gene classification: Gene name=HpaF; Function=5-Carboxymethyl-2 -hydroxymuconate isomerase; Function class=E Amino acid transport and metabolism
  Homolog annotation: Query=1..127bp; Hit=1..127bp; Blast score=162; Percent Identity=62.0; E value=7e-41; Homolog= PA4125 COG3232
MPHFYAECTENIREAARLPALFANVNQALADTGIFPLGGIRSRAIWLDTWQMADGEQDYAFVHMTLKIGAGRSLEDRQQVGEMLFTLIKAHFADLMAQRYLGLSFTMEELDPILNYKSNNVHQLFKSKD

SEQ ID NO: 8556 - protein, 494 aa, Xenorhabdus bovienii
  Coding DNA sequence: Name=SeqID_2448
  Gene classification: Gene name=PutA; Function=NAD-dependent aldehyde dehydrogenases; Function class=C Energy production and conversion
  Homolog annotation: Query=9..489bp; Hit=8..483bp; Blast score=644; Percent Identity=65.0; E value=0; Homolog= PA0265 COG1012
MTNHLETLLLRQQAYINGQWVDAHNKTTFAVTNPANGEVIANVSDMGSAETQQAIEAAQTALPAWRALTAKQRSQKLKQWFQLIMDNQKSLAELLSAEQGKPHAEAMGEIAYGASFIEWFAEEGKRIYGETIPSPMPGRRLATIKQPIGVVAAITPWNFPNAMITRKVSPALAAGCTVVLKPAAETPLSALALAVLAEQAGIPAGVLNIVTGMDAKVIGETLTSSQIVRKLSFTGSTRVGKLLMAQSADTVKKLSLELGGNAPFIIFDDADLDAAVEGAMATKFRNSGQTCVCANRILVQESVYDAFAERLVHAVKQLRVGPAHSDSSQPASQQGPLINQAAVEKIQAHISDAVSNGARILAGGKSHTLGGLFFEPTVLADVDGSMRVSHEETFGPLAPLFKFRDEEEAIRLANDTEFGLAAYFYSRDIGRIYRVAEALESGMVGINEGLISNEVAPFGGIKQSGLGREGSRHGIEDYLEVKYLCFGGLGAKGA

SEQ ID NO: 8557 - protein, 270 aa, Xenorhabdus bovienii
  Coding DNA sequence: Name=SeqID_2449
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=5..270bp; Hit=2..267bp; Blast score=411; Percent Identity=74.0; E value=1e-115; Homolog= PA4127 COG0179
MQQQLQQEVVSQVARRLHQAEKKREQIRQISLDYPEITIEDAYAIQREWVNLKIAEGRVLKGHKIGLTSRAMQVSSQIEEPDYGALLDDMFFQDGSDIPCERFIVPRIEVELAFVLAKPLRGPNCTLFDVYNATDYIIPALELIDARCHNIDPETQRPRKVFDTISDNAANAGVIMGGRPIRPDELDLRWVSALLYRNGVIEESGVAAAVLNHPANGVAWLANKLAPHGVQLEAGQIILGGSFTRPVPARKGDTFHVDYGAMGSISCHFV

SEQ ID NO: 8558 - protein, 268 aa, Xenorhabdus bovienii
  Coding DNA sequence: Name=SeqID_2450
  Gene classification: Function=2,4-dihydroxyhept-2-ene-1,7-dioic acid aldolase; Function class=G Carbohydrate transport and metabolism
  Homolog annotation: Query=4..253bp; Hit=1..250bp; Blast score=316; Percent Identity=63.0; E value=1e-86; Homolog= PM1535 COG3836
VDLLTNRFKQALQAGHPQIGLWLGLCSSYSAEILAGTGFDWLLIDGEHAPNHIPSILTQLQAIAPYPSQPVVRPPWNDPVLIKQLLDIGAQTLLVPMVQNAEQAREAVRATRYPPAGIRGVGSALARASRWNRIPDYLARANDEICVLVQVETREALHNLPEILTVEGVDGVFIGPADLSADMGYSGNPQHPEVKAAIEQAIRQIAASDKAAGILMTHVETAEHYLNLGARFVAVGVDTTLLTTAAHSLAVRFGKKQENVTPPSLSTY

SEQ ID NO: 8559 - protein, 52 aa, Xenorhabdus bovienii
  Coding DNA sequence: Name=SeqID_2451
MASGGLLIVVTFFIIRCVSRFYGNWHENYHCAGRCGDRHLPCRNTDCGVIYQ

SEQ ID NO: 8560 - protein, 455 aa, Xenorhabdus bovienii
  Coding DNA sequence: Name=SeqID_2452
  Gene classification: Gene name=ProP; Function=77 Permeases of the major facilitator superfamily; Function class=G Carbohydrate transport and metabolism
  Homolog annotation: Query=35..419bp; Hit=25..402bp; Blast score=235; Percent Identity=41.0; E value=9e-62; Homolog= PA4126 COG0477
MSSPPEAIQEPENPAYPPQKLTYRQQNVINKLFRRLILFLFVLFVFSFLDRINIGFAGLTMGKDLGLSSTMFGLAATLFYATYVIFGIPSNVMLSIVGARRWIATIMVLWGIASTATMFAIGPTSLYILRMLVGIAEAGFLSGILVYLTYWFPAYYRARANALFMIAMPVTMAFGSLASGYILEMDGIWDLRGWQWLFLLEGFPSVLLGFVVWFYLDDSPEKAKWLTREDKQCLQEMMERDELSQVQSNGPASPKTSLWREVLTPIVLMYTFAYFCLTNTLSAINIWTPQIMQSFNQGSSHVMIGLLTAIPQFCTILGMIYWSRRSDRLQERKMHTALPYLFAAAGWILTSLTNHSMVQLLGIIMASTGSFTAMAVFWTTPDQSISLRARAIGIAVINATGNVGSAVSPLLIGWLKDQTGSFNSGLYFVAGLLIIGALMVSFIPMKQTQRSGDNY

SEQ ID NO: 8561 - protein, 315 aa, Xenorhabdus bovienii
  Coding DNA sequence: Name=SeqID_2453
  Gene classification: Gene name=AraC; Function=AraC-type DNA-binding domain-containing proteins; Function class=K Transcription
  Homolog annotation: Query=11..300bp; Hit=7..299bp; Blast score=233; Percent Identity=43.0; E value=1e-61; Homolog= PA4120 COG2207
MPTSNTSKAIITNIDISKDYDETQGSDDVHYQTFGRMAAFFGRDMQAHRHDGFFQLHYLVTGRIELQLDELRYSVQAPLFILTPPSVPHAFFTQEDTDGYVLTVRQALITPLLNSLYPTHRELVDIPAICLSVADKPDELATFNHYWALIGRESANQFAGREQSLAFLAQSLFTFLLRSILLDDHRSGGVRGELKLFQRFNQLIDQHYHQHLAVPEYAEKLGITESRLKDMCRRFANRPPKKLIFDRLLRESKRLLLFSDSPVFEIAYQLGFKDPAYFTRFFNRLMGCAPSVWRERSVGGGVKNTLLLPSDTSRI

SEQ ID NO: 8562 - protein, 97 aa, Xenorhabdus bovienii
  Coding DNA sequence: Name=SeqID_2454
MNIDFSEKSGMIIFNDFSISDDIPFENQLDELKEDMLQVEFPNGYLLDIGWRPSFEIDGQFKLALIKDFNWENPVYLDSASNVFELKEKLQLAMHKL

SEQ ID NO: 8563 - protein, 87 aa, Xenorhabdus bovienii
  Coding DNA sequence: Name=SeqID_2455
MSWKDIVKSTKSGPAKYTPEINIEALERSVYKTGQPVTNGKPWKVQDMGEIIGASEGKPSQWMRVEYSGGTIHGHPISLNEFRKLTK

SEQ ID NO: 8564 - protein, 577 aa, Xenorhabdus bovienii
  Coding DNA sequence: Name=SeqID_2456
  Gene classification: Gene name=RhsA; Function=Rhs family protein; Function class=M Cell envelope biogenesis, outer membrane
  Homolog annotation: Query=1..577bp; Hit=917..1487bp; Blast score=177; Percent Identity=28.0; E value=4e-44; Homolog= Z0705 COG3209
VTRPDGTILRFGYDRLTRLKSVTASTGETYRYERDVAGQIIRETDFTGRTIDYQYDKLGRRIQAQYPDGQQLRWHYSAAGSLIKQESWQPEENQRVLKDTTTYEYNQRYQLVKATHADATVEYEYDKTTGLPTCERINGREITRKWDNLTGRPVSESVDGNTLHFGYNLSGSLNHFQLNQHVPLTFQHDALGQETVRESANGFILASRYTATGLLTHQSAGQTTPLFRETLAQNDPHFPPQATAVNRSWQYDRAHNVRVIDDSCWGQTRYRYNANDQILNTLFEGARPHEEQFSYDTNGNLSQHLPVDAYGAMAQITQRQKAGRVVQQGDIRYRYDDNGCLVEKTEQRDGFRPQIWRYRWDTQNQLTHCETPDGSRWHYRYDAFGRRIRKLKVHDGKLTAANLQRWLNGKPDLTPRADAIMGQDYLWSGDQLIEETPIYADGTLVEDQRIRWLYEPGSLTPSARVEKGKLHYIVSDHQGTPREMLSEEGVLVWAQRLTTWGKAEKSQVIASNNPDYHVSCNLRFMGQYEDEESGLYYNRFRYYSPETAQYISPDPIGLLGRGNPYGYVHNPTGWIDP

SEQ ID NO: 8565 - protein, 84 aa, Xenorhabdus bovienii; identical to SEQ ID NO: 6530
  Coding DNA sequence: Name=SeqID_2457
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 8566 - protein, 83 aa, Xenorhabdus bovienii; identical to SEQ ID NO: 6529
  Coding DNA sequence: Name=SeqID_2458

SEQ ID NO: 8567 - protein, 91 aa, Xenorhabdus bovienii; identical to SEQ ID NO: 6528
  Coding DNA sequence: Name=SeqID_2459
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 8568 - protein, 474 aa, Xenorhabdus bovienii
  Coding DNA sequence: Name=SeqID_2460
  Gene classification: Gene name=RhsA; Function=Rhs family protein; Function class=M Cell envelope biogenesis, outer membrane
  Homolog annotation: Query=19..468bp; Hit=415..901bp; Blast score=148; Percent Identity=28.0; E value=1e-35; Homolog= Z0705 COG3209
MATGDFLQVWPVIAIPGLLPITLTRTYRSTANLNGLFGPKWADDWSRQLKRVNGKVNFTDADGVIYDFSTPKNQVLARNQHIPHYVLTGELNGELQLTDRQSQLTYHFNHAVGSIRKLSAITDRRQNAIRFIYDKQSQLIEVTRTDGFRLILGYQNQYLRTVDYLDQKKQQRLVTCHYDPQGYLHECDAFQHNHLWHEYDAQGWMIRWHDTDQTDLSLTYDEQGRVLSTTSPRGYWCDHFHYDDQACITTYRDGEGGETQYHYDHNGLVVREVDPLGCIIRRQWRHSQIVWEADRAGGITTFDYNPDGALTEVKLPTGETFAYGYDEHGQLIESVRPTGERWQFHYDEQGNLTALTHPLGHKEEYQYGTHGELRQRLLPDGRQWHYAFDEQQRLAAVVTPDGQTTNLQLDELGHLRQLTDALKQQTHYRYSDAHASLNGSLTEVELPDGTTQQLAYDSERRVVAVTDGGHAPNS

SEQ ID NO: 8569 - protein, 72 aa, Xenorhabdus bovienii
  Coding DNA sequence: Name=SeqID_2461
VPKSKANSRKLPRPHTINPKTLKKTRLITSLPTKTEAATGLVKRKVNLSIWLPVTSCKSGRLLLSPDYCRLP

SEQ ID NO: 8570 - protein, 339 aa, Xenorhabdus bovienii
  Coding DNA sequence: Name=SeqID_2462
MAEKSSTLVVTPTVYAGKEFCEEFNIRTQAEAETALGKVDTLYPQSSKYYGAYGDDPELDEYYNDEDAKFEEQYFKKTAQDAVDKFKSGEFPLKEWEEKEKTKGPEYPQPNSPLPAKARDDSPTGTGNTPGIITAQAGPAQVPATEANPLPQAETPAEKSWRAKAWAAMVEAKDSVVDWAYEKAINHVEGIKHPLERAKGQLKGAYNTVVGTAESYIQGAYFEGAKDSEDTARWLEIYGETEKAKTVREVADIQKKQSGEFNLDDWKATSSNRAQEAGIFDIQVLETIGLPARKIDVIKKGATELASAANKVSTAATKAERKVLTEEAKAVEGAKIEGQ

SEQ ID NO: 8571 - protein, 118 aa, Xenorhabdus bovienii
  Coding DNA sequence: Name=SeqID_2463
  Homolog annotation: Query=1..117bp; Hit=1..117bp; Blast score=95; Percent Identity=43.0; E value=1e-19; Homolog= ref|ZP_00031153.1|
MADNYIARTAGNWMIVGMLPDVCKTPMGPSTPPIPYPVVAKLADSSSPVPSVRANGKPVVVFARSFVPTTIGDQPGVANGVKSGTVGGKCHPQEHTKTVRAGNKLVLRHGDKFWMNGA

SEQ ID NO: 8572 - protein, 405 aa, Xenorhabdus bovienii
  Coding DNA sequence: Name=SeqID_2464
  Homolog annotation: Query=1..368bp; Hit=96..409bp; Blast score=142; Percent Identity=31.0; E value=2e-32; Homolog= ref|ZP_00005220.1|
MEFRNLTPFAVMNYQMLDIEDTEHHVAVMKIGYQLLPTGQGEYSAELLPAPPLCLQDEYRGQMNASQVLQESDLAPFKPRCDVIVNGTAYAPEGKPCTEFPVQLQVQTKQGQILLDKTLTVTGEREFIRDADGNWQLTNPKPFATLPLDYRYAFGGECKIQADDKANEYLKESDRLTPEQRQQHSDGKNAPAAHAVCETNPLGTGFITPWYASAKQLTRYPAPRIIRPDVPFTAQHFTAQLSGTSAPDTPACQPQGMGFIGRPWLPRRQLAGTYDAEWLEHRHPYLPKDFDFRYWNGAPTDQQIDWPETNLSLHLQGMTPGGNLHVTLPGHRPFILLRMHNGMLLPVPMRPDTLILDSDAKTLYLTCRLNFKTDLPVRVAEARFEINPEAPLLKLAPLEEEKKDG

SEQ ID NO: 8573 - protein, 752 aa, Xenorhabdus bovienii
  Coding DNA sequence: Name=SeqID_2465
  Gene classification: Gene name=VgrG; Function=Uncharacterized BCR; Function class=S Function unknown
  Homolog annotation: Query=133..707bp; Hit=15..582bp; Blast score=546; Percent Identity=49.0; E value=1e-155; Homolog= ZvgrE COG3501
MSIKKNINKLKKGHALVQQGQEAVQKAKQVAGKLGGGMSGTAGLIPGGGFTGGIGGHSGSGMSGAAGLIPGGGFTSGIGGRSGSGMSGTAGLIPGGGFTGGKGLAERAAGGQNAATKALEKAAQMLMGGRDPSGLQFTLTAGGLPPQTFVVTDFTLNESFSQPFSLSVGLASADPAIDFPAVLDRTATLTILQNGIEQRSITGIVSRFEQGNTGLHQTTYQMTIRPDLWRTTLRQNSRIFQQQDIATILTTLLKEHNIRDVIFSLRHPHPAREFCVQYQESDFAFLQRLTAEEGIFYFFECSNGRNTLVFADDCGSVPPGIVIPYQPGEVSTGGEPAISSLTCSAQVRPAQVQLKDYTFKNPAWPAEFHQQMRDENLQQLYYEHYDYPGRFKDEAHGKDFTRYRLEALRSDAMMGQGSGNAITLQPGKLFILDNHPRADLNQSWQTVSTSHSGSQPGALETTTGDSGTTLHSHFYFIRQNQNWRPAPLSKPVVDGPQIAKVVGPAGEEIFCDQYGRVRLQFPWDRYGKSNDQSSCWIRVTQPWAGQGWGMLAIPRIGQEVVVDFLHGDPDQPIVTGRTYHASNIPPGALPGSKTQMAFRSKTHKGQGYNELLFEDAKGSERLSLHAQKDMYTKVLNDRDTHVIANHTETVEKNQTIKVNENKEETVTLNSTETVKEVRKLITGQNYIIEVGAHKTETITNTLSITAGDVIELRCGLSVLRMDSAGRITLQGSELKFEASGPVQITGKDIDLN

SEQ ID NO: 8574 - protein, 73 aa, Xenorhabdus bovienii
  Coding DNA sequence: Name=SeqID_2466
MFFFIDMMCLPEMMERYVIGIPPDSDAGHNIWAPDLNLTHLVSDKLVNSGRNTLSFDNLMGLCVRIYRLIRDK

SEQ ID NO: 8575 - protein, 42 aa, Xenorhabdus bovienii
  Coding DNA sequence: Name=SeqID_2467
MIILILRSLSQKRLFLAMRFFIFCLFYLKKIIITNDIFALNI

SEQ ID NO: 8576 - protein, 47 aa, Xenorhabdus bovienii
  Coding DNA sequence: Name=SeqID_2468
MGISSEMRDRLQNHKKPGVSTKHYDRYDYLKEKREIIAPWESKLLSL

SEQ ID NO: 8577 - protein, 34 aa, Xenorhabdus bovienii
  Coding DNA sequence: Name=SeqID_2469
MLLDRKILLSKKVIKYVNAKVDIIAMSKLTIYFP

SEQ ID NO: 8578 - protein, 520 aa, Xenorhabdus bovienii
  Coding DNA sequence: Name=SeqID_2470
  Gene classification: Function=Aromatic ring hydroxylase; Function class=Q Secondary metabolites biosynthesis, transport and catabolism
  Homolog annotation: Query=1..518bp; Hit=1..518bp; Blast score=818; Percent Identity=72.0; E value=0; Homolog= PA4091 COG2368
MRLEDLRADHKRPFTSKEYLKSLQDGREIYIYGERVKDVTTHPAFRNSAASIGQLYDALHEPETHDILCWDTDTGSGGYTHKFFRFATSPDEMRQQRDAIAEWSRQSYGWMGRTPDYKAAFCCALGAYPEFYGQFADNARTWYKRIQESGIYFNHAIVNPPIDRHKPADQVKDVFIQIEKETDAGIIVSGAKVVATNSALTHYNFIGFGSAQVIGDNPDFALMFVAPMDADGVKLISRSSYELVAGAMGSPFDYPLSSRFDENDAILVMDKVLIPWENVLIYRDFDRARNWAVQGGFARLFPMQACVRLAVKLDFITGLLQKSLECTGVVDFRGVQADLGEVVAWRNLFWSLTDAMWAEAKPWEGGAYLPDTQAIQTYRVMAPMAYTKIKNIIENNVTSGLIYLPSSVRDMNNPEINKYLEKYVRGSNGIDHVERIKILKLMWDAIGSEFGGRHELYEINYAGSQDEIRLQCLRHAYGSGNMKKMTELVDRCLSDYNLDGWTKPHLHNNRDINLLDKLLK

SEQ ID NO: 8579 - protein, 172 aa, Xenorhabdus bovienii
  Coding DNA sequence: Name=SeqID_2471
  Gene classification: Function=Conserved protein/domain typically associated with flavoprotein oxygenases, DIM6/NTAB family; Function class=R General function prediction only
  Homolog annotation: Query=1..163bp; Hit=1..163bp; Blast score=210; Percent Identity=62.0; E value=6e-55; Homolog= PA4092 COG1853
MSVENEHRLRFRNAMASLSAAVNIITTDGPAGRCGITATAVCSVTDTPPTLMVCINRNSAMNPVFQENGRLCVNILNHEQELIARHFAGMTGVSMEERFGWNIWKTGALGQPMLKETLANLEGSIEQIQEIGTHYVYLVEVKQMAVKEEGHGLIYFKRDFHHVMDKSLADAV

SEQ ID NO: 8580 - protein, 52 aa, Xenorhabdus bovienii
  Coding DNA sequence: Name=SeqID_2472
MGKVKCSVDEGSRMEPSTSLGKILAGEILDKLPYKIKPHPPGFYPSHDENHV

SEQ ID NO: 8581 - protein, 117 aa, Xenorhabdus bovienii; identical to SEQ ID NO: 7849
  Coding DNA sequence: Name=SeqID_2473
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 8582 - protein, 163 aa, Xenorhabdus bovienii; identical to SEQ ID NO: 7546
  Coding DNA sequence: Name=SeqID_2474
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 8583 - protein, 54 aa, Xenorhabdus bovienii
  Coding DNA sequence: Name=SeqID_2475
MDDINKNSSIKSRRRIQRVYSSYCTVYVQLNKMNLTFVQILLLHCLKNRHTSLI

SEQ ID NO: 8584 - protein, 496 aa, Xenorhabdus bovienii
  Coding DNA sequence: Name=SeqID_2476
  Gene classification: Gene name=PTR2; Function=Dipeptide/tripeptide permease; Function class=E Amino acid transport and metabolism
  Homolog annotation: Query=9..490bp; Hit=1..483bp; Blast score=638; Percent Identity=73.0; E value=0; Homolog= yhiP COG3104
MTTNRGTSMSKTAPVGLWDQPKPFFMIFFVELWERFGFYGVQGILAVYFVQQLGFSEEQSFITFGAFTALVYGLISIGGYVGDHILGTKRTIVLGAIVMAIGYYMIGLSIMKPELIFYALGTVAVGNGLFKANPASLLAKCYRPQDPRLDGAFTLFYMSINLGSLFSLSLAPVIAEKYGYTVTYNICGIGLIIALLVYIACRRMVHNIGSAPDHHPVKPISLIAVLIGSVVMIGVCAWLLHNIKVANIALFAITTIVVLIFFWQAFKQKKVARNKMFVAFILMLQAVVFFILYNQMPMSLNFFAINNVHHQILGFNVNPVSFQALNPFWIIIFSPILAVVYTKLGAKGKDFSMPAKFTFGMFLCSLGFLTAAASGLFADAQGITSPWFIVLVYLFQSIGELMISALGLAMVAAFVPSYLTGFILGMWFLSQAVASMLASHVAVLTATPVGVTDPLQTLPIYMSVFGKIGVATLIVAVIMTFMVPWLNRIMREEVKA

SEQ ID NO: 8585 - protein, 41 aa, Xenorhabdus bovienii
  Coding DNA sequence: Name=SeqID_2477
VVEPYHERRSEGLICRALIEKTLHSIFIQRTSGGRSHPFYD

SEQ ID NO: 8586 - protein, 442 aa, Xenorhabdus bovienii
  Coding DNA sequence: Name=SeqID_2478
  Gene classification: Gene name=UhpC; Function=Sugar phosphate permease; Function class=G Carbohydrate transport and metabolism
  Homolog annotation: Query=19..438bp; Hit=20..439bp; Blast score=534; Percent Identity=64.0; E value=1e-152; Homolog= uhpC COG2271
MTGFSQSKRIPHGNLSDAEIREQYRYWRLHIMLNLYVGYALFYFTRKSFNYAMPAMITDLGLDKSEIGLIGTLFYITYGCSKFFSGIISDRSNPRYFMGIGLIATGIINILFGLSSSIVMFTFLWILNAWFQGWGSPSCAKLLTTWYSRSERGFWWAIWNTSHHVGSALIALIVSFLTLHFSWREGFIVPGCVGILAGILLCWRLRDKPSTMGLPTIGQFRNDLLEKAQENQGKGLTTREILRIYVFRNKYIWLLSFSYVLVYIIRTVINDWGNLYLTEYHHYDLVSANAVLSLFEVGGFMGSLVAGWGSDKLFGGNRGPMNLIFSMGIFLSVAALWLMPVTGLVFQSLGFFAIGFFVFGPQLLIGMAAAECSHKDSAGAATGFVGLFAYTGAAIAGYPFAIILENYHWSGLFMTISVCAVMIGLLLLPFLQAQFPKQRVQR

SEQ ID NO: 8587 - protein, 507 aa, Xenorhabdus bovienii
  Coding DNA sequence: Name=SeqID_2479
  Gene classification: Function=Signal transduction histidine kinase, glucose-6-phosphate specific; Function class=T Signal transduction mechanisms
  Homolog annotation: Query=12..506bp; Hit=24..520bp; Blast score=353; Percent Identity=44.0; E value=2e-97; Homolog= PM1339 COG3851
MRRYLINSFCGWLLFSCCWFCLWVIAYYFVNDPELAILFFPFALRLGIVLHTPKHYWPTIYGAEWWLTICLALLMGQPQWLTVLTASIASLPVVWVASRYYRGSQWQRLAVMAMVITATAIINVVAVSNHNPSLIIVFLVSLTGGVMLVPTCYLVWHYLFQSIWLPLTANVVSRQIQFRLHHVMLYALLFVLNILLQIGFPNELRYFAPFCLAIPIILLAFRYGWQGALLGTLLNSIVLIAARSGVSNMEITDLLLSLLAQTITGIMLGMAVQRQRDLNTQLKRELYRNRSLAGQLVKAEESVRRDIARELHDEIGQNITAIRTQANIIQRVEVTPIGSNCAKTIESLSLNVYDTTKRLLSCLRPKILDDLGLKEAIEQLLRDMEFENCGISVEIHWEANSAEVIEQLSDTTKVTLYRLCQEALNNALKYSQADRIELHFSVREMIRLLIKDNGIGCKAEDNMKGFGLRGMRERVQALGGQFSIHSEKRQNDSTSAGTDLSIILPKL

SEQ ID NO: 8588 - protein, 202 aa, Xenorhabdus bovienii
  Coding DNA sequence: Name=SeqID_2480
  Gene classification: Gene name=CitB; Function=Response regulator containing a CheY-like receiver domain and an HTH DNA-binding domain; Function class=T Signal transduction mechanisms
  Homolog annotation: Query=1..193bp; Hit=1..188bp; Blast score=247; Percent Identity=66.0; E value=5e-66; Homolog= uhpA COG2197
MIKVALVDDHVVVRSGFAQLMSLEPDIEIVGQFSSCAEARNGLPGSGATVCILDISMPDESGLSLLQDLPSGIHCIMLSVHDSVTMVENALKAGARGYLSKRCSPDELLQAVRTTANNGCYLTLDIALKLASSKNSQTSLDYLTNRERQVGEMLARGMDVKVVAAELGLSHKTVHVHRANMMSKLGVTNNVGLVNYFTTSDL

SEQ ID NO: 8589 - protein, 32 aa, Xenorhabdus bovienii
  Coding DNA sequence: Name=SeqID_2481
MSLRNRLNIEIKDKQKTPLRSGSGVSVFLQGY

SEQ ID NO: 8590 - protein, 459 aa, Xenorhabdus bovienii
  Coding DNA sequence: Name=SeqID_2482
  Gene classification: Gene name=UhpC; Function=Sugar phosphate permease; Function class=G Carbohydrate transport and metabolism
  Homolog annotation: Query=1..459bp; Hit=1..459bp; Blast score=682; Percent Identity=79.0; E value=0; Homolog= PM1341 COG2271
MFKILDQIRKPTLDLPVEERRKMWFKPFIQSYLVVFIGYMAMYLVRKNFNIAQNDMISTYGLSMTELGLIGLGFSITYGIGKTVVSYYADSKNTKQFLPFMLILSGLAMIGFSMSMGSSNISVFLMVACYALSGFFQSIGGPASYSTITKWTPRNKRGTYLGLWNMSHNVGGAGAAGVALFGANYLFDGHVVGMFVFPSIIALIIGFIGLRYGSDSPESYGLGKVEELFDEAISEEDIAAEENQMTKREIFVEYVLKNKVIWLLCFANIFLYVVRIGIDQWSTVYAYQELGHSKETAISGFTLFEVGALVGTLMWGYLSDLANGRRALVACVSLGLIIVCLEFYQHATSEFMYLSSLFVLGFLVFGPQLLIGVAAVGFVPKKAISVADGVKGTFAYLIGDSFAKLGLGMIADGVPIFGLTGWKGTFVALDASAFICIGLLAFVVIAEEKKIRKAKKNSQ

SEQ ID NO: 8591 - protein, 37 aa, Xenorhabdus bovienii
  Coding DNA sequence: Name=SeqID_2483
MQEEAKKGDRRKARVFVGIVITQKFKKVEKDWLELQS

SEQ ID NO: 8592 - protein, 84 aa, Xenorhabdus bovienii; identical to SEQ ID NO: 6530
  Coding DNA sequence: Name=SeqID_2484
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 8593 - protein, 83 aa, Xenorhabdus bovienii; identical to SEQ ID NO: 6529
  Coding DNA sequence: Name=SeqID_2485

SEQ ID NO: 8594 - protein, 91 aa, Xenorhabdus bovienii; identical to SEQ ID NO: 6528
  Coding DNA sequence: Name=SeqID_2486
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 8595 - protein, 301 aa, Xenorhabdus bovienii
  Coding DNA sequence: Name=SeqID_2487
  Homolog annotation: Query=4..286bp; Hit=474..762bp; Blast score=362; Percent Identity=67.0; E value=4e-99; Homolog= ref|NP_928298.1|
MTNKVSSSDSLEEYRYDSGGIRMLKIGEQQRVTYLAGLELRTTKNGGNITEDLQMISVGEAGRAQVRVLHWESGKPTDIDNNQLRYNYDNLLGCSQLELDGTGQIITEEEYYPYGGTSVWATRNQTEAHYKTIRYSGKERDATGLYYYGFRYYQPWVGRWLSADPAGTIDGLNLYLMVRNNPIKLLDVKGLAPVHRTEDAAIAKGSFTGLEERFFQKMMKSQPFKRQRAIAAQTEKESHELLTQNPIGKDSQFLKDYTTSSKAINEDIRQGKTGTIVQQGIDRALSPCKVKITKKRSFTAL

SEQ ID NO: 8596 - protein, 145 aa, Xenorhabdus bovienii
  Coding DNA sequence: Name=SeqID_2488
  Homolog annotation: Query=1..134bp; Hit=796..935bp; Blast score=137; Percent Identity=51.0; E value=3e-32; Homolog= gb|AAO17210.1|
MNVGDIVSDRTYLSTSEHRGFLDFKHKEDKGETRYVKMALLSNKGVNIADISQYNNAIEKMAFDRASSKTLTERLKGPPAGQAEILFPRETRFKIHSIKQDGRNVHVLLSDITANNAMNVDIKEMFSGESYKKSCLIIIYEVHKY

SEQ ID NO: 8597 - protein, 30 aa, Xenorhabdus bovienii
  Coding DNA sequence: Name=SeqID_2489
MFYYIYIEKWITLIFRCCFNLIFMYFIYYN

SEQ ID NO: 8598 - protein, 358 aa, Xenorhabdus bovienii
  Coding DNA sequence: Name=SeqID_2490
  Gene classification: Gene name=Fba; Function=Fructose/tagatose bisphosphate aldolase; Function class=G Carbohydrate transport and metabolism
  Homolog annotation: Query=1..358bp; Hit=26..384bp; Blast score=653; Percent Identity=85.0; E value=0; Homolog= Zfba COG0191
MSKIFDFVKPGVITGDDVQKVFAVAKENNFALPAVNCVGTDSINAVLETAAKVRAPVIIQFSNGGAAFVAGKGLKAEGQQAAILGSISGAHHVHQMAEYYGVPVILHTDHCARKLLPWIDGLLDAGEKHYAQTGKPLFSSHMIDLSEESLEENIEICSQYLARMAKIDMTLEIELGCTGGEEDGVDNSHLDSSSLYTQPEDVAYAYEKLNAISPRFTIAASFGNVHGVYKPGNVKLTPKILRNSQDYVSEKFNLPHNSLDFVFHGGSGSTAEEIQEAVSYGVVKMNIDTDTQWATWEGILNYYKKNEGYLQGQLGNPEGADKPNKKFYDPRVWLRAAQVSMIVRLEQAFKELNAVDVL

SEQ ID NO: 8599 - protein, 32 aa, Xenorhabdus bovienii
  Coding DNA sequence: Name=SeqID_2491
MTPGFTKSKILDMLRGPVLTLNRQQMLPVITT

SEQ ID NO: 8600 - protein, 388 aa, Xenorhabdus bovienii
  Coding DNA sequence: Name=SeqID_2492
  Gene classification: Gene name=Pgk; Function=3-phosphoglycerate kinase; Function class=G Carbohydrate transport and metabolism
  Homolog annotation: Query=1..385bp; Hit=1..385bp; Blast score=644; Percent Identity=86.0; E value=0; Homolog= pgk COG0126
MSVIKMTDLDLAGKRVLIRADLNVPVKDGKVTSDARIRASLPTIVSALNQGAKVMVTSHLGRPTEGEYNEEFSLQPVVDYLKEKLSSPVRLEKNYLDGVEVAEGELVVLENVRFNKGEKKDDETLSKQYAALCDVYVMDAFGTAHRAQASTHGVAKFAEIACAGPLLSGELEALGKALRNPARPMVAIVGGSKVSTKLTVLDSLSKIADQLIVGGGIANTFVAAEGHNVGRSLYEDDLIPEAKKLLESCDIPVPTDVRVATEFSETAEATLKSTSEIKDEEQILDLGDASAERLAEILKDAKTILWNGPVGVFEFPNFRKGTEIIARAIAESDAFSIAGGGDTLAAIDLFGIADKISYISTGGGAFLEFVEGKKLPAVVMLEERANSN

SEQ ID NO: 8601 - protein, 339 aa, Xenorhabdus bovienii
  Coding DNA sequence: Name=SeqID_2493
  Gene classification: Gene name=GapA; Function=Glyceraldehyde-3 -phosphate dehydrogenase/erythrose-4-phosphate dehydrogenase; Function class=G Carbohydrate transport and metabolism
  Homolog annotation: Query=1..339bp; Hit=1..339bp; Blast score=535; Percent Identity=76.0; E value=1e-152; Homolog= epd COG0057
MTIRIAINGFGRIGRSILRALYESGRQAEISVIAINELADAEGIAHLLKYDSSHGRFAWDVRLNNSLLQVGDDSIRLFHQPDISALPWKELDIDIVLDCTGKYGERADGEAHIASGAKKVLFSHPGGNDLDATVVYGVNHHELVAEDCIVSNASCTTNCIIPIIKLLDDAFNIESGTVTTIHASMNDQPVIDAYHSDLRRTRAASQSIIPVDTKLSAGITRIFPKFSDRFEAISVRVPTINVTAIDLSVTVSAAVDVRDVNQLLQESAVSSFRGIVDYTDLPLVSTDFNHDPHSAIVDGTQTRVSGNHLIKTLVWCDNEWGFANRMLDTTLVMAATGFK

SEQ ID NO: 8602 - protein, 38 aa, Xenorhabdus bovienii
  Coding DNA sequence: Name=SeqID_2494
MQPLRITEQLLIVRMIHHKINQIVTDKTFYEPKLKRFS

SEQ ID NO: 8603 - protein, 664 aa, Xenorhabdus bovienii
  Coding DNA sequence: Name=SeqID_2495
  Gene classification: Gene name=TktA; Function=Transketolase; Function class=G Carbohydrate transport and metabolism
  Homolog annotation: Query=1..663bp; Hit=1..663bp; Blast score=1109; Percent Identity=80.0; E value=0; Homolog= tktA COG0021
MTTRKTLANAVRFLSMDAVQKAKSGHPGAPMGMADIAEVLWRDYLNHNPVNPNWADRDRFVLSNGHGSMLIYSLLHLTGYDVSIDDLKNFRQLHSKTPGHPEYGYTAGVETTTGPLGQGVANAVGFAIAERTLAAQFNRPGHDIVDHHTYVFMGDGCMMEGISHEVCSLAGTLKLGKLIAFYDDNGISIDGEVEGWFTDDTAARFDAYGWHVIRGVDGHDSDAIKAAIEEAQKETGKPSLLMCKTIIGFGSPNKAGKEECHGSPLGDAEIEATRNALGWEHPAFEVPQDIYAGWDAKAAGKAKETTWEEKFAAYATAHPELAAEFNRRTRGELPASWEAESKAFIENLQQNPASIASRKASQNALEAFGKVLPEFMGGSADLAPSNLTMWSGSKPLNEVQDGNYIHYGVREFGMSAIMNGIALHGGFVPYGATFLMFVEYARNAVRMAALMKIRSIFVYTHDSIGLGEDGPTHQPVEQIASLRVTPNMSTWRPCDQVESAVAWKYAIERQNGPTALIFSRQNLAQQARTAEQLANIEKGAYILKDCAGQPELILIATGSEVELAVKAADQLSAAGRQVRVVSMPSTDAFDKQDAAYREAVLPAAVSARVAIEAGIADYWFKYVGINGAIVGMETFGESAPADLLFKEFGFTVENVVAKATSLLK

SEQ ID NO: 8604 - protein, 74 aa, Xenorhabdus bovienii
  Coding DNA sequence: Name=SeqID_2496
MKLSPICANAPSVVRIDLKICHNNGIKQRIDARGKLRLFPLSGINDCGLYAALRKLVLMYINAFIRLGVKNDHS

SEQ ID NO: 8605 - protein, 181 aa, Xenorhabdus bovienii
  Coding DNA sequence: Name=SeqID_2497
  Gene classification: Gene name=WecD; Function=Histone acetyltransferase HPA2 and related acetyltransferases; Function class=K Transcription
  Homolog annotation: Query=14..179bp; Hit=4..171bp; Blast score=127; Percent Identity=43.0; E value=8e-30; Homolog= PA1885 COG0454
MSKFNLTSDSTSTPAIMRLDSIHTKRDGLINLLHDCVESDASVGFIAPLDVNEAEQYWQNVEADMVSGSRVLLMALEGEEVAGSVQLSFCQKKNGLHRAEVEKLIVHTAYRQRGIGRMLMNELERLAKQYQRRLLVLDTRTGDPASALYRKCGFIEAGQIPQFALNSGGEFAGTTFFYKLI

SEQ ID NO: 8606 - protein, 44 aa, Xenorhabdus bovienii
  Coding DNA sequence: Name=SeqID_2498
MLRLVLSTPFSTRTPCGAVVQLVRIPACHAGGRGFEPRPHRQNI

SEQ ID NO: 8607 - protein, 249 aa, Xenorhabdus bovienii
  Coding DNA sequence: Name=SeqID_2499
  Gene classification: Gene name=DnaQ; Function=DNA polymerase III epsilon subunit and related 3'-5' exonucleases; Function class=L DNA replication, recombination and repair
  Homolog annotation: Query=1..243bp; Hit=1..243bp; Blast score=377; Percent Identity=72.0; E value=1e-105; Homolog= dnaQ COG0847
MSTAITRQIVLDTETTGMNKLGVHYEGHNIIEIGAVEVINRRLTGRHFHLYIKPERLVDPEAFEVHGISDEFLQDKPKFADIADEFIEFIRGAELIIHNATFDIGFMDYEFRKLNRDIPPTADFCTITDSLVLARQLFPGKRNNLNALCDRYQIDNSKRTLHGALLDAEILSDVYLTMTGGQTSLTFSMEGEISGGAQMAEIQKITRPQTGLKVIYASDEELLQHESRLDLVEKKGGSCLWRSKPEQLQ

SEQ ID NO: 8608 - protein, 156 aa, Xenorhabdus bovienii
  Coding DNA sequence: Name=SeqID_2500
  Gene classification: Gene name=RnhA; Function=Ribonuclease HI; Function class=L DNA replication, recombination and repair
  Homolog annotation: Query=1..151bp; Hit=1..151bp; Blast score=240; Percent Identity=76.0; E value=5e-64; Homolog= rnhA COG0328
MSKKVEIFTDGSCLGNPGPGGYGVVLRYQQHEKTLSKGYFRTTNNRMELMAAIAGLESLTCPCNVILTTDSQYVRQGITQWIHNWKKRGWKKADKSPVINVDLWQRLEQAIADHDIDWRWVKGHAGHRENEQCDELARTAANSPTLPDNGYAESEN

SEQ ID NO: 8609 - protein, 34 aa, Xenorhabdus bovienii
  Coding DNA sequence: Name=SeqID_2501
MLPPKRKAMLDELSKDIPKMVRVGFKVLVDELDL

SEQ ID NO: 8610 - protein, 59 aa, Xenorhabdus bovienii
  Coding DNA sequence: Name=SeqID_2502
MSFDSSSSIAFRFGGSIFLSSKIKSPSLSNLTQPSRTDLKRGNRSLTTSYTATKKRDLI

SEQ ID NO: 8611 - protein, 92 aa, Xenorhabdus bovienii
  Coding DNA sequence: Name=SeqID_2503
MLNVCTSRGDVMEKINIYDAKTNLSRIVQEVARTGESVVIAKNGHALVKVVAYREEKPKRKLGFLKGKGRIPDNFDDMNSAEIVDMFEGKDS

SEQ ID NO: 8612 - protein, 133 aa, Xenorhabdus bovienii
  Coding DNA sequence: Name=SeqID_2504
  Gene classification: Function=Uncharacterized BCR; Function class=S Function unknown
  Homolog annotation: Query=1..117bp; Hit=1..117bp; Blast score=72; Percent Identity=39.0; E value=1e-13; Homolog= sll0525 COG3744
MELLLDTNILLFMAYEPEKLKADVIDLLEDTDKTLCFSAASIWEVVIKSNLNKPDFSIDPKQFRDGLFQAGLIEIPIKSEHTLVVCDLPEKLHKDPFDRLIVAQAKYNKIPLITSDSKLIDFVSDYITVIPNR

SEQ ID NO: 8613 - protein, 30 aa, Xenorhabdus bovienii
  Coding DNA sequence: Name=SeqID_2505
MSMGNVTRLLPPRLKRRGFTMHLGKNYWRR

SEQ ID NO: 8614 - protein, 238 aa, Xenorhabdus bovienii
  Coding DNA sequence: Name=SeqID_2506
  Gene classification: Gene name=SmtA; Function=SAM-dependent methyltransferases; Function class=Q Secondary metabolites biosynthesis, transport and catabolism
  Homolog annotation: Query=1..238bp; Hit=7..245bp; Blast score=261; Percent Identity=51.0; E value=7e-70; Homolog= ZyafS COG0500
MQSARSIKQITSPASWAELPWGEYYRVALERQLEPWWPKIFGLHLAKLGNLSAEIDSRACPISHQFNIGLLEGSMDVIADPYCLPFEAKSVDACLLAHMLTYSADPHWLLREVDRIITDDGWVIISGFNPISLLGLRKVLLPIHRRQAYEAQMFSMLRQVDWLSLLNYEIVHHASFHVLPWQSGKSFCNRSTSIFGCMNLVIARKRTIPLTLNPMWATSLKPKFRNVLGAAKDLHRRQ

SEQ ID NO: 8615 - protein, 251 aa, Xenorhabdus bovienii
  Coding DNA sequence: Name=SeqID_2507
  Gene classification: Gene name=GloB; Function=Zn-dependent hydrolases, including glyoxylases; Function class=R General function prediction only
  Homolog annotation: Query=1..251bp; Hit=1..251bp; Blast score=266; Percent Identity=52.0; E value=2e-71; Homolog= gloB COG0491
MELIRIPALSDNYIWLLCDEDKHCVIVDPSESQPVIDILAANQLIPAAILLTHHHHDHVGGVAGLLKQYAELPVYGPEETRSKGATHIVHEHGTIEIGHYCFHIMELPGHTLGHIAFYQAPYLFCGDTLFSGGCGRLFEGTAEQMFSSLEKIISLPDETLICCAHEYTAANMKFARAVLPENKTIHDYYNKIISIRENNKPTVPTTLQIEKKVNVFLNCHNIDLQKNIGIKPNSKPLSSVFQQLRIYKDRF

SEQ ID NO: 8616 - protein, 443 aa, Xenorhabdus bovienii
  Coding DNA sequence: Name=SeqID_2508
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=1..441bp; Hit=1..443bp; Blast score=427; Percent Identity=50.0; E value=1e-119; Homolog= dniR COG0741
MKTKAILFASVLLAGCQSGLQSKTPSQQNTQKMSSTNQQTDGIAEPKDTANWKESPTTQQDLWGHIRDELKMEIPDNNRVREQQNYYLKHKSYLQNVMLRAEPYMYWIVDQLDQRHMPMEVVFLPIVESAFNPHATSYAKAAGLWQIIPSTGHHYGLTQNKWYDARRDVAASTTAALEMLEYLNARFNGDWLLTIAAYNSGEGRVIRAIKDNQAKGRPTDFWSLSLPRETMQYVPKIVALSNIIRHNDKFSLKLPQLNNQQALSKVEVGQQITLSQAAELSGLSLTSIRAYNSGYKQGITSPDGPHYIMLPKRNVKQFKNLLTDEKVLKDIRLAVAQNTRQLLQQSQYTVRSGDTLSAIAKRFKTSHRELQRLNSLKTVDRLKIGQVLKINSSGPVTYQVRKGDSFFSIAKRHGVNLNDLMSWNKSIRIKDIKPGINLTLYPN

SEQ ID NO: 8617 - protein, 186 aa, Xenorhabdus bovienii
  Coding DNA sequence: Name=SeqID_2509
  Homolog annotation: Query=43..169bp; Hit=35..160bp; Blast score=103; Percent Identity=41.0; E value=2e-21; Homolog= ref|NP_845072.1|
LLPLENGSWSLPSDTDNIPNSFTEIEKSFLRPAGFQFSAIPYQEKESHEYNAMRFGINGKTIVFRQAKTTPNKMGQFVTLWKRPTPDSEIMPFEQRDNIDFCMIATHSGNQKGIFLFNTHILIKKGIFSTQDKAGKRAIRIYPSWVSPISKQAIQTQKWQSSYFINLDNQIAAFEQFHKLFSYRDY

SEQ ID NO: 8618 - protein, 100 aa, Xenorhabdus bovienii
  Coding DNA sequence: Name=SeqID_2510
MENSMYQSGYFVTAEIKARDNVDLNIVVKELKSLQEKTLLEPGCEIFSIQQSNENPAIFVMWEKFIDRDALKKHYEYEHTKYYFSLNFTDVVQIFTADTI

SEQ ID NO: 8619 - protein, 48 aa, Xenorhabdus bovienii
  Coding DNA sequence: Name=SeqID_2511
MRDPGSCSPGTSLGLRKGQSVSERLPQQSSYRWCLSAVVACHSSILAF

SEQ ID NO: 8620 - protein, 93 aa, Xenorhabdus bovienii
  Coding DNA sequence: Name=SeqID_2512
MKKIILPLLLSMFLVGCGGEPTFDASNDEAMKASAEKMAKNMSPEEMAKFEKAFLKLSMQSVLVAKDGDDALTLMKEKLNGKTAKQIIEMAEK

SEQ ID NO: 8621 - protein, 44 aa, Xenorhabdus bovienii
  Coding DNA sequence: Name=SeqID_2513
MTITIRWAELFFIKTLAAALHPPFIHINNLSIINQKHNKDCQKI

SEQ ID NO: 8622 - protein, 160 aa, Xenorhabdus bovienii
  Coding DNA sequence: Name=SeqID_2514
  Homolog annotation: Query=2..157bp; Hit=6..162bp; Blast score=90; Percent Identity=35.0; E value=9e-18; Homolog= ref|ZP_00091111.1|
MRILMMLVISMALTGCVTNAQECDPTTGDMSIIAKFNCNYSGTWDQRVVDKEKVLQHEQTLNKEFKAVYDAIEREKKAGQANLESRKRSQAALQKSLNRLFSQLKTKAAGKVKMEKQIAELEKRMREAQQKPSQSEMQKQLELQQLQNQLNELQDSLMIP

SEQ ID NO: 8623 - protein, 235 aa, Xenorhabdus bovienii
  Coding DNA sequence: Name=SeqID_2515
  Homolog annotation: Query=18..234bp; Hit=19..235bp; Blast score=173; Percent Identity=42.0; E value=2e-42; Homolog= ref|ZP_00091110.1|
MVLQSMRSMISLCMIFLLVACQTPQGPSAQTGEVDSRLTQSQDVEFFNKSGWQACAAGAAAGALACLLVNGDHQAICIAAAAIVGCGVGVGANAYLDNQRKKYASEEQLLAASINDVKAENQRIENVTATAKEVIKTDKLTLAQINKDIAAKVVKKDQVQKQLKGLDANIVYLRNTIKEMKEHENQWQSVSTQIAEDGTKTKDLNNQIVQMRKNIGSLQQELDSLYEQRTAIKVS

SEQ ID NO: 8624 - protein, 508 aa, Xenorhabdus bovienii
  Coding DNA sequence: Name=SeqID_2516
  Gene classification: Function=Uncharacterized BCR; Function class=S Function unknown
  Homolog annotation: Query=6..504bp; Hit=9..504bp; Blast score=465; Percent Identity=45.0; E value=1e-131; Homolog= PM1825 COG1262
MTLAGLFLAMLPFSASAVWEEKYYNPKPLPDDVILPMPCEGAMAFRKVSIPLSQPLQDYSITLGGGANDEWGYLEQARAEHIAGSFAEGKSGKGRYFLMAKYELTDLQYQALTGQCPTPNMKLRLPKVNIGWVDAMNFANQYNLWLLQNQPKALPVEDGKPGFLRLPTETEWEFAARGGLAVSTAEFRDQRFPMPEGITSYAWFSGTQSSNGKLQLAGLLKPNPLGLHDMLGNASEMMFEPFHLNKLDRPHGKAGGYIVRGGNFLTPQSDIRSSLRGEEPYYTGQSDNKNKTLGFRLVLVSPTLTSRDRIKEIAEEWKALGTENPQAKEKKSPDSIDNLSSISSQVQDTVLKKQLEQLRADLRANAQLRDEQRDQAIRTSLQLGAFLCTKLKDDGEFYDRLNGLYEKTCKAGSELDANCSRRQSQLDQHKKVLNFIVNYYADTLVDMGVTYNAELIAPQIRVVQQQMSARGKTNLNGYLNTYWKNLQEYWKNGRVARDSWLESCKKNN

SEQ ID NO: 8625 - protein, 416 aa, Xenorhabdus bovienii
  Coding DNA sequence: Name=SeqID_2517
  Gene classification: Function=ABC-type transport systems, involved in lipoprotein release, permease components; Function class=R General function prediction only
  Homolog annotation: Query=20..416bp; Hit=14..410bp; Blast score=345; Percent Identity=48.0; E value=4e-95; Homolog= PM1824 COG0577
MENKVSLQPVNADARPSRLLLPRMALADLIHDRKVALCIIFSLIAVITPLLLLFGLKNGIVSQLRHTLLDDPRTREVRMLGNGNYDHTWLTQLAARPDVGFVIPLTRSLNTQADLVRDNQRFVSNAEIIPTALHDPLLVNAKEPQNEQQVVLSASAAERLQIKTGDSLRLVIARKRNGINEHVQHTLTVIDVVDGAKFARPAAFVTLPLLVAMEDYRDGYQVTLFKVHDGTPTRERTTFAKARLYANSIDSVAELAEWLQQQHIETVTQQAEIESVRAIDHVLGLIFTVIAWISATGCIASLVGAFMANIDRKRKDMAVLRLLGFRRQAVVMFVLIQALLLTGSAWGVGLLLYFVASQLFNNVLGASLPETAFVCHLEPWHLLMALLSVLVVALGVAAVGALRALKIEPAESLREI

SEQ ID NO: 8626 - protein, 231 aa, Xenorhabdus bovienii
  Coding DNA sequence: Name=SeqID_2518
  Gene classification: Gene name=PhnL; Function=ABC-type transport systems, involved in lipoprotein release, ATPase components; Function class=R General function prediction only
  Homolog annotation: Query=1..229bp; Hit=1..232bp; Blast score=211; Percent Identity=51.0; E value=4e-55; Homolog= PM1823 COG1136
MLYIQSMQIQRGQADQGFTVRLPRLSLNAGEVAALTGPSGCGKSTLLEMIGGILQPDSLECYQLGIPPRDITASLLEGEENQLAQVRAKDLGFMLQHGGLLPWLSVEQNIQLPRQIAGLVARSEWLDTAIARLSIAGLMKKMPSQLSIGERQRVAFARAIAHQPQLLLADEPTAALDPHNAETLFSLIVEMVKALNLVAIIVSHDWQRVTDFGLKRYAATVDGKQSVFTTC

SEQ ID NO: 8627 - protein, 663 aa, Xenorhabdus bovienii
  Coding DNA sequence: Name=SeqID_2519
  Gene classification: Gene name=SPS1; Function=Serine/threonine protein kinases; Function class=T Signal transduction mechanisms
  Homolog annotation: Query=17..663bp; Hit=403..1032bp; Blast score =417; Percent Identity=37.0; E value=1e-116; Homolog= PA0074 COG0515
MKHLNCLKAGFAALALMASAGALAAQKPLLQEGKQTLYQRVLTYPGCELSAKVGEKGKVQPAFSRFYVYQRQKQSNEEWLQVGPDSYGNSRGWMKANCSVDWKMQLTLAFTNPSGRNPMLFFRDKTDVEKILNNAKPATQLQPLLNDLKAGKTVPSVLAREPDYMIDQQKNFYLLPVLGSDDIFTDTGYQVRVLNVASVSEAGKTASALSGKNASTSPDKEKNMMKGFSASVVFVIDSTISMGPYIDRTKQAIEKIYQRIEKENLLGQVKFGLVAYRSNVAAVPGLEYDSKMYVDPNTVKDGKDFLAKVRDLKQATVSSSKVNEDAYAGVMTALDKVDWTKFGARYVILVTDAGALEGDDKLSSTQLDATQVRLEATYRGVALYALHLKTPSGHKNHASAENQYRDLTLNAFLHKPLYYPINSGDVNSFGTIVDNLANAITSQIKTAWRGEETVGSALGANESYMGKKSELSKEPLLHDAALLGHAMRLAYLGDKQGTQAPPVFKSWISDRDLVHQNIPATEVKVLLTKSELSDLSEVMKKVVNAANEGLISPDDMFASLRSLAATMGNDPKQAKNKQATKLSEMGLLGEYIEGLPYLSEVLSLDEETWKSWDGLEQERFIRRLNTKLNYYQRYNEDVDRWISLAPDSDPRDNVYPVPLENLP

SEQ ID NO: 8628 - protein, 333 aa, Xenorhabdus bovienii
  Coding DNA sequence: Name=SeqID_2520
  Homolog annotation: Query=1..332bp; Hit=1..337bp; Blast score=166; Percent Identity=34.0; E value=4e-40; Homolog= ref|ZP_00091105.1|
VIKPELRPYEPVEPGYAVLRIEDWQGATEGVKISIQRNQDRCFLNGQGQWVNNEEWLLLPELQEVDGAAEARVGPELVDALLAERQVAYRVTVIDDIQREVGGLKIANGVLSSLAKGEHTPSDNVSEHVPPDQEPPVSMPTETPSVESFVELTVSESHGLPEPQPIPVDERIGAASSASAKKPNKGMLIVLTLLVVAGVLWWLLKPQEKQAPVIASASVTAPCAMENMAKGNGLEFVKSCLRSQPSSLQVQEIISQAKNAGQCDIAQRLYAYKSQSGDKQIALRYAQEYDPKTATKKGCFVADAQTAIYWYEILINQDPQNSEAKARLAALKK

SEQ ID NO: 8629 - protein, 893 aa, Xenorhabdus bovienii
  Coding DNA sequence: Name=SeqID_2521
  Homolog annotation: Query=5..889bp; Hit=66..964bp; Blast score=813; Percent Identity=49.0; E value=0; Homolog= ref|ZP_00091104.1|
MKYFTPEQLKQAWLDVAQGAGQAIEWVEEVRGNAPRLNTEADRLKLKLRRSRNTAQRLAKGATHPMTIGFFGLSQAGKSYLISSLAAGENGRLETQMGPYQLDFIEHINPPGGGKEATGLVTRFSRHARPSNPDWPIELQLFNEAEIAKIFANTFIHDFNQEKIDWNYDEKRINTLLTSLNERRQAHKVPGVAEDDVVALWDYLIRHAAKSQSKMTLQYWPAAVELAPWLSIDDRAQLFGELWGNIHEFTEAYRRFAHTLQRLGGASVVRAPLNVLVTEQNGRLVQTNSIMNVDMLERLNKSNDLQITVCPERENGLAAPVSVSLAELTALTVELHVPLLSSTRERLFEEVDLLDFPGYRGRLGVESLNYLQNAAESDDSNPLAQLILRGKVAYLFERYTLNQEMNVLVVCTPSNEQSNVKDVGGVLDEWIRYSQGADADSRARRPAGLVWAITKLDLRITQELTKSEDMLREVWGQGGMIKIAMTERFGHFPWMQEWHPGRAFNNAFLVRKPCQATPFITMKEGCEAEFSQETASKLTLMKKTFLEDAAIQRHIASPEQAWDAMLQLNDGGMRRLADYLGIVAQREMKLERITEQLNETRHELVEGNLHAWYQPDGAEEVEKKRLISEEILKALQNRAGRHGELLAGLVPQRKALQELYMQEAELDLPTEGKDANESVAAFGIGSDFDLFSDTPDETVSAHSHEQEFAHRVIKLWINYLRTVPEQTSMTDFIGLSRSIVEVLVDELITAIQRMNVEGELMKVLANTEQAGVRREKMMERQVSRVMHIMNDFITWLGYQNVPSEKRPASRINKGQPIFARPDKKDPALWKGDERLYRLTNEQLNYSAMFIFDWLFGFGEIIKENAGHSAGREITAVQNERLGTIIHRIQLSSE

SEQ ID NO: 8630 - protein, 1006 aa, Xenorhabdus bovienii
  Coding DNA sequence: Name=SeqID_2522
  Homolog annotation: Query=6..1004bp; Hit=38..1021bp; Blast score =1011; Percent Identity=54.0; E value=0; Homolog= ref|ZP_00091103.1|
MLATITDFKEKVTLIRDSGIQFLDFAFALPKKKEYGEFLLTEEDNPVIRLVYNERDENFLVPSASGSSAFAADSDYSLVLEKSLEIYNDIWLPLPFFRFNSSRSFAQGPTNWSRVKFHALDTPDEQGNTWRVTLAFDTKVSPDRRNTQYLEPVDDDVRSGVGFALAETHHEMGDFLLLKWVDDWLRETYTERATALWRQYHEDTENCLNRKEHQAHYLNLINALNALLQVPEVQLNDVKLQDNPINVDLVLDIGNSRSCGILIEEHRDGDQGLSNLYQLQLRDLSEPQYIYTDPFDSRLEFAQAEFGKQDFSVKSGRSDAFTWPTIGRVGEEAFRMASQRLGTEGSTGLSSPKRYLWDDAPYSPGWRFSRAFVKSDREPQATAAPMTYMINDKGEALYALKPSERMPVFTPEYSRSTLMTMMLSEVLAQALMQINSPAQRLKMRHASTPRQLKNIILTVPPAMPKPERAIFQKAMTQAIRLVWKALDWEEMDQGVDENGREDKNVSRKRTLPDVHVKWDEATCGQLVYLYNETQNYFGGRSEEFFAATVRPDNKREAGNDRTLKIASIDIGGGTTDLVITRYTLDEGSGSNVRIVPTQLFREGFKVAGDDILLDVIQLYLQPAFEAALLNIGYQDLDAEALMSRLFGSEALEAGKQVLRQQLTLQIFAPVALAILHRYEKFTPEAGEQVISATFNDLLSHQPTDKVCEYVDEEVKRSLPEGIENPFSILNVPLNINLMKLHNEFIDARHNRINICGSLRGLCEVLWHYNCDILLLTGRPSRLPGIQALIRHLQPVPPARILPLHGYETGGWYPFNKKGLIDDPKSTAAVGAMLCLLAEKSRLSNFYFRTANFKPYSTIRYFGMLDSNNLLKDSNVFYRDIDLDTPGFQLDNQQYFESRGEMRLGFRQLDNERWPATPLYTLKIPGTRLATALSGDAVLRLKLEVEEGRGQEAETNGSPEKFRISEMEIVESTQNPRPQDVSFKLNTLVGNGLGETHYWLDSGSIKI

SEQ ID NO: 8631 - protein, 477 aa, Xenorhabdus bovienii
  Coding DNA sequence: Name=SeqID_2523
  Homolog annotation: Query=3..476bp; Hit=3..476bp; Blast score=275; Percent Identity=36.0; E value=1e-72; Homolog= ref|NP_669431.1|
VKKTFLRGDKLESYLPLGENGQAVHLSALQLRETLRLRQLSDVANSLAIPQGNEQGDRIDWYAGFSGNVVPWSAATYDERQSALRQLEAHQAAIERLSAQMIQQKAPEMRLFGALLSKTIQFPDQDHIYLVDGKPVVTFWGFVNAKQQARPNPLECLRTVRSVTQSVASVAPTEPTAETVVATPPPVSERSRRWLLPHWLWWLLPLLLILFALLLLRGCVPDVYIWGMTPSTHSTPPLQGEIISKEGKPVPERSVPALSVNESHSLPLVKGMSSVNGTASVNSTVPVNGAMPIDGASSSVDGTSPVSPEVNPIEPMIPTQPIPPVADGVSNGTPKPSLPEINLPPVQVSPPAEALTIPDIAVRQGTTDFLNGSWHAGAGIQDSRTGKPLSLTYQMADGKGQVEMARGDGIRCQAPVKAAMNSGALQLDNIGEAKCSDGSVYTMPEVVCQSGSQGTAECKGRYDEKTLFPMSMKREAN

SEQ ID NO: 8632 - protein, 458 aa, Xenorhabdus bovienii
  Coding DNA sequence: Name=SeqID_2524
  Gene classification: Function=Protein containing von Willebrand factor (vWF) type A domain; Function class=R General function prediction only
  Homolog annotation: Query=256..444bp; Hit=8..185bp; Blast score=88; Percent Identity=27.0; E value=2e-17; Homolog= mlr6511 COG2304
MIRITRTVAHESAQSEYLLRHYDALHSALVQHLPINFSTLFAKPVKSSDGAIEWYSDLQGQPVPFAQLSAIERDKLQAQIARQLTVLARLREQLSEKEGVDSELLTLLGKISQFPAEEHIWSVDSQPVILWEPMSASASQNIAGSGTASPDLVASQPEQKRKPRWLWWLLLLLFILLLLWLLRGCLPRSHTHIAIKQPNPPVAVKPPQVKPVEQPIKQPIEQPAPTVPEVKPEAVVIPPPVDVRKRCPSQRKRNQAPEVVVVFDASGSMSISVDVTPQELQYLLQRKAFEYIEREPSRITLAKKSAKKIIDKLPSDMNVSLVEAFDCRHVSASLPFSPTQRPALKRAIDRITPDGKTPLALALEKAGALVDGVNRDAIILLISDGDETCGGDPCAVARALKENKPRLQVNVVDIMSSGAGNCIASQTGGKVFTANDANQFNQVINQAMQDYIPENCNE

SEQ ID NO: 8633 - protein, 34 aa, Xenorhabdus bovienii
  Coding DNA sequence: Name=SeqID_2525
MEETVFHVLNHIPIRISDFGCIKRTYTSASGSQA

SEQ ID NO: 8634 - protein, 32 aa, Xenorhabdus bovienii
  Coding DNA sequence: Name=SeqID_2526
LFYRFGYLYVYDVRIACNGELDINKIYSSMAD

SEQ ID NO: 8635 - protein, 310 aa, Xenorhabdus bovienii
  Coding DNA sequence: Name=SeqID_2527
  Homolog annotation: Query=42..310bp; Hit=96..337bp; Blast score=284; Percent Identity=60.0; E value=1e-75; Homolog= ref|NP_929379.1|
MSTQDKKPELKALEEEDEVVIVPTRKYVKDSIQNHAQSRDHPDATLKDKGFVILSNDVGSDSETNAATPKAVKAAYDLANTANKNASNANNNANTRLEKNRNGEDIPDKETFVKNIGLAETVERAKNAVTIDIVYPVGIVLWFAQNKNPNNLFPGTTWKYIGENKTIRLASLNGSDVLSTGGNDSITLSAAQIPAHNHSFSATTDPFDYGTKTTNSAGEHFHDSGWGEAYTDTGKARYGVYDNTNNNYGSGSSDWDNYKYNTSTDGAHQHEVDIGSHTHTISGATSNTGNGEAIDITNTYIMLMGWYRSA

SEQ ID NO: 8636 - protein, 50 aa, Xenorhabdus bovienii
  Coding DNA sequence: Name=SeqID_2528
LGRFFTPLLSPSASNFTSNLPASGHGHLTGCRQVNHTPHHRCNRSTHPLT

SEQ ID NO: 8637 - protein, 125 aa, Xenorhabdus bovienii
  Coding DNA sequence: Name=SeqID_2529
  Homolog annotation: Query=1..91bp; Hit=251..341bp; Blast score=161; Percent Identity=85.0; E value=2e-39; Homolog= ref|NP_287334.1|
MEYQQLSMSNQDAEWLASHRFTIDDIARMFNVSPILLQEYSNSTYSNFSEASRAFLTITMRPWLANFEQQIKSALLMAFPKRGICYRVEFDKVLPDGAIEIKVTHRQNAHMPARLQNRHIKSVDG

SEQ ID NO: 8638 - protein, 52 aa, Xenorhabdus bovienii
  Coding DNA sequence: Name=SeqID_2530
MAKFIIAEFFTDRLGFTCLTAFFIRQCFIMGNFRIQGVGLAAQFVELLASFK

SEQ ID NO: 8639 - protein, 30 aa, Xenorhabdus bovienii
  Coding DNA sequence: Name=SeqID_2531
MELYKRAYSLFPVENSRLVEEISLSNLVRI

SEQ ID NO: 8640 - protein, 54 aa, Xenorhabdus bovienii
  Coding DNA sequence: Name=SeqID_2532
LFFQSREKIIEKRKSFRRISNNEKISEDIRALEKNEEVRIINSYYLKCDLSVDA

SEQ ID NO: 8641 - protein, 53 aa, Xenorhabdus bovienii
  Coding DNA sequence: Name=SeqID_2533
MDFVKTVELIINHGWIGFLLCVFTFLLFVFTIVNIHTTLLYKAFVFSIKRKNY

SEQ ID NO: 8642 - protein, 169 aa, Xenorhabdus bovienii
  Coding DNA sequence: Name=SeqID_2534
  Homolog annotation: Query=11..163bp; Hit=7..152bp; Blast score=101; Percent Identity=36.0; E value=5e-21; Homolog= ref|NP_746990.1|
MYYRDKFGVLLLDKKDNLGYYSQQKIFIENKMTALDVYNQMTQKTPLWLRLSFSIRDKISSLAGLEKIHGFSDENLNKEFHAGSYIDFFKIVRISDDEICLLSKDIHLTVLISLNVFSDDNHKGGCIATVTASVITHNFFGKVYMIPVSLTHGSIVRGMLSKVGQVLKD

SEQ ID NO: 8643 - protein, 63 aa, Xenorhabdus bovienii
  Coding DNA sequence: Name=SeqID_2535
MSYDLSSHQFVSLLYFHISISSFIYNYIDFHGITGYIDIFLFISNSYPTPFYPTYPVAQKYYF

SEQ ID NO: 8644 - protein, 139 aa, Xenorhabdus bovienii
  Coding DNA sequence: Name=SeqID_2536
  Homolog annotation: Query=2..139bp; Hit=252..384bp; Blast score=80; Percent Identity=35.0; E value=3e-15; Homolog= ref|NP_287328.1|
VIKQSFDDWLEDFGIGNREKYQVVTRARDFIQKYGLSRFQPYSYGKLNGNIDTANAMKINNFAGYLVHNRRSDGQVEYHIIPSVFEEEILQGLQKKSGFEALEKAGMLIKMEKDRFISKTISVNGTQGRFVVLIFKDED

SEQ ID NO: 8645 - protein, 68 aa, Xenorhabdus bovienii
  Coding DNA sequence: Name=SeqID_2537
VGIPQSISGSIIIFILSLILAVIFLLLGKYAFSTAYYANIVPAVLALWGLKRLILPNDCIYLKNNIIT

SEQ ID NO: 8646 - protein, 150 aa, Xenorhabdus bovienii
  Coding DNA sequence: Name=SeqID_2538
  Homolog annotation: Query=3..150bp; Hit=250..397bp; Blast score=218; Percent Identity=72.0; E value=3e-56; Homolog= emb|CAC83041.1|
MVRKSQVKDGRSAAMEPWLIFTSMDDFKPRQVMKIYSRRMQIEQNFRDEKSERFGFGLRASYSHGTGRLSVLSLLATLSSVVLWLIGFYAENKGIHLNYQANSIKSRRVISHLTLAENVLRHSPLILFEIVLNNTLKYLAKIYQNMVLIY

SEQ ID NO: 8647 - protein, 71 aa, Xenorhabdus bovienii
  Coding DNA sequence: Name=SeqID_2539
  Homolog annotation: Query=1..71bp; Hit=122..192bp; Blast score=108; Percent Identity=74.0; E value=3e-23; Homolog= emb|CAC83041.1|
LLSQIVPSCEQQNVTIQNAFLDMLASAVNPKARVIIVTDAGFQNAGFKQIKTLGWDFVGRIRGNTQLRLEK

SEQ ID NO: 8648 - protein, 112 aa, Xenorhabdus bovienii
  Coding DNA sequence: Name=SeqID_2540
  Homolog annotation: Query=1..112bp; Hit=11..122bp; Blast score=199; Percent Identity=83.0; E value=9e-51; Homolog= ref|NP_085189.1|
MPVREICHNFFKDALSPFHKYRQNALIDATIALINGASLTLTSIGRFLPGNAHVKHKIKRIDRLLGNEALHRDIPDIFRNIIAMLTESLSLCVIAVDWSGYPSQEHHVLRAS

SEQ ID NO: 8649 - protein, 53 aa, Xenorhabdus bovienii
  Coding DNA sequence: Name=SeqID_2541
MTYFTYRHSSDLIDLVEQSVDHTTLCLSIFWGFLSAQCEVFYYLNNRRIYGLD

SEQ ID NO: 8650 - protein, 46 aa, Xenorhabdus bovienii
  Coding DNA sequence: Name=SeqID_2542
MDWIKTSDRLPNDDGYYLVYETFNNKVGDDYFFHNGSGDHWKLFHE

SEQ ID NO: 8651 - protein, 82 aa, Xenorhabdus bovienii
  Coding DNA sequence: Name=SeqID_2543
MFILPNMPCFPDTSDITNIIESELNELKKSLTRDNYPKLEIGYTVILLNGDVGVVEDIFHDGTYDCRMERTEKLHMLPPTGM

SEQ ID NO: 8652 - protein, 260 aa, Xenorhabdus bovienii
  Coding DNA sequence: Name=SeqID_2544
  Gene classification: Gene name=XerC; Function=Integrase; Function class=L DNA replication, recombination and repair
  Homolog annotation: Query=20..253bp; Hit=145..378bp; Blast score=369; Percent Identity=77.0; E value=1e-102; Homolog= intD COG0582
LPNGKNRKVTHVATYRYVATKAKHLALMKSLLRAAERDWKWLEKAPVIKVPAVRDKRVRWLEPCEAQRLVDECPEPLQSIVKFALATGLRRSNIINLEWSQIDMQRQVAWIHPDQSKSARAIGVALNETACRVLRAQIGNHNKWVFVHTKPSTNPDGIVMPNIRKMRVDDNTAWNSALKRAGIEDFRFHDLRHTWASWLVQSDVPLSILQEMGGWESIEMVRRYAHLAPNHLTEHARQIDELFGNLVPNPSQSGKIVVAK

SEQ ID NO: 8653 - protein, 269 aa, Xenorhabdus bovienii
  Coding DNA sequence: Name=SeqID_2545
LEKYFQSYIVKLTKLQIKNFRSLKDLQVDLEEYISIIVGKNNSGKTSLLLALERFLGSTNPHFELDDFNIDFQKDLVKLIESEIFPTEPCLNMSLRLFIKYEEDDDLANVGNKIIMDLDPANNWIVLDFLYQLSPENLNFLKRDYIAHSKKKGAKAQSTLDFLRENHSFYFKLARRSIQFDHVSQAAQEDDYVDLIKEGIRFENIISFKRINARRSVSNKDSDRSLSTMSAKIYSAILNNADEENVFDDFKEALNNTDGQLDSIYIRRH

SEQ ID NO: 8654 - protein, 349 aa, Xenorhabdus bovienii
  Coding DNA sequence: Name=SeqID_2546
  Gene classification: Function=Predicted transposase; Function class=L DNA replication, recombination and repair
  Homolog annotation: Query=183..336bp; Hit=34..184bp; Blast score=70; Percent Identity=29.0; E value=2e-12; Homolog= BH2520 COG3335
MIALMKINLTDAQKEALELMHDTTRDGRVRDRIKAVLLASEGWTAQMIAQALRIHESTVSRHLKDYFSEEKLAPENGGSESRLSAEQTTALVEYLMANLMHTTAQIVAYVRARWQVTFTVAGMTKWLHRQGFSYKKPMGAPHKFDADKQQQFIETYNALKEECGQNTPILFIDAVHPTLSTKLSYGWMKSGRKHVKVVETTGSRTRLNIMGALNLQRIEETIVREYPTINAKNVVLFFGSIRETYPLSQKIHIILDGAGYHRSAVVQFFAEVLNIELHYLPPYSPNLNPIERLWKYVNEQVRNNVYFPDTKTFRETLRHFFHVTLPEKAKELTTRLTDNFQILKPASSS

SEQ ID NO: 8655 - protein, 443 aa, Xenorhabdus bovienii
  Coding DNA sequence: Name=SeqID_2547
  Gene classification: Function=Predicted ATP-dependent endonuclease of the OLD family; Function class=L DNA replication, recombination and repair
  Homolog annotation: Query=3..372bp; Hit=306..659bp; Blast score=134; Percent Identity=29.0; E value=2e-31; Homolog= PA1939 COG3593
MYGQGEEAYALPENFNGLGYLNLISIIFDIKIILNEFKRNKSPKPADINLLFIEEPEAHTHPQMQATFIKNIKNLIGRDIVNTNGITRPLQTIISTHSAHIVTESDFEDIRYFKRGSGGTYSKNLKDLETHYNNAGHNEHYKFLKQYLTIHRSQLFFADKAILVEGETERILLPAMMRKKDQSDEAEAWETGIQSPVPLLSQNISVVEVGAHSQIFEIFLDFIGIKTLIITDIDSAVEENRTAEDGQSKTNKEGHPIKDLCAHEVMGATHTTNKALQFFFNVGPELNYFLELKSEEKRVHKNKATNQWGNNPAGQIMCAYQISEANADSTAYHARSFEDAFLHVNRQFMGNACDGNGDIDKTKFPSLVKKHLIQYLNGDSPFEMAENGITKKPSFAIEILLNSQSTTVTKKNSAGDLKVFYLEFNNWQTPQYIDEGLTWLKKE

SEQ ID NO: 8656 - protein, 632 aa, Xenorhabdus bovienii
  Coding DNA sequence: Name=SeqID_2548
  Gene classification: Gene name=UvrD; Function=Superfamily I DNA and RNA helicases; Function class=L DNA replication, recombination and repair
  Homolog annotation: Query=24..212bp; Hit=16..247bp; Blast score=64; Percent Identity=25.0; E value=4e-10; Homolog= mlr8166 COG0210
MAQKGMKLEPEVVDILKHITEGKNFLLSGGAGSGKTYSLVQVIGELLRIDPCSFIACITYTNAAVKEIESRISSKRLSVSTIHDFLWNAIKPYQKELRNVLIKLMNGEDPRIKPSNTIVSEDMFDRKSIEYKEFRILEQGIISHDEVIILARSIFEKYPKIRDILRDKFRYILVDEYQDTSPDVINILLDFLPLSSRKGVCGFFGDSMQSIYDEGVGTIQNYINNGIVKEVRKEQNRRNPKLVYELANKLRDDSLIQHASDDQNAPNMNNGIIKKGTICFYYSSGEIDKLDSVRNHLNWNFDDVLETKELNLTHNLIAPQAGFGDLMEIYDKDGVLDFRDRIVKFVQKHGDFNKYNELTFGEVIEEVQRGKTDKELNAVSPTPQMQKFIDTHPDLLNEAKKNNFHLLRHMYVNKDQLIDDNKLSENDIRRKGSQRCNFIKHIFKIQTVIHLYEQRRYNDFLRKTEFQLKRVNDKVRLKECIETICSMKNCPIIDVINFAHEHKICIKDDQFHNFSQKKEYLFNRLINVKYASFQKLYEYLEGRTAFSTQHKIKGREFDRVLVVLDSGGWNKYNFNHFFEKIGTEPVRLRTQKLFYVCCTRAKESLAVYFRDPSDATLTQARDWFGAENVIKI

SEQ ID NO: 8657 - protein, 93 aa, Xenorhabdus bovienii
  Coding DNA sequence: Name=SeqID_2549
  Gene classification: Gene name=Nlp; Function=Predicted transcriptional regulator; Function class=K Transcription
  Homolog annotation: Query=13..86bp; Hit=7..81bp; Blast score=90; Percent Identity=66.0; E value=2e-19; Homolog= sfsB COG3423
MEGVAGMNNVRNDWHQADIIAALRKRGTTLAAVSREAGLSSSTLANTLIRPWPKGEWIIANYLGIHPSEIWPSRYIDMDGQLIERTARKVSTE

SEQ ID NO: 8658 - protein, 72 aa, Xenorhabdus bovienii
  Coding DNA sequence: Name=SeqID_2550
LNLVVRLLSQIIQSVKVIVPLAKSNGQGVAALRSRALVNNLFASVPAIVPQWRFRQGRLCLAGSERRSANPV

SEQ ID NO: 8659 - protein, 62 aa, Xenorhabdus bovienii
  Coding DNA sequence: Name=SeqID_2551
MTKIKTLSLAQVMQKTRLSKLWIYQLMQQGNFPQPVRKKIGVDVWQEKAITDWLAIDESNTE

SEQ ID NO: 8660 - protein, 352 aa, Xenorhabdus bovienii
  Coding DNA sequence: Name=SeqID_2552
  Homolog annotation: Query=60..348bp; Hit=4..292bp; Blast score=361; Percent Identity=65.0; E value=1e-98; Homolog= ref|NP_404706.1|
MTCLCRRQYSVLNRYPAIPQPAFTLAHRYPSRTKQASPVLSALSRARDGMLSGISREKQMSRLIKELKFFARQGGGSHKTCHDRIRIAGRLGALLLSLNIQVKSLSHLKAKHVEHYVDARLSQGVTKRTAQNEMSALRNIFRMAGRDKLETSPRLSNQALGLSGASRAGTKQAIPDVMFQAVYQKALERDAGFAVTLKLARLMGLRSQEAVQCSASLKSWRKQLEQPEPKLHVVFGTKGGRPRQTRVLDVAVVKEAVEQAIAIAEQRGGRLIDKPDLRQAMNYWRTHTTRIGLKGCHSPHSLRYAWAQDALNFYQQNGFSRQEARALVSMDLGHGDGRGRYVERVYSQGKGE

SEQ ID NO: 8661 - protein, 52 aa, Xenorhabdus bovienii
  Coding DNA sequence: Name=SeqID_2553
MLFQSIKCSVRFTALLNRHEPVIVMLSFCCGVTFSDKSAKSDALSTAYGQQK

SEQ ID NO: 8662 - protein, 37 aa, Xenorhabdus bovienii
  Coding DNA sequence: Name=SeqID_2554
VIPSASRIVGLSYILISFHFNEQDCFRASSSCLAMPA

SEQ ID NO: 8663 - protein, 36 aa, Xenorhabdus bovienii
  Coding DNA sequence: Name=SeqID_2555
MRLRCNSIPLCERLMGSPDANVKSKRARVSAHLKLR

SEQ ID NO: 8664 - protein, 43 aa, Xenorhabdus bovienii
  Coding DNA sequence: Name=SeqID_2556
LFILAISASKGAQTYRNSYSPFQATGVFLVARKRFLSDLWKHW

SEQ ID NO: 8665 - protein, 31 aa, Xenorhabdus bovienii
  Coding DNA sequence: Name=SeqID_2557
MDNFANIRKNVKIIIFFVKTKYNYKIISTPN

SEQ ID NO: 8666 - protein, 332 aa, Xenorhabdus bovienii
  Coding DNA sequence: Name=SeqID_2558
EIDKFVYYQCEDGGAELFFIESDEVVFSEWNYHLFPEDPHYHQECNWKPILSDRFDNINLYDEQVFGYLLFTINSATTINEINNNNLIRDFVKSYSFFQFSKINEFQFLSKRDKNKLRNFFFHFFLYAHPVNYETLHAFSIKNDEIFHIKSGVSVRKYFEEYYDFFVNNYEQYKNKIPITIDELRSCKKLTVSLLDNIEGKCNGFEVHCEDRGSRIIDSVNNFASLINVYHEDKDKFYDEFKKIVLECNRKSILLDFFLQDYVCYVLYFDMDEINNFVECFSRNEALCKGLINKLFSIPVFIKEILDNQKKDLFSYGRVTCFFDEKIINIYS

SEQ ID NO: 8667 - protein, 197 aa, Xenorhabdus bovienii
  Coding DNA sequence: Name=SeqID_2559
  Gene classification: Function=Transposase; Function class=L DNA replication, recombination and repair
  Homolog annotation: Query=19..190bp; Hit=17..184bp; Blast score=67; Percent Identity=31.0; E value=1e-11; Homolog= NMA1185 COG3547
DLGGGGGGGGGGGGVYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELAELEALIAEHINQHPNLKKDF

SEQ ID NO: 8668 - protein, 125 aa, Xenorhabdus bovienii
  Coding DNA sequence: Name=SeqID_2560
  Gene classification: Function=Transposase; Function class=L DNA replication, recombination and repair
  Homolog annotation: Query=24..122bp; Hit=189..283bp; Blast score=58; Percent Identity=39.0; E value=1e-09; Homolog= NMB1750 COG3547
MHHMKNELAELEALIAEHINQHPNLKKDFELLTSIKGDGTQIGLNMLIILRTNTFTRATQVAAYLGVIPIAKQSGTSEHGRVRLSITLTAKIRAKMFMSALTAARFNPHINDLYNRLRNKGKARM

SEQ ID NO: 8669 - protein, 65 aa, Xenorhabdus bovienii
  Coding DNA sequence: Name=SeqID_2561
  Homolog annotation: Query=1..60bp; Hit=88..147bp; Blast score=84; Percent Identity=65.0; E value=4e-16; Homolog= gb|AAL66868.1|
VRDFAKGMGILTKTDEVDAYILACYSALKQPDVWQPPPIEIRELKALLCRRDALLEDIQRERRPI

SEQ ID NO: 8670 - protein, 31 aa, Xenorhabdus bovienii
  Coding DNA sequence: Name=SeqID_2562
LTPGPFQGYPVRMQRCFCLETAGGETVCPVV

SEQ ID NO: 8671 - protein, 45 aa, Xenorhabdus bovienii
  Coding DNA sequence: Name=SeqID_2563
VSSGVRFERLTSPVIDSTDCFKFSACSRLLKSKNFTTHGRVPHGF

SEQ ID NO: 8672 - protein, 44 aa, Xenorhabdus bovienii
  Coding DNA sequence: Name=SeqID_2564
MNSGQDSATDCTGFPHSGIVGYNASYQLTDAYRRLARPSSPLTA

SEQ ID NO: 8673 - protein, 31 aa, Xenorhabdus bovienii
  Coding DNA sequence: Name=SeqID_2565
MKDSSLFGIENRICLAAIARWSHLIPCRTQQ

SEQ ID NO: 8674 - protein, 42 aa, Xenorhabdus bovienii
  Coding DNA sequence: Name=SeqID_2566
LSGGHSAVVPPDPMPNSAVKRRSADGSVGSPHVRVGHCQTPI

SEQ ID NO: 8675 - protein, 117 aa, Xenorhabdus bovienii
  Coding DNA sequence: Name=SeqID_2567
  Homolog annotation: Query=9..114bp; Hit=7..110bp; Blast score=113; Percent Identity=50.0; E value=6e-25; Homolog= ref|NP_754992.1|
MIKPVINIIKNVLVIFPLLFTTACSNMYQANDIWTGKDKAQHFLFSAAMAAAGNAYGERQNWTHRESAQFGLLLSISFGAAKEFYDSRPPGTGWSWQDFVYDVAGAMAGYSLYQSLK

SEQ ID NO: 8676 - protein, 40 aa, Xenorhabdus bovienii
  Coding DNA sequence: Name=SeqID_2568
MTGFIIVIYAMMYISVNHSLLINKIQKIPSSDSEKGLMNR

SEQ ID NO: 8677 - protein, 451 aa, Xenorhabdus bovienii
  Coding DNA sequence: Name=SeqID_2569
  Gene classification: Gene name=Cls; Function =Phosphatidylserine/phosphatidylglycerophosphate/c ardiolipin synthases and related enzymes; Function class=I Lipid metabolism
  Homolog annotation: Query=1..431bp; Hit=2..432bp; Blast score=587; Percent Identity=66.0; E value=1e-168; Homolog= pssA COG1502
MLSKFKRAKHQQHLAQLPKLPQSVADIKTLYQSKVFRSTLLEHIANAEKYIYIAALYLENDDAGRDIMNALYVAKQKRPELDIKILVDWHRAQRGRIGVEAAATNADWYCSMAESYPDANISVLGVPVNTREALGVLHLKGFIFDDTVIYSGASINDVYLHRHEKYRYDRYHLLHNAKLAAIMKQFIDDNILTAGAVKNLASHSRPRSLEIKNLIRQFRASLRSVEYSIENQASNEELAVTPLVGLGKKNLLNKTICHLISSTENKLVICTPYFNLPAVLVRAISRLLRQGKQVEIIIGDKTANDFYIPPEEPFRIIGALPYLYEINLRRFTSRLQYFIDSQQLTIRLWKDADNTYHLKGIWVDNKWQLITGNNLNPRAWGLDLENAILIHDPYQEMQEQRTLELDCIRTHTKIINDYQELESIQLYPVKVRKLIRRLRRIRVDRLISRIL

SEQ ID NO: 8678 - protein, 31 aa, Xenorhabdus bovienii
  Coding DNA sequence: Name=SeqID_2570
VLLVFCSFKFRQHHSAFFLLVWMVGVPSSGV

SEQ ID NO: 8679 - protein, 880 aa, Xenorhabdus bovienii
  Coding DNA sequence: Name=SeqID_2571
  Gene classification: Function=Acyl-CoA synthetase (NDP forming); Function class=C Energy production and conversion
  Homolog annotation: Query=1..709bp; Hit=1..709bp; Blast score=967; Percent Identity=68.0; E value=0; Homolog= yfiQ_1 COG1042
MSQRGLEALLHPKSIAVIGASEKPEKASSMLMRNLLMGHFTGPILPVTPNKTAILGVLAYPSIDKLPLTPDLAVICTHHSRNLSLLEQLAQRGCKTVIILSSPPSQFAELKQFSQKHHIRMLGPNSLGILAPWIGLNASFSPIPILKGKLAFISQSAAISNTILDWANHRNIGFSYFIALGDSVDIDIDDLLDFLARDSKTSAILLHLEHISDARRFLSASRSASRNKPILVVKSSRTRKAQELLGEQQNFDAAYDAAIQRAGLLRVQDTHEMFSAVETLSFMRPLRGERLLIVSNGSAPAAMALDELLRRTGKLAVLGDETSNKLSAILPDTLILRNPLDLGDDSSSEQYIAALKLLLDSHDYDALLLIHSPCAISHSMNTAIKVIQIIKEHPRGKWLTIFTNWCGEYSSLEARRLFSEAGIPTYRTPEGAITAFMHMVEYQRNQKQLKETPAMPIGITSNTARAHECIQQALNSGNTLLDTHEVQPILEAYGLNTLPTWIAYTSDDAVNIAEKIGYPVALKLRSPDISHKSEVQGVMLYLRNSDEVKTSAQAIIDRVKQNFPQARIHGLLVQSMANRAGAQELRVAIEQDEIFGPLIMLGEGGIDWINETQTAVALPPLNMALARYLVIQAIKGGKIKSGGSLLPLDIPALSQLLVRVSNLLIDCPQISRMNIHPLLASGSEFTLLDVAMELTPVTGDPHNKLAIRPYPNELEETIYLKKDFECLLRPILPEDEPLLKTFISQVTKEDLYYRYFSEISEFTHDDLANMTQIDYDREMAFVAIRHAATTPEIIGVARAMADPDNIEAEFAVLIRSDLKGITLGYQLMTKLIHYTRGHGIQMLTAITMPENRNMIQLAKKLGFTIDIQLEDGVVNLVLRL

SEQ ID NO: 8680 - protein, 33 aa, Xenorhabdus bovienii
  Coding DNA sequence: Name=SeqID_2572
LGVIMLPVRADSFLGFLISYHINKQSPLIKQLL

SEQ ID NO: 8681 - protein, 235 aa, Xenorhabdus bovienii
  Coding DNA sequence: Name=SeqID_2573
  Gene classification: Function=Uncharacterized ACR; Function class=S Function unknown
  Homolog annotation: Query=1..219bp; Hit=8..225bp; Blast score=249; Percent Identity=59.0; E value=2e-66; Homolog= yfiP COG3148
MRNNNTVYQLRQQRLARSTRPFQARGCRVQRCLHCLLPQKSCLCETISPVNATSRFCLIMFDTEPMKPSNTGKLIADILPDTHAFLWSRTEPDQRMLEALRDPTRQPYLIFPESYATPPRTVYQQLPDNQKAPLFIILDGTWPEARKMFRKSPYLDDIPLLSINNCAKMDYLLRIPSRKEQHCTAEVAAAALELANDLEASQTLLSHFNHFREQYLAGKPHRQEESITVILDNPR

SEQ ID NO: 8682 - protein, 41 aa, Xenorhabdus bovienii
  Coding DNA sequence: Name=SeqID_2574
MARRLPDVRARSYLWQRQSIKIPANFLSALFTNMFEFLNEK

SEQ ID NO: 8683 - protein, 340 aa, Xenorhabdus bovienii
  Coding DNA sequence: Name=SeqID_2575
  Gene classification: Gene name=SpoU; Function=rRNA methylases; Function class=J Translation, ribosomal structure and biogenesis
  Homolog annotation: Query=1..340bp; Hit=1..345bp; Blast score=425; Percent Identity=64.0; E value=1e-119; Homolog= yfiF COG0566
MNDSYSGKNGKVKVMYVRSEGNNDRRSNNDSRNNNKRPSSGQGRDQGGRRRDNERPAYSGDRSPWKTVSRPVEESLTPDHGGISGKSQIDPEQLRRQRLEETRIYGENACQAMFQNRPEAIVRAWFVQSVTPRFRDALKWMAANRKAYHVVDDEELVKASGTEHHGGVCFLIKKRNGLDVETYLQQAPAKDCVLALENVGNPHNLGAIMRSCAHFGVQGVILQDVAMLESGAAVRTAEGGAEHIKGIDADGFTTTLNQFRCAGYTIVTTSSHKGSTTLAKADLPEKMVLVLGQESDGLSDSTWEDGDIRLSIGGTGRVESLNVSVATGIMLAEWWRQNKA

SEQ ID NO: 8684 - protein, 38 aa, Xenorhabdus bovienii
  Coding DNA sequence: Name=SeqID_2576
MTDRVDTPIYKLWILLSSSGGVNSSSLKLRSFYFFLHG

SEQ ID NO: 8685 - protein, 33 aa, Xenorhabdus bovienii
  Coding DNA sequence: Name=SeqID_2577
MRGLRTQFSVQRTHLIKPFIHIQHHPVSMHKHD

SEQ ID NO: 8686 - protein, 606 aa, Xenorhabdus bovienii
  Coding DNA sequence: Name=SeqID_2578
  Homolog annotation: Query=1..600bp; Hit=1..599bp; Blast score=943; Percent Identity=79.0; E value=0; Homolog= ref|NP_931783.1|
MSPLYTKLSPQTSHLTRESWLHANRHLIAKILRELLHEKLIFPVNQSTDKSYSIKIDQFQYHFKAQSYQLDHLDIDVASITKFSHNQPQPLDAIQLIIELHPLLDISEKMLPIYLDEISSTLYGYAFKYQNNRLTAQNLAQADYQAVETAMTEGHPVFIANNGRIGFDADDYLHYAPESANPVTLIWIAVHRNKTVFSALSSLSYSQLVAEELEKYLPARFEQHMQTLGLNLSDYYLMPVHPWQWLHRIAISFAADIANQEIVYLGEGHDRYLAQQSIRTFFNISQPKKNYVKTALSVLNMGFMRGLDPHSMVTTPQINEWLNHLVESDVFFQEKGFTILRERAAIGYFNHYFEAAIKKDNPHKKMLSALWRESPMTILKETQRLMTMASLLHVDREGDAVVAALVKDSGLSAEAWVTRYLDAYFSPLLHSFFTYDLVFMPHGENLMLVLENNVPVKMLMKDIGEEIAILNGDIQLPEEIDFLHVTIKDEMKINYIFLDIFDCFFRYLTPLLQKHLALPEARFWELVAQCVYNYQSQHLNQIEKFRKFDLFKHDFVRTCLNRLQMANNQQMIDLDDREKNLKFAGTLVNPLHALREKYAVTVETDN

SEQ ID NO: 8687 - protein, 770 aa, Xenorhabdus bovienii
  Coding DNA sequence: Name=SeqID_2579
  Gene classification: Gene name=CirA; Function=Outer membrane receptor proteins, mostly Fe transport; Function class=P Inorganic ion transport and metabolism
  Homolog annotation: Query=22..770bp; Hit=2..729bp; Blast score=444; Percent Identity=36.0; E value=1e-124; Homolog= fhuE COG1629
LRQITDGYVKVKIITNQFGNGISRVINPILQPNHLTKKKVLSLMIPLILAGNSTAMAEETQSKNDKIIVTAGAPGHEGVTEDTGMYNTSSMVTATGLNMSARETPQSVSVMTKQRMVDENLSSVESAIGSITGMTVRQADSDRFTFTSRGMTVKDMLRDGVPTFYDIRFNYGDNLMDTTIFDRLEVVRGAAGLMVGPGTPSAAVNVIRKRPTQDFRGEMTLGGGSWDKWRTGLDLSGPLNEDGTVRGRFVTAYQRSNSFIDRDKHEKYPFYGILEADLTENTLLTVGADYQINHTRGGMFGGLPIYFKDGSKTDYKRSDSYAPDWAFSKVRSFSTFTSLQHQFDNGWSVKGTFTYDHGTLDQKVLWATGFPDRVTNEGMYPGNMTLIDGTRRQRNFDLQVNGDYRLLGRTHHASFGLNYQKQNFQNDYYYATCMREGNSNKEDQDKTGKRNNCNYLGDFTQSSWGYAEPTWGKNRTTGSDGYNEQTAGYAVTQISLADPVTLILGGRVTSWKTRGDNFGMPQNASYSDEFVPYGGLVYNITPDFSVYGSYTKIFDPESRINRNGQLLKPVTGENYELGLKGVALDNGLDYSLAIFDIRQDNFTEWDSTAPRRPDNIRTYYVLNGVKTRGFEAEVSGQITDDWRIYAGYTQFRATDPKGKRINTDNPSRLFKLFTTYTLPGVMSDLTLGGGVNWQDKTWLELDTPTGKRQDEQGSFATVNLMGRYQFTPDLSLSVNLKNLFDKKYYTSFGGYTQYYYGAPRNVEATLSYKF

SEQ ID NO: 8688 - protein, 342 aa, Xenorhabdus bovienii
  Coding DNA sequence: Name=SeqID_2580
  Gene classification: Gene name=FecB; Function=ABC-type cobalamin/Fe3+- siderophores transport systems, periplasmic components; Function class=P Inorganic ion transport and metabolism
  Homolog annotation: Query=20..320bp; Hit=22..312bp; Blast score=65; Percent Identity=24.0; E value=6e-11; Homolog= Rv0265c COG0614
MVLTRCKMLVAVPLILLVSLLVGCDKPAVSKNLPTDAVGYPKTIATALGTAVINQSPQRIVALGTGSEDILLDLGIIPIGIESHRWGGDAEGYLPWFRDEIERRGEKLPAIIEMYPELDIEKIISLKPDLILAMQSGITQEQYDHLSHFVPVIAYPEKPWQTTPQQQIALVAHALDKIQLGEKLSAELDTMLSQAGSTVPNVGRYRFAYIKAGTTGNILSIYVKNDPRVDTMVHLGLSLLPLADTLTAPFGSFSANIGLENADLLNGADILVTWYSSEKERQDTESQPLFSSIRAVRQGGYIPLTDQSIVMSMSYGSPLSLRWGLSRFMPLLKQEIAKHNER

SEQ ID NO: 8689 - protein, 335 aa, Xenorhabdus bovienii
  Coding DNA sequence: Name=SeqID_2581
  Gene classification: Gene name=BtuC; Function=ABC-type cobalamin/Fe3+- siderophores transport systems, permease components; Function class=P Inorganic ion transport and metabolism
  Homolog annotation: Query=3..328bp; Hit=16..341bp; Blast score=192; Percent Identity=37.0; E value=3e-49; Homolog= slr1316 COG0609
MNAKRRTALILGLVLMALLTCLCIVASLSLGSKSLPLSAIWQHYWLGDQGSYYDLVINAREPRTLIGLMAGAALALAGTVTQGLLRNPLGDPGLLGINAGAATAVVCFSFIPALDILPRFWTAFIGASLSTLLFYLLSGGPRNTNSVRLVLTGAAIHACLFALVQGIVLINAQAMDNYRFWTIGSLSAMSLNEASLLIPYLLVAVVVTLSLSASLNVMVFGEGIASSLGANVARTRILSLVMVTMLAATATAMAGPISFIGLAAPHLMRALVGSDFRWLLPYCLFAGPCLLLISDVVARLLIAPQEIMVGIITAGMGAPLLYLVAKNRSQKIMAE

SEQ ID NO: 8690 - protein, 348 aa, Xenorhabdus bovienii
  Coding DNA sequence: Name=SeqID_2582
  Gene classification: Gene name=BtuC; Function=ABC-type cobalamin/Fe3+- siderophores transport systems, permease components; Function class=P Inorganic ion transport and metabolism
  Homolog annotation: Query=33..340bp; Hit=37..351bp; Blast score=134; Percent Identity=36.0; E value=2e-31; Homolog= VC0778 COG0609
MAQINFTAGQPKIKIFTLGNAVFIAPSSHTSRVTLSMLLLLVVLFYLALSLGREGMDNPFLAMETPYQEFILLQIRLPRALVAIGAGMTLALSGSLFQLTTRNALGSPDIIGINAGAAVGIMVALLFWPSILPVPLGALLGACLAVLLVYIGNGSGVGNMQANKIVISGIAVATFCMAFVDFAISSIRIEQAQQISSLLRGSLASRRWQDVGLISGMVIFIPFLCWLGRQLNYTHFGDDIANTLGVPVRFIQIVSILLAVTFATMSVLVVGPVAFIALSAPQIARRLVRAKGAALFCSALVGALLMLASDLITLILPTVARLPVGMITAVVGGIYLMYLLYAELRRTR

SEQ ID NO: 8691 - protein, 271 aa, Xenorhabdus bovienii
  Coding DNA sequence: Name=SeqID_2583
  Gene classification: Gene name=FepC; Function=ABC-type cobalamin/Fe3+- siderophores transport systems, ATPase components; Function class=P Inorganic ion transport and metabolism
  Homolog annotation: Query=13..265bp; Hit=20..273bp; Blast score=275; Percent Identity=54.0; E value=3e-74; Homolog= VC0779 COG1120
MSSDANSPVVTSRLKAHDLSLAYGKRTIIEGVNLAIHDSEFSVIIGSNGCGKSTLLRAISRNMQPQRGEVQLDGINIHRYKPKAVARELSLLTQGATVTEALTIYDLVARGRYAYQSFLRQWSAEDERVVNEALQAVDLDEMSQKLVSELSGGQRQRAWFAMTLAQQTPIILLDEPTTYLDITHQIELLDLCQRLHRQGKTLVLVLHDINLALRYASRLIMMKNGQIYAEGVPEEIVTEQSIADVFGLECRIICDPESGKPLIIPKYKMNK

SEQ ID NO: 8692 - protein, 255 aa, Xenorhabdus bovienii
  Coding DNA sequence: Name=SeqID_2584
  Homolog annotation: Query=3..253bp; Hit=4..253bp; Blast score=368; Percent Identity=68.0; E value=1e-101; Homolog= ref|NP_931789.1|
MINKNNEISNEWVSKIEIEDIIKLFDGAFSHFNSSMKVNAENIPSDSMEFYQWSNEKEFSLLMKRYQDAYYGNNEQKPNQKGLYSLWAQWYFGLTIPPMMLMLLEYSQPIDTDYHLFQIEFHESGRPDIVYYQLTWLNESLSLLERYHSLLDRHIIPVCEKIESYRGINGRLLWNNIGYVIHWYLDNFKGRMSTEQYESLIQNLFFEQTLPDGRDNPLYRTMILKNNIIQRRSCCQRNKLPGVGNCHDCPLESTA

SEQ ID NO: 8693 - protein, 51 aa, Xenorhabdus bovienii
  Coding DNA sequence: Name=SeqID_2585
LIIYIQKNLIEITIFKIIKIPLMRRFSPTDWRLFEPLKTLYILIVYINYLR

SEQ ID NO: 8694 - protein, 34 aa, Xenorhabdus bovienii
  Coding DNA sequence: Name=SeqID_2586
MNVANIFMMLKIKGKFILFNILFILTITSLVFSK

SEQ ID NO: 8695 - protein, 439 aa, Xenorhabdus bovienii
  Coding DNA sequence: Name=SeqID_2587
  Gene classification: Gene name=IucD; Function=Lysine/ornithine N -monooxygenase; Function class=Q Secondary metabolites biosynthesis, transport and catabolism
  Homolog annotation: Query=7..433bp; Hit=8..430bp; Blast score=338; Percent Identity=42.0; E value=5e-93; Homolog= BH2620 COG3486
MTTKTYDFIAIGIGPFNLGLACLVQPIKEITSLFIDQKAGFNWHPGMMLESSTMQTPFMADLVTLASPTHPLSFLNYIKQKGRIYSFYIRESFFLMRKEYNQYCQWAAEQLSNLRFNTRVENISYDASTSLYTLHCADTLTGQKHQFFCKKLVLGTGPSSYIPKCCRPFADHMVTSGDYLENKAALQQKKSITVLGSGQSAAEIFYDLLEDIDAHGYQLNWVTRSPRFFPLEYTKLTLEMTSPEYVDYFYSLPENKREALNRSQQPLYKGINSSLINEIFDLMYTKRLSGELDVSLYTNSELRQVHFIAERQGVAEEQKLILDLFQHEQEAAFSLETEGLVLATGYQYQIPSFMEGIQHLIRWDKQGRYDVQRNYSIDCRNEIFVQNVELHTHGFVTPDLGMASYRNSRLIQEITGTEHYVIEKSIAFQQFGVASEGVF

SEQ ID NO: 8696 - protein, 802 aa, Xenorhabdus bovienii
  Coding DNA sequence: Name=SeqID_2588
  Gene classification: Gene name=RimL; Function=Acetyltransferases, including N-acetylases of ribosomal proteins; Function class=J Translation, ribosomal structure and biogenesis
  Homolog annotation: Query=28..179bp; Hit=29..180bp; Blast score=72; Percent Identity=29.0; E value=2e-12; Homolog= BH2621 COG1670
MSAVATVSFEKTLPDLGTFSLRPLNLTEDIVAITDWVNQEYAYYWGMQSHTEQQVKTFYQDLLNRQPDSVFIGIYQEQPVFLLECYWAQDDQIGKYYPARPGDMGMHILVAPSEQKISQFTWGIFQTIIAFIFKNPAVNRIVVEPDIRNEKIHRLNLRAGFVYDKTVQLSHKTAGLAFCTREQHQMALQSAKLAVPSNQTHYLVSHLHPAIWQKVNRLHLRKAISEFSHECLLFPEQLTEKADQDGYHHYRLDNPEYSVNYHFRARRLALDHWLIDVDSLRKMQAGDWCELDFISFIIEFKQQLGISDTVMPTYLEELTSTLHSSAFKYHRNGIDVEELVNADFQTIEAEMMEGHPIFVANNGRIGFDAEDFQKFSPESASDIRLVWLAAHKSKAHFACIEQLSYQQLMEQELGEAEIAKFNHQLILLGLNPEEYLLMPFHPWQWQNKLPSVFAHDLANRKLVYLGQGTDVYQAQQSIRTLFNRSHPQRYYVKVALSILNMGFMRGLSPYYMATTPGINDWLFDLVQKDAVLQSYGFRLLREVASIGFRNSYYEQAIHGDTPYKKMMAMLWRENPLPLIEPNQKLMTMAALLHHDQQGKAFLPALISASGLPTQEWIRRYLDCYLSPLLHCLYAYDLMFMPHGENIIMVLENHIPQYIFMKDLAEEILVVNPDADLPEKASRVKVSMPEEMKTLTILSDVFDGVFRYLSAILDEQGGYSQEQFWQTVADCILDYQSHYPEFSKQFVRYELFTPEIKRCCLNRLQITNNRQMLDLSDPALSFKFSDNLTNPIAPFVKNIVNVV

SEQ ID NO: 8697 - protein, 38 aa, Xenorhabdus bovienii
  Coding DNA sequence: Name=SeqID_2589
VARFNNIFIILKYTPIHLIYNEMILLKYYFIMMSFYDK

SEQ ID NO: 8698 - protein, 43 aa, Xenorhabdus bovienii
  Coding DNA sequence: Name=SeqID_2590
LHNNSNCWGRTVLSSDFEAFLLMCPPDGYKNSVHLIIYHKMTS

SEQ ID NO: 8699 - protein, 215 aa, Xenorhabdus bovienii
  Coding DNA sequence: Name=SeqID_2591
  Homolog annotation: Query=9..214bp; Hit=11..216bp; Blast score=183; Percent Identity=46.0; E value=2e-45; Homolog= ref|NP_799605.1|
MQGLELYEEKIERDQFRGEIIKNSKFLNCDFSSSDLRDTQFIDCQFYEPTNYLGCNFKHAMLKEASFKNCDLSMADFRYINALGIEIRGCRLQGADFRGASFMNRVSANIQFCSAYITKSNLSYTNFADVILEKCELWENRWHETHILGARFSGSDLSGGEFISFDWNAADFTYCDLTNSTLGELDIRKVDLKGVKLESYQVAELLERIGIVVMA

SEQ ID NO: 8700 - protein, 513 aa, Xenorhabdus bovienii
  Coding DNA sequence: Name=SeqID_2592
  Gene classification: Gene name=ProP; Function=77 Permeases of the major facilitator superfamily; Function class=G Carbohydrate transport and metabolism
  Homolog annotation: Query=1..502bp; Hit=1..502bp; Blast score=705; Percent Identity=73.0; E value=0; Homolog= emrB COG0477
MVTREPLTGAKLALLTISLAMATFMLVLDSTIANVAIPTIAGNLGASNSQGTWVITSFGVANAISIPITGWLAKRIGEVKLFIWSTALFTFSSWLCGISNSLEVLILFRVIQGVVAGPIIPLCQSLLLNNYPPAKRNMALALWSVVIVVAPICGPILGGYISDNYHWGWIFFINIPLGIAIIFVARQTLRNRETKTEIHAIDTVGLVLLVLGIGCLQVMLDQGKELDWFNSTEIIVLTVIAVISLTILIVWELTDDHPIIDLSLFKERNFTIGTLCLSLAFMFYFGTIVLLPQLLQEVFGYTATWAGLAAAPIGLMPLLLSPLIGKYGHKIDMRYIVTVSFIIYTVCFYWRAYTFEPGMNFAAVAWPQFFQGFAMACFFMPLTTITLSGLPPERMASASSLSNFIRILSGSIGASITTTIWTQREAMHHSYFTEHINPYDPNYQQTYQQLTQLGMNDQQISAYLAKQITHQGLIISANEIFWLAAGIFLVLVLLVWMAKPPFSAGSKDSGGAH

SEQ ID NO: 8701 - protein, 392 aa, Xenorhabdus bovienii
  Coding DNA sequence: Name=SeqID_2593
  Gene classification: Gene name=EmrK; Function=Multidrug resistance efflux pump; Function class=Q Secondary metabolites biosynthesis, transport and catabolism
  Homolog annotation: Query=1..390bp; Hit=1..389bp; Blast score=430; Percent Identity=58.0; E value=1e-120; Homolog= ZemrA COG1566
MNIKEEIKSPTATSRNKKRQRRSIIILLTLLFLILGAVYTVYWFLVLRHHQETDNAYVTGNQVQVMSQVTGSVTTVYFDNTDFVKSGSVLVQLNPLDAELVLKKAENELATAVRTTHQRILDNQQYQAVINLKKIALSKAQNDLNRREILGIKEVIGKEELQHTRESVAIAKADLDVAIAQYNSNQATILDTPLDKQPTVEKAASGVRDAWLALQRTKIVSPVDGYVSRRNVQVGSRINSGTPLMVIVPASNMWIEANFKETQLANMRIGQTVKIISDFYSDGVVYTGKVAGLDMGTGSAFSLLPAQNASGNWIKVVQRLPVRIELDPEQLKQYPLRIGLSTKVTVDTADTREMTLATSERHHPAYHTNALTIDMAPANKIVNDVINSHSRN

SEQ ID NO: 8702 - protein, 47 aa, Xenorhabdus bovienii
  Coding DNA sequence: Name=SeqID_2594
VCIYTTGKGELHGFKYYLRIIVSHMRYQMIQASRKDFLGHVAITRFS

SEQ ID NO: 8703 - protein, 175 aa, Xenorhabdus bovienii
  Coding DNA sequence: Name=SeqID_2595
  Gene classification: Gene name=MarR; Function=Transcriptional regulators; Function class=K Transcription
  Homolog annotation: Query=1..169bp; Hit=1..165bp; Blast score=205; Percent Identity=68.0; E value=2e-53; Homolog= emrR COG1846
MESSFTPTEELLNCRVTQQKELNKSLPYQEILLTRLSMHVQGKILENRNNMLRAQGINETLFMALMILDTKESRSIQPSELSAALGSSRTNATRIADELEKQGWIERKESHNDRRCLHLHLTEKGTNFLNSLLPPQHDCLIKLWSALEQEEQKQLEKLMRKLLARLDNIGDCFKK

SEQ ID NO: 8704 - protein, 50 aa, Xenorhabdus bovienii
  Coding DNA sequence: Name=SeqID_2596
LLNLTFNIVFVGFLTEVTLPVETNKVSKQWKVHSLPLKSCLIAVLHSKKS

SEQ ID NO: 8705 - protein, 111 aa, Xenorhabdus bovienii
  Coding DNA sequence: Name=SeqID_2597
  Homolog annotation: Query=1..111bp; Hit=1..112bp; Blast score=134; Percent Identity=71.0; E value=2e-31; Homolog= ref|NP_928589.1|
MIDNRILLIGIVVGVANFLFRYLPLRFGVNRSPMTKAGNTGVVLDSIGIASICSLLIVSGIPEVIREHNKFFPTLIGCLTICLLFYKTRSISIATLSGATVFGLTFKVFMN

SEQ ID NO: 8706 - protein, 263 aa, Xenorhabdus bovienii
  Coding DNA sequence: Name=SeqID_2598
  Gene classification: Gene name=AzlC (BS); Function=Predicted branched- chain amino acid permease (azaleucine resistance); Function class=E Amino acid transport and metabolism
  Homolog annotation: Query=22..250bp; Hit=8..235bp; Blast score=300; Percent Identity=69.0; E value=7e-82; Homolog= Z3983 COG1296
MPIPDKPAPDTPKSGTSIPELPIPNKISSFSEGIIDSLPIAIGYIPIAFAFGLSAVKLGFTPLEAIFFSCVIYAGASQFIITALLSAGMSLWVSALTVLAMDIRHILYGPALRYRIKQKLSEKKTAIWAFGLTDEVFAAATAKLIKDQRSWSENWMVAIAMCSWLSWVLGTVAGSLLGNGYLDSYPAVEAAMTFMLPALFLSFLLASVKKQNSYCVTASLAGALIGVTCFSIPVAILAGILGGCLTALLQFHTTQLNKNKTDD

SEQ ID NO: 8707 - protein, 87 aa, Xenorhabdus bovienii
  Coding DNA sequence: Name=SeqID_2599
MAMGKLSIMPSENEEILFGMGSSGMDVPDFGVSGAGLSGIGMELIVFLLIGETTLTKYGESENMKCINYLINIIKTRVFYRFLAVWR

SEQ ID NO: 8708 - protein, 344 aa, Xenorhabdus bovienii
  Coding DNA sequence: Name=SeqID_2600
  Gene classification: Gene name=ProX; Function=ABC-type proline/glycine betaine transport systems, periplasmic components; Function class=E Amino acid transport and metabolism
  Homolog annotation: Query=11..338bp; Hit=1..328bp; Blast score=481; Percent Identity=68.0; E value=1e-136; Homolog= proX COG2113
MRIITRCKKIMNKNTILGLTLSSLVSMPLFAVELPGKGISVQPLQSTISEETFQTLIVCKALEKLGYDIKPIKEVDYNVAYASIAAGDATFMAVNWVPLHNAQYKAAGGDKKFYRKGTYVENAVQGYLIDKKTAEKYRITNIAQLQDPQLAKLFDSNGDGKADLTGCNPGWGCEKAINSQLKAYGLENTVEHNQGNYAAMMADTIARYREGKPIFYYTWTPYWISDVLKPGTDVIWLQVPFSALNDDGVVDTQLPNGRNYGFPPSTMHIVANKTWAEKNPAAATLFAVMKLPVADINAQNLRMHSNKVSDIDIEHHAEGWLRAHQTIVDEWLEAARKATGQKTG

SEQ ID NO: 8709 - protein, 364 aa, Xenorhabdus bovienii
  Coding DNA sequence: Name=SeqID_2601
  Gene classification: Gene name=ProW; Function=ABC-type proline/glycine betaine transport systems, permease component; Function class=E Amino acid transport and metabolism
  Homolog annotation: Query=5..348bp; Hit=10..354bp; Blast score=422; Percent Identity=73.0; E value=1e-118; Homolog= ZproW COG1174
MSSKTPQTASDQATFSDPWINSATVDPSSNNDWLDTSATEISSEHFNIMAPFQHKLIPFDSWVTHAIDWLVLHFRPIFQGVRVPVDFILNGFEQFLVSMPAPVTILIFALLAWQLAGTGIGVTSFISLILIGAIGAWSEAMITLALVLTALLFCILIGLPLAIWLAHSERVARIVRPLLDAMQTTPAFVYLVPIVMLFGIGNVPGVMVTIIFALPPIVRLTILGIKQVPADLIEAARSFGASPRQMLFKVQLPLAMPTIMAGVNQTLMLALSMVVIASMIAVGGLGQMVLRGIGRLDIGLAAVGGAGIVILAIILDRLTQSLGKNSRVRGGLWYHSGPIGLFITLFARKWARKSSCDNNVQTDK

SEQ ID NO: 8710 - protein, 400 aa, Xenorhabdus bovienii
  Coding DNA sequence: Name=SeqID_2602
  Gene classification: Gene name=ProV; Function=ABC-type proline/glycine betaine transport systems, ATPase components; Function class=E Amino acid transport and metabolism
  Homolog annotation: Query=1..398bp; Hit=1..398bp; Blast score=580; Percent Identity=73.0; E value=1e-165; Homolog= proV COG1125
MTIKLEVKNLYKIFGDHPEPAFKLLESGLNKEQIFEKTGLAIGVQNANLAIEEGEVFVIMGLSGSGKSTLVRLLNRLIEPTRGQVLIDGKDIAAISDIQLREVRRSKMSMVFQSFALMPHLNVLENTAFGMELAGIPKKERHYKALETLKQVNLENYALSYPDELSGGMQQRIGLARALANDPDILLMDEAFSALDPLIRTEMQDEVLRLQGEHQRTIIFISHDLDEAMRIGDRIAIMQGGIIVQVGTPDEILNNPVNDYVKTFFRGVDISHVFSAKDVARRRQEALLHIATGFGPRSALKVLDDEDRSYGYLIEKGQKFIGVVSVCSLQKALTEKQSIEYAILKEPAAVSADMPLHELISIVAQSPCAVPVVGDNDRYLGVISKGILLQALDKETPNEQ

SEQ ID NO: 8711 - protein, 65 aa, Xenorhabdus bovienii
  Coding DNA sequence: Name=SeqID_2603
LSCNKYFPFVNDIFSLLLRIIRIIFSHIYPSTLKYVDNPLFRIINQNGYLLWRNVCDYNLIFNLF

SEQ ID NO: 8712 - protein, 45 aa, Xenorhabdus bovienii
  Coding DNA sequence: Name=SeqID_2604
LVKAIQLTPFIFQVAVLLTTFTYSIHIVIYIYALGIRFTCYRTAT

SEQ ID NO: 8713 - protein, 72 aa, Xenorhabdus bovienii
  Coding DNA sequence: Name=SeqID_2605
VAFIKKHNIYCIYFINRLSEYNTKMLVFIISYSSTQKVILPEALSFMANTVVFGTILPAFSTTQDLSDEIYK

SEQ ID NO: 8714 - protein, 161 aa, Xenorhabdus bovienii
  Coding DNA sequence: Name=SeqID_2606
  Gene classification: Gene name=Ada; Function=Methylated DNA-protein cysteine methyltransferase; Function class=L DNA replication, recombination and repair
  Homolog annotation: Query=19..154bp; Hit=16..157bp; Blast score=145; Percent Identity=45.0; E value=2e-35; Homolog= VCA1017 COG0350
MYHHYLNTPEGFPKPYIHITADDEGVTSIYFVNEKKELESKNTITKQCVKELQEYFKGKRHTFTVPLSMKGTEFQKRVWQQLCNIPFGDMWSYKQLALTLGSVNYCRAVGMANSRNPISLIVPCHRVIGHDGKLVGYTGGLDIKVWLLEHEKNKKIKAKQS

SEQ ID NO: 8715 - protein, 30 aa, Xenorhabdus bovienii
  Coding DNA sequence: Name=SeqID_2607
MKRIKKLKLNRVEQNTSLFMKLLLKYKITL

SEQ ID NO: 8716 - protein, 33 aa, Xenorhabdus bovienii
  Coding DNA sequence: Name=SeqID_2608
LLPSSGVIKPNPLDSLNHLTLPLIFDIKLTFNK

SEQ ID NO: 8717 - protein, 82 aa, Xenorhabdus bovienii
  Coding DNA sequence: Name=SeqID_2609
MNLKDSVLSLQKMVAKMFLYTFPPFSLTVSKLWLKVKESSLKSLRVRKVHLLQTLSQSNFYPRILKTRLLQRVFYVFKHNLI

SEQ ID NO: 8718 - protein, 124 aa, Xenorhabdus bovienii
  Coding DNA sequence: Name=SeqID_2610
  Gene classification: Gene name=CrcB; Function=Integral membrane protein possibly involved in chromosome condensation; Function class= D Cell division and chromosome partitioning
  Homolog annotation: Query=1..118bp; Hit=1..118bp; Blast score=123; Percent Identity=61.0; E value=2e-29; Homolog= crcB COG0239
MINIIFAVFIGGGLGSVLRWLISFRLNNASTPLAVGTLTANCVGAFIIGLGLAYFNKATHLDPVWKLMLTTGFCGGLTTFSTFSVEVVYLLQAGKIGWALSSILANLVGSLLMTTFAFAVMNRF

SEQ ID NO: 8719 - protein, 321 aa, Xenorhabdus bovienii
  Coding DNA sequence: Name=SeqID_2611
  Gene classification: Gene name=LipA; Function=Lipoate synthase; Function class=H Coenzyme metabolism
  Homolog annotation: Query=1..321bp; Hit=1..321bp; Blast score=615; Percent Identity=92.0; E value=1e-176; Homolog= ZlipA COG0320
MSKPIQMERGVKYRDADKMALIPVKTVATEREALLRKPEWMKIKLPADSSRIQGIKAAMRKNGLHSVCEEASCPNLAECFNHGTATFMILGAICTRRCPFCDVAHGRPTAPDTNEPTKLAQTIQDMALRYVVITSVDRDDLRDGGAQHFADCISAIREKNPSIKIETLVPDFRGRMDRALEILTATPPDVFNHNLENVPRVYRQVRPGANYEWSLKLLEKFKETHPNIPTKSGLMVGLGETNKEILEVMRDLRRHGVTMLTLGQYLQPSRHHLPVQRYVSPAEFDEMKEAALEMGFTHAACGPFVRSSYHADMQAKGMEVK

SEQ ID NO: 8720 - protein, 216 aa, Xenorhabdus bovienii
  Coding DNA sequence: Name=SeqID_2612
  Gene classification: Gene name=LipB; Function=Lipoate-protein ligase B; Function class=H Coenzyme metabolism
  Homolog annotation: Query=6..213bp; Hit=3..209bp; Blast score=280; Percent Identity=64.0; E value=8e-76; Homolog= VC0944 COG0321
MMKFPLQHNTVILRQLGIQPYGPVSDAMHQFTEQRTAETSDEIWLVQHEKVFTQGQAGKAEHVLTPGEIPVIQSDRGGQVTYHGPGQQVMYVLVDLKRAKIGVRQLVTAIENTVIETLAYFGVEAHARPDAPGVYVQNNKICSLGLRIRKGCSFHGLALNIAMDLQPFLRINPCGYAGMQMTQLSHLAAEVTVEDVQPVLVEKFCRILGFQLINER

SEQ ID NO: 8721 - protein, 68 aa, Xenorhabdus bovienii
  Coding DNA sequence: Name=SeqID_2613
MPHNQELVFSDHLLAQTEIKGEIIEIYNHHNIKFKYIRLINNIIALKHSQTGGNPFRTLYWRVIFVNE

SEQ ID NO: 8722 - protein, 486 aa, Xenorhabdus bovienii
  Coding DNA sequence: Name=SeqID_2614
  Gene classification: Gene name=TrkG; Function=Trk-type K+ transport systems, membrane components; Function class=P Inorganic ion transport and metabolism
  Homolog annotation: Query=9..485bp; Hit=8..484bp; Blast score=559; Percent Identity=62.0; E value=1e-159; Homolog= trkG COG0168
MVRKNQLLIVGHLCSFLVLLYSLSMLLPIFVALFYKEKSVFAFFETLLIGLSVGSVGWYFTRKTKAQPSTQDGFLIIVLFWLLFSLLSALPFVLDKSLNINLVDAVFEGVSGITTTGATVLNDVSELPKSILYYRAQLNFIGGLGVIVLAVAILPLLGIGGVKLYQSEMPGPFKEERLTPRLADSAKSLWLVYLLLGALCSVSFKVAGMSWFDAVCHGISTVSLGGFSTRNESLGYYDSAAIEMVGGIFSVLAAVNFTLYFVALTRRSLKPLLKNAELKFFLLVLAAVVCIIWLELYRSGMYGVKEAFVHGFFMTSSMMTDNGLATSDYAQWPSHTILMLLAVSFFGGCVGSTCGGIKALRFLILAKQSISEINQLVHPNAISTIKVGQSSVHERVLRSVWGFFFLYVFFSCFFIWALNLLGYDLVTSFATVAACINNMGVGYGATAQGFGDLDAVAKWMMCAAMLLGRLEIYPILILCSKAFWRF

SEQ ID NO: 8723 - protein, 36 aa, Xenorhabdus bovienii
  Coding DNA sequence: Name=SeqID_2615
LIIIINIINDVANTTSSCSLPPQKRQNAFEQRIRIG

SEQ ID NO: 8724 - protein, 308 aa, Xenorhabdus bovienii
  Coding DNA sequence: Name=SeqID_2616
  Gene classification: Gene name=ViuB; Function=Siderophore-interacting protein; Function class=P Inorganic ion transport and metabolism
  Homolog annotation: Query=5..298bp; Hit=6..295bp; Blast score=232; Percent Identity=44.0; E value=4e-61; Homolog= PA2033 COG2375
MSSTYSIFTLFLKERILVSPSILRCVFQGPDVHRMRRYAPDQRIKLLFPVQNNPALKLEGGEEWRRDYMAIPKEQRPLMRTYTLRALRIEKHEMDVEFVLHGKNSPVSNWLSHANLGDTLQIVAPMAGLDGCMENSGGGCEWNPPEHMCQTLLIADETALPAALGILEQLAQRDNPPYVQAFFEVLEQGDCVNVEHFTFADVFWLPRDTEGKYQYGKRLIEEVPQHVTIPESAFIKEQALDEKTTSEGELWERATSENNETRFYGWIAAESSVVKKLRQYLLQERHLDRSLINFMAYWSKSSSKDDHA

SEQ ID NO: 8725 - protein, 87 aa, Xenorhabdus bovienii
  Coding DNA sequence: Name=SeqID_2617
  Gene classification: Function=Uncharacterized ACR; Function class=S Function unknown
  Homolog annotation: Query=1..87bp; Hit=1..87bp; Blast score=143; Percent Identity=86.0; E value=3e-35; Homolog= ybeD COG2921
MKTKLNELLEFPCSFTYKVMGLARPELVDQVIEVVQRHAPGDYSPVVKPSSKGNYHSVSITINATHIEQVETLYEELGNLELVRVVL

SEQ ID NO: 8726 - protein, 35 aa, Xenorhabdus bovienii
  Coding DNA sequence: Name=SeqID_2618
MSRGTQAVHLILFSWALLVYLPRQRGSFCRGVIIF

SEQ ID NO: 8727 - protein, 402 aa, Xenorhabdus bovienii
  Coding DNA sequence: Name=SeqID_2619
  Gene classification: Gene name=DacC; Function=D-alanyl-D-alanine carboxypeptidase; Function class=M Cell envelope biogenesis, outer membrane
  Homolog annotation: Query=1..402bp; Hit=1..403bp; Blast score=648; Percent Identity=78.0; E value=0; Homolog= dacA COG1686
MKYIVLPRFIKNTTLGIALAASASAFANTDDNFKTMIPGVPQTDAEAYILIDYNSGKILAEKNSDIRRDPASLTKMMTSYVIGQAIKSGKIGPNDTVTVGKDAWATGNPVFKGSSLMFLKPGDQVSVAMLSRGINLQSGNDACVAMADYVAGSQDAFVNLMNKYVQNLGLQNTHFETVHGLDAAGQYSSAHDMALIGQALIRDVPDEYAIYKEKEFTYNNIHQPNRNGLLWDKSLNVDGIKTGHTSGAGYNLVSSATESNMRLISVVMGSPTFKGRETDSKKLLTWGFRFFETVSPLQVGKEFASEPVWFGDADKVQLGVDKNVYLTIPRGRLKDLKASYVLNNTELHAPLAKDQVVGTINFQLDGKTIEQRPLVVMQEIKEGGFFSRMIDYIKLMFHHWFG

SEQ ID NO: 8728 - protein, 347 aa, Xenorhabdus bovienii
  Coding DNA sequence: Name=SeqID_2620
  Gene classification: Gene name=RlpA; Function=Lipoproteins; Function class=M Cell envelope biogenesis, outer membrane
  Homolog annotation: Query=1..344bp; Hit=1..358bp; Blast score=224; Percent Identity=43.0; E value=1e-58; Homolog= rlpA COG0797
MHQQWLILGIVAVLISGCTTTGNKREDSSIPPVPTREVLGAEPQYEPYHPSANQDYQRDRQSYRIVQDSANFTQTGYASGFGEEANGKLTAIGERASPYALAAAHPTLPIPSYVRVTNLSNGRMMIVRINDRGPYNKPGKIIELSRAAAERLNLMPQSRVKLDGIQVAPDGSVSGLGTEGATIVKQSYALPDRPNIGAPAMMSSPSEQNIAEQNTVGQPAVDQNLSGNTENPFLTSPPVGTPSAPKQSETKWILQPQTEPVATSPVTPEPAATSTGGFMVQVGAISSEQKAKEWQQSLSQRFNVQGRIMQFGNVHRVQLGPLSRQQATELQKKLTDQMHQSSFIVAP

SEQ ID NO: 8729 - protein, 370 aa, Xenorhabdus bovienii
  Coding DNA sequence: Name=SeqID_2621
  Gene classification: Gene name=FtsW; Function=Bacterial cell division membrane protein; Function class=D Cell division and chromosome partitioning
  Homolog annotation: Query=1..370bp; Hit=1..370bp; Blast score=505; Percent Identity=80.0; E value=1e-143; Homolog= mrdB COG0772
MTDSQKKVPFWTRVHIDIPLLLCILALLVYSLFIMWSASGQDVDMMERKAGQVIMGLIVMIVLAQVPPRIYENWAPYLYIGCVFLLILVDVFGQISKGAQRWLDLGIVRFQPSEIAKIAVPLMVARFMNRDLCPPSLKNTGIALILTFLPTLLVAAQPDLGTSILIAASGVFILFLAGMNWRLITIAILLIACFLPILWFFLMHDYQRARVMMLLDPESDPLGKGYHIIQSKIAIGSGGEFGKGWLQGTQSQLEFLPERHTDFIFAVLSEELGLVGVLVLLALYLLLIIRGLVIAARAQNTFGRVMVGGLILILFVYVFVNIGMVSGILPVVGVPLPLISYGGSALIVLMAGFGIIMSIHTHRKLLSKSL

SEQ ID NO: 8730 - protein, 631 aa, Xenorhabdus bovienii
  Coding DNA sequence: Name=SeqID_2622
  Gene classification: Gene name=FtsI; Function=Cell division protein FtsI/penicillin-binding protein 2; Function class=M Cell envelope biogenesis, outer membrane
  Homolog annotation: Query=8..629bp; Hit=7..631bp; Blast score=987; Percent Identity=74.0; E value=0; Homolog= mrdA COG0768
MKNKRTPFRDHTAESALFMRRALVAFIGIIILTGILIANLYNLQIIRHEDYQTRSNGNRIKLVPIAPSRGIIYDRNGTPLATNRTIYQLEIIPQKIDNLDKTLDELRSIVDLTDEDIENFKKERQRARRFTSVPLKTSLNQVQVARFSVNQYRFPGLEIKGYQRREYPFGSALTHVIGYVAKINDKDVERLEKEGILADYAATHDIGKLGIERYYESTLHGKPGYEEVEVNNRGRVIRQLHEQPPQAGKDIYLSIDLNLQNYIEQILTTSRAAVVVTDPRTGEVLAMVSNPSYDPNLFVDGISSKDYKNLLNDPNRPLINRATQGAYPPASTVKPFIAAAALSSDIITKNTTIFDPGWWQLPGSEKRYRDWKRWGHGKLNVHKSIVESADTFFYQLAYDMGIDRLSEWMSRFGYGQFTGIDLREETPGNMPTREWKVKRYKKPWYQGDTISVGIGQGYWTATPMQMVKALMILINDGEVKTPHFLLGTRVNGEMHPYQPPVNHSIGDIHSGYWEIAKDGMYGVANAPNGTARRFFAGAPYKAAVKSGTAQVFSYETYNASKLAEHLRDHKLMIAFAPYDSPTVAISIILENGGSGPAVGTIIRQILDHILIKDSERITPVAAQAVTGTQAN

SEQ ID NO: 8731 - protein, 145 aa, Xenorhabdus bovienii
  Coding DNA sequence: Name=SeqID_2623
  Gene classification: Function=Uncharacterized ACR; Function class=S Function unknown
  Homolog annotation: Query=1..145bp; Hit=12..155bp; Blast score=255; Percent Identity=88.0; E value=1e-68; Homolog= ybeA COG1576
MPDWVQTGFIDYLHRFPKDTPFELIEVPAGKRGKNADIKRILEKEGEQMLSAVGKDNRIVTLDIPGSRWDTPQLAQQLERWKQDGRNVSLLIGGPEGLAPACKAAAEQSWSLSPLTLPHPLVRVLVAESLYRAWSITTNHPYHRE

SEQ ID NO: 8732 - protein, 134 aa, Xenorhabdus bovienii
  Coding DNA sequence: Name=SeqID_2624
  Gene classification: Function=Uncharacterized ACR (homolog of plant Iojap proteins); Function class=S Function unknown
  Homolog annotation: Query=35..133bp; Hit=4..102bp; Blast score=127; Percent Identity=62.0; E value=2e-30; Homolog= PM1922 COG0799
LPLSRLLLQRLACYYSALFNQFDEIKVILLQGTELQKFVIDKLEDSKAQDIVSIDVRGKSSITDCMVICTGTSTRHLMSVADNLVDDCRKAGFMPLGVEGQGISDWIVVDLGEIMIHVMQEDSRRMYELEKLWS

SEQ ID NO: 8733 - protein, 226 aa, Xenorhabdus bovienii
  Coding DNA sequence: Name=SeqID_2625
  Gene classification: Gene name=NadD; Function=Nicotinic acid mononucleotide adenylyltransferase; Function class=H Coenzyme metabolism
  Homolog annotation: Query=16..225bp; Hit=4..213bp; Blast score=244; Percent Identity=58.0; E value=4e-65; Homolog= ZybeN COG1057
MLHSTDSTIDPSSPIIQALFGGTFDPIHYGHLRPVEALAKQVGLKQVILLPNHVPPHRPQPEATASQRLEMVRLAVQDNPLFTVDTRELERQTPSYTIETLKSFRQEVGEQRPLAFIIGQDSLQSIHTWYKWEELLGICHLLVCSRPGYQSQLSTSDMQKWLEQHKIDTPISLRQKPHGCIYLAATPLLNISATDIRQRHQQGLSCDDLLPPAIQNYVDSRGLYRQ

SEQ ID NO: 8734 - protein, 346 aa, Xenorhabdus bovienii
  Coding DNA sequence: Name=SeqID_2626
  Gene classification: Gene name=HolA; Function=DNA polymerase III delta subunit; Function class=L DNA replication, recombination and repair
  Homolog annotation: Query=1..342bp; Hit=1..342bp; Blast score=416; Percent Identity=67.0; E value=1e-116; Homolog= holA COG1466
MIRLYPEQLLSQLNEGLRNNYLLWGNEPLLLQESQDSIRRVAEQHGFLEHFTFSLDNHTEWEEIFSLCQSLSLFSSRQSLTLLLPENGPNAAMVERLTKLSGLLHADILLILRGHKLTKAQENSPWFKTLGQNGVYVSCLTPEQNRLPQWVAQRARSMGLSLEDEANQLLCYCYEGNLLALAQALERLSLLHPDNRLTLPRVEEAVNDAAHFAPYHWVDALLAGKIKRAWHILKQLRQEDTEAIILLRTIQRELMLLLILKRQDKTTPLKTLFDQHKVWQNRRSLLTTALQRLSQQDLQSAIHLLTQMELCVKQDYGQSIWADLETLSMLLCGKTLPESFLNASFH

SEQ ID NO: 8735 - protein, 186 aa, Xenorhabdus bovienii
  Coding DNA sequence: Name=SeqID_2627
  Gene classification: Gene name=RlpB; Function=Rare lipoprotein B; Function class=M Cell envelope biogenesis, outer membrane
  Homolog annotation: Query=12..177bp; Hit=6..173bp; Blast score=168; Percent Identity=51.0; E value=3e-42; Homolog= rlpB COG2980
LVGNNVRHGIFTLFLGLAVLVTAGCGFHLRGTTQVPKELQTLQLSSGDPYGPLARAVRQQLRLNDVKIVERGDASVPILKLLGSNEHKETASVFQDGKAAERQLVLYVDAQVLMPNGGIYPLQARVDRSFFDNPLEALAKDAENELIQQEMREQAAHQLMRQLLTVHSAELLKTEEKQQAVTAQKQ

SEQ ID NO: 8736 - protein, 860 aa, Xenorhabdus bovienii
  Coding DNA sequence: Name=SeqID_2628
  Gene classification: Gene name=LeuS; Function=Leucyl-tRNA synthetase; Function class=J Translation, ribosomal structure and biogenesis
  Homolog annotation: Query=1..860bp; Hit=1..860bp; Blast score=1468; Percent Identity=80.0; E value=0; Homolog= leuS COG0495
MQEQYRPEDIERQVQLHWQEKQTFKVTEDSNKEKYYCLSMLPYPSGRLHMGHVRNYTIGDVISRYQRMLGKNVLQPIGWDAFGLPAEGAAVKNNTAPAPWTYSNIEYMKAQLKTLGFGYDWDREVTTCTPEYYRWEQWFFTKLYEKGLVYKKTSAVNWCPHDLTVLANEQVIDGCCWRCDSQVERKEIPQWFIKITDYAEELLNDLDKLEDWPEQVKTMQRNWIGRSEGVEITFNVADSQETLTVYTTRPDTFMGTTYVAVAAGHPLAKQAAENNPELAEFINECRNTKVAEADMATMEKKGVPTGMFAIHPLTNEKIAIWVANFVLMEYGTGAVMAVPAHDQRDWEFATKYSLPMKTVILDNDGNVPTVQEGAATDKNALVNSGEFSGLSNEEGFNAIADKLVEMGAGNRKVNYRLRDWGVSRQRYWGAPIPMATLEDGTVVPVPEDQLPVILPEDVVMNGITSPIKADPEWAKTTINGQPALRETDTFDTFMESSWYYARYTCPDYDKGMLDPAAANYWLPVDQYIGGIEHAIMHLMYFRFFHKLMRDSGMVNSDEPAKRLLCQGMVLADAFYYTGNSGEKVWVSPADAIVERDDKGRIVKSVDQDGHELVYTGMSKMSKSKNNGIDPQIMVDKYGADTVRLFMMFAAPPELTLEWQESGVEGANRFLKRVWRLVYEHSSKGTTQPLDIASLTTEQKDLRRDLHKTLAKVTDDIGRRQAFNTAVAAIMELMNKLTRVPQETEQDRALMQEALTAVVRMLSPITPHACFVMWKELGNESDIDTAAWPQADEQAMVDDTKLVIIQINGKVRGRITVPADATKEYVQEMAAKEYSVAKYLEGVSIRKVIYVPGKLLNLVVG

SEQ ID NO: 8737 - protein, 39 aa, Xenorhabdus bovienii
  Coding DNA sequence: Name=SeqID_2629
LPVKLYLSLYVFWTILFLHGTDNPMVSNKAAPVTRIVCL

SEQ ID NO: 8738 - protein, 41 aa, Xenorhabdus bovienii
  Coding DNA sequence: Name=SeqID_2630
VRSLKFTYFRSRLRSAEVVLSADREKISVEFSPENHGRVLI

SEQ ID NO: 8739 - protein, 241 aa, Xenorhabdus bovienii
  Coding DNA sequence: Name=SeqID_2631
  Gene classification: Gene name=GlnQ; Function=ABC-type polar amino acid transport system, ATPase component; Function class=E Amino acid transport and metabolism
  Homolog annotation: Query=1..241bp; Hit=1..241bp; Blast score=400; Percent Identity=87.0; E value=1e-112; Homolog= gltL COG1126
MISLKNVSKWYGQFQVLADCSTEVKKGEVVVVCGPSGSGKSTLIKTVNGLEPVQQGEIRVNNTPVNDKSTNLAQLRSKVGMVFQHFELFPHLSIIENLTLAQVKVLKRDKKAATEKALKLLERVGLTSHADKFPSQLSGGQQQRVAIARALCMDPIAMLFDEPTSALDPEMINEVLDVMVKLANEGMTMMVVTHEMGFAKKVAHRVIFMDEGKIVEDSKKEDFFANPKSERARDFLAKILH

SEQ ID NO: 8740 - protein, 224 aa, Xenorhabdus bovienii
  Coding DNA sequence: Name=SeqID_2632
  Gene classification: Gene name=ArtM; Function=ABC-type amino acid transport system, permease component; Function class=E Amino acid transport and metabolism
  Homolog annotation: Query=1..223bp; Hit=1..223bp; Blast score=304; Percent Identity=83.0; E value=5e-83; Homolog= gltK COG0765
MYQFDWSSIIPSLPFLLNGLVITAKITVIAIIIGIAWGTLLAMMRLSSIKILSWFATLYVNLFRSVPLVMVLLWFYLIVPNLLQNVLGISPKTDIRLISAMVAFSLFEAAYYSEIIRAGIQSISRGQSSAALALGMTHMQSMRLIILPQAFRAMIPLLLTQGIVLFQDTSLVYVLSLADFFRTATNIGERDGTQIEMILFAGVVYFVISFAASMLVNYLKKRTV

SEQ ID NO: 8741 - protein, 246 aa, Xenorhabdus bovienii
  Coding DNA sequence: Name=SeqID_2633
  Gene classification: Gene name=ArtM; Function=ABC-type amino acid transport system, permease component; Function class=E Amino acid transport and metabolism
  Homolog annotation: Query=1..246bp; Hit=1..246bp; Blast score=391; Percent Identity=82.0; E value=1e-109; Homolog= gltJ COG0765
MSVDWNWGIFLQAAPFGNTTYLGWIISGFQVTIALSVCAWVIALVVGSLFGILRTVPNKFLATLGACYVELFRNVPLIVQFFIWYLVVPEFLPKNLSNWFKMELDPNIQFFISSVICLGLFTAARICEQVRAAIQSLPRGQKAAGQAMGLTLPQTYRYVLLPNAYRIIIPPMTSEMLNLVKNSAIASTIGLVDMAAQAGKLLDYSAHAYESFTAITLAYVGINLVIMLAMTLLEKKVRLPGNLGGR

SEQ ID NO: 8742 - protein, 336 aa, Xenorhabdus bovienii
  Coding DNA sequence: Name=SeqID_2634
  Gene classification: Gene name=ArtI; Function=ABC-type amino acid transport system, periplasmic component; Function class=E Amino acid transport and metabolism
  Homolog annotation: Query=40..336bp; Hit=1..302bp; Blast score=441; Percent Identity=77.0; E value=1e-124; Homolog= ZybeJ COG0834
MNYFFTAYKQKDSGNRFYKNVNATICKQTQSSKNNPIKELYMRKLMLTMMLLSAVGAAHAEELTGTLKKIKDNGIIVVGHRESSVPFSYYDNQQNVVGYAQDYSNLIVDAVKKKLDMPNLQVKLIPITSQNRIPLLQNGTYDFECGSTTNNLERQKQAAFSNTIFVVGTRLLTNKDSGIKGFDDLAGKHVVVTSGTTSEILLNKLNDEKQMQMRIISAKDHGDSFRTLESGRAVAFMMDDALLAGERAKAKKPDQWIIVGKPQSEEAYGCMLRKNDPQFKKLIDGTIVKVQTSGEAEKLFDLWFKQPIPPKKLNMNFSMSDEMKTLFKSPNDKALN

SEQ ID NO: 8743 - protein, 41 aa, Xenorhabdus bovienii
  Coding DNA sequence: Name=SeqID_2635
MFLFRDLPRTINKQFYLCTIKEKIILNSVHSLCFLGQYIYF

SEQ ID NO: 8744 - protein, 530 aa, Xenorhabdus bovienii
  Coding DNA sequence: Name=SeqID_2636
  Gene classification: Gene name=Lnt; Function=Apolipoprotein N -acyltransferase; Function class=M Cell envelope biogenesis, outer membrane
  Homolog annotation: Query=24..529bp; Hit=4..510bp; Blast score=626; Percent Identity=64.0; E value=1e-179; Homolog= lnt COG0815
MSKYRMMLTFLALINNNRIWMNKASLLSCQRLRALLALFLGASGTLAFSPFGFWPAAFLSLFGLQILTLNRTTRQSLFIGFCWGFGLFGSGTNWVYVSIANFGGMPTVVNIFLVILLSTYLALYPTLFAGLLNRFFPAANGIRLVVASPALWQLTEFLRGWVLTGFPWLQFGYSQIDGPMKAIAPILGVEGITFLILMISGLLVLATIRKKLSLALAAVILLLLPWPMRYYQWYTLLPDKSADIALVQGNIPQVIKWNPSELENTLDIYLNNSRPFIGKIPIIIWPESAITAYEITQGSFLTELDSLLRQRNTRLITGIPDARPTLEGYKFYNSIIVLGDKTPYRYPASIRYDKHHLVPFGEFVPLESILRPLAPFFNLPMSSFNRGDYIQPQLSVAGHNITAAICYEIILGEQVRDNFKPDTEFLLTISNDAWFGRSIGPWQHFQMARMRSLELGRPLLRGTNNGITAVIRPDGSIQAKLPQFTRQVLEAKVTPASGSTPYFRFGYWPIWGLALLFIGFGLISSNRRRT

SEQ ID NO: 8745 - protein, 300 aa, Xenorhabdus bovienii
  Coding DNA sequence: Name=SeqID_2637
  Gene classification: Function=Hemolysins and related proteins containing CBS domains; Function class=N Cell motility and secretion
  Homolog annotation: Query=9..299bp; Hit=1..292bp; Blast score=425; Percent Identity=81.0; E value=1e-119; Homolog= ybeX COG1253
MGNFHSNAMSDDHPSNNDSPGPKKGFLALLNQLFHGEPKNRHDLVELIRDSEQNDLIDPDTREMLEGVMDIADQRVRDIMIPRSQIVTLKRNQPLDECLDVIIDSAHSRYPVISEDKDHIEGILMAKDLLPFMRTNAEPFSIDKVLRQAIVVPESKRVDRLLKEFRSQRYHMAIVIDEFGGVSGLVTIEDILELIVGEIEDEYDDDEDNDIRALSRHTYSVRALAQIEDFNDVFGTNFSDEEVDTIGGLVMQAFGHLPSRGESIDINGYLFKVAMADSRKIIQVHVKIPDDADVPGLDKQ

SEQ ID NO: 8746 - protein, 155 aa, Xenorhabdus bovienii
  Coding DNA sequence: Name=SeqID_2638
  Gene classification: Function=Predicted metal-dependent hydrolase; Function class=R General function prediction only
  Homolog annotation: Query=1..155bp; Hit=1..155bp; Blast score=212; Percent Identity=75.0; E value=1e-55; Homolog= ybeY COG0319
MNSVILDLQIACKNPEGLPDEALFQRWLESVLPQFQAESEVTIRLVDEAESHDLNLTYRGKDKPTNVLSFPFEAPPEVELPLLGDLIICRQVVEQEAEEQQKTVEEHWAHMVIHGSLHLLGYDHIEDDEAEEMESLETEILQKMGYADPYLAEKE

SEQ ID NO: 8747 - protein, 348 aa, Xenorhabdus bovienii
  Coding DNA sequence: Name=SeqID_2639
  Gene classification: Gene name=PhoH; Function=Phosphate starvation -inducible protein PhoH, predicted ATPase; Function class=T Signal transduction mechanisms
  Homolog annotation: Query=8..348bp; Hit=16..356bp; Blast score=556; Percent Identity=85.0; E value=1e-158; Homolog= ybeZ COG1702
VTQINSQVATQEIFLEPADNQRLMSLCGPLDDNLKQLERRLGIEISRRDNRFKLVGKPLCVSAVAGILRHLYVETAPVRSVIPVLEPEQIHLAITESRVLEQSAESIPDYGKAVNIKTKRGVVKPRTPNQAQYIANILDYDITFGIGPAGTGKTYLAVAAAVDSLERQEIRRILLTRPAVEAGEKLGFLPGDLSQKVDPYLRPLYDALFEMLGFEKVEKLIERNVIEVAPLAYMRGRTLNDAFIILDESQNTTIEQMKMFLTRIGFNSKAVITGDVTQIDLPRGQKSGLSHAVEVLSEVDELSFNFFHSEDVVRHPVVAKVVIAYEAWESAEQKRKQELNDKRKQEAQ

SEQ ID NO: 8748 - protein, 476 aa, Xenorhabdus bovienii
  Coding DNA sequence: Name=SeqID_2640
  Gene classification: Gene name=MiaB; Function=2-methylthioadenine synthetase; Function class=J Translation, ribosomal structure and biogenesis
  Homolog annotation: Query=5..476bp; Hit=3..474bp; Blast score=832; Percent Identity=84.0; E value=0; Homolog= yleA COG0621
MSTIKKLYIKTWGCQMNEYDSSKMADLLETTHGYQLTDVAEEADILLLNTCSIREKAQEKVFHQLGRWKGLKDKNPEIIIGVGGCVASQEGDFIRQRAPSVDIIFGPQTLHRLPEMINHVKGTHSPIVDISFPEIEKFDRMPEPRAEGPSAFVSIMEGCNKYCTFCVVPYTRGEEVSRPCDDILFEIAQLAAQGVRDVNLLGQNVNAYRGATFDGDICTFAELLRLVAAIDGIDRIRFTTSHPIEFTDDIIEVYEDTPELVSYLHLPVQSGSDRILTQMKRAHTALEYKGIIRRLRKARPDILISSDFIIGFPGETQDDFEKTMQLIADVNFDMSFSFIYSARPGTPAADLPDDVSEEEKKQRLYLLQQRINQQAMSFSRAMVGSTQRILVEGTSRKNIMELSGRTENNRVVNFEGTPDMIGKFVDAEIVDVYANSLRGKIIRTEDEMNLRIHESPESVIARTRKEDEIGVGIYQP

SEQ ID NO: 8749 - protein, 67 aa, Xenorhabdus bovienii
  Coding DNA sequence: Name=SeqID_2641
LYESQSRRCTNHTRTHDDDIEFLLWIIHIHHAINFLIKIVYRNFPFPAVNIRCYSLVTGASNDYNSL

SEQ ID NO: 8750 - protein, 397 aa, Xenorhabdus bovienii
  Coding DNA sequence: Name=SeqID_2642
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=8..397bp; Hit=4..391bp; Blast score=471; Percent Identity=61.0; E value=1e-133; Homolog= ubiF COG0654
MNMNNPQQKFDIVVVGAGMVGAATALGLVQEGWRVALLEHQPPQPYDEGNEPDLRVSAISCASVDLLKQLGVWNHVLRMRSAPYRKLETWEQHDSNVTFDAQSLGLTELGYMVENRILQLALWQEFERYPNLTLFCPAALKSMQRQNAHQMWQITLTDGTEMNARLIIGADGARSQVRQLAGIGSNGWQYQQSCMLITVKTEQPQQDTTWQQFFPSGPRAFLPLFDQWASLVWYDSPARIRQLQSMTMVQLEREIFQAFPSRLGKVTPIAVGSFPLTRHHASHYVREGLALLGDAAHTINPLAGQGVNLGYRDVEVLLKVLINAKELQEEWDSQAVLMRYQRRRMPDNLVMQAGMDLFHTAFSHDLPGLKTMRNLVLMAAQRSGAMKKLALKYALGL

SEQ ID NO: 8751 - protein, 127 aa, Xenorhabdus bovienii
  Coding DNA sequence: Name=SeqID_2643
MILVSPSSNLTNAEPVQRNHRLFSLDSTINCAIPSYSIRPEPDFVAIQALSLQNHFLSPSTDPFELLQINYNPNAYFSASFFIAPERCAAISTKFRMVFNPGKSWLNAVWKRSIPACITKLSGILRR

SEQ ID NO: 8752 - protein, 31 aa, Xenorhabdus bovienii
  Coding DNA sequence: Name=SeqID_2644
LTMEILISYFVVSLSPYEKCSIFRISIGIGS

SEQ ID NO: 8753 - protein, 121 aa, Xenorhabdus bovienii
  Coding DNA sequence: Name=SeqID_2645
  Gene classification: Gene name=SoxR; Function=Predicted transcriptional regulators; Function class=K Transcription
  Homolog annotation: Query=1..116bp; Hit=1..117bp; Blast score=82; Percent Identity=37.0; E value=9e-17; Homolog= DR1111 COG0789
MKIKELSSKTGVSARMIRYYEEQGLLKPDRTNSGYRRFTSKDLITIRSIQSLQEAGLTLDAVRVLMPCIVSEPIKLSPCPLIIATLKQHRDKIRADLNKNTRALSLLDQFISDVTIFSTNV

SEQ ID NO: 8754 - protein, 33 aa, Xenorhabdus bovienii
  Coding DNA sequence: Name=SeqID_2646
MLVSFFKTQIKKVCYIIFFSKKLACFSCQSWFL

SEQ ID NO: 8755 - protein, 31 aa, Xenorhabdus bovienii
  Coding DNA sequence: Name=SeqID_2647
VFLMPVMVFIISSVVDLLAKSILILAFLANF

SEQ ID NO: 8756 - protein, 402 aa, Xenorhabdus bovienii
  Coding DNA sequence: Name=SeqID_2648
  Gene classification: Gene name=AraJ; Function=Arabinose efflux permease; Function class=G Carbohydrate transport and metabolism
  Homolog annotation: Query=13..369bp; Hit=4..359bp; Blast score=159; Percent Identity=30.0; E value=5e-39; Homolog= PA4113 COG2814
MSIEENDCQGAVTKPVRKTSWFSIIILSLAAIIFVTAELLPIGVLHEIGNTYNKSAGNIGLIVTGYAWVVALSAISATSFFMKVEKKKLVIGILLAFSISNLIVSFAPNLFWLYIGRVIGAFFHGVFWSIVGPLAVRLVPDSGKAKATSLVFGGIAIASVAVVPIATFVSQNIGWRLSFISLAIMGLLITIAALFSMPKVHQADASKKIAIKEIITQPYLRRTFPVTALALSGNYCAFTYISPLLENRAGISHEQLPFFLLLFGMFGVIGNIISGFITNSRLVAATRAILAVLIISVIGIGYFSEGNVALTYSFIAMWGIGICLLTVTLQSLVLNLATDTGERASSVHVAMFNTGIGSGAFIGGILIDRFNTETTALTGGILLTIAFVILIPQIKLNNNSSS

SEQ ID NO: 8757 - protein, 38 aa, Xenorhabdus bovienii
  Coding DNA sequence: Name=SeqID_2649
LGDVYSLVDWLFKSDKRGEFLPFHNFLLFFSVRVERRA

SEQ ID NO: 8758 - protein, 71 aa, Xenorhabdus bovienii
  Coding DNA sequence: Name=SeqID_2650
MQKATERWLFAFLPSKYQHLKIHFKAHQAIICLKGSHLALTNYLLLPLFLWRILGSPLYTHRKEKQEIVER

SEQ ID NO: 8759 - protein, 461 aa, Xenorhabdus bovienii
  Coding DNA sequence: Name=SeqID_2651
  Gene classification: Gene name=AnsP; Function=Gamma-aminobutyrate permease and related permeases; Function class=E Amino acid transport and metabolism
  Homolog annotation: Query=1..445bp; Hit=1..445bp; Blast score=603; Percent Identity=75.0; E value=1e-173; Homolog= ZyifK COG1113
MSDSKQSLQRGLEARHIELIALGGTIGVGLFMGSASTLKWAGPSVLLAYIIAGIFVFFIMRSMGEMLFLEPVTGSFAAFGHKYLSPYWGCLTAWGYWFMWVSVGISEITAVGVYAEFWFPDLPQWVSALVAVGLVALANLAAVRLYGELEFWFAMIKVTTIIVMILIGIGLIFFGLGNDWQPIGLDNLTAHGGFFSGGWKGFLFALCIVVASYQGVELVGITAGEAKNPQVTLKKAINNILWRILIFYVGAIFIVVTLFPWTEAGTHGSPFVMVFSKVGIASAAAVINFVVLTAALSGCNSGMYSGGRMLYALAKNRQLPASLLKLSKNGVPVRCIAITIGCLIVGSTLNYLIPNPQSVFVYVYSASVLPGMVPWFVILVSQLRFRQQNQEALKQHRFKSLLFPYVNYLTLVFLSCVLIGMAINPDTRFSLMVGGAFLLFVSLAYWLGKFICGKTQNSSLD

SEQ ID NO: 8760 - protein, 245 aa, Xenorhabdus bovienii
  Coding DNA sequence: Name=SeqID_2652
  Gene classification: Gene name=WecG; Function=Teichoic acid biosynthesis proteins; Function class=M Cell envelope biogenesis, outer membrane
  Homolog annotation: Query=7..245bp; Hit=8..246bp; Blast score=348; Percent Identity=73.0; E value=2e-96; Homolog= wecG COG1922
MTLNNIPKYRIRGLSLWGFRGMSHFLDHLFQDGQVKTGTLVAINAEKVLTAEKDNALNILLDEAEYLYADGISIVRAIRRKYPDAHVSRIAGADLWEALMERAGREGTPVFLVGGKPDVLAQTENKLRSQWNVNIVGSQDGYFTQEGRDAVFERIHASGAAIVSVAMGSPKQEIFMRDCRKVYSGALYMGVGGTYDVFTGHVKRAPKIWQNLGLEWLYRLLSQPSRIRRQIKLLKFLGYYYGGKL

SEQ ID NO: 8761 - protein, 398 aa, Xenorhabdus bovienii
  Coding DNA sequence: Name=SeqID_2653
  Homolog annotation: Query=1..376bp; Hit=433..796bp; Blast score=547; Percent Identity=75.0; E value=1e-154; Homolog= gb|AAA67593.1|
MLASGCFYAIYYVSYKTRLSYKTPARKTASFSTPSSVVSRRPLFTMNRVETNLTWLLLASIAIFTVGSFFMQNGFLLFKLQSYSQIFSNQVSGVALKRFFYFFIPAMLVVFFLKPTKTRWLCFLVATVGFGILTYVIVGGTRANIILAFALFLFIGIVRGWITLWMLLLAGVIGVVGMFWLALKRYGLDVSGSEAFYTFLYLTRDTFSPWENLALLLDNYDKIDFQGLAPIARDFYVFIPSWMWPDRPNLILNTANYFTWDVLDNHSGLAISPTLIGSLVVMGGVFFIPFGAIVVGLIIKWFDWVYEAGKQEVSRYKAAILQAFCFGAIFNIIVLAREGMDSFVSRVVFFCLIFGLCLVVAKLLYWLFESVGLVRKFVISNVPASQKISTIADVKEEK

SEQ ID NO: 8762 - protein, 320 aa, Xenorhabdus bovienii
  Coding DNA sequence: Name=SeqID_2654
  Homolog annotation: Query=1..319bp; Hit=40..359bp; Blast score=457; Percent Identity=67.0; E value=1e-127; Homolog= ref|NP_931815.1|
MVVSKDHTWLSNYPALAITVYGSKAALARAVIEKAQADRKTRFFFHGQFNAALWLALLVGKIKRHQFWWHAWGADLYEDSRQLKFRLFYQLRRLAQKRVGQVFATHGDLQYFSQSNPNVPSTLLYFPTRMEPSLTVTEKTCPSEGITILLGNSGDQSNRHIEALNKIHGQFGDEVRVIMPMGYPGDNQAYVQCVEHTALSLFRAENVHMLKNKMAFDDYLSLLRQCDLGYFIFNRQQGVGTLCLLIQFGIPFVLSRQNPFWHDLTEQQIPVLFDGDELNKHWVQEAQRQMLSLDKKAIAFFDPNFIEGWKAALSAALGEY

SEQ ID NO: 8763 - protein, 416 aa, Xenorhabdus bovienii
  Coding DNA sequence: Name=SeqID_2655
  Gene classification: Gene name=RfbX; Function=Membrane protein involved in the export of O-antigen and teichoic acid; Function class=R General function prediction only
  Homolog annotation: Query=1..416bp; Hit=1..416bp; Blast score=526; Percent Identity=72.0; E value=1e-149; Homolog= wzxE COG2244
MSLAKASVWTAGSTLIKIGVGLLVIKLLAVSFGPAGVGQAGNFRQLITVLGVLSGAGIFNGVTKYVAEHHQQPEKLRAILGTSSSIILGFSTLLAVIFLLFTDAISIGLFGHNNYKTVVQALAFIQMGIAYANYFLAILKGFRDAQGNALSIILGSLTGMIAYGLCYWLGGYEGALAGLALVPALVVLPAGLMILRSKVITFSALKPMWDRVIASHLGKFTLMALLTSMTLPVAYIMMRNLMAERYSWEEVGIWQGVSSISDAYLQFITASFTVYLLPTLSRLESKQEITGEIVKALKFVLPAVAAASFSVWLLRDFVIWLLFSDKFTAMRDLFAWQLVGDVLKVGAYVFGYLVIAKAALRFYVLTEISQFLLLTGFSHWLIPENGALGAAQSYMATYIIYFILCCSVFIIYRRRA

SEQ ID NO: 8764 - protein, 388 aa, Xenorhabdus bovienii
  Coding DNA sequence: Name=SeqID_2656
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=13..388bp; Hit=1..376bp; Blast score=615; Percent Identity=74.0; E value=1e-176; Homolog= wecE COG0399
LRAPHIGYTEDEMIPFNKPPVVGTELEYMQQAMGSGKLCGDGHFTKRCEEWMEQHFNCLKVLLTPSCTAALEMAAILLNIQPGDEIIMPSYTFVSTSNAFVLRGATIVFVDIRPDTMNMDETKIEAAITDKTRAIAPVHYAGVACEMDVIMALAEKYNLYVVEDAAQGVMSTYKGRALGTIGHIGCFSFHETKNYSSGGEGGAILINDESMIARAEIIREKGTNRSQFFRGQVDKYTWRDIGSSYLLSDLQAAYLWGQLEIAENINQRRLSLWDNYYQALQPFAEAGHLTLPVVPEGLEHNAHMFYIKLKGVEERGAFNRYMQEANILTVFHYVALHTSPAGEKCGRFHGEDRFTTSDSERLVRLPMFYNITDEEQQVVINRIKEFFA

SEQ ID NO: 8765 - protein, 242 aa, Xenorhabdus bovienii
  Coding DNA sequence: Name=SeqID_2657
  Gene classification: Gene name=WecD; Function=Histone acetyltransferase HPA2 and related acetyltransferases; Function class=K Transcription
  Homolog annotation: Query=44..241bp; Hit=1..181bp; Blast score=168; Percent Identity=47.0; E value=6e-42; Homolog= wecD COG0454
MSIRANIESLAWDSQFFGLPTARLNFSLQASVLTTAQLDEYALVQAKVPAQQMDTIDGLSALGFSLVEGEADFLLPVDSGAMRCRNATGIQSKQALISATPQDIPVLTAAAASVFKASRFRAPWYQPDDSGRFYAAWVEKAVLGTFDHECLLVNDEYGQIIGFVTLRDIGSHEARIGLLAALPGNYHRGIGKKLMSAAQRWCENHQIQRLRVATQISNITALRLYTRSGATIESTAYWLYRG

SEQ ID NO: 8766 - protein, 291 aa, Xenorhabdus bovienii
  Coding DNA sequence: Name=SeqID_2658
  Gene classification: Gene name=RfbA; Function=dTDP-glucose pyrophosphorylase; Function class=M Cell envelope biogenesis, outer membrane
  Homolog annotation: Query=1..291bp; Hit=1..291bp; Blast score=485; Percent Identity=81.0; E value=1e-137; Homolog= rffH COG1209
MKGIILAGGSGTRLYPITRGVSKQLLPIYDKPMIYYPLSVLMLAGIRDILIISTPEDLPAFKRLLGSGEQFGIRLSYAVQPSPDGLAQAFIIGEEFIGNDACCLVLGDNIYFGQAFSPKLQSVVARQTGATVFGYQVMDPERFGVVEFDEQYRVLSIEEKPAQPKSNWAVTGLYFYDNKVVDLAKQVKPSVRGELEITSINQMYLECGELNVELLGRGFAWLDTGTHDSLIEASTFVQTVEKRQGFKIACLEEIAWRHGWLNDEQLKAAAANLAKTGYGKYLMDLLHVYSR

SEQ ID NO: 8767 - protein, 356 aa, Xenorhabdus bovienii
  Coding DNA sequence: Name=SeqID_2659
  Gene classification: Gene name=RfbB; Function=dTDP-D-glucose 4,6 -dehydratase; Function class=M Cell envelope biogenesis, outer membrane
  Homolog annotation: Query=1..353bp; Hit=1..353bp; Blast score=597; Percent Identity=79.0; E value=1e-171; Homolog= ZrffG COG1088
LKRILITGGAGFIGSAVVRHIINHTEDSVVVVDSLTYAGNLESLSSVVDHPRYAFEQVDICQRDALDRVFQQYQPDAVMHLAAESHVDRSIDGPAAFIETNIIGTYVLLEASRAFWQQLDQEKQAAFRFHHISTDEVYGDLHGDEGFFTENTPYAPSSPYSASKASSDHLVRAWRRTYGLPTVITNCSNNYGPYHFPEKLIPLIILNALAGKPLPVYGKGEQIRDWLYVEDHARALHLVATTAEPGETYNIGGHNERRNIDVVETICELLEELRPIKPAGIVCYRDLITHVADRPGHDMRYAIDAAKIERELGWTPQETFESGIRKTVQWYLENENWWRRVQDGSYAGERLGLANE

SEQ ID NO: 8768 - protein, 420 aa, Xenorhabdus bovienii
  Coding DNA sequence: Name=SeqID_2660
  Gene classification: Gene name=WecC; Function=UDP-N-acetyl-D -mannosaminuronate dehydrogenase; Function class=M Cell envelope biogenesis, outer membrane
  Homolog annotation: Query=1..420bp; Hit=1..420bp; Blast score=677; Percent Identity=78.0; E value=0; Homolog= ZwecC COG0677
MSFETISVIGLGYIGLPTAAAFASRKKNVIGVDVNQHAVETINRGAIHIVEPDLDKVVKTAVEGGYLKAVTCPQPADAFLIAVPTPFKGEHEPDMAYVRSAAESIAPVLKKGDLIILESTSPVGATEQMAEWLAAARPELSFPQQAGENADIDIAYCPERVLPGQVMVELIKNDRVVGGMTLKSSRRASELYKIFLEGECVVTNAKTAEMCKLTENSFRDVNIAFANELSLICAEQGINVWELISLANRHPRVNILQPGPGVGGHCIAVDPWFIVSQNPAQSRLIHTARLVNDGKPLWVVDQVKAAVADCLVESGKRADEIKIACFGLAFKPNIDDLRESPAVYITKMVAQWHVGQTVAVEPNVHQLPNSLKDRVELVDIQQALNEADVVLMLVDHSQFKAIAGREIKQKWVVDTKGVWR

SEQ ID NO: 8769 - protein, 376 aa, Xenorhabdus bovienii
  Coding DNA sequence: Name=SeqID_2661
  Gene classification: Gene name=WecB; Function=UDP-N-acetylglucosamine 2-epimerase; Function class=M Cell envelope biogenesis, outer membrane
  Homolog annotation: Query=1..376bp; Hit=15..390bp; Blast score=603; Percent Identity=79.0; E value=1e-172; Homolog= ZwecB COG0381
VKVLTVFGTRPEAIKMAPLVHALAKDAAFDAKVCVTAQHREMLDQVLHLFEITPDFDLNIMKKGQDLTDITCRILEGMKPVLEEFKPDVVLVHGDTATTMATSLAAFYQRIPVGHIEAGLRTGDLYSPWPEEANRKIAGHLAMYHFAPTENSQNNLLKESIAGSSIFVTGNTVIDALLWVRDRIVSDDALSGQLAKLYPFIDPNKKMILVTGHRRESFGGGFERICEALAQVARAHREVQVVYPVHLNPNVSEPVKRILHDIDNVILINPQDYLPFVYLMNHAYMILTDSGGIQEEAPSLGKPVLVMRDTTERPEAVDAGTVRLVGTKTQTIVEEVTRLLTDDIAYQQMSRAHNPYGDGQACQRILEALRKNQVTL

SEQ ID NO: 8770 - protein, 351 aa, Xenorhabdus bovienii
  Coding DNA sequence: Name=SeqID_2662
  Gene classification: Function=Chain length determinant protein; Function class=M Cell envelope biogenesis, outer membrane
  Homolog annotation: Query=16..348bp; Hit=15..346bp; Blast score=411; Percent Identity=60.0; E value=1e-115; Homolog= ZwzzE COG3765
VINSETKSKQDQSVIEHELDIRALCHALWRGKIWIIALAMIFAAVALGASYLMQQKWSATAIVDLPTTNDLGSYYSQQQFLRNLDTHINASPEAQLPTISDGAYKEFITQVVAYDTRREFWLQSDYYKQYREGNEKADAVLLEELINTIQVLRRDDKKLPNEVIKLTAETAVNANQFLREYMAFANQRASTHLNNEIKGAWATRIQSMKALVKRQEMVAKAMYSRKLNVLQQSLKIAEKQGINRNQTDTPIEELPESQMFMMGAPLLQSQIETLEVTGPNYSIDYDQNIAMLATLNVGPTLQNTFQTYRYLRTPEVPVNRDTPRRVFMMIMWGAIGLLVGAGVALTRRSHT

SEQ ID NO: 8771 - protein, 344 aa, Xenorhabdus bovienii
  Coding DNA sequence: Name=SeqID_2663
  Gene classification: Gene name=Rfe; Function=UDP-N-acetylmuramyl pentapeptide phosphotransferase/UDP-N- acetylglucosamine-1-phosphate transferase; Function class=M Cell envelope biogenesis, outer membrane
  Homolog annotation: Query=1..331bp; Hit=19..349bp; Blast score=454; Percent Identity=78.0; E value=1e-128; Homolog= Zrfe COG0472
VFLFLARKVAKIIGLVDKPNYRKRHHGLIPLVGGISVFFGVCFAFAITKEFIPHKWLYLACAGILVFVGALDDRFDISVKIRAAIQALVGISMMYFADLKIESLGSAFGPWEMTLGPFSYVVTLFAVWAAINAFNMVDGIDGLLGGLSSVSFGALGILLYANGNTALAFWCFAFIAGILPYIFLNLGLLGKRFKVFMGDAGSTLIGFTIIWLLTETTQGEHSSVNPVTALWIIAIPLMDMVAIMYRRLRKGMSPFSPDRQHIHHLIMRAGFTSRQAFILITVAAALLASIGIIGEQLSFVPEWVMLALFLLAFMLYGYCIKRAWRVARFIKRCKRRMRRAVSHH

SEQ ID NO: 8772 - protein, 419 aa, Xenorhabdus bovienii
  Coding DNA sequence: Name=SeqID_2664
  Gene classification: Gene name=Rho; Function=Transcription termination factor; Function class=K Transcription
  Homolog annotation: Query=1..419bp; Hit=1..419bp; Blast score=789; Percent Identity=96.0; E value=0; Homolog= rho COG1158
MNLTELKNTPVSELITLGENMGLENLARMRKQDIIFSILKQHAKSGEDIFGDGVLEILQDGFGFLRSGDSSYLAGPDDIYVSPSQIRRFNLRTGDTISGKIRPPKEGERYFALLKVNEVNFDKPENARNKILFENLTPLHANNRLRMERGNGSTEDLTARVLDLAAPIGRGQRGLIVAPPKAGKTMLLQNIAANIANNYPDCVLMVLLIDERPEEVTEMQRLVKGEVIASTFDEPASRHVQVAEMVIEKAKRLVEHKKDVIILLDSITRLARAYNTVVPASGKVLTGGVDANALHRPKRFFGAARNVEEGGSLTIIATALVDTGSKMDEVIYEEFKGTGNMELHLSRKIAEKRVFPAIDYNRSGTRKEELLTTQDELQKMWILRKIIHPMGEADAMEFLINKLAMTKTNEEFFDFMKRS

SEQ ID NO: 8773 - protein, 77 aa, Xenorhabdus bovienii
  Coding DNA sequence: Name=SeqID_2665
MLNIETLSAPSYIPNDSRIYALKYFAKCDMPSDTSDEPEITDLSDTTDCLVCNTLNVNSLYKLKNPLMQCFIQAHDC

SEQ ID NO: 8774 - protein, 113 aa, Xenorhabdus bovienii
  Coding DNA sequence: Name=SeqID_2666
  Gene classification: Gene name=TrxA; Function=Thiol-disulfide isomerase and thioredoxins; Function class=O Posttranslational modification, protein turnover, chaperones
  Homolog annotation: Query=3..113bp; Hit=16..126bp; Blast score=154; Percent Identity=65.0; E value=2e-38; Homolog= trxA COG0526
MNEKIISDRIIHLADADFDAKKLNVKGAVLVEFWAEWCGPCKMIAPILDEVSEEYAGKLTVAKLNVDDHEQAPKAHGIRGIPTLILFKDGEKAATQVGALSKTQLKAFLDSHI

SEQ ID NO: 8775 - protein, 427 aa, Xenorhabdus bovienii
  Coding DNA sequence: Name=SeqID_2667
  Gene classification: Gene name=SrmB; Function=3 Superfamily II DNA and RNA helicases; Function class=L DNA replication, recombination and repair
  Homolog annotation: Query=1..427bp; Hit=1..421bp; Blast score=730; Percent Identity=83.0; E value=0; Homolog= rhlB COG0513
MSKTHLTEKKFSDFALHPKVIEALDKKGFSNCTPIQALTLPFTVEGRDVAGQAQTGTGKTLAFLTSTFHYLLTHPAAADHKTNQPRALIMAPTRELAVQIYSDAEELAEATGLKMGLAYGGDGYDKQLKVLESGVDIVIGTTGRLIDYTKQGYVNLNAVQVVVLDEADRMYDLGFIKDIRWLFRRMPVAAQRMNLLFSATLSYRVRELAFEQMNSPEYVEVEPLQKTGHRIQEELFYPSNEEKMRLLQTLLEEEWPDRCIIFANTKHRCEDIWAHLAADGHRVGLLTGDVAQKKRLRILEEFSLGNLDILVATDVAARGLHIPLVTHVFNYDLPDDCEDYVHRIGRTGRAGESGHSISLACEEYALNLTSIEEYIQHQIPVSKYNSDALLMDLPVPKRRNRARSGGHPRRTNMSRRGNPTRNRKHPG

SEQ ID NO: 8776 - protein, 502 aa, Xenorhabdus bovienii
  Coding DNA sequence: Name=SeqID_2668
  Gene classification: Gene name=GppA; Function=Exopolyphosphatase; Function class=F Nucleotide transport and metabolism
  Homolog annotation: Query=1..491bp; Hit=1..491bp; Blast score=687; Percent Identity=72.0; E value=0; Homolog= ZgppA COG0248
MLSSSSLYAAIDLGSNSFHMLVVREVSGSIQVVTRIKRKVRLATGLDKNNHLSQQAMERGWQCLRLFSEYLQDIPASQIRVVATATLRLAVNSADFVGKASEILGSPVKVISGEEEARLIYQGVAHTTGGSEKRLVVDIGGGSTELVTGTGAKANQLFSLEVGCVTWLERYFNDRSLTEENFAQAESAAHHILAPITTTLLKQGWQICVGASGTVQALQEIMIAQGMDELITLPKLQQLKYKAIECGKLEELEIDGLTLERALVFPSGLAILIAIFQALNIESMILAGGALREGLVYGMLDLPIEQDIRTRTLCNIQHRFQLDIEQALRVKQLAEHFCQQVATVWNLDARCRDLLTSACLLHEIGLCVDFRQGPAHSAYLISHLDLPGYTPAQKRLLATLLNNQSGPVDLASLSQQNALPPLQAQQLCRLLRLAIIFASRRQDDTLPALRLRVENETLTITLPYQWQMQHPLRAEALHQEIQWQSYIQWTLFLEEQNNSHLG

SEQ ID NO: 8777 - protein, 676 aa, Xenorhabdus bovienii
  Coding DNA sequence: Name=SeqID_2669
  Gene classification: Gene name=UvrD; Function=Superfamily I DNA and RNA helicases; Function class=L DNA replication, recombination and repair
  Homolog annotation: Query=1..667bp; Hit=1..667bp; Blast score=1085; Percent Identity=81.0; E value=0; Homolog= Zrep COG0210
MRLNPSQQQAVEFVTGPCLVLAGAGSGKTRVITNKIAHLIRACGYQARHIAAVTFTNKAAREMKERVAQTLGRKETRGLMISTFHTLGLEIIKREYKALGMKSNFSLFDDQDQRVLLKDLTADLLEEDKDLLQKLNSSISNWKNDLMSPEQVIRQARSAQEHQFAECYRRYDLHLNSCNVLDFDDLITKPTLLLMQNEEVRERWQNKIRYLLVDEYQDTNTSQYQLVKLLVGNRARFTVVGDDDQSIYSWRGARPQNLILLNEDFPQLNVIKLEQNYRSSGRILKAANILIANNPHVFEKKLFSELGYGDPLRVIEANNEDHEAERVVGELIAHHFINKTEYKDYAILYRGNHQSRIFEKMLMQNRIPYRISGGTSFFSRPEIKDLLSYLRVLTNPDDDSAFLRIVNTPRREIGAVTIQKLGEWANQRNKSLYHASFDLGLEQSLTGRGLAALQHFTHWMDEISRQAEREPLLAVRDLLRGMDYESWLYETSPSPKAAEMRMKNVNQLFTWMSEMFEGDDLNEPMTLSQVVARFTLRDMLERGENDEELDQVQLMTLHASKGLEFPYVFLVGMEEGLLPHQSSIDENNIDEERRLAYVGITRARRELFFTLSKERRQYGELIRPEPSRFLLELPQDDLHWPRGKKMISAEDRMKQGQSRLADIKSRLGLGQKNSDK

SEQ ID NO: 8778 - protein, 322 aa, Xenorhabdus bovienii
  Coding DNA sequence: Name=SeqID_2670
  Gene classification: Gene name=AcuC (BS); Function=Deacetylases, including yeast histone deacetylase and acetoin utilization protein; Function class=T Signal transduction mechanisms
  Homolog annotation: Query=1..322bp; Hit=49..370bp; Blast score=427; Percent Identity=64.0; E value=1e-119; Homolog= PA3774 COG0123
MKSLMDVSGLSHSLELMSAEPIDEATLRLVHTESYLQRFKYLSDNGGGTLGSEASLGAGSYEIAKLSAGLTYAAVKAVLQDELDNAYSLSRPPGHHCLPDQAMGFCFLANISLAIEKAKEQLGLGRVAVVDWDVHHGNGTQHIFWQRDNVLTISLHQDRCYPAGYSGESDIGEGPGEGFNINIPLMAGAGHDSYMYAMDQIVIPALRRYQPELIIIACGYDANGFDPLARMQLHSDSFREMTRKMQQMADELCHGKLVMVHEGGYSEAYVPFCGLAVMEELSGVRTEVIDPALAMMELQQPRAHFETLQRQAIDDLKQQLSL

SEQ ID NO: 8779 - protein, 492 aa, Xenorhabdus bovienii
  Coding DNA sequence: Name=SeqID_2671
  Gene classification: Gene name=IlvC; Function=Ketol-acid reductoisomerase; Function class=E Amino acid transport and metabolism
  Homolog annotation: Query=1..492bp; Hit=1..491bp; Blast score=846; Percent Identity=87.0; E value=0; Homolog= ilvC COG0059
MANYFDTLNLRQQLAQLGKCRFMVREEFADEAGYLKGKKVVIVGCGAQGLNQGLNMRDSGLDIVYALRQAAIEEKRASWRKATENGFKVGTYEELIPQADLVINLTPDKQHSAVVQAVQPLMKEGAALGYSHGFNIVEVGEQVRKDITVVMVAPKCPGTEVREEYKRGFGVPTLIAVHPENDVKGEGMAIAKAWAAATGGHRAGVLESSFVAEVKSDLMGEQTILCGMLQAGSLLCYDKLVAEGTEPGYAGKLIQFGWETITEALKQGGITLMMDRLSNSAKLRAYALSEQLKVILAPLFQKHMDDIISGTFSSTMMADWANDDKNLLTWRAETGQTPFENYPDHSGNISEQEYFDHGVLMIAMVKAGVELAFETMVDAGIIEESAYYESLHELPLIANTIARKRLYEMNVVISDTAEYGNYLFSHVAVPLLKEKFMATLQAGDMGKPVVDSSIDNAQLRDVNEAIRHHPIETIGRTLRGYMTDMQRIAVGG

SEQ ID NO: 8780 - protein, 293 aa, Xenorhabdus bovienii
  Coding DNA sequence: Name=SeqID_2672
  Gene classification: Gene name=LysR; Function=Transcriptional regulator; Function class=K Transcription
  Homolog annotation: Query=1..293bp; Hit=1..293bp; Blast score=394; Percent Identity=69.0; E value=1e-110; Homolog= ilvY COG0583
MDIRDLKLFLHLAESCHFGRTAKAIHVSPSTLSRQIQRLEELLGHPLFLRDNRTVKLTFAGEQLKQFAQQTLLQYQQLRHSLNHQSPSLSGELRLFCSVTAAYSHLPQVLDKFRAEHPLVEIKLTTGDAAGAVDRIQSDQADLGIAGKPEKLPHNVSFTKIGEIPLVLIAPSLPCAVRTLATQEQPDWNSIPFILPEHGPSRTRIELWFRRNKIPNPLIYATVSGHEAIVSMVALGCGIALIPAVVVENSPEPVRNRISLLENIALVEPFELGVCTLSKRLQEPLVKAFWGML

SEQ ID NO: 8781 - protein, 515 aa, Xenorhabdus bovienii
  Coding DNA sequence: Name=SeqID_2673
  Gene classification: Gene name=IlvA; Function=Threonine dehydratase; Function class=E Amino acid transport and metabolism
  Homolog annotation: Query=5..514bp; Hit=6..512bp; Blast score=793; Percent Identity=78.0; E value=0; Homolog= ilvA COG1171
VAVYPLNAEPKGAEYLKAALSAPVYDVAQVTPLQEMEKISARLANTILVKREDRQLVHSFKLRGAYTMIAGLTEEQKAKGVITASAGNHAQGVALSASKVGTRAIIVMPIATADIKVDAVRSFGGEVLLYGANFDEAKAKAISVAKEHGYTFVPPFDHPAVIAGQATLAMELLQQDVHLDRIFVPVGGGGLIAGVAVLIKQLVPEMKVIGVEAEDSACLKAALEAGRPVDLPRVGLFAEGVAVKRIGDETFRLCQQYVDDVITVDSDAICAAMKDIFEDVRAIAEPSGALALAGLKKYVQQHQIQGERLAHILSGANVNFHGLRYVSERCELGEQREALLAVTIPEQKGSFLNFCQTLGTRVVTEFSYRYSDATNPAEACIFVGVRLNRGNAERLEIINELKASGYQVADFTDDEMAKLHVRYMIGGRPAKPLQERLYSFEFPESPGALLKFLQTLGTHWNITLFHYRSHGMDYGRVLAAFELSGAEVRFDRHLDDLGYEYHDETNNPSFNLLLK

SEQ ID NO: 8782 - protein, 616 aa, Xenorhabdus bovienii
  Coding DNA sequence: Name=SeqID_2674
  Gene classification: Gene name=IlvD; Function=Dihydroxyacid dehydratase/phosphogluconate dehydratase; Function class=E Amino acid transport and metabolism
  Homolog annotation: Query=1..616bp; Hit=1..616bp; Blast score=1090; Percent Identity=87.0; E value=0; Homolog= ZilvD COG0129
MPKYRSATTTHGRNMAGARALWRATGMTDEDFGKPIIAVVNSFTQFVPGHVHLRDLGKLVAEQIEASGGVAKEFNTIAVDDGIAMGHGGMLYSLPSRELIADSVEYMVNAHCADAMVCISNCDKITPGMLMASMRLNIPVIFVSGGPMEAGKTRLSDQIIKLDLIDAMIQGANPNVSDEESNQIERSACPTCGSCSGMFTANSMNCLTEALGLSQPGNGSLLATHADRKALFLNAGKRIVELTKRYYEQNDDSALPRNIATKAAFENAMILDIAMGGSTNTVLHLLAAAQEGDVDFTMADIDRLSRLVPHLCKVAPSTQKYHMEDVHRAGGVIGILGELDRAELLNRDVKNVLGLDLPQTLAQYDIMLTQDEGVKSMYSAGPAGIRTTKAFSQDCRWPSLDTDRKEGCIRERTHAYSQDGGLAVLSGNVAANGCIVKTAGVDEGSLTFRGPAKVYESQDDAVEAILGGKVVAGDVVVIRYEGPKGGPGMQEMLYPTTYLKSMGLGKSCALITDGRFSGGTSGLSIGHVSPEAASGGVIGLVYDGDIIDIDIPNRKIHLDVNETELAVRTQAELSRGDQAWTPKSRDRQVSFALRAYALLATSADKGAVRDKAKLGG

SEQ ID NO: 8783 - protein, 308 aa, Xenorhabdus bovienii
  Coding DNA sequence: Name=SeqID_2675
  Gene classification: Gene name=IlvE; Function=Branched-chain amino acid aminotransferase/4-amino-4-deoxychorismate lyase; Function class=E Amino acid transport and metabolism
  Homolog annotation: Query=2..307bp; Hit=3..308bp; Blast score=573; Percent Identity=87.0; E value=1e-163; Homolog= ZilvE COG0115
MTKQADYIWFNGEMVPWADAKVHVMSHALHYGTSVFEGVRCYNSHKGPVVFRHREHMRRLHDSAKIYRMPVSQSVDELMEACRETLRKNKLVSAYIRPLVFIGDVGMGVNPPDGYKTDIIIAAFPWGAYLGEEALDQGIDAMVSSWNRVAANTIPTGAKAGGNYLSSLLVGSEARRHGYQEGIALDVHGYISEGAGENLFEVKDGVLFTPPFASSALPGITRDAIIKLAQDLGLEVREQILTRESLYLADEVFMTGTAAEITPVRSVDGIQVGIGKCGPITKKIQNAFFGLFDGTTEDKWGWLDAVNP

SEQ ID NO: 8784 - protein, 85 aa, Xenorhabdus bovienii
  Coding DNA sequence: Name=SeqID_2676
  Gene classification: Gene name=IlvH; Function=Acetolactate synthase, small subunit; Function class=E Amino acid transport and metabolism
  Homolog annotation: Query=1..75bp; Hit=1..75bp; Blast score=89; Percent Identity=66.0; E value=5e-19; Homolog= ilvM COG0440
MMQHQLAIQARFCPEILERILRVARHRGFQICALNMDHTTDSDNVSIELTVASQRSVNLLFSQLMKLVDVAGVEIRNKESQLISA

SEQ ID NO: 8785 - protein, 548 aa, Xenorhabdus bovienii
  Coding DNA sequence: Name=SeqID_2677
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=1..546bp; Hit=1..546bp; Blast score=864; Percent Identity=75.0; E value=0; Homolog= ZilvG COG0028
MNGAQWVVQALRTQGVEKVFGYPGGAIMPVYDALYDGGIEHLLCRHEQGAVMAAIGYARANGKPGVCIATSGPGATNLITGLADALLDSVPVVAITGQVSSELIGTDAFQEIDMLGLSLACTKHSFLVDSLDKLPQVIAEAFTIATSGRPGPVLIDLPKDIQLAQSDLAPYLIPVVSESFLPEQELEQARYMMPMAQKPILYVGGGIGMADAVPELRRFVTETGLPVVSTLKGLGAADAEHECYLGMLGMHGTKAANLAVQSCDLLIAVGARFDDRVTGKLNTFAPHAKVIHVDIDPVEFNKLRQAHVSLLGNLKTLLPHLQQPLSIESWQQEVKKLKNEHTWRYDYQGVSIYAPSLLKQVSERKPSNAVITTDVGQHQMWTAQHMTFDGPENFITSSGLGTMGFGIPAAIGAQMARPEDMVLCISGDGSFMMNVQELGTIKRKQLPIKIILLDNQRLGMVRQWQELFFDKRYSETILNDNPDFITLAKAFDIPGQQITDETQINAALDALFSSEGPYLLHVSIDELENVWPLVPPGSSNATMLEKSL

SEQ ID NO: 8786 - protein, 508 aa, Xenorhabdus bovienii
  Coding DNA sequence: Name=SeqID_2678
  Gene classification: Function=Predicted ATPase with chaperone activity; Function class=O Posttranslational modification, protein turnover, chaperones
  Homolog annotation: Query=1..503bp; Hit=1..506bp; Blast score=608; Percent Identity=61.0; E value=1e-174; Homolog= HI1117 COG0606
MTLAVIYTRATIGVDSPIVTIEAHISNGLPGLTLVGLPETTVKEARDRVRSALLNSGFTYPPKRITVNLAPADLPKEGGRYDLPIAIAILAASEQIPTDKLHNYEFLGELALSGEIRRVMGAIPAALSAKRAGRQLILSIENQAELAILSQNETLVANHLLQVCHFLRGETAILSSPPPITLQADPLVLDIRDIIGQEQAKRALEITAAGGHNLLLLGPPGTGKTMLASRLCGLLPPLTHLEALDVAAINSLTGNSVNPQKWHTRPFRAPHHSSSMAALVGGGSIPKPGEISLAHNGILFLDELPEFSRGALDALREPLESGEIVISRARAKVCFPAQVQLIAAMNPSPTGYHQGLHNRSSPQQILRYLSKLSGPFLDRFDLSIEVPLLPPGILSQSSEKHGESSYEVKKRVLIARKVQIERCGHVNAYLNRKQTDSACKLKMEDSIFLEDTLLKLGLSVRAWHRILKVSRTIADLKEQKRIERPDIMEALSYRSIDRLLIQLQKQAG

SEQ ID NO: 8787 - protein, 112 aa, Xenorhabdus bovienii
  Coding DNA sequence: Name=SeqID_2679
  Gene classification: Function=Uncharacterized BCR; Function class=S Function unknown
  Homolog annotation: Query=1..112bp; Hit=1..112bp; Blast score=181; Percent Identity=81.0; E value=1e-46; Homolog= yifE COG3085
MAESFITTNRFFDNRNYPRGFSRHGDFTIKEAQLLERYGHAFNELDLGKREPQTEEEKLFVAVCRGERAPATTEEKVWIKYLAKISRPKRFHTLSGGKPQIDSAEDYTDTDD

SEQ ID NO: 8788 - protein, 278 aa, Xenorhabdus bovienii
  Coding DNA sequence: Name=SeqID_2680
  Gene classification: Gene name=LysR; Function=Transcriptional regulator; Function class=K Transcription
  Homolog annotation: Query=1..271bp; Hit=1..274bp; Blast score=317; Percent Identity=60.0; E value=9e-87; Homolog= ZyifAm COG0583
VDTELLKTFLEVSKTRHFGRAAESLYLTQSAVSFRIRQLENQLGTNLFTRHRNNIRLTAAGERLLPYAESLMNTWQLAKKEISYVSQHTELSIGATASLWEGYLISWLNTFYQHHQGMRVESRVSTRQILVKQLHSRELDLLITTEPPKMDEFQSQLIGNIQLVLLTTQHNLKQGVENYIKLEWGADFHQQEQQILKNDYPPIITTTSAHIARELLNSVNAAAFLPIHWQEDYPKLVTSPNREQIKRPLYAVWLQNSDQQTFIQQLLKIPVEKAPITS

SEQ ID NO: 8789 - protein, 294 aa, Xenorhabdus bovienii
  Coding DNA sequence: Name=SeqID_2681
  Homolog annotation: Query=20..166bp; Hit=1..146bp; Blast score=194; Percent Identity=65.0; E value=1e-48; Homolog= ref|NP_927393.1|
MGRDFSVKSLGLGIVENLGLAETKNQAQNALPRSGGEVTGDITISTDSEIAWRKNTDMAAIGFKNTGDGDTDSYMWFKTADNGNEYFKWQHSLSGGGTNEWMSLKSDNLRVKGHQVYHEGYKPTAAIVGAYTKSEAESKYQPKGNYAVRGENYTKQESDGKYQPRGNYQPIGNYILRGDCYTKGESDSRYLSFQNRSPRTVLSGVSLNDGETANLGVDCRGKVMWVWCTEREFPAAMTVIPIDNYGVSTHYGYQASIDLTLINGGRTIKVIFTRKDTRLWAYRHLGLGFNFKGV

SEQ ID NO: 8790 - protein, 112 aa, Xenorhabdus bovienii
  Coding DNA sequence: Name=SeqID_2682
  Homolog annotation: Query=15..110bp; Hit=15..111bp; Blast score=97; Percent Identity=51.0; E value=5e-20; Homolog= ref|NP_461660.1|
MANTEKEKFAQINLGQRLEGLNHLSRIRAIYWGDDEKELNRFFADMRDKKDSYYEENKRALSAIFYLANIPRVRHESELEHFTQEEKQALIKAMNHIKVVVSQFPKYLKLSK

SEQ ID NO: 8791 - protein, 663 aa, Xenorhabdus bovienii
  Coding DNA sequence: Name=SeqID_2683
  Homolog annotation: Query=76..631bp; Hit=65..623bp; Blast score=437; Percent Identity=44.0; E value=1e-121; Homolog= ref|NP_052289.1|
MNSGFITTEHNGDYPIAKGRQSGLFQPGIPQGVSMAERLLWEVNAEDHQWRHQYIGQMPDFLAKYFSRRYVGIFNHSGRRDANAFLRRTVGQNVLPRLQLVKARYSFTHHISGITPFPFIEQLEKVVTCDRKQLLKLAHEISIFIAGNYEHYSLQSSQQYQAAPVDSESELFPRVAKLYQLLAKLTLQCGTNPPYWQRFNHGRKVPSVDQLCAGMLRMMSARWWYFRLKRLREIQSEHMAIAVGQVQKAASPYVSNYALREWLEQKRRNREFFKHFDLENENGERISLAETVVHSNANPAIRRCELMVRMRGFEDVANKMGCVGEFYTITAPAKYHAVQHQGGFVRHWNGATPRDTQRYLCGIWAKARAAIARAGINLFGFRVVEPHHDGTPHWHILLFMLPEHQWQVRAILEHYACQEEKAELQRDDAKKARFDYRTIDPNKGSATGYIAKYISKNIDGYALEDEKDHQTGAPLRDMAKSVTAWASRWRIRQFQQIGGAPVSVWRELRRLGEVRLTDNKVNAVLQAADEGNWAAYIQAQGGPWVARRDLVIRLSYKHIPFGSPYGEDVYTIQGVTSPFLSCVEFICTRIHQWTIVPKFDAAPTSGHIVYKRNTKWPSWSSVNNCTDGQVDRSMKRYVNYRIDEDDKIINMANISAKTVHNRY

SEQ ID NO: 8792 - protein, 74 aa, Xenorhabdus bovienii
  Coding DNA sequence: Name=SeqID_2684
  Homolog annotation: Query=1..57bp; Hit=3..59bp; Blast score=77; Percent Identity=77.0; E value=5e-14; Homolog= ref|NP_927403.1|
VDSLMESLVAQRINFIARMATSCECNHAEDKELALVWIAELSAPHENRLNVHRSDLENNLLIEKALRNSGSTDE

SEQ ID NO: 8793 - protein, 78 aa, Xenorhabdus bovienii
  Coding DNA sequence: Name=SeqID_2685
  Homolog annotation: Query=1..77bp; Hit=1..77bp; Blast score=83; Percent Identity=48.0; E value=8e-16; Homolog= ref|NP_892101.1|
MRVEILFDKRANVSESVMSALESELKKRILPQYPDTHFRIAVSSSSSVRVTGTKDSSEHDQMMELIQSVWEDDSWLPD

SEQ ID NO: 8794 - protein, 67 aa, Xenorhabdus bovienii
  Coding DNA sequence: Name=SeqID_2686
  Homolog annotation: Query=1..67bp; Hit=1..67bp; Blast score=111; Percent Identity=77.0; E value=2e-24; Homolog= ref|NP_927402.1|
MQVIAQQNETVDALCWRHYGRTLGMTERVLLSNPGLAAFGAVLPHGTKVEMPEFMPAATKPIIQLWD

SEQ ID NO: 8795 - protein, 91 aa, Xenorhabdus bovienii
  Coding DNA sequence: Name=SeqID_2687
MDKYSHATYACASITAIFSGLSLYEWSFLLGAFASISLGILTYRLNRREQMKRTLILKNILKNILENLDIESASKSAKIVSELIHHAPREL

SEQ ID NO: 8796 - protein, 179 aa, Xenorhabdus bovienii
  Coding DNA sequence: Name=SeqID_2688
  Gene classification: Function=Phage-related lysozyme (muraminidase); Function class=R General function prediction only
  Homolog annotation: Query=8..179bp; Hit=9..177bp; Blast score=238; Percent Identity=66.0; E value=2e-63; Homolog= Z3339 COG3772
MQDIKTRLSRVVIGLIIGGASSSVILSQFLDEKEGNRLSAYQDGGGIWTICRGVTRIDGKVVYKGMKLAPEQCDVLNRIEADRAIDWVKKNVHVPLTEPQIAGIASFCPYNIGPGKCFSSTFYRKLNAGDKKGACAEIKRWVYDGGRDCRKTQGQPNGCYGQVLRRDQEAELVCWGLNR

SEQ ID NO: 8797 - protein, 166 aa, Xenorhabdus bovienii
  Coding DNA sequence: Name=SeqID_2689
  Homolog annotation: Query=1..157bp; Hit=1..149bp; Blast score=78; Percent Identity=37.0; E value=5e-14; Homolog= ref|NP_309561.1|
MKKVPLLVSLVIGGCFGWWGHRSLFLSEVTGLKQQHAAQIVTISQKAHSETLAAIQQMKNAQSRVAQLDDYYSGKLTYVTEENAALRADIAAGHRRVQIAAANLATCQLTQNRDTGSRSVGDETQVELTAKAGRAIYDIRAGIISDQAKLDYLQQYVLEVVRQCKP

SEQ ID NO: 8798 - protein, 211 aa, Xenorhabdus bovienii
  Coding DNA sequence: Name=SeqID_2690
  Homolog annotation: Query=1..204bp; Hit=1..206bp; Blast score=253; Percent Identity=64.0; E value=1e-66; Homolog= ref|NP_052263.1|
MNTQLTELLRLMRNLIRTGVITQVDTTKGMCRVATGNLETNWLNWLTSRAGNSRTWWAPSIGEQVLLLSIGGELTTAFVLPAIFSDEFPAPSTSSEATHIQFPDGAVMEYEPQSGALTVTGIKTATVTASDSVHITAPEITCVASTRITLDTPEVICTQLMSTGNLIVRNGGKMTGNIEHTGGTFSSNGVVVDSHKHTGVRSGGDTSGGPV

SEQ ID NO: 8799 - protein, 115 aa, Xenorhabdus bovienii
  Coding DNA sequence: Name=SeqID_2691
  Gene classification: Function=Phage baseplate assembly protein W; Function class=R General function prediction only
  Homolog annotation: Query=3..98bp; Hit=2..97bp; Blast score=67; Percent Identity=36.0; E value=2e-12; Homolog= PA0617 COG3628
MYLGMNRQTGRELTDLAHVRQSVSDILLTSVGSRIARRTYGSLLPELIDWPQNPALRLQVMAASYTAISRWEPRVMLTSITMETRQNGEMVVDIAGTYHQSAKEFSLSIPVSHSR

SEQ ID NO: 8800 - protein, 302 aa, Xenorhabdus bovienii
  Coding DNA sequence: Name=SeqID_2692
  Homolog annotation: Query=1..302bp; Hit=1..302bp; Blast score=409; Percent Identity=69.0; E value=1e-113; Homolog= ref|NP_839865.1|
MPTIDLSQLPPPDVVEPLDYEQLLEERKEGLISLYPEEQQDAIARTLQLESEPLVKLLEENVYRELLLRQRVNEAARAVMVAYSTGSDLDQLGVNNNVARMVLSPADNSTVPPTPALMESDNDYRVRIPQAFEGLSVAGPVGSYEFHARSADGRVADASAISPSPANVTVTIMSREDKGVASKELLDKVEKALNDENVRPVADRLQVQSASIVEYEIDAVLYIFPTPESEPIRKAAEQKLKYYVEAQHRLGRDIRLSAIYAALHVEGIQRVELKAPLKDVVLDKTQVSYCTKTTLMMGGSDE

SEQ ID NO: 8801 - protein, 202 aa, Xenorhabdus bovienii
  Coding DNA sequence: Name=SeqID_2693
  Homolog annotation: Query=1..202bp; Hit=1..204bp; Blast score=305; Percent Identity=72.0; E value=2e-82; Homolog= ref|NP_927398.1|
MNDRLLPMGSTQLELAAAKACAELQKIKVPLRELWNPDTCPATLLPYLAWAWSVDRWDEHWSESIKREVIKSSLFLHKHKGTIGAIRRVVEPLGYLIRVKEWWQTNDVPGTFRLDIGVLENGITHEMFEELEKLISDAKPVSRHLIGLDINLDTRGEYYYSAASYSGDELTVYPYFPEQVTVSGSDVVGMGIHIIDDMRIRP

SEQ ID NO: 8802 - protein, 650 aa, Xenorhabdus bovienii
  Coding DNA sequence: Name=SeqID_2694
  Homolog annotation: Query=4..212bp; Hit=2..211bp; Blast score=304; Percent Identity=79.0; E value=3e-81; Homolog= ref|NP_927397.1|
MSTKYFALLTQLGADKLANAAALGTKIEITHMAVGDGGGSLPTPDTKQTKLINEKRRAAINTLSIDPKNTNQIISEQVIPESEGGWWIREIGLFDKDGILIAVGNCAESYKPQLQEGSGRTQTIRMILIVSSTESVTLKVDPSVVLATREYVDDSIQKHSNSRNHPDATLKEKGFVILSSAVDSNSETHAATPKAVKAAYDFANAANNNANGRVPSGRKVNGKALSEDIRLKASDVDAYNKTETDARVNDAKAQAKAANDNADGRVPTGRKVNGKALNADISLNSGDVGAYSKGETDIRVDGAKEQAKAANENANGRVPAGRKVNGKALNADISLNSADVGAYSKDETDTRVDEAKALANARLEKNQNGADIPNKPKFVENLGLAETKNQAQNALPRSGGEVTGDITISTDSEIAWRKNTDMAAIGFKNTGDGDTDSYMWFKTADNGNEYFKWQHSLSGGGTNEWMSLKSDNLRVKGHQVYHEGYKPTAAIVGAYTKSEAESKYQPKGNYAVRGENYTKQESDGKYQPRGNYQPIGNYILRGDCYTKGESDSRYLSFQNRSPRTVLSGVSLNDGETANLGVDCRGKVMWVWCTEREFPAAMTVIPIDNYGVSTHYGYQGSIDLTLINGGRTIKVIFTRKDTRLWRIDIWD

SEQ ID NO: 8803 - protein, 363 aa, Xenorhabdus bovienii
  Coding DNA sequence: Name=SeqID_2695
  Gene classification: Gene name=RfaG; Function=Predicted glycosyltransferases; Function class=M Cell envelope biogenesis, outer membrane
  Homolog annotation: Query=3..353bp; Hit=10..357bp; Blast score=248; Percent Identity=36.0; E value=5e-66; Homolog= rfaB COG0438
MDSKKILFVGYDMPGFGGKETVCKNVYYMMMDKNPSINIEFLFIQDFRQGPDEISDEWLGDISFSRISSGVYNTKIRRIHFSYKFAKFLKKKKPDIIISIDPLSCYVTSLGKKLAMVKIPIYSWIHSSLDQLYKSTYSLNADYHLAISSGIKSQFIRRGVSADNIFTIFNPIKRSSEIMTRPSDIITFLYVGRLTDDDKNISEMFTALSKVNGNFELHIVGSGRDENELKNLANKLKLQNNIIWHGWKKKPWEFIESNIKEITTLLLTSNFEGFPMVLGEAISRGIYCISSNCITGPEDIIIDGINGELYPLNSVNCLVEKLQYIIDGKQLPNNIIIKESIEDLYEEKYIENVFYALENSNKK

SEQ ID NO: 8804 - protein, 300 aa, Xenorhabdus bovienii
  Coding DNA sequence: Name=SeqID_2696
  Gene classification: Gene name=WcaA; Function=Glycosyltransferases involved in cell wall biogenesis; Function class=M Cell envelope biogenesis, outer membrane
  Homolog annotation: Query=4..276bp; Hit=5..286bp; Blast score=75; Percent Identity=23.0; E value=6e-14; Homolog= BS_yveT COG0463
MITLSIIVTAHNLEKLILQCLLSIKNCIEKNTNRDIEVLLVDDCSSDDTSCLMNDFANLHDGYTYIRTEYGNIGKVRNYAINIANGKYITFIDGDDTIPNFSIKNLLCFLKNKEPDLLLSKMHEVRNEKDKIILSNLNKPKIMDKDKAIVEFLLHKKFQAHLWGKFFKKELFKNKTIPPLTCYEDSYIFPELLNDSTKIFYTDSVMYNYIKRENSLSAKIDNVKAEIKVDIINHMNTIFSKRKYYNLIICHAIDLLLKNREVLSIQKQKELKSLIKNTRKIKFLLDRNIRFSFKKKLLKC

SEQ ID NO: 8805 - protein, 169 aa, Xenorhabdus bovienii
  Coding DNA sequence: Name=SeqID_2697
LQAGDIGAQPAGNYAIRGESYTKEESGGRYQPRGNYQPAGNYQPAGNYQPAGNYAVRGEIYTKSESDSRYQMRSTGQRWRKIGDFGGQYDISATLAENILGKLIFVQRDKGDETYHGINVPPIAGIRFGYSMASESWWDFIVSPDGKQLTMVDSRYGSANGVYLSELII

SEQ ID NO: 8806 - protein, 102 aa, Xenorhabdus bovienii
  Coding DNA sequence: Name=SeqID_2698
  Homolog annotation: Query=1..67bp; Hit=331..398bp; Blast score=79; Percent Identity=55.0; E value=1e-14; Homolog= ref|NP_927497.1|
LQALRDFESGCQFIGIDTPGAEEITTYEGRGRLGKDKQPQVHYQLSGRTYSQQDKAAYAKPKVGMFIFPPMKLTMNCLIWGVTRQLQSSAKGGAWLPVSEKP

SEQ ID NO: 8807 - protein, 577 aa, Xenorhabdus bovienii
  Coding DNA sequence: Name=SeqID_2699
  Homolog annotation: Query=397..575bp; Hit=159..335bp; Blast score =234; Percent Identity=66.0; E value=4e-60; Homolog= ref|NP_929379.1|
FFSFCLFCAGLQVHLVAGEWESLSEDIRLKASDVDAYNKTETDARVNDAKAQAKAANDNADGRVPTGRKVNGKALNADISLNSGDVGAYSKGETDIRVDGAKEQAKAANENANGRVPAGRKVNGKALNADISLNSADVGAYSKDETDTRVDEAKALANARLEKNQNGADIPNKPKFVENLGLAETVDRAKNAVPKGSFGFGGDGGTVLSKNDNDFLAWVRRNNASPEFFRNSTPSKYTFTYGVGVLLKASDTYASLSVDYSTARVKVVAGNNSGNANSPVRELAFTDESYTKPESDNRFIRSNVNTKTSGYILSKTANYLEDTNSRHLGRSGFLRPNGMDNLGDLAIHVAHPSVEGPQHARGISFSYGSDSNGFGISTYAFDKNGKFQGKKRILTEDDIADMLYPVGIVVWFAQNKNPNTLFPKTQWKYIGENKTIRLANQNGSDVLSVGGNDSITLTGAQIPSHNHQINATTSSFDYGAKTTNSNGNHFHDSGWGEAFAEGARYGTYDNTRNNIGSGETDNDNYKYKTSTDGAHTHTVHIGAHTHSISGTTGNSGSNSAINITNSYIMLMGWFRVE

SEQ ID NO: 8808 - protein, 71 aa, Xenorhabdus bovienii
  Coding DNA sequence: Name=SeqID_2700
LWVEPKEGLNCSDDSIANHIIDALQTHIAVSLTVRVVNKGIIGSLKSTALSCSNGVKIPQLIDISHPKEYI

SEQ ID NO: 8809 - protein, 54 aa, Xenorhabdus bovienii
  Coding DNA sequence: Name=SeqID_2701
LVSQNSCEPLFTMVSRSWDAFDHPSTTSVKIAKSMYYQIRDKLRTYMTSICCMK

SEQ ID NO: 8810 - protein, 51 aa, Xenorhabdus bovienii
  Coding DNA sequence: Name=SeqID_2702
MVKRIPAPANHSKKRFTRVLADQNPCASVCFAYIVLPLRYELIEAAFSHCF

SEQ ID NO: 8811 - protein, 225 aa, Xenorhabdus bovienii
  Coding DNA sequence: Name=SeqID_2703
  Gene classification: Gene name=CaiB; Function=Predicted acyl-CoA transferases/carnitine dehydratase; Function class=C Energy production and conversion
  Homolog annotation: Query=6..225bp; Hit=190..407bp; Blast score=117; Percent Identity=30.0; E value=1e-26; Homolog= PA0446 COG1804
MNLAQAVLLALYHREKIGEGQWVYTFLLESTLTIMDFQVARWLADGKTPELMGNDHPTLMPTGIVKTKDGEINIAAAEDDKFKILCHLIDIPIIYSNSQYSDIHSRSIHRKQLMSEIEAATIKYESKQLIQMLNAGGIPSGYVYDIAQAMSDPQMNYLNMKCPINHPYLGNLTLVGQPMHLSAFPDFDAVRTPAPEHGQHTGNLLKNYLGFNDDEIASFREMQVI

SEQ ID NO: 8812 - protein, 91 aa, Xenorhabdus bovienii
  Coding DNA sequence: Name=SeqID_2704
  Gene classification: Gene name=CaiB; Function=Predicted acyl-CoA transferases/carnitine dehydratase; Function class=C Energy production and conversion
  Homolog annotation: Query=5..91bp; Hit=17..107bp; Blast score=71; Percent Identity=44.0; E value=1e-13; Homolog= PA3733 COG1804
MDFLPLSGIVVIDLTWHRAGPVTSRLLGNWGAEIIKIEAPTDQGDSMGGSREGFDYQNLHRNKKSLSVNLKTEQGQQILQRLVRKADVVLE

SEQ ID NO: 8813 - protein, 99 aa, Xenorhabdus bovienii
  Coding DNA sequence: Name=SeqID_2705
  Homolog annotation: Query=1..99bp; Hit=51..149bp; Blast score=151; Percent Identity=78.0; E value=2e-36; Homolog= ref|NP_928335.1|
MAKDRASALSGSIYFRDRVQQRIVSNILLTKVERGGNKILAHVMTIFAIHENICGQDNKLLVSGTTQDIIEYQDNVALFKERLCICTPDIITDSIVYPI

SEQ ID NO: 8814 - protein, 44 aa, Xenorhabdus bovienii
  Coding DNA sequence: Name=SeqID_2706
LCVVPFCKIDDFRCIVNYLIVIIIFFLGVVHIFHINTELTILFF

SEQ ID NO: 8815 - protein, 43 aa, Xenorhabdus bovienii
  Coding DNA sequence: Name=SeqID_2707
MMVTFCICYSPLQLLLTQHNVSIKAKITRIELFQDIGILCIID

SEQ ID NO: 8816 - protein, 248 aa, Xenorhabdus bovienii
  Coding DNA sequence: Name=SeqID_2708
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..247bp; Hit=3..249bp; Blast score=316; Percent Identity=62.0; E value=2e-86; Homolog= VCA0301 COG1028
MQKVTIITGGSRGIGKATALCLAQQGHHVCIGYRSREDEADEVVDILRGFGQSAMAVRVDVTDEKQIMELFQRTEKELGYISGLVNNAGVLKPQATIEQLTAERLNTIFTTNVTGYFLCAREAVKRMAFRHGGRGGAIVNVSSAAARLGSPHEYIDYAASKGAVDTLTIGLAQEVAAQGIRVNAVRPGFIYTGMHADGGEPDRIERIKDSLPMKRGGQPEEVAQAIAWLLSDKASYVTGNFIDLAGGK

SEQ ID NO: 8817 - protein, 114 aa, Xenorhabdus bovienii
  Coding DNA sequence: Name=SeqID_2709
MSLHVSFRHTDIPELMLNGSTLSNAGFSADALFHISQFSNEIIISLVDPDVDLVSLIHEVEDHADQGIDNIRENGELYIAGDWLTSSQLVEQPINIEVAPGKVILKPKLTESLD

SEQ ID NO: 8818 - protein, 62 aa, Xenorhabdus bovienii
  Coding DNA sequence: Name=SeqID_2710
VLPLSINSGISVWRNETWRLICTFLVLFRHIAILYQYFADTALRIHTCFQIHACLICTACVD

SEQ ID NO: 8819 - protein, 43 aa, Xenorhabdus bovienii
  Coding DNA sequence: Name=SeqID_2711
MNFFISSIFYSFYCELVFFKFFRKMYFFIVIECDDGVFIYYFS

SEQ ID NO: 8820 - protein, 34 aa, Xenorhabdus bovienii
  Coding DNA sequence: Name=SeqID_2712
MSLLYKYMLYRLISFRLIYELSVDVIQKVFSSLF

SEQ ID NO: 8821 - protein, 469 aa, Xenorhabdus bovienii
  Coding DNA sequence: Name=SeqID_2713
  Gene classification: Gene name=TnaA; Function=Tryptophanase; Function class=E Amino acid transport and metabolism
  Homolog annotation: Query=2..465bp; Hit=5..471bp; Blast score=558; Percent Identity=58.0; E value=1e-159; Homolog= PM1420 COG3033
MKRIPEPFRIKMVENIRMTTAAEREAALEEAGYNPFLLPSDMVYIDLLTDSGTGSMSDRQWAGMMMGDEAYAGSRNYYHLESKVKELIGYEYTIPTHQGRGAEQILFPALIANKKAKGGAEKPVFISNFHFDTTAAHVELNGACAINIVTPKAFDTTTYYDWKGNFDLDALKNTIKEHGADNIVAIITTVTCNSTGGQPVSLANMKAVYDIAKQHDIPVVIDSARFCENAWFIKQREKGYENKSIKEIVKEMYQYGDMLTMSAKKDPMVNIGGLCCFRDDEALFNEVRIRCVPMEGFVTYGGLAGRDMAALAIGLEEGMDEDFLSYRINQVKYLGEKLREAGIPVQYPIGGHAVFVDAKLLLPHIPSDQFPAHALNNELYLEAGIRSVEIGSLLLGRDPQTGQQKPSPMELMRLAIPRRVYTNDHMDYIVGAFIALKQRATQIKGLTFTYEPPVLRHFVSRLKPIDNDK

SEQ ID NO: 8822 - protein, 54 aa, Xenorhabdus bovienii
  Coding DNA sequence: Name=SeqID_2714
LITINNQKTIALFLVPESRYRASNSIKLLGTQVSKQKLRFARIRICCVIRVVMR

SEQ ID NO: 8823 - protein, 74 aa, Xenorhabdus bovienii
  Coding DNA sequence: Name=SeqID_2715
  Gene classification: Gene name=XerC; Function=Integrase; Function class=L DNA replication, recombination and repair
  Homolog annotation: Query=1..54bp; Hit=142..196bp; Blast score=92; Percent Identity=81.0; E value=7e-20; Homolog= fimB COG0582
MLRHSCGYALADNGVDTRLIQDYLGHRNIRHTVRYTASNAGRFDGIWRARGKRKGVTFSAKLLTTDEFSGSELS

SEQ ID NO: 8824 - protein, 32 aa, Xenorhabdus bovienii
  Coding DNA sequence: Name=SeqID_2716
MMKKPCLVISAGFFGKLLLINMTIQRQFSGQL

SEQ ID NO: 8825 - protein, 191 aa, Xenorhabdus bovienii
  Coding DNA sequence: Name=SeqID_2717
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..191bp; Hit=1..191bp; Blast score=301; Percent Identity=82.0; E value=3e-82; Homolog= ZterE COG2310
MGVSLVKGGNVSLTKEAPAMNIALVGLGWDMRATDGAAFDLDASVFMVGEDGKVLSDGHFVFFNNKVSPCGSVSHQGDNRTGEGAGDDEQIKIDLAKVPADVKKVVFAVTIYDADNNKQNFGMVSNSFIRVVNNDNDQEIARFDLSEDASTETAMIFGELYRHNTEWKFKAVGQGFAGGLSALAIQHGITI

SEQ ID NO: 8826 - protein, 192 aa, Xenorhabdus bovienii
  Coding DNA sequence: Name=SeqID_2718
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..192bp; Hit=1..192bp; Blast score=327; Percent Identity=88.0; E value=6e-90; Homolog= ZterD COG2310
MGVSLSKGGNVSLSKEAPTMKNVLIGLGWDARATDGQDFDLDASAFLLSANGKVRGDADFIFYNNLKSADGSIMHTGDNRTGEGDGDDESLKIKLDQVPADVEKVVFVVTIHDAQTRHQSFGQVSGAFIRLVNDDTQVEVARYDLTEDASTETAMLFGELYRHNTEWKFRAVGQGYAGGLASVCAQYGINAS

SEQ ID NO: 8827 - protein, 45 aa, Xenorhabdus bovienii
  Coding DNA sequence: Name=SeqID_2719
LLRETLPPLERDTPIIISSLIKSHTLHLLSCCFVGCNLKSIGYID

SEQ ID NO: 8828 - protein, 343 aa, Xenorhabdus bovienii
  Coding DNA sequence: Name=SeqID_2720
  Gene classification: Gene name=TerC; Function=Membrane protein TerC, possibly involved in tellurium resistance; Function class=P Inorganic ion transport and metabolism
  Homolog annotation: Query=1..342bp; Hit=1..342bp; Blast score=525; Percent Identity=85.0; E value=1e-149; Homolog= ZterC COG0861
MVSTHIGFPMETVAVFIILSVGALFIDLFMHRHDKPISLRSAALWSVFWIAIAFVFAGFLFVHHGAETASLFVTGYALEKVLSVDNLFVIMAIFSWFAVPDRYRHRVLYWGIIGAIVFRGIFVAIGTSLLMLGPWVEMVFAIIVGWTAVMMLKSGDDSDGIEDYSQHLAYRLVKRFFPIWPKLRGHAFMLNQKEVNAELAKPENADVKVGRTGKAALYATPLMLCLAVVELSDVMFAFDSVPAVIAVSREPLIVYSAMMFAILGLRTLYFVLEALKKYLVHLEKAVIVLLFFIAIKLGLNASEHMFHHGYSISATTSLFVVIGVLTVGIIVSLLFPQKEENES

SEQ ID NO: 8829 - protein, 151 aa, Xenorhabdus bovienii
  Coding DNA sequence: Name=SeqID_2721
  Gene classification: Function=Tellurite resistance protein; Function class=P Inorganic ion transport and metabolism
  Homolog annotation: Query=1..151bp; Hit=1..151bp; Blast score=211; Percent Identity=72.0; E value=2e-55; Homolog= ZterB.2 COG3793
MSFLNKIKTAFSAGREELTNQVGRFKNRKFMEGTVAVCAHIAMASNGVSSEEKQKMVGFIKNSPELKVFDTTEIIEFFNKLVSSYEFDADIGKGEAMKFIMVLKPQPEAAQLALRVGIAVAKSDGDFDNDEKTAAREICTTLGFTPADFEL

SEQ ID NO: 8830 - protein, 386 aa, Xenorhabdus bovienii
  Coding DNA sequence: Name=SeqID_2722
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..162bp; Hit=1..162bp; Blast score=219; Percent Identity=67.0; E value=3e-57; Homolog= ZterA.2_1 COG2310
MNLTPGGNAPVSNQTLTVRVLSGTAVDVSAFCLYADGKVQGDPDMVFYGQPVNDDNTIRLAGGNVNTSFFVNLPALRQDVQKVAFTATCDGNQTISSLRTLSIQVELNGNTVLQGSVDVQGRTESALILGELYRRNSEWKFRFIAQGFNGGLKPLAEHFGVNIVDDAPAKTPAPPPAPASNSVNLSKVSLTKEKPAISLSKRDNFGEIRVNLNWNQAASPAKKGVLQGIFSANKGVDLDLGAFIRLHDGERYVVQAIGKSFGDYHREPYVKLQGDDRTGAVRDGEWLHINGLEWKNINEVLVYALIYEGVPSWDNTDGVVTIHISGQAPIETRMTEGNNQKRMCAVGRLVNENGAIKVERINQYFSGHKEMDRAFGWGFRWVAGSK

SEQ ID NO: 8831 - protein, 195 aa, Xenorhabdus bovienii
  Coding DNA sequence: Name=SeqID_2723
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..195bp; Hit=1..193bp; Blast score=272; Percent Identity=69.0; E value=2e-73; Homolog= ZterZ COG2310
MVSLNKNQSVSLAKQSSSLAKVDFGLGWDPVSKNKGFMARMFGGGSDEIDLDASCILLDNAGKTIDTVWFGQLDSLCGSVAHSGDNRTGEGDGDDEVISVDLVNLPANIEYLVFTVNSFRGQTFNDVENAFCRVVDQSGKELARYQLNEQGAHTGVIISSLRRNKGQWDFTAHGAACRGRTIEDMYPQIVETVVR

SEQ ID NO: 8832 - protein, 44 aa, Xenorhabdus bovienii
  Coding DNA sequence: Name=SeqID_2724
LTFGLGKEIIKKEIRLFSIMDLNTRHAVYGNHNMTEFRHISVIL

SEQ ID NO: 8833 - protein, 384 aa, Xenorhabdus bovienii
  Coding DNA sequence: Name=SeqID_2725
  Homolog annotation: Query=11..384bp; Hit=5..378bp; Blast score=540; Percent Identity=68.0; E value=1e-152; Homolog= ref|NP_403944.1|
MTAFNDTQSYQGQVSKWKLNSGTLTVTAARGTASLETLFDIAERRNPKRAFLFVSKVLGRHIPVSPSIMRSVYRQLSEQFPTHLPGPVLYIGMAETAVGLAAGVFQETREKVEAPVFLTSTRHPVEGDLLCEFKENHSHATDHLIYWPEENRLRQRVVDARTLILIDDEATTGNTFLNLLNALSHAGLNQIEHIVTVTLTDWSGKAVIERCPLPVSTVSLIEGNWHWDADISAPIPVMPQVNVTARGDVSIIGKQSWGRLGLDDIQCDIGTEIHAIAGEKVLVLGSSEFVWQPFLLAERLEQEGAQVKFGSTTRSPISCGHAIQSVMSFMDNYGLGIPNFLYNVAHQQFDRILLCLETPKTAVDPALITQLARVSPIVEIVSYD

SEQ ID NO: 8834 - protein, 264 aa, Xenorhabdus bovienii
  Coding DNA sequence: Name=SeqID_2726
  Homolog annotation: Query=1..259bp; Hit=1..255bp; Blast score=321; Percent Identity=57.0; E value=1e-86; Homolog= ref|NP_309375.1|
MIKPVFLTDLDDTLFQTRRKIKKAPGIESCRVGALDREYSPCSYMTEEQSMLIDWLLAYAEVIPVTARNTEQLSRVKIPFNSWRIATHGAVILTPESTVDKEWQAHILAALTPYRDQFRELDHLSHRLIAAHGMEAWARIDYEYGDVPVYLVIKHRDCNRLEELDVLAENITQEMADIFDSGGFYLHQNNNNLTLLPKCVDKGLATRHLLTKLRTERGVFPIIGLGDSLSDHRFMKLCNWFGMPQHSQFANTLMTSLFGTVNNE

SEQ ID NO: 8835 - protein, 359 aa, Xenorhabdus bovienii
  Coding DNA sequence: Name=SeqID_2727
  Homolog annotation: Query=1..358bp; Hit=1..358bp; Blast score=554; Percent Identity=73.0; E value=1e-157; Homolog= ref|NP_403942.1|
MNSFPLFSGSYDPDDVQFLLKPVQIEMTPVDIKEQLIQSGVRHYSEMLSQEPEPTPYHLDLFDRALEQGAVRLATEVVMLANALISRFGDTPIVLVSLVRAGVPLGVMLHQTLRKMGKQSYHYGISIIRDRGIDSTALSYIEQQHGTDGLVFVDGWTGKGAITAELSRSLAGRSGYSGIPRLVVLADPCGCSWLAASDDDWLIPFGIMGAPVSGLISRSIWREEGMHGCVQCDHLSEFECSRLLVDTVADCRDRLELNAIPVVDWQPQEKISLLELSKTVISTLAETYQIDSINRIKPGIAEATRAVLRRVPEHVLVRSQDDPDVALLVHLARQKNVVITEVGDLIGQYRAVTIIKKVA

SEQ ID NO: 8836 - protein, 317 aa, Xenorhabdus bovienii
  Coding DNA sequence: Name=SeqID_2728
  Gene classification: Gene name=CitE; Function=Citrate lyase beta subunit; Function class=G Carbohydrate transport and metabolism
  Homolog annotation: Query=1..316bp; Hit=1..314bp; Blast score=422; Percent Identity=66.0; E value=1e-118; Homolog= Z1166 COG2301
MKPIPSPHQLGATLYIPATRQGIAEIVLHNKIPGLRSLVICLEDAVSDQDIPDAIENLGCVLQALAGADISSSHTERHYPLIFIRPRNEEMGRYLVDNVNLSAVDGLVLPKFTCASLAGWWDIVGSTHLSMMPTLETEEVFDARQMNQLADSLKTHPCYERIIALRIGGNDLMNVISLRRSRDFTLYEGPMGYVIKMLVTVFAARGFSLTAPVCEHIDDLRLLEKELILDIAHGLVGKTAIHPGQIEYIQRALMVNGHDYADALRILNSSQAVFKSQGTMCEPATHRRWAVNILDRAKYYGIAPEFNEETCKTFNVF

SEQ ID NO: 8837 - protein, 38 aa, Xenorhabdus bovienii
  Coding DNA sequence: Name=SeqID_2729
MKKPVKLLMCFDIDLLVIGAMLDAMPMINIRDFLFSYP

SEQ ID NO: 8838 - protein, 158 aa, Xenorhabdus bovienii
  Coding DNA sequence: Name=SeqID_2730
  Homolog annotation: Query=1..146bp; Hit=1..148bp; Blast score=132; Percent Identity=53.0; E value=2e-30; Homolog= ref|NP_403940.1|
MLLSPKQFRNFRLTLLLSHEKPVSKVRMIRELNCSEPTLTRALRELRDLYCADIRFSKMGNTYQLVDKGTLTKKDVRRIEELLIQNNSLKAEEAISHVFLDKEKKKPVSLSLRMSVIRKIDGLANRLETTRSDVVEMVVDRFMETLQKEAMDVGSQKR

SEQ ID NO: 8839 - protein, 186 aa, Xenorhabdus bovienii
  Coding DNA sequence: Name=SeqID_2731
  Gene classification: Function=Uncharacterized membrane protein; Function class=S Function unknown
  Homolog annotation: Query=23..186bp; Hit=1..164bp; Blast score=238; Percent Identity=89.0; E value=2e-63; Homolog= yqhA COG2862
MYFVAVIFLIYTIAPFLTDKNTMERFLENIMYASRWLLAPVYFGLSLALLALAVKFFQEIIHILPHIFSIAESDLILTLLSLIDMALVGGLLVMVMFSGYENFVSTLDIYEHKEKLSWLGKMDATSLKNKVAASIVAISSIHLLRIFMDAKNIPDNKLMWYVIIHLTFVMSAFVMGYLDKLTRHKH

SEQ ID NO: 8840 - protein, 35 aa, Xenorhabdus bovienii
  Coding DNA sequence: Name=SeqID_2732
MKRVLYREEGTDGISNPQLRYCYDHIPGSRALETV

SEQ ID NO: 8841 - protein, 128 aa, Xenorhabdus bovienii
  Coding DNA sequence: Name=SeqID_2733
  Homolog annotation: Query=11..127bp; Hit=10..127bp; Blast score=79; Percent Identity=37.0; E value=1e-14; Homolog= gb|AAN64011.1|AF434658_8
MNKKTTTQWLISDELWQKMEPLLPVPKTHHPLGCHRHRVDNWAAMNAIFHVLRTGCPWNALNVTGFCSSSSAHRRFQEWLATGVFERFWQNGLLTSEKIGDIDLTKLGLDNHLPKTPPARSKKQKIAR

SEQ ID NO: 8842 - protein, 41 aa, Xenorhabdus bovienii
  Coding DNA sequence: Name=SeqID_2734
MLYLLLLALTAYKNACQIINKLIIGATISFARLIILRFLSR

SEQ ID NO: 8843 - protein, 40 aa, Xenorhabdus bovienii
  Coding DNA sequence: Name=SeqID_2735
LFCLFTLENEIIDVRTHTQPFSGCLFNLLNFSSKNATALK

SEQ ID NO: 8844 - protein, 35 aa, Xenorhabdus bovienii
  Coding DNA sequence: Name=SeqID_2736
MKPLNAYKRKWGTFFTIKTVVIARSMSRFCSVSLR

SEQ ID NO: 8845 - protein, 65 aa, Xenorhabdus bovienii
  Coding DNA sequence: Name=SeqID_2737
MVKKVPHFLLYALRGFIHSILHLIYILLRYPNDSGINKRTKTVNIAIKILTFSPIKKLSHWCSSP

SEQ ID NO: 8846 - protein, 272 aa, Xenorhabdus bovienii
  Coding DNA sequence: Name=SeqID_2738
  Gene classification: Gene name=FadB; Function=3-Hydroxyacyl-CoA dehydrogenase; Function class=I Lipid metabolism
  Homolog annotation: Query=1..271bp; Hit=15..284bp; Blast score=206; Percent Identity=39.0; E value=3e-53; Homolog= mlr3490 COG1250
MGLDTAMVCAAYDHDVLLIDKDPHVLENIASRISSEFRLYRMLEPTLKSVDISKLKERIRITQCYEEIEGSDWVIENVKEDWSAKKSVYEKLTPYLNAKTYVAANTSCISITKIAASLPFPQQVIGLHFMNPVLIKKCVEVIKGFHTSEQTLDSAKQFLASLKKNAVVVEDFPGFVSNRLSHLFMNEAAFLVQDGVATPQDIDRIFKDGYGHSMGPLETADLIGLDTVVNSLHVLYESYQDPKYRCCPLLKKMVEAGNLGRKNGKGFFNYKN

SEQ ID NO: 8847 - protein, 352 aa, Xenorhabdus bovienii
  Coding DNA sequence: Name=SeqID_2739
  Homolog annotation: Query=11..351bp; Hit=15..354bp; Blast score=325; Percent Identity=48.0; E value=5e-88; Homolog= ref|ZP_00110260.1|
MDDLIEKIELNKKPVKCVIWDLDNTIWTGILSEQDDLKLKNGIEQLIDQLDKMGILQSIASRNDASDALDMLKKFNLEQYFVYPQINWGPKSSSIKKIQKSLNISADTFIFVDDQILERDEVNSKFPEVTCIDALEYESILSLPRIANMEVSDDAKLRRQRYQDDILRKEEEETFVGASEEFLSQLDMKFYISKAEPEDLLRAEELTQRTNQLNSTGITYSREQLSQLMNSEEYALFVFELVDKYGSYGKIGLALVHYKDNTDYIKLLLMSCRTLSRGVGSIALTFIMQQAKEHGRKLHAEFKRTPRNRQMFVTYQFSGFKEIEKHPDDTIIFYNDLEQVPDLPHYVDVIIK

SEQ ID NO: 8848 - protein, 85 aa, Xenorhabdus bovienii
  Coding DNA sequence: Name=SeqID_2740
MKDSDVISKEIREFIENNMTVFDDDIELLDDTNIFENGLVNSLFSMRLLCFIEDKFSISIPDEYIERENFVSINKMLELVNKVRG

SEQ ID NO: 8849 - protein, 382 aa, Xenorhabdus bovienii
  Coding DNA sequence: Name=SeqID_2741
  Gene classification: Gene name=CaiA; Function=Acyl-CoA dehydrogenases; Function class=I Lipid metabolism
  Homolog annotation: Query=13..368bp; Hit=22..379bp; Blast score=249; Percent Identity=40.0; E value=4e-66; Homolog= DR1255 COG1960
MEYDIHPLVGIAKKFSDEVLRPSAGLFDEQGEVPREIMREMADLGLLGSILPKEYGGQGIDPLSYGYLTEEIGKGCNSTRALLTVHTSLVGETLVKLGTQEQKEKYLPAMAKGEKIACFALSEPEAGTDANAISTMYEPTENGFVINGHKKWITYSGVADLFLVFAKHDEKVSAFIVEMGTQGLTRKPMRGLMASRGAHLSELHFDNVEVPKDSLIGREGTGFSFVANAALFYGRYSIAWAGVAIAHAALEEMVTYARKREQFGKKIGQHQLIQGLIADSTTAFYAAKSACEKIGYLRNQGDHNSLMEINIAKYYSSSVAMLVANNAVQVLGGNGISNRFPVERLYREAKVLEIIEGTNQIQQILISQHALRKFFRKDSIVA

SEQ ID NO: 8850 - protein, 40 aa, Xenorhabdus bovienii
  Coding DNA sequence: Name=SeqID_2742
MGTFPIASYRTVHESLSIRAVLLFLCNDRVFAEKFSQSML

SEQ ID NO: 8851 - protein, 46 aa, Xenorhabdus bovienii
  Coding DNA sequence: Name=SeqID_2743
MYRSVRGYGEGSHGLLTINFTVKYKALGNYAIGIINFNISLPTDYN

SEQ ID NO: 8852 - protein, 3419 aa, Xenorhabdus bovienii
  Coding DNA sequence: Name=SeqID_2744
  Gene classification: Function=Polyketide synthase modules and related proteins; Function class=Q Secondary metabolites biosynthesis, transport and catabolism
  Homolog annotation: Query=2081..3060bp; Hit=5..1003bp; Blast score =621; Percent Identity=36.0; E value=1e-177; Homolog= ML2353_1 COG3321
MGNNFTGLEVAIIGMAGQFPGADNIRDYWEMLRDGKEGVSRFTNEILKSNGVSEEYYLNKNYIPAKGVINKPFHFAADYFGINHSDAKKTDPQIRLMIESCWQALKHANIDTETYPGQIGVYAGASSQWSWFKALNTEFNSSAEQFHVATLNDLSFCTRISYLLNLRGPSITIQTACSTSLVAVHTACQALQAGECDVALAGGVSITHPHQSGYLYQEGMINSPDGKTRVFDANACGTVFSNGVGVVVLKRLSDAIEDNDKIYAVIKGSAVNNDGSDKISFTAPSVLGQQNVIRSALDFAEVTPDQISYIEAHGTGTLLGDPIEISALNAVFKNSQSCAIGSVKSNVGHCDAAAGILSLIKSALCVYFKTLVPSIHFEKANAKLELENTPFYVNTETKPWHSSDNELICAGVSAFGVGGTNAHVVLQEFPMRTEMVSVEDLEYEELPNRIEFKPTIAAETTDVLHAEVESDSVFVDDEIDIEGLPQNLLKIFQEYFSNQKISQNDNFFDIGASSLDIVQLHEKINNTYSVNLSISDFYRYTNCQKMTEKLLGMIGNKSQGQPKKSKITKKRKVLNNKNRTYQDYPEHAIAVVGMSGRFPGSKNIQEYWNNLLQGKEGISFFTDDELIDAGISAHTLKAKNYIKAKGIVADSLSFDPTAFGYTARESQYMDPQFRLLHEVTWQVLDDAGYGNSKYRPVTGLFASSGSNHAWLDLLKEEIQDTTEQFGVALLNDREFLTTRIAYKLNLTGPAVTVQSACSSSALAITLACQSLQINQCDLALAGGVSVVTPIKSGYTYAKGMVNSADGHCRPFTQDASGTVFSDGIGMVALKRLDDAIRDNDHIYGVIAGYGVNNDGHEKAGFTAPNADGQAACVKQSLKMAAIQASDVEYLEAHGTATQVGDEVELEGIKDALGVTEINARDCFIGSVKSNIGHTNTASGVASFIKTLLALKHQKIPPSCHGTENKHTSLENTRFRLTDVAADWVSHGRVRTAGVSSFGIGGTNVHITVQSIEEQPASSQCQAELITLSSKSREGLVKTMARLGDFLDEEQHSYSLSDIAYTLQVGRGDYDYRTSLVVENVEALKDALHSLKDSNTLPEALPDQTSGIVFMFPGQGSQYVNMAKDLYQELEIFKILLDECHERLSSQFSIDLIGLLYSGDSEEDSEKLQNTQITQPVIFAISYSLAKTLELLGIEAKAMIGHSIGEYVAATMAGVMTLDEGLKLVATRGIIMQECEPGVMLSVAAGRDDLEPFLTDKVALATVNSPNSCVIAGSQADIEKVQQRLVDKNFRTRLLKTSHAFHTPMMKPGAEKFKAALAEVNWQKPTKAYISNVTGQWITLSQANSVDYWVEHLCQAVEFHAGIMTCLEKPGLNVFLEVGPGRTLSTFVKQIAASDANILTFNMMRHPLEAENDRNYLLKLVGQLWMRGISVNWPLLYQNTHPKRISLPGYQFAGENMVMGASVLAAKGVEKASETKIQKNEISEWLYTEAWEDISLPDEATQSDIRVALCFVPDITWCQPLCNSLKLDEKSIKFVLPADAYTSAENVITLVPGDKRHFGKLIDELKQDALLPDSVIFAWPLSGQSDLETSWFSVITLIQSWTTSGSMTDFRLLLANTKQPEHTMLNGLVKVITQEVSKCHPRLVQISPLESIERQCEILTEELLATDERFIVNRTQTGRSTLAYHKLRAGLLKENTLLKNEGVYLITGGLGDLGLLFAEYLIKEYGAKVILSGRRVLPGKHEWKQLASIDNSEAEILQRLDELSELGKGEVAYYSSNVSDKHEMQVLLDAIEEQYGCLHGIICAAGVTRGNSFQGINKLTLEDCTPQIETKVEAYKILAELTENKPLDFCLLCSSIASVLGGLSFSAYSSVSSFADAFAKQQNSQGKPWISVNWDGWVFERNDAGDPIGSSLDQLLIEPDEGLKILECALQSPLRGQLIISTGDLDKRFEQWVGGHLKPFKLNEFNHSQRAVVSKEQIVGTIVSVWQDFLKVTNISRDDNFFELGANSLDMVQVNKRLTDALDMDFSVVDMFSYPTSELLADFIVNQYGITHDTGEQAEHSDTLNQHRDPSAQLNQSSTPIDRQIAIVGLAGTFPGAENIHEFWENLTFGKESVTTFSKEELSEEGIDSGLLENPNYIRAKGVFPNAGEFDAEFFGYTPYEARQMDPQVRALHTCCWQALQDARIATKDNRAKIGLYASASGNLQWLAQAMATAEGSAGQYSAMTVADKDYMSTIVSYKLNLTGPSMVLSTACSSSLVAVNEAVKSLRAGECDIALAGGVSITLPIKAGYVFEEGMIHSKDGKCRAFDIQASGTVFGDGIGIVVLKPLKQALADNDNIYATIIGTAINNDGGMKVGYTAPSTKGQVEVIQSALRDANVMAESIHFVEAHGTGTTLGDPIEFNALKQAFSTDKKNYCRIGSVKSNIGHLNSAAGIAGLIKATLAVKNRILPPTLHYARPNKEIDVTNSPFIVNNQYTELNDTRNPIRAGVSSFGIGGTNVHVVLEEAQVNKDKSFNKKVDNRLPIVLSAPDDKSLQCYKQQLKTFVENNQQQMSVSDIAYSLMQREPMASQFVASACDYDALIKALSSGEKDNVKVKPGTTKRKVVFLFPGQGAQYVTMGHELYHSNGLFKEWCDKGFTLADKYCSIDLKSLFHSRDEDRNLYNTEFAQPLLFIIEYALAQVLKSYGVTPDAMIGHSLGEYVAAALAEVFSFEDAIKMICVRGKLMQSTEDAVMLSVMSSSESVKEILTGSLEIALDNSSDLCVVAGSDSDISSFESDCEAKSIKTKRLRVNKAFHTRYMEPVLGDYAGIIREIAFNKPQIAFISNVTGKWAETDKVVEYDYWVNHIRQPVRFKESITEVLKEGNCLFIEVGPGHGLSTLAENHSDYHANHICISCFDRKNEEINKHSELVQKLGKMALLKIDVNWHAEMADLQPRLVHLPPTPLRGTKYPTDIKRLQALFSGNKNLGYQADKPEEPVSQSKAGSNPHPKAKRSVIDELSAIWKLILGVDTIKEDDDFISIGGSSLSAVQVIAKAKSVNLPVNMSMLLSGQTLVQISASLQSDDETTHKGWQFNEHFSPEMYPGSASCLYSAVREKLKHEHGLTSDDAIMQVVDGSPLLGIGVQQFENATKIVSKPVNYGTLSGWPSLQECYSFSYDKQFFEDYEAYRHYCESELALGHLVIVTGSDYYLPFSPSYGLPESEYIKRPLFENIELGDDDIIPHAFVLVGKTPSGYQIYDGSFQYFGEITEQEFEKTVIGFKGLDFMQSHEVYNKSRSFMVITVTCDGKFHKDNDLKEQTLNRLVTDFQTKQAIESNESHLSYYVGLTALDKLIENPGLIASSSNFDLAEIFSRWYQQMLLLRKFLKISKPEVSTECDHAFSIISEELDKVVACCKNSSDDKTIIDSLLLVKSNLSDIIKNLS

SEQ ID NO: 8853 - protein, 38 aa, Xenorhabdus bovienii
  Coding DNA sequence: Name=SeqID_2745
MDLFTISLLFFNDNSFLHSWLSIKPSLNFGIGIQAIHK

SEQ ID NO: 8854 - protein, 455 aa, Xenorhabdus bovienii
  Coding DNA sequence: Name=SeqID_2746
  Gene classification: Gene name=NorM; Function=Na+-driven multidrug efflux pump; Function class=Q Secondary metabolites biosynthesis, transport and catabolism
  Homolog annotation: Query=13..431bp; Hit=22..438bp; Blast score=145; Percent Identity=28.0; E value=1e-34; Homolog= BH2163 COG0534
MVNKSIFTVYMKLSFPIIFGMSIQGLYGLFDAIFITRYIGTYAMAGFSIFFPVLLIISAIGVMFGTGTAVLVSRHLGASNNGDANQVAIISLISGLIISLFFTLVGLINLDSILYALGATEDIISYAYDYAYPLILCMPILIITIIAGDLLRAEGKTKQMFAIMLTASVANIVFDALFIVVLKMGIGGAAIATIVANLIALIWAFLLFRSHHTAINLSLINFNFKISIVISVLILGIPTLISNLSYGTIIFLVNSLIKESGLDNAGSLLSAYGIIFRILSFLILPLIAMMAALQTLSSYNFGAGKYLRSLSALKVACLISCIYSIILTLSMFLSFDLVFKIFTDDPSLIKETTDIASSIFIGLAFLGLTLIFIGFFQSIGEVKYATFIVLSKLFVQLALLWFIYKMFGVENMALSFVITDISVFVLSLIYLRNKINKWRRNTDIFLENENRNVAL

SEQ ID NO: 8855 - protein, 505 aa, Xenorhabdus bovienii
  Coding DNA sequence: Name=SeqID_2747
  Gene classification: Gene name=AmpC; Function=Beta-lactamase class C and other penicillin binding proteins; Function class=M Cell envelope biogenesis, outer membrane
  Homolog annotation: Query=65..361bp; Hit=53..378bp; Blast score=103; Percent Identity=24.0; E value=4e-22; Homolog= CC3086 COG1680
MKTETSHYNRIVNLVYKSIYKMKFKYLFIFFSFIFINISYAATESTGNDALEKQLVEYMNVGKIPGLSIVILDSKKDAKFIFLGKERMNADKNIDGTTLFELASTSKAFTGFIAARLIEEGKIKGDTKVSSILPALSFYYDSKPVEVTFLQLLHHTSGIPFSSIDFVYGGQDNTSLADMLNKIDKIELQSVPGNSHSYSTINYGIAARMMEIVTQMSYQQLLQTYVLAPFNMNQTSVEAFVENKSTGHQISYLAPRPYNAPFVVANVPAGYIQTNAIDMEKWLRFLSGDDYPALERAKKRMFTPDKAVVTNEGNNSHYAMGWYVDGEKILHTGMNPSFSSFVGVHVGSGAAVAVMANVNSNVTFAIGEQILDQLSSNQQILKLTSPDDVKLFDSFDRVFLIISLIILAFILFIGFRIYRNIFVKERASFPKKNRFILILLIIFCMFCTVLSLILPMAILNISWKTFVIWMPGSFLLMSALLISSLLVSILNCSIVLVRRIQFAKE

SEQ ID NO: 8856 - protein, 1488 aa, Xenorhabdus bovienii
  Coding DNA sequence: Name=SeqID_2748
  Gene classification: Gene name=EntF; Function=Non-ribosomal peptide synthetase modules and related proteins; Function class=Q Secondary metabolites biosynthesis, transport and catabolism
  Homolog annotation: Query=7..1487bp; Hit=5..1508bp; Blast score=496; Percent Identity=25.0; E value=1e-140; Homolog= BS_ppsB_2 COG1020
MSCGNKLYSMTRIQRGIWATEEKYQGTGMFNIGGTCSVEKNLDLVKLRDAIIQVIRENQCLNFVLNNEVPPKLVTSERTEFMIGKFDFSANDKPDDAFDQWRHQVLSAQMQTDSSLYDFSVYKVTERKYGFLIKLHHIIADATTMQNMITRICECYENSVNNKEDAKIVEDDQQYFLDREEKYLSSHSHSKDSEYWQSALSNLDGGTHFILGNKSLATAAKRKVYDIPNRVSDHVKALASLCGCSESSIYLAALYLLLGRFSGQETLTVGMPLHGRKKTDSHRNSMTVSTIALQCEVDEEQSFEDLLHQVSKNTREAYRHQRFDYSDLLKTVSNNNERSEEIFDVSYNYSNTKYEITLENLPLIVEDIFPGEQQYSIQFLVKELFNEKITKIYCDFKTNEYSEQQVDSIINQFIVTCEQVCQFPSRKLVEFDLVSQSQLKEIESAKYNAARTHLTVIELFNQTACTNPERVAVIEGDTEVTYADLQYKMNAIRNKLKEYGISTDSRVAVLLPKSSLQIAALLAIMHIGATYVPLERDLPDERIAYILNDSLCSLVLCPTEWASSLPEHFPHHDLTSLQTSDGIHPETVPCECQSETAAYLIYTSGSTGLPKGTVIRQAELVNYCQWAAKTYYPEKSDVAAYYTPLTFDLTVTSIFPPLLAGATIKIYRESTNFVLSEIIHDSKATVIKCTPSHLQAIKHENIERHCSVRRFVVGGESLKVEVASHTDTQFHGKVEILNEYGPTETVVGCMIHKYNPHHDKAISVPIGIPIDNTQIYILDKHGRHCTPYIKGEIVIAGNGISAGYWNKEELTREKFVTDKFHPSQRSYLSGDLAYRDATGNIIYIGRIDKQIKIRGHRIELDEIESRLLKHELVKDAVVLVDEIESGSAILKAFIVAADKKTASKPLLSDYLSSYLPAYMVPQYFKFIDEIPLTFNGKVNTDVLSQIKFEVEEIDDEIENSDIERNVLDEFKHILRCEELTVNSNFYQYGGDSIKAIQLVTLLQRKGLVVKVKDIFQLPTPRALCRLINDRTPVSCEEEDIEVNEFALTPIMKWFTGLGLDRKDIYHQMLTLKISSQLDNSDLEKIFNRLISSHPILNTYFDESSRKLLVKDNDSLVKIDVLDVICFEEKESIVRNRLNETEWPQTPLFQAVLLRKEGEQELMVFAHHLVVDGVSWRVLLDDLNLLASQRVQGKTLSLPKPNNRFAKWVSLVEDHYRDLDADEQSYWQAQSRSTALADIAKYSSEKPEIKYFNANLTTRDQGQFLQLCSSMKIKPNELFFAIFTYALFKQFDKNNFAVELEGIGRSLHSSDLDLNRTVGWFTSIYPLVIDCNKDIISHIKQAKERLRAVKDNGMGYQSIRYSPTGSQYEYEHKLPRFNYLGDFDQSETTDLIQIKSIHPNIISHEDNLYTDLLDCNIYWEGSCKLSMSYLNTHVNESDITNITNTLRDTLESLLNLEDQLYQRVYTLTDFPTISLSSTELEDLVSQLSI

SEQ ID NO: 8857 - protein, 1924 aa, Xenorhabdus bovienii
  Coding DNA sequence: Name=SeqID_2749
  Gene classification: Function=Polyketide synthase modules and related proteins; Function class=Q Secondary metabolites biosynthesis, transport and catabolism
  Homolog annotation: Query=7..866bp; Hit=8..894bp; Blast score=593; Percent Identity=37.0; E value=1e-169; Homolog= Rv2935_1 COG3321
MTDSFDIAIVGMACNFPDAKTPEEFWQNLISGKESIKKFPHEELIKSGYKEEEINDPNFVAAKAVLDDYKSFDNNVFGYLKDEVDKMDPQCRLLHECCWHALEDAAYAPSHSRERIGLFAGAASNIPWISNLLKQKLTPAETFDIVNWNLPESIITRTAYRLGLNGPVMAIHTACSTSLVAIHTACQSILSGDCDLALAGGVSITLPQESGYLYQQGMVRSADGHCRPFDIDSNGTVGGSGAGILLLKPLDRALEDNDHIHAIIKGSAINNDGQRKVGFTAPSVEGQAEVISSAQMLAGVEAEDVSYIECHGTATEIGDPIEVSALSRVFRNSGNVCWLGAVKSNIGHLDEAAGVAGVIKTVMSLKHKQLAPTLHYHQPNDKLHIEETPFKVVDKLMDWSVSANEKRIAGVSSFGIGGTNAHIVLAEADKQEALHEDEYPNVFLISAETPAALNHNQQNILTALRSSQKHRLCDIAYVLQEGRTHHRYRKAFVGSNIQEIGEALEKVTANPTKAKDSERHIVFMLPGQGAQYTNMALSLYEKHAVFRSQVDRCLTIASRYLGESLKEKWFHNDKVNYLSETQYAQPAIFIVEYALANCLIEAGIKPSALLGYSFGELVAATIAEVFTLEDALKFVVKRGQLMQSLPTGAMLSIPLPASEVLALCSGGIVVAVDNKDSCIVSSDEKSIEEFSQVLKKKRILTTPIKSKHAAHSPAMAAINKQLLRVLSGFTLGEPKTPIISSVTGEELTAAESTSIQYWADQAEKTVCFIRGLENILNNKSCVFIEVGVGRDLVNLVRRYVPQDASQSIIQLLPEDNKAQTQPYLFWSGLGKIWQQGIQIQWRKVSAAQDCRRISLPGYAFEKSVFWPKNANFLSLFSGIQHVEKDQLCIKKNDNMSDWLYQAAWQQHILRSTKPVECTKSALIFKLGSSNDQSTTFEKALLNHYQKAVRVKVGSECELEIEALSTLRCLNYGDYKNLFDLLNNNEISIEEMVIDCINVDLSLNEQLAAVLYLLKSHRAFSSHPNLMNVTLLIQNGVVVCNEPDINPFAAAMMSISTVIRQEFHELCCKVIDVGALNDCSDDKLIREIAERDNKNVVYRNNRRWAEVFLPYSPIMNDETSRLKKEGVYLLIGGRGFIGHTFAQYLATEYNANLIITSRSRQNIDDKWQQVSNDAANLEFAQVDASDRVAMEAFIQDTTAKYGRIDGVFYLAGLTGEASLRSINETESDYIDSHLTSKQKGIEVLEQVLEPVNYDFCLILSSLAPILGGLGFFAYAAASSYLDAFVLRHNRQNDKKWTLINWDGWELAKKTELNAKIGSSLSHLLVTKEEGISLLEEVLKYQEKDAVVISTADINARIAQWSNPSLSKNEEGSDDSGYSARPDLDSEYVAPNSEIEKKLVSIWQEFLRIESIGMKDDFFDLGGNSLKAITLLSRIHKSCQIDVSLTHFFKNPTIKDIVALTDSQFGKSEYQAILPAEEQENYPLSPGQRRLYLQQILDKNSVAYNETAAFSISGKLDKDKFNKTLQSLVKRHDSLRTSFVLINGEPRQKCHQDLEINLEHVKLNSSGLSNEEIKSQVQSLIKPFNLNELPLMRPILIEVKEDQYIFFLDLHHIISDGLSQDIFVRDFLEIYQDKRLKPLDVQYKDYTVWQHNMANSCRIQKQQEFWISNLKQVSELQLPTDYPRTDSHSHKGQRIYFTINKNLSDRLDEFANRENITRFMLFISSYALFLKDISGQDAFAVGTPILGRPQSELQDIIGMFVNLLPITFKLDDDLSFKCFVNNVAENTIAAFENSDFQFEDMVKALNIKPRLNRTPIFDTVFSYMNIGMADFTLPDVKFSRYDISQESSRFDLAFFVKETETGYEFSFEYKSELFRDESIERFKDKYIALLEGIASKPDDSIRLLLGKGEWDKNNTLQTEELLDFNF

SEQ ID NO: 8858 - protein, 243 aa, Xenorhabdus bovienii
  Coding DNA sequence: Name=SeqID_2750
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=14..241bp; Hit=16..242bp; Blast score=119; Percent Identity=35.0; E value=2e-27; Homolog= PA4229 COG3208
MPNLIKLNTPKNAKLKLYLLHHAGGSHMLYRAWQRELPDWIEFNALELPGRGMSFGERSLESIEDMIELFLSKIETDKPFAFFGHSMGALLAYELTLRLQMQSLYPIWLGLSAYKPPHLRNTEAARRGTMTDPELLEYLKTLGDVSELIANEQVLKIMLNIIRNDFKAIENWKMSESIIHPEILVSLYSGQEDTAVTPEIMKDWGRYISGQSQISAFPGGHFYLQKYTLDVINSLSRDIANII

SEQ ID NO: 8859 - protein, 107 aa, Xenorhabdus bovienii
  Coding DNA sequence: Name=SeqID_2751
MKYVIIWTLVFNEKWNALNRSERQQLQNESLPEILSKYKNSINMRTIDTEGFTADFQDFAIIETEKLDDYYCMLQDMRNTRVLSEGYLKISKVFMGIENAHEIYESN

SEQ ID NO: 8860 - protein, 1051 aa, Xenorhabdus bovienii
  Coding DNA sequence: Name=SeqID_2752
  Gene classification: Gene name=EntF; Function=Non-ribosomal peptide synthetase modules and related proteins; Function class=Q Secondary metabolites biosynthesis, transport and catabolism
  Homolog annotation: Query=2..1015bp; Hit=5..1042bp; Blast score=459; Percent Identity=28.0; E value=1e-128; Homolog= BS_ppsC_1 COG1020
MPVNYNIVALSPLQEGMLYHSIKEESKSIYVTNFTLVLNGDINDKRLEKAWNKVVSEHDSLRTILRWRGLSQPVQIIFKHKYNPLSVIHVNPDLVHDINSYNDRIKFCETEIDLETNPVKLTLHKLSTYKSLLHLQYHHISLDGWSLGILINQLWSYYDNEHLSDEDCNLNYEHYIQHLNKVRDCKGTRDFWINKIDVDAAISLPSINDSETYSIKCLTHSLDKILLQSVDKFCKSNEVTIATVFYTAWSLILSKYNDSNSVCFGTTVSGRDNLLAGIEDSIGLYIQTPPLVVDNLNGSLSLKSLVKKLHNQILERDGYTEYPISEIQHVNQVRQNLFDSIVVIENYPLAKRLSALSTHVSVESYDIFETTNFDLTLEINLLDDALLKFSFNSAKFDKEIMDKVLIHFSKIIGYIATQPNLTLSELNLLDDEEYKNIVFDFNDNDIVSDKPLHSVDAWNKSVENHSNEVAIRSANDVFTYNELDRIVNKIAQGLISKGITSKDLVAVKCKPSAHTISLFIAINKIGAVYVPLDISTPEERVSNIITQGVKWLIEDTELRSFVALPTVEAKIPEHDHQENDLMYTIFTSGSTGEPKGVMVEHQTVMNYVYWAIEKYHYDSKKTVYPLFTSLAFDLTVTSIWCPLISGGTIEIVGKNSLESIQEVSKLAATTHIKLTPSQLNLLSQTTDFCHSNLSTFIVGGEQLETSLCRQVANSLVNPSGIFNEYGPTEATVGCMYYQYDPQADKKKLSVPIGRPINNARIYVLDRFLQPQPEGVPGELYIGGKILARGYLNKDELTSERFISNPFIPNERMYKTGDLAVIRAGGIIEYIGRNDNQVKVRGYRIELDEIASVIRSYKDCHNAAVLVKDIHGESQIVAYYVADVHIPESDLRAYINARLPDYMTPNIFIKLDRIVLTSNGKIDQHTLPEVTPERQSKFVFNDKSEHKQKVIEVFENVLAVSDIDQNQSFFELGANSIKILRIANILNEFLPRKIKIVDFFTYTNINKLVSYIEHNTSDDSVINIKSASETVSRRAKLANRRKTLIEKASLEH

SEQ ID NO: 8861 - protein, 152 aa, Xenorhabdus bovienii
  Coding DNA sequence: Name=SeqID_2753
  Gene classification: Gene name=WecD; Function=Histone acetyltransferase HPA2 and related acetyltransferases; Function class=K Transcription
  Homolog annotation: Query=18..149bp; Hit=8..140bp; Blast score=81; Percent Identity=29.0; E value=3e-16; Homolog= yiaC COG0454
MSNKYSGDIKLRPIEIDSDVQAVVDVWFNTSIECHEFVSKDFWYSCKKDMKEIYIPNSETVVATINKEIVGFISLLDNILASIFVLPEYQNRGIGLQLLNHAFEVRNSLTLNVYEKNTKARQFYESQGFEEKEQGIDEHTGEPEITMVWSRS

SEQ ID NO: 8862 - protein, 33 aa, Xenorhabdus bovienii
  Coding DNA sequence: Name=SeqID_2754
MNIPASLKLRWYGAAHRFPLSFSDDKIINTEIT

SEQ ID NO: 8863 - protein, 858 aa, Xenorhabdus bovienii
  Coding DNA sequence: Name=SeqID_2755
  Gene classification: Gene name=EntF; Function=Non-ribosomal peptide synthetase modules and related proteins; Function class=Q Secondary metabolites biosynthesis, transport and catabolism
  Homolog annotation: Query=142..849bp; Hit=372..1062bp; Blast score =322; Percent Identity=30.0; E value=9e-88; Homolog= BS_srfAA_1 COG1020
MINEVEELNKIQKKEHFWRGFINNCKHPEFSNYFTKSNDNSGVDKIYLSSEISKNLLSIANGSDKRLSALLISLIGFIQSTMLRTNESVILTTSYHCEDESAGMLCVPVKLIYEKTLIDLIKSTSKSIQDVLPYGVNSFTSIFEGAVQFTSAVILKNCQSVNKEIEDFSCSQLIFEHDGENIFCEIHSPYDANYYNEIIKMVELLVRQIRSENPLSSLKLSESSHIDVNKTVPEIESGSTIPALFMKRVKMHPTRIAVTDAHASFSYAELDELSNLFAFEMLKQGVAKNDTVGIHMKRSCSAIIVMLAVLKIGAKYCPFDVNWPIKRKIYVKDTAAIKYLIVSHDTACELSDCNSIIYGSTDSTTNTNLDAEFNDAEAGDSAYVIFTSGSTGNPKGVEVSHGAVINLVQGLYERVYKNYSGSLNVSMISALSFDASVQQLYPSLLLGHTLHIVPDDMRRDGRKVVEFWNENNIHIADCTPTHLRMIHTQFNEQAICCSVNHLMIGGELLEKHNWYNFAKCWQSVPNASNAYGPTECCVQSTSFEFNDSRQIHTTTIPIGFPMPGEKVVLIDDFLRILPEGAIGEIAIAGQGLAKGYINNPELTAQKFVMIDGERYYRTGDLAQYVGDVGLVYLGRLDNQVKINGYRIELGEIEIAIQQVMTELSSTNQFDAKPICDVFVTVNSQDSDNKFLVAYLYSNIEFISDDIKSALAERLPDYMVPAYFIQLEAFPQNSSGKIDIARLPDPSNFIVNKRVIPCSNETEEKILGLWSEILNTKKENISSCDNFFDLGGSSFKLVQLSLSLGELFNKEIEVVDLFQYTTIKQQAELIDNNGENDNIVISEDHSVEQFDEALKMFGN

SEQ ID NO: 8864 - protein, 1487 aa, Xenorhabdus bovienii
  Coding DNA sequence: Name=SeqID_2756
  Gene classification: Function=Polyketide synthase modules and related proteins; Function class=Q Secondary metabolites biosynthesis, transport and catabolism
  Homolog annotation: Query=20..876bp; Hit=8..893bp; Blast score=570; Percent Identity=37.0; E value=1e-162; Homolog= Rv2935_1 COG3321
MSQRENLNNKSHQDLTGLEIAIVGVSCRFPNSPTIESFWKNCLEGNDCITRFSDEILAKNGVPKQDYSSNNYVNAKGVIDKPMAFDADFFNYNKREAEFLEPQIRKLHECGFEALGSAGLVPAVYAGKVGCYLTASAQLQWQMAAYEECEQDGASLFSAFNLVEKDFAATRLAYKLGLTGPAVSLQTACSSSLTAIHMAARALLLGECQMALVAAAALVTPNQQGYLYQDGMITSPEGVCRPFDEKANGTVGGEGIGAVVLQPLKQALADKRPILALIKGTAINNDGARKVGYTAPSIEGQADVISSAIKMSKIDPESISYIEAHGTATKLGDPIEISALKKAFPGCPAQSIAIGSVKSIVGHLDSAAGMAGLIKTALMLKNKMLCANQYFTNPNPQIKLESSPFYINQNSQEWVSQSIRRAGVSSFGIGGTNAHIVLEESLFQPSGSEPAERLTLLPLSAKNESSLAMMEKALLDRLADKKDTLSDIAYTLQNGREYFSHRSVLICSESQGSYCESDFIRGKVEYTGKKIIFLYPGQGTQYQGMAYGLYQHEKTFKDSVHQCLHLLPEDQQKELTDFFIGASEQNDASSEITQLAIFVVEYATTRLLESKGFKPYALLGHSLGEYVAATVSGVFSLDDALHLVSQRARLMQRMSPGTMLSVPLGMEKLQDYLDDTLEVAAINGRESIVVSGAPADIERLESLLQNAGIICRRLKTSHAFHSRTIDEIQTEYAETLSTINFSKPYIPVLSNLTGTWHSEEEIMQPDYWLSHQRQKVDFLGCLETLSESNDLIFIEVGPGNTLSSFTQKYFQSKNENKPLVVNALRHPKLPEDDQEYFYGQLAKIGCASNEIYWQNINQQKGNLIHLPVYQFSQTEYSKIRDRLISGPNKKRHSVDPDQSSTYLPGWQREVNFQTEEVKQSQSVFLLCPRTAEPNRRTLAKVLWPDSDVFFIDELDKLASLKVTAECTFVLIPDQREFSTDPIEHYLQWVDSLRTLLSSIPLQSMRFILFTPEIENVLGYEQALPAISLLKGLVWSIPLEYQKHQAMQIDFAMQDLADNNKLKALIRTIASSDKYRQAAIRHGQLWIPEFKPLPAHQLVHVNKCHELNVGGLVFISGGLGGIGLKMAESLADQYKARLILASRSEFPDRSKWEAIKNDPTKVETASKIASIERIEQLGGEVHIHQVDVSCKTALHVLLTAIESELGKFSMVIHSAGSDAGALIMQPDLALHREIMAAKVTGADNLISYFSDKDLRSMLFCSSLLSYHGASGQSAYVAANAYLDALTDNQESPFRIHSIAWDRWLEVGMAAKNIQDSNETIGLTNQEGQALFLQAIAYYPERMAVSVLPINKRLQESERSKVRVKSGPAEKAILEAKTSVKQTILEVLKHQLGLSEIDERARFFDLGATSLDIVQINERLKQKLNADIPIAMMFTYSSVIKLEGALRPVLNKEDHLSEDKIDDLQSGGRNLAKNRMNKRLKRQAPLKNE

SEQ ID NO: 8865 - protein, 62 aa, Xenorhabdus bovienii
  Coding DNA sequence: Name=SeqID_2757
VLLPAFNYKYGLCAGMTLTTWKHARHSDGLITTVKARGCLLQGNEQLGTATEFIRSLMEPVF

SEQ ID NO: 8866 - protein, 57 aa, Xenorhabdus bovienii
  Coding DNA sequence: Name=SeqID_2758
MAPYHDPPLFSAVWSVESNGGDTLSHHPNHQEQLSYRKGDIRLLFVNGKLKYMCKNG

SEQ ID NO: 8867 - protein, 41 aa, Xenorhabdus bovienii
  Coding DNA sequence: Name=SeqID_2759
MDYDQNRDIDCLEYISSALPMMLNNMPQSVIHFYTYILTYH

SEQ ID NO: 8868 - protein, 37 aa, Xenorhabdus bovienii
  Coding DNA sequence: Name=SeqID_2760
LIIIHIPFYRFSLLLLPGNDPRDGVNQSTLTQVTTCT

SEQ ID NO: 8869 - protein, 49 aa, Xenorhabdus bovienii
  Coding DNA sequence: Name=SeqID_2761
LLICKNIIYEQCVRQPPATGFFTGKTVDHGQYRGVLSNIFWLSASRNLC

SEQ ID NO: 8870 - protein, 1044 aa, Xenorhabdus bovienii
  Coding DNA sequence: Name=SeqID_2762
  Gene classification: Gene name=AprE (BS); Function=Subtilisin-like serine proteases; Function class=O Posttranslational modification, protein turnover, chaperones
  Homolog annotation: Query=26..604bp; Hit=8..556bp; Blast score=263; Percent Identity=34.0; E value=5e-70; Homolog= PA3535_1 COG1404
MVTEMNKRYRIFQQTPVAGRLPVKTQPRVLCRAVACCLAAVSASAFAGSYNDPGQLNNPASWRTSEFRADWGLGAIHAEEAYARGYTGKGIKLGIFDQPVYTKHPEFMSPDKVITLVTSGIREYTDPYIKVKKGDKFNYDGTPTKGSSGKLGAHGTHVGGTAAGIRDGEKMHGVAYNAQIISADNGDPGPEDGIVLGNDGGVYQAGWNALIESGARIINNSWAIGITKKFTVGGYNPAYPHFTVADAQKQFDEIKLILGTKPGGAYQGAIDAARRGIVTIFAAGNDGNLNNPDAMSGLAWFVPEIAPNWLTVASLQQDLKSTNSVPYSISDFSSRCGYTASLCVSAPGSQIYSAIISGTGIDNLTTGYANYNGTSMAAPHAAGSIAVLMERFPYMTGEQIASVLRTTATDMGEPGIDALYGWGMINLGKAIHGPGMFYTEEDIPQAFRIPDPNGVAYGNSQFIADISGIGSVLDKGKPTERICDSQLCAQDTWSNDISGHGGLTKQGSGALILTGQNTYSGPTLVRQGLLGISGELTSSVSVLESGVLGGNGTLGALSVQRGGTVAPGNSVGTLSVSRDVAFEAGSHYAVEIAADGRSDHIQAAGSAQLRGGDVSVSLENSANLLSRNEVRSLIGQQYRILSAKQGINGRFDQVAPNYFFLGTSLSYQPAEVTLHVGRNNTAFADVAKTPNERAVAAAADTLSVGNPVYESILSFTSADQARQAFSRLDGQIHADIASSLVNDSRYLRDTLNTRLSQAEGRASSSDIREDDNGAWARLLGAWNHASGTDNSTGYQASTYGVLLGFDAPTDAYSRLGIATGYTRTSLDGGYDSNADSNNYHLALYGDRQFGDLALRAGGGYTWHRIDTHRSVSYGSQFDSQSAKYSGRTAQLFAEAAYNLPAGSVNFEPFVNLAYVGFRNDGINENGAAAALHSDKQHTEAKLSTLGLRANHSWQAIGGTSVALQGELGWQHQYGDRERATSLAFRGSDTSFVTRSVPVSRDGMVLKANAEMTASDNVSLTLGYSGLLSSSHQDNSVHAGFNWRF

SEQ ID NO: 8871 - protein, 45 aa, Xenorhabdus bovienii
  Coding DNA sequence: Name=SeqID_2763
LWPHRSPVCNCPYWEWNSQLGSVILSKAFHMKRFFICYSRRAYCE

SEQ ID NO: 8872 - protein, 48 aa, Xenorhabdus bovienii; identical to SEQ ID NO: 6457
  Coding DNA sequence: Name=SeqID_2764

SEQ ID NO: 8873 - protein, 55 aa, Xenorhabdus bovienii
  Coding DNA sequence: Name=SeqID_2765
MYRPSSNCSGFSDVTSCTRKCGSSCKYLMFRTVSKLIFSDLYSEETLPNVSVLQT

SEQ ID NO: 8874 - protein, 83 aa, Xenorhabdus bovienii
  Coding DNA sequence: Name=SeqID_2766
MDEYGLHQIDNYPLIVSRFHTNMLSSSIIPSIKTDAFLSYNPEYCRRELKKERSLLKPAKSESIRQKKKRTNKIAKASRRKNR

SEQ ID NO: 8875 - protein, 36 aa, Xenorhabdus bovienii
  Coding DNA sequence: Name=SeqID_2767
LRRLLAERTDKNTSMLVMVYQRSLFAQIRLLDLAYR

SEQ ID NO: 8876 - protein, 37 aa, Xenorhabdus bovienii
  Coding DNA sequence: Name=SeqID_2768
LRTGSFVPRAGLANAVVFQSIGTGSLGLRTNYNKLIQ

SEQ ID NO: 8877 - protein, 54 aa, Xenorhabdus bovienii
  Coding DNA sequence: Name=SeqID_2769
MNYYCSIDIFYNSARLDNRKIVSGLRRLLIDRSSFRRCFISEKLCPGNFTYPIL

SEQ ID NO: 8878 - protein, 146 aa, Xenorhabdus bovienii
  Coding DNA sequence: Name=SeqID_2770
MEEYKKSCEDELDWVIVNQLHEATLQMSKSCFEFKKICIGLIGATLAILAKLTDGKLDHSYFYITLILCSGFWIADFSAYYFQRKTRMAMNRKLAALANRNSIKDYPSDNLEVTWLKAAFNHSMVLYYVFAFIEVSGWLVYVTIGK

SEQ ID NO: 8879 - protein, 114 aa, Xenorhabdus bovienii
  Coding DNA sequence: Name=SeqID_2771
MNIFVSYTTRDDNVDKTLLESISEIVSLYGHCYIDLLHNTEKDKQRHVEFMLSQANLLILIASNSIFTSKWVQWELSEAKRCCIPIIIVDAKSDMSNILKNLKSILTSNSYLSS

SEQ ID NO: 8880 - protein, 30 aa, Xenorhabdus bovienii
  Coding DNA sequence: Name=SeqID_2772
MAQGCCCSPDKLRLQSIQIFPMHHRLKSIH

SEQ ID NO: 8881 - protein, 52 aa, Xenorhabdus bovienii
  Coding DNA sequence: Name=SeqID_2773
MFCEGLLDSMMIWYTYGVSHAIFYILKLKILSTVKQFNCSDVSYGTGLLLQP

SEQ ID NO: 8882 - protein, 40 aa, Xenorhabdus bovienii
  Coding DNA sequence: Name=SeqID_2774
VTRSGRLVYNSFMPHCVLMPMTELYRQPIFTIYKLMVRAC

SEQ ID NO: 8883 - protein, 104 aa, Xenorhabdus bovienii
  Coding DNA sequence: Name=SeqID_2775
MRLRNLHRHQTDGICFQRCADVPHGCVLPCRLQECYCRCPKVILTSDRIIDKSDYANKRKSSGQWVIHFPGQKIMSGTRWPFGLIGSRLSMLISRGDPFWPLGL

SEQ ID NO: 8884 - protein, 43 aa, Xenorhabdus bovienii
  Coding DNA sequence: Name=SeqID_2776
MANRPVTQRGTRFPLGQVFPVVLSGEYHATKYNPGHGAHCARV

SEQ ID NO: 8885 - protein, 144 aa, Xenorhabdus bovienii
  Coding DNA sequence: Name=SeqID_2777
MQQNTTPVTVHTVPASELSPFAEIFPHTGSLELMLLEHTFIKAAAVLCDDDRCDQWQYRKVSDNIAYVVPTRSDSSVVNVNTTDFKGEVSADAFGLMVTLSVLGYLAALMKLDGYAERFCDLCEYALQHPQASCIRAALGLKGA

SEQ ID NO: 8886 - protein, 153 aa, Xenorhabdus bovienii
  Coding DNA sequence: Name=SeqID_2778
MPNNELIMLDSLALSVVFPDKTPLERLFLGFLLANTASTLCGDYQPEQWTSRQVSESLTYMVPTRAETYSVYLPVTQLTVTLSADAFGLAVTAIVSARIAVLDTQNKDAYRFCTLREYAQQHPESGLIASVMTLKPREGVISPSLIPNKNNHY

SEQ ID NO: 8887 - protein, 41 aa, Xenorhabdus bovienii
  Coding DNA sequence: Name=SeqID_2779
MGFMVLFLDFMSMKENTRPIPGRCFGFPGQALKKSVNSLMG

SEQ ID NO: 8888 - protein, 185 aa, Xenorhabdus bovienii
  Coding DNA sequence: Name=SeqID_2780
MNPIFLPAPDETDTALREELFTAQVTGLRQHPKAPQSLQPETLMVCEASTVTEMVLRLKVIHLLGDWPVPERLSAQVAGAFFPLTVMIFDAQDRKVLGGRFDEEIIWAQPVTLTSERLSLEQQQQRLCQAAMLEQSWQNTPAACALWHKVHLLSLHGVSSCYQQCHEVRDILRYGVSVSAFSEGA

SEQ ID NO: 8889 - protein, 85 aa, Xenorhabdus bovienii
  Coding DNA sequence: Name=SeqID_2781
MMATLHLTVWQVIAAALLKRHFGLSLTDTALCETDTVAELIAGGVRPSEAINELVDKYDLTRLNTQVIPRSTPYLDIHDELTGHF

SEQ ID NO: 8890 - protein, 30 aa, Xenorhabdus bovienii
  Coding DNA sequence: Name=SeqID_2782
MIKINRRNRPIRSTVPPMGRLKKSVTAWFA

SEQ ID NO: 8891 - protein, 324 aa, Xenorhabdus bovienii
  Coding DNA sequence: Name=SeqID_2783
  Homolog annotation: Query=18..286bp; Hit=1..271bp; Blast score=193; Percent Identity=40.0; E value=4e-48; Homolog= ref|NP_928356.1|
MGRFRLFIFIIQVRNLTMAEWCTNQLEITGKSVCLDVMQQWVCGEEVPRYRQAVLQSLRLFLAGCAGILKPTKPQTYTPYPALVRGTAVPTAQYLAFEQWLLLLQNNVPLNTDNIKRIDNLYRQSGLSLMSWDKVPEAARDIMARLLTRQYTDWFGMVGWSDTPDIGACWDKLNAYPQAAQPCDMLMMMSTNLATEINGNSTLLKGIATTAQFYDEQYGMEWPFGHHVRWERRNVSSLTVRFDSSWAPPSAELMGELSLMFDCEIRHWYSEASGQLKGYDCYDQGEHVDSGHGQSGRENRPALYLVTGEQAETALALPAIAVGQ

SEQ ID NO: 8892 - protein, 46 aa, Xenorhabdus bovienii
  Coding DNA sequence: Name=SeqID_2784
MPLRVFLAEQKAKKGKHAPKREPVPLSVDVKINGYCVKRRAIAQPR

SEQ ID NO: 8893 - protein, 228 aa, Xenorhabdus bovienii
  Coding DNA sequence: Name=SeqID_2785
  Homolog annotation: Query=6..222bp; Hit=15..230bp; Blast score=238; Percent Identity=54.0; E value=7e-62; Homolog= ref|NP_928475.1|
MASRTDHQKEFISLFKQTARYHTRYQVFRDFCNCAMAAIHNKHCFSEELEQYYLKTINKYERVDVDRIVQLFSHVVLGLAQEPGDFLGSVFMRLELGDKDLQQFFTPWSVARMMAQMQLQDAAGLLQTQPFVTLCEPCCGAGCITLAAAEVLRELGHDPLCSLWVYAIDIDPLAAVMAYIQLSLTGIPAAVTIGNALHDGGDKRTRYTPAHYLGNWSQRLREAELIAA

SEQ ID NO: 8894 - protein, 207 aa, Xenorhabdus bovienii
  Coding DNA sequence: Name=SeqID_2786
  Homolog annotation: Query=55..160bp; Hit=30..133bp; Blast score=102; Percent Identity=51.0; E value=3e-21; Homolog= ref|NP_928357.1|
MNRVRLIFIFVKRVVPCFRPGFTDTEPNLNRKRKTMFQRFKSRFTRDLSPSQEAPGLAPERVRGAGGYFRPQSAEVLLVTSERGQYLRQLWENSALPAGLYQQFYLDPLRQLCARVQHVPATQEGIWSYRGGFIDLTLQFTACAVRLAKGHMLPPGVAPEPDTTAPSTSGSSMPLAVRLSLPIRILNGYGSVTVPLTGTRPNNAVMA

SEQ ID NO: 8895 - protein, 318 aa, Xenorhabdus bovienii
  Coding DNA sequence: Name=SeqID_2787
  Homolog annotation: Query=1..287bp; Hit=1..305bp; Blast score=255; Percent Identity=47.0; E value=5e-67; Homolog= ref|NP_928408.1|
MEVKSNALVKILVPTVLVIGGFIGIKSCSSTDNTASNTTQNNALATLSPEELQALGVGGDTPEDTLRTLIGTLNKVRAEQKRLSQQNTDILKENDQLKNQNQDVAGQIDAAVAAIRQEDEQRQRVLQDDQQGLLAQIDLLTERLNSTPLSVPESQSALSSPYAVSPVSGQGEFIWVNPADEKPTVLQAMGNGQSTPQYPTSFLSEQSATGQKGQNEPARKEKNETPVYTLPENTTLVGSQAMTALLGRVPVNGTVTDPYPFKILIGKDNLTANGIELPEVEGAVVSGSGATPGGNMCPFASRTAQAVNCRVRSINPPR

SEQ ID NO: 8896 - protein, 173 aa, Xenorhabdus bovienii
  Coding DNA sequence: Name=SeqID_2788
  Homolog annotation: Query=2..172bp; Hit=109..302bp; Blast score=172; Percent Identity=51.0; E value=2e-42; Homolog= ref|NP_928407.1|
VTAGKTDATEPVRIIYPNEKQPASTETSQHQSKPQLSAPVPVALTRYAAQQLYAPLRTVEPVTGIQPVNLHLASSITTLYPSEPIAISPLAGWRWNNHTVMALKLRNTAKRTITLDPRILQGQFVAATFQHRWLGETGSPEDTTVLYLVTKGLPDNTFIPEPTSVKPGGRHGG

SEQ ID NO: 8897 - protein, 92 aa, Xenorhabdus bovienii
  Coding DNA sequence: Name=SeqID_2789
  Homolog annotation: Query=19..92bp; Hit=20..93bp; Blast score=95; Percent Identity=66.0; E value=1e-19; Homolog= ref|NP_928407.1|
MRGYPSFPRCVWLGLASILLFSTGVKADELLKWERIPLPITLKVGQERIVFADRNVRVGFPPSLHDKLRVQSTGGAVYLKASRAFPPTRLQL

SEQ ID NO: 8898 - protein, 218 aa, Xenorhabdus bovienii
  Coding DNA sequence: Name=SeqID_2790
  Homolog annotation: Query=1..217bp; Hit=1..217bp; Blast score=310; Percent Identity=71.0; E value=8e-84; Homolog= ref|NP_458653.1|
MSRFRHAIKSKDQHVLTLRVACGILVLVLLLTLTGWMASPRNLTIHNPPDLRSGSTRPWWEVPAPSVYSFAFYIFQQLNAWPKNGAQDYPAKIYALSPYLTPACQDFLREDAKTRADSGELPGRVRVVYEIPGRGYETRSVTVRDRDNWVVRLDLVADEYYHAEPVKRALVRYPLKVVRWEGDAERNPFGLALDCYDGVPQRLEAMPPPLEEKKGVFQ

SEQ ID NO: 8899 - protein, 124 aa, Xenorhabdus bovienii
  Coding DNA sequence: Name=SeqID_2791
  Homolog annotation: Query=1..113bp; Hit=2..114bp; Blast score=121; Percent Identity=59.0; E value=3e-27; Homolog= ref|NP_928406.1|
MQTIPFLPDRLNAEPVVFRGFTTPEMGLAAIAGVALGLIVSLPLILLVGWVMLPTGMLMMPLLLVSFGGRWLVQLKRGKPENYLWLKLAEKKRRLCIGDPALIIAAQGWSLRRSRQAHRSRRVR

SEQ ID NO: 8900 - protein, 125 aa, Xenorhabdus bovienii
  Coding DNA sequence: Name=SeqID_2792
  Homolog annotation: Query=24..125bp; Hit=27..128bp; Blast score=105; Percent Identity=64.0; E value=1e-22; Homolog= ref|NP_928405.1|
MKQIFTDCRRISTNLITRISVFLLLSGLSCQPARADLPAIEPPKSGGGGGLLGQVKGYAQDGIVIGGLILSAVAFFKVASAAVETFSEVRDGKATWTQFGSIIVVGIVLLVAVIWLLAKSASIIF

SEQ ID NO: 8901 - protein, 78 aa, Xenorhabdus bovienii
  Coding DNA sequence: Name=SeqID_2793
  Homolog annotation: Query=1..78bp; Hit=1..78bp; Blast score=78; Percent Identity=55.0; E value=2e-14; Homolog= ref|NP_928404.1|
MTPAQRNAFEVASGHFDITFLYLVCVGFFLSTLFLWAAWAAVDVWNGWANEKIRNQTISQFAIRMAVLLVVAVWMFAS

SEQ ID NO: 8902 - protein, 109 aa, Xenorhabdus bovienii
  Coding DNA sequence: Name=SeqID_2794
  Homolog annotation: Query=23..108bp; Hit=7..90bp; Blast score=79; Percent Identity=53.0; E value=1e-14; Homolog= ref|NP_458650.1|
MRDCFSISGSACLLGLIVLCMPLAHAAEKDELASARRLIDQVQMALERANIAEKQSDTSTLSRYDFDYSRIRADLNTIKVGIDHYLMPSRDQPRDPVPISGDYRQEHPQ

SEQ ID NO: 8903 - protein, 37 aa, Xenorhabdus bovienii
  Coding DNA sequence: Name=SeqID_2795
LPTFSYSSSGTCKSIRSILLAPLIAKFWLNKLVRLFS

SEQ ID NO: 8904 - protein, 230 aa, Xenorhabdus bovienii
  Coding DNA sequence: Name=SeqID_2796
  Homolog annotation: Query=1..184bp; Hit=33..249bp; Blast score=80; Percent Identity=26.0; E value=2e-14; Homolog= ref|NP_065371.1|
MLRIDLHVPDDEYEKVGKLGAHWDAADQTWYIDSSFDPEPFMQWLPFYNVHAEYWYLAQTRTICPHCHEPTTVTAFMLPAGHQLLEADSDDEPCTEIDYTEQDSPAFLFYIADIPTVVRSVLPGFHHTLRKAVSQRLHRQHWINHCEHCGAQQDDTELFAEIGGAFFPATKEQAEAIQLHRIEQPFVGYCEDISHHHDRFDPKQDYHLCNACDWFASMTLIINNQSTSRH

SEQ ID NO: 8905 - protein, 47 aa, Xenorhabdus bovienii
  Coding DNA sequence: Name=SeqID_2797
MTSKRISEHKEFSEDKYDKRYLLSANEPLRRPVCEHRHHTFIDFFNI

SEQ ID NO: 8906 - protein, 203 aa, Xenorhabdus bovienii
  Coding DNA sequence: Name=SeqID_2798
  Gene classification: Gene name=MdaB; Function=Putative NADPH-quinone reductase (modulator of drug activity B); Function class=R General function prediction only
  Homolog annotation: Query=2..195bp; Hit=1..192bp; Blast score=197; Percent Identity=53.0; E value=8e-51; Homolog= PA1225 COG2249
LVHALIVISHPISDSLSGHVAQYIADGITQSNPENSVELADLAKEGFDPRFTESDIAAFYKESLPPVDVIAEQSRIALADALVLVYPVYWWTMPALLKGWIDRVFCHGWAYNEHPDGRLEKKLQHLPVHLVAIGAAGRETYLKHGFWDAMKTQIDHGIFDYCGAPVITSELLLHPELKDTNAYQEAAYDIGRHIFSMAEVSEA

SEQ ID NO: 8907 - protein, 229 aa, Xenorhabdus bovienii
  Coding DNA sequence: Name=SeqID_2799
  Gene classification: Gene name=AcrR; Function=Transcriptional regulator; Function class=K Transcription
  Homolog annotation: Query=40..228bp; Hit=12..200bp; Blast score=204; Percent Identity=59.0; E value=7e-53; Homolog= PA1226 COG1309
MIKDKRNLYTKSRLPLVSYLWYINMSSNKAHSKLANSQTRIRLTREERYQQLTAIAWQIIRNEGTEALTLGRLAEKASVTKPVVYDHFGTRSGLLAALYIEFDNRQTIIMDTAIQQSEPILEKKAAVIASSYINCVLFQGREIPSIIAALAGSPELEKIKREYAKIFVEKCRVILVPYTQSGKMTAASLWAMLGAAETLSYAAANGDITATQAEIELSAIIIAMVERSL

SEQ ID NO: 8908 - protein, 252 aa, Xenorhabdus bovienii
  Coding DNA sequence: Name=SeqID_2800
  Homolog annotation: Query=1..252bp; Hit=1..250bp; Blast score=237; Percent Identity=53.0; E value=2e-61; Homolog= ref|NP_928401.1|
MAQSENQSRQSSQPPRKHGLLYRLLWEWPWQLIGFIVMSWLFSLLLEYVGMTFFWPEQGTSHSQAMMKTELQFLSTEFTQSLLFSKPSQTVSDGLGQAYQWLFVDSGFIHRIQGQQQYQLNSRNDFLHEFNAILQDVSGYLREYCLATVFITMVTLIRLAILLLSVPLFVMVVLVALVDGLGRRDLRRYGAGYESSFVYHHAKRGIKPACTIPCVLYLFWPDVVYPTVILLPAVLFLGMTVVITTSMFKKYL

SEQ ID NO: 8909 - protein, 388 aa, Xenorhabdus bovienii
  Coding DNA sequence: Name=SeqID_2801
  Homolog annotation: Query=178..384bp; Hit=473..682bp; Blast score =275; Percent Identity=63.0; E value=8e-73; Homolog= ref|NP_458648.1|
MSGRYVVEALLRPAVELNTAVVSSVAAFICICAPWAIALTPSVSYVMAGGFAVLAMIRTWQGIQVIHYRRNLRRLPRYQMSTKQIPVSHQRLFLGKGFRWQQKHTQRLQDTRRPEVERFVQPPQIYQLARALERRTEYRWPGLSALLRKDSPLNPVRPLPPVGGNPMIHGIEPQETEVFMDLRERVGHTLVMGTTRVGKTRLAINLHCDEFNELMGDEFIPLINKGGGAGMQVTAYTQTSSDIEARISSPAKTAQVIGNFNTLIMLRVRDNRTAELLTSQLPEVEIYSKTLVSGHSDIADVEQGQDFTSSTQDRVGTVKTPLVTPAEMINLPKGQAFALLEGGQLWKIRMPLPTGDDDDALMPANLQKIAEQMRRHYRTSENWWEEKG

SEQ ID NO: 8910 - protein, 109 aa, Xenorhabdus bovienii
  Coding DNA sequence: Name=SeqID_2802
  Homolog annotation: Query=1..106bp; Hit=71..176bp; Blast score=122; Percent Identity=61.0; E value=1e-27; Homolog= ref|NP_928399.1|
MLPVKTPELTPGKVTRRSLQLPGMGALFLIGDDPDSRQWLSQNAERLKARHAVGLVVNVSEMSGLQSLRTLAPDVLLSPASGSELARRLQLQHYPVLITETALTQQPSP

SEQ ID NO: 8911 - protein, 78 aa, Xenorhabdus bovienii
  Coding DNA sequence: Name=SeqID_2803
MAYHVITMKRLSILPMLGLLWINICQAELNVIADLGGKDASPFYAGINAQPSDEPPPSVQHFSPEVAGEKCCQSKHRN

SEQ ID NO: 8912 - protein, 233 aa, Xenorhabdus bovienii
  Coding DNA sequence: Name=SeqID_2804
  Homolog annotation: Query=29..231bp; Hit=43..245bp; Blast score=234; Percent Identity=56.0; E value=6e-61; Homolog= ref|NP_458644.1|
MKSHRSGLLMWLLLSNSVWAATPTPLASQQIHATESQQQSLKSQAKQWKLSADEYQHYQHLMKGPRGIQSTGLDPLTTLGIEAESDAERRRYAEQWVRAEFARTEKELRFQREVDTAWQRLFPDVLPVNMEKSRETNGRLALFIKAKDCLPCETRLSGVLAANQPVDIYLVDSQSNDDILRQWAKTHRIPVERVRNRQITLNHDAGYWLRFGKGLMPVLLRQGEQGWHITSLQ

SEQ ID NO: 8913 - protein, 191 aa, Xenorhabdus bovienii
  Coding DNA sequence: Name=SeqID_2805
  Homolog annotation: Query=66..179bp; Hit=8..122bp; Blast score=121; Percent Identity=55.0; E value=5e-27; Homolog= ref|ZP_00138044.1|
MLRLSRNLFGMKINVLIGLIAVILTGCTAPVKQPLPQPSQNSFSSVTLTRNIQSVSADIYYQIPEVVRYGRYLLVSTDPTAAQRDPLSQLMGIHLPTSQNPTVADAMRYALRQSGYALCVPDKKNDILYRQPLPSVHAQLGPVRLRTALQVMADPAWQLEVDEVQRVVCHYLRQGYQLPAPAKHSHQGGGR

SEQ ID NO: 8914 - protein, 99 aa, Xenorhabdus bovienii
  Coding DNA sequence: Name=SeqID_2806
  Gene classification: Gene name=Nlp; Function=Predicted transcriptional regulator; Function class=K Transcription
  Homolog annotation: Query=7..79bp; Hit=7..80bp; Blast score=93; Percent Identity=67.0; E value=4e-20; Homolog= sfsB COG3423
MINSHQDWHPAEIICALRKRGTTLAALSRESGLSSSTLANTLSRPWPKGEWIIATRLEMDPAEIWPSRYFDDYGNFIERKVRQPVADCQSVDEYQPADE

SEQ ID NO: 8915 - protein, 54 aa, Xenorhabdus bovienii
  Coding DNA sequence: Name=SeqID_2807
VRNLRPRKINPLVGCFCQCVCYRPFNGGSGRGGFDLAGLVDLRYLRIPVLNRHQ

SEQ ID NO: 8916 - protein, 36 aa, Xenorhabdus bovienii
  Coding DNA sequence: Name=SeqID_2808
LSKDVVISPPLKCFISVSDKGVTINSTMHQHSCLQC

SEQ ID NO: 8917 - protein, 369 aa, Xenorhabdus bovienii
  Coding DNA sequence: Name=SeqID_2809
  Homolog annotation: Query=1..369bp; Hit=1..377bp; Blast score=438; Percent Identity=57.0; E value=1e-122; Homolog= ref|ZP_00042882.1|
MTTSLDKLTIKGFKSIHELNEFELKNLNVIVGANGAGKSNLISFFKMLRALIDGTLNRYVRDSGGASDLLFNGNKVTQKMAFDTRFGERGFRFKLVPTPADSCAIEDEARYYIKGIGDGWWELGDSDDGRSRMVAEVENKYSDAPYSRPIYDAIASWQIYHFHDTSATAGMRKYEIIQDNKTLRTDASNIGAFLLKLKNDASNEYKSIVNAIRLVTPFFDNFILEPRQSGQKEEVNISWTQKGSDYPMQPYHLSDGSIRFICLATALLQPNPPSTIIIDEPELGLHPAAIVILAELIQQAAQRTQVIIATQSPILIDQFSAEDIVIVNRKKGASSFERLNEEDFSQWLENYSLGELWAKNVIAGGPTYE

SEQ ID NO: 8918 - protein, 254 aa, Xenorhabdus bovienii
  Coding DNA sequence: Name=SeqID_2810
  Homolog annotation: Query=26..251bp; Hit=7..232bp; Blast score=129; Percent Identity=36.0; E value=4e-29; Homolog= ref|ZP_00032552.1|
MRKIFLNGSKTIHWVSYGLKTSLPEGRLMSNYIEVMAIVEGKTEQIFIEKILQPYLAEKMIFISATQVSKPGQKGGDVRFSRVKKDIEMHLKQRPDTYVTTFIDYYGTNEWPGLETLNRQWEPKKIAEHLHLSTQNEIHQFLFAQRADERFIPYIVMHEFEALLFSDKEILANELNIHVQEVEQVLRECGEPESINNSPQTAPSKRLEKWSANGTFGKTTTGIAIAEKTGIPKMREKCPLFNEWLCRLEILMTV

SEQ ID NO: 8919 - protein, 172 aa, Xenorhabdus bovienii
  Coding DNA sequence: Name=SeqID_2811
  Gene classification: Gene name=Ssb; Function=Single-stranded DNA -binding protein; Function class=L DNA replication, recombination and repair
  Homolog annotation: Query=3..172bp; Hit=1..171bp; Blast score=184; Percent Identity=53.0; E value=5e-47; Homolog= BU545 COG0629
MDMSSRGINKVILVGHLGQDPEIRYLPTGGTVTTLSLATSDSWRDKQTDETREKTEWHRVVIFGKLAEIAAEYLQKGTQVYIEGQLQTRKWQDNQGQDRYSTEVVVNINGTMQVLGSRGDAKRVPVQQAKAAQKPQPSQPTKKERKPTQMAQLSSLPEEEKEEPDWSDEIPF

SEQ ID NO: 8920 - protein, 101 aa, Xenorhabdus bovienii
  Coding DNA sequence: Name=SeqID_2812
  Homolog annotation: Query=39..99bp; Hit=10..70bp; Blast score=72; Percent Identity=62.0; E value=1e-12; Homolog= ref|NP_458626.1|
MQKIHSDIPFTPSTCPELSGQSRDYQRQQDTEMNIAPIGVLALQYCHKQLPLTVLRSRAGFYIGTQDEGEPCSRESVEYFACHEQAEFALKQGHWTQRQSV

SEQ ID NO: 8921 - protein, 184 aa, Xenorhabdus bovienii
  Coding DNA sequence: Name=SeqID_2813
  Homolog annotation: Query=39..184bp; Hit=6..152bp; Blast score=214; Percent Identity=69.0; E value=7e-55; Homolog= ref|NP_928367.1|
MPDTRREKLFPSGSRVFSVTLYFYLHGEHRMSENTTSLTKNDYFNLNIKGLGYLNNIRHVSTASGTFLSCVINALNGPSDNPVYVRFDITLVGKEATSLVGRCQKAVDEDKKVLLGFTLSNPSTDIFTLKRGDHAGEQRVSLKARLIKVDWIKIGQDKVYQAEQSDSAPPQNGVAQAEYAENSF

SEQ ID NO: 8922 - protein, 81 aa, Xenorhabdus bovienii
  Coding DNA sequence: Name=SeqID_2814
VTEKTLLPDGNSFSRRVSGIYVADVLIKNNEPSLPLDWQYLLPKGGKCTALRHSLSGYGSFTATQRRSLQVHRSFKKQVDS

SEQ ID NO: 8923 - protein, 672 aa, Xenorhabdus bovienii
  Coding DNA sequence: Name=SeqID_2815
  Gene classification: Gene name=TopA; Function=Topoisomerase IA; Function class=L DNA replication, recombination and repair
  Homolog annotation: Query=307..667bp; Hit=245..610bp; Blast score =322; Percent Identity=43.0; E value=1e-87; Homolog= XF1776 COG0550
MFARFKSHFTRPPAPQKKSSEQKTSEVRDNGGYFRPQSADALLATPLRRQCLQQLWQNSTLPEGLYQRFYLAPVKQLLGSVQQVPAAPEGDWSGRGGFADLTMQFTTCAVLLAKGHLLPPGVAPEMQAAQSVLWQTVVFWAALFYHLPLLRQLEGELEDGHYWQPGVCIPDKPFRFRFRAPENVLPVPQGLLLAARLLPEEFIRWVMTVPEAWRCLMLHMNGNPSSLSLIDALLQEAAEWVHSPLVKPVISPPPVTETDFDSEIDVVPETTSIPPANEMKSLSQSASDDTQTLLSLFQFNNEALPSIGMGASQVLTIAQSLYETHKATTYPRTDCGYLPVSMQTDIPVMLTALVRTDPAMAGIISQLDEQLVSRVWNDKKITAHHAIIPTRHAFDLTRLTTDELQIYQLIRQHYLAQFLPMQETDVTEVTLDIGGQCFRAKGRVNVTTGWKALFTENQEKSDVDSPLPRFQQGDCCQIIEASIQSLHTKPPTPFTEGTLIAAMKNAASLVSDPQLKQVLRESAGLGTEATRAGILDTLFKRRLIERKKKAIQSTPLARELVAGLPEVLTSPGMTALWEQSLDDIAQGKTSLAVFMQKQVQWLLHLVELGKAQPFHLTLPKTPDCPNCGSRMRQRQGKTSPFWGCVNYPGCKGVLNDKAVTQSRKARRANQRT

SEQ ID NO: 8924 - protein, 44 aa, Xenorhabdus bovienii
  Coding DNA sequence: Name=SeqID_2816
MRFKTRKHVVFLLFKFGSVSVNPNLKQGETLFAKMKINLTRVTH

SEQ ID NO: 8925 - protein, 227 aa, Xenorhabdus bovienii
  Coding DNA sequence: Name=SeqID_2817
  Homolog annotation: Query=6..225bp; Hit=15..233bp; Blast score=249; Percent Identity=55.0; E value=2e-65; Homolog= ref|NP_928475.1|
MASRPDHQKEFISLFKQTARYHNRHQVFRDFCHCAMAAIHNKYCFSEELEQYYLKTINKYKRDDVDRIVQLFSHVTLGLAQEPCDFLGSVFMRLELGNKGLQQFFTPWGVARMMAEIQLHDAAGLLQTQPFVTFFEPACGAGCMTLAAAEVLREQGHDPMCSLWVSAIDIDPLAAVMAYIQLSLTGIPAAVTIGDALHDGGKKRTRYTPAHYLGNWSQRLQEYEQAA

SEQ ID NO: 8926 - protein, 31 aa, Xenorhabdus bovienii
  Coding DNA sequence: Name=SeqID_2818
MPLRVFLIGQKRKTRPEREPVPLSVEVKING

SEQ ID NO: 8927 - protein, 324 aa, Xenorhabdus bovienii
  Coding DNA sequence: Name=SeqID_2819
  Homolog annotation: Query=18..286bp; Hit=1..271bp; Blast score=197; Percent Identity=37.0; E value=3e-49; Homolog= ref|NP_928474.1|
MGRFRLFIFIIQVRNLTMAEWCTNQLEITGKSVCLDVMQQWICGEETPRYRQAVLQSLRLFLAGCAGILKPAKPQTYTPYPALVRGTAAPTVQHLAFEQWLLLLQNNVPLNNDNVKRIDNLYRQSGLSLMQWDNVPEAARDIIARLLTRQYTDWFGMVGWSDTPDIGVCWDKLNAYPQAAQPCDMLMIMSTHLATEINGNSALLKGIATTAQFYGEQYGIEWPFGHHVRWERRNVSSLTVRFDSPWAPPSAELMGELSLMFDCEIRHWYSEASNQLKGYDCYDQGEHVDSGHGQSGRENRPALYLVNGEKAETARVLPAIAVGQ

SEQ ID NO: 8928 - protein, 88 aa, Xenorhabdus bovienii
  Coding DNA sequence: Name=SeqID_2820
VIAAALLKRHFGLSLADTALCETDTVAELIAGGVRPSEAINELVDKYDLTRLNTQVIPRSTPYLDIHDELTVIFDSGLAEMLFRQTRP

SEQ ID NO: 8929 - protein, 57 aa, Xenorhabdus bovienii
  Coding DNA sequence: Name=SeqID_2821
MASEGRTPPAISSATVSVSHSAVSARLRPKCRFSKAAAITCQTVKRNVAIMPPQKKH

SEQ ID NO: 8930 - protein, 185 aa, Xenorhabdus bovienii
  Coding DNA sequence: Name=SeqID_2822
MNPIFLPAPDETDTALREELFTAQVTGLKQHPKAPQSLQPEILMVCEASSVTEVVQRLKVIHLLGDWPVPERLSAQVAGAFFPLTVMIFDAQDRKVLGGRFDKEIVWAQPVMLTSECLSLEQQQQRLCQAAMLEQSWQNTPAARALWHKAHLLSLHGVSSCYQQCHEVRDILRHGISVSAFSEGA

SEQ ID NO: 8931 - protein, 41 aa, Xenorhabdus bovienii; identical to SEQ ID NO: 8887
  Coding DNA sequence: Name=SeqID_2823

SEQ ID NO: 8932 - protein, 153 aa, Xenorhabdus bovienii
  Coding DNA sequence: Name=SeqID_2824
MPNNELIMLDSLALSVVFPDKTPLERLFLGFLLANTASTLCGDYQPEQWTSRQVSESLTYMMPTRAETYSVYLPVTQLTVTLSADAFGLAVTAIVSARITVPDTQNEEAYRFCALQAYAQQHPESGLITSIMTLKPREDVISPSLIHNKNNHH

SEQ ID NO: 8933 - protein, 143 aa, Xenorhabdus bovienii
  Coding DNA sequence: Name=SeqID_2825
MQQNTPPVTDIVPASEHSPFAEIFPHTSSLELTLLEHTFIKAAAVLCDDDRCDQWQYRKVSGTIAYIVPVRPDSSGVRVETTDFKGEVSADAFGLMVTLSVLEYLAALMKLDGYAERFCDLREYALQHPHASCIRAALGLKGA

SEQ ID NO: 8934 - protein, 42 aa, Xenorhabdus bovienii
  Coding DNA sequence: Name=SeqID_2826
MANRPVTQRGTRFPLGQVFPVVLSGEYHATKYTSGHGHRARV

SEQ ID NO: 8935 - protein, 100 aa, Xenorhabdus bovienii
  Coding DNA sequence: Name=SeqID_2827
MRLRNLHRHQTDDICFQRCADVPHGCVLPCRLQECCCRCPKVILTSDRIIDKSDYANKRKSSGQWVIHFPGQKIMSGTQRDFGGVRERLSIRGDPFWSFV

SEQ ID NO: 8936 - protein, 45 aa, Xenorhabdus bovienii
  Coding DNA sequence: Name=SeqID_2828
LGESGRGCQYEVTRSGLLSKSFMPHCVLVPMAELHRKPIFTIHKS

SEQ ID NO: 8937 - protein, 138 aa, Xenorhabdus bovienii
  Coding DNA sequence: Name=SeqID_2829
  Gene classification: Function=Predicted transposase; Function class=L DNA replication, recombination and repair
  Homolog annotation: Query=42..115bp; Hit=2..75bp; Blast score=72; Percent Identity=43.0; E value=9e-14; Homolog= sll1094 COG3335
MPRLHGYSKKGLRCFGTHDWHAQGLVNVIGAIIKNTFLTLSLFTGNINADVFHAWVTQDLLPKLPSGAVIVMNNARFHKRHDTIQAIADSRCQLEWLPPYSPDLNPIEHKWAGVKAIGEKRCSVDELFMEHVECVKLY

SEQ ID NO: 8938 - protein, 117 aa, Xenorhabdus bovienii
  Coding DNA sequence: Name=SeqID_2830
MRITQISLTNFRSFKETQTIDIAPVTLLFGPNSVGKSSVLMALAYVQQILKHGHCNPQKLDSLGKKTIGGLMTMSKWANPLFIWMKEVLPSPCLACTGIQKKGYGASVHTIGTRKVL

SEQ ID NO: 8939 - protein, 69 aa, Xenorhabdus bovienii
  Coding DNA sequence: Name=SeqID_2831
MVYNRDFVDRNLNQGDPLQDIFTLSENQVEANEAYLRVFRSIFGKAGQIGHYNMMTGTVIETLVTKRRL

SEQ ID NO: 8940 - protein, 87 aa, Xenorhabdus bovienii
  Coding DNA sequence: Name=SeqID_2832
MVMRLINHTADDGLACAVRTKNIIDAAKITEPCWTHISRYGRIYLDFADHTLFLEFTRKGFLANRQEIVSGSFIAFVLVFNQLCYLY

SEQ ID NO: 8941 - protein, 388 aa, Xenorhabdus bovienii
  Coding DNA sequence: Name=SeqID_2833
  Gene classification: Gene name=HsdS; Function=Restriction endonuclease S subunits; Function class=L DNA replication, recombination and repair
  Homolog annotation: Query=93..348bp; Hit=126..394bp; Blast score=91; Percent Identity=26.0; E value=2e-18; Homolog= CC0621 COG0732
VTFKPDDLVEPLSSNSTVVMRTKNVQVEGLEQSDLIAIPSELVKRKEQALCEGDILISSANSWELVGKASYVPKLNYQATAGGFISIVRTKQRVIDSRYLYHWISSPSTQHKIRHCGRQTTNISNLDVGRFKDLEIPLPPLTEQKRIAAILDKAGAIRRKRQQAIQLANEFLRAVFLDMFGDPETKGWKFTTVENMAAKCKGSMRTGPFGSDLKHSEFINEGILVLGIDNAVSNKFRRGKERFISQEKYEQLKRYTVNPGDVLITIMGTCGRCAVVPDDIPLAINTKHLCCITLDKNQCIPSFLHSYFLVHPIARRYLGQKAKGAIMDGLNMGMIKEMPIPIVPINEQKKYESISVKVAKLIENQYEGNEATRNNFLSISQKAFSGEL

SEQ ID NO: 8942 - protein, 534 aa, Xenorhabdus bovienii
  Coding DNA sequence: Name=SeqID_2834
  Gene classification: Gene name=HsdM; Function=Type I restriction -modification system methyltransferase subunit; Function class=L DNA replication, recombination and repair
  Homolog annotation: Query=21..534bp; Hit=23..483bp; Blast score=164; Percent Identity=27.0; E value=2e-40; Homolog= Z5947 COG0286
MLTGQIRNDIDNLWEKFWTGGITNPLTVIEQISYLMFARMLDMQEDMAERKANRTGKEFDRLFPNTPEGQLLRWKNFKNLSGKELHKHLKQNVFPYFAKLGKKSDEQDGLGNDGSAIEALGHIGEYMQDADLEIKNESVLVSAVEMVDELPLTQSDVKGDIYEYLLSKLTTAGINGQFRTPRHIIDTMIELINPQPFDTVCDPACGTAGFLARIMEYLNRVHSSEFGILEDDDGNKHYTGDLLEPYRDHINKKMFWGFDFDTTMLRVSSMNMALHGVNGANILYQDSLSKSIKENFPQQEENFFDVILANPPFKGSLDETNTNPDLLGLVKTKKTELLFVAHILRALKLGGRAAVIVPDGVLFGSSKAHQQLRQELMENNQLEGIVSLPSGVFKPYAGVSTAILMFTKGGNTERVWFYDLQADGYSLDDKRTPLKGEGSNDLPEAIAKWKQYIALVERNALAKDINKAFGDKTQKAFVVDAKDIVDNKFDLSINRYKEVVYEEEAFEDPKTILNKLKTLESEIMADLDALEGML

SEQ ID NO: 8943 - protein, 40 aa, Xenorhabdus bovienii
  Coding DNA sequence: Name=SeqID_2835
LNSSLNDFLLFLIRLALRLAHCPVPCFPTGLALPLKPINP

SEQ ID NO: 8944 - protein, 594 aa, Xenorhabdus bovienii
  Coding DNA sequence: Name=SeqID_2836
  Gene classification: Function=Uncharacterized BCR; Function class=S Function unknown
  Homolog annotation: Query=1..588bp; Hit=5..533bp; Blast score=419; Percent Identity=43.0; E value=1e-117; Homolog= PM1267 COG1322
MQSLEWTTELMIIASVAGLVLAAFGYLLAMVLLGHKNTELNTQLQQADQALKLANTQNQKHQDELKQLGTTLHEKELSESKLQTQQTNAKVTEQRLNDALAERKGELASLQKTLEELRGQHHSTEKQLETAQSDNRALKEQAQDLRDRLEKCEQNVQQERTLVSQLKDELAQEGKKAKELEASNTEAREQLKDVRQTLVDQQQRYDQIQEHYQSLSNEYTELKTTLERKEEHFKEQMQQLSETKQSLTKEFESLANKIFEEKGKTFTHTSQVSIDTMLKPFREQIEGFQKRINEVHDVSLQGNTSLNAEIKKVLEIGLQMSKEANNLTSALKGDSQKRGAWGEAQLRRTLEMSGLMEEAHYEVQGSFRDAEGKQKQTDYLIKLPDGKHIIIDSKVALNAYDRAVGAESPEEYQLAMSEHVKAVRRHIDDLASKDYTNLVGMRSPSFVLMFMPIEPAYIEALKDNKNLFEYGYKKGIVLVSHTTLIPILRTVSNLWMIERSNAEAREISEKAGDIYNSVCTVAERLSKLGGTLSTVSNHYNSTVKALVGQQGLYGKVDRFSQLSAKVSKSLPHLEAAHIDFETERLTLIVEPIDE

SEQ ID NO: 8945 - protein, 1027 aa, Xenorhabdus bovienii
  Coding DNA sequence: Name=SeqID_2837
  Gene classification: Gene name=HsdR; Function=Restriction enzymes type I helicase subunits and related helicases; Function class=L DNA replication, recombination and repair
  Homolog annotation: Query=7..630bp; Hit=162..861bp; Blast score=140; Percent Identity=25.0; E value=6e-33; Homolog= hsdR COG0610
MALGTAHQLAMYMGIKYYNKKKDQIPSFVDIKDPTATLSQLQKSVSSYEKELQKQQEELERVIEQLERERTRNIDKLEPPAKSDRQKRRQQSQLVADSLQWNEAKTRALLIDAMLLQAGWDIQNPDQISQEFEVIFPNNPSGKGYVDYVLWGDNGHPLAVIEAKKSGNTNLQAGREQARLYADAFEHMGYQRPVIFYSNGYETFIWDDHQYNTYRPVYGFYSKDSLDYLIYQRHYRAAELEKFNPELSIADRPYQIEAIKTVAAHFQSQRRKALIIQATGTGKTRVAIALAELLLRTGWAKRVLFLCDRKELRVQADDAFKQNLPSEPRCVIGETNKIDKSARIYIATYPGMMNRFAQLDVGFFDLIIADESHRSIYNKYRDLFDYFDALQVGLTATPVKFISRNTFDMFDCESTDPTFEFGLDAAINNEPPYLVPFRVKDLTTDFLRDGIHYNNLTEEQKRQLEEDLGEEEARNTTIAGKDIGRKIFSEDTDRIILENLINNGIKDETGSLVGKTIIFAQRQDHAEHLEELFCKLYPQYGTKVCKVIHNAIPHVESLIKEFKKADNEFRIAISVDMLDTGIDVPEVVNLVFAKPVKSWVKFWQMIGRGTRLRHNLFGPGKHKTEFLIFDHYANFAFFEEEYQEPEDTGGKSLLQTTFESRIELAQAALQRNHAAAFDAAIELLRADINDLPDTSIAVKRELRVVHQLQQTDLLKRFDAKTQHQLVNHIAPLMSARVLRDKHATYLDKLIATIERCLVEQASCFDDGRELLLAELNKLAVNIQAVRQKDVVIAEVRSAEFWQNPTIDKLEKARKELRGIMKYRQTVSGGLYAIPETKTGDTGLQLKEREVKIAGANEAMIYRRRLKDILDQMIAANPTLQKIRKGESIAEPELKTLTSTILTSHPSVSLEVLNEFYGRTADQLHLTVREVIGLDPQAIEEHFKSFLHAHPTLTAQQVRFMNLLKNYIAQHGSIRIEKLYDAPFTSVSHEGIDGVFTADGVGELITVLKPFIKAEPKLSGSQPESTQE

SEQ ID NO: 8946 - protein, 463 aa, Xenorhabdus bovienii
  Coding DNA sequence: Name=SeqID_2838
  Gene classification: Gene name=AtoC; Function=Response regulator containing CheY-like receiver, AAA-type ATPase, and DNA-binding domains; Function class=T Signal transduction mechanisms
  Homolog annotation: Query=181..428bp; Hit=143..390bp; Blast score =235; Percent Identity=47.0; E value=7e-62; Homolog= mll3001 COG2204
MCKAKPRTLVSWIGGNDLKATGSTGADGQALGPIAATLTAQAFDAVELLYNYPEDQVRSYLAWLQELVTTPICAHAISLSSPVNFGEIYVQANQQLSKLTVEGCELSILLSPGTPAMQAVWILLGKTHYPCQFYQSSLEQGVQQVDIPFEVSAEYLPAAKSIDSAKISQLAEASAPINAAFDNIVTRNPRMQSLKAQAQILAEREVPVLIYGESGTGKELFARAIHNASHRANKPFVPVNCGAIPTELVDSVLFGHKKGAFTGALADKAGLFEQANGGTLFLDEFGELEPSIQVRLLRVLQEGTFIPVGGTKEQKVDVRLITATHRNLIEAVSNGSFREDLFYRVAVGVLHLPPLRERDGDLSLLADSLVKAMSIHDSMLRHKKISPDAKNLILQCPWRGNVRELQSTLLRAALWCQGDDITAADIRQALFHMPEPETGLMNMDISQGIDIKCIIGSVTAYSR

SEQ ID NO: 8947 - protein, 69 aa, Xenorhabdus bovienii
  Coding DNA sequence: Name=SeqID_2839
MIRCHLARLMGERKMKISDVLRETGLSRNTVTLMYKESAQKIYIEALDKLCRLFECEVADMLEFTDVQG

SEQ ID NO: 8948 - protein, 37 aa, Xenorhabdus bovienii
  Coding DNA sequence: Name=SeqID_2840
LITVECCSTSKLHDINDSIHSGLTSAPEAYLRSAAIL

SEQ ID NO: 8949 - protein, 294 aa, Xenorhabdus bovienii
  Coding DNA sequence: Name=SeqID_2841
  Homolog annotation: Query=1..283bp; Hit=1..283bp; Blast score=356; Percent Identity=61.0; E value=2e-97; Homolog= ref|NP_927686.1|
MSNLEELYCCVDDFCQKFIPLWHQQLIENGLRKRHREASLSLSEVMMILILFHMSHYRDFKTFYIEHVKQYLTADFPGLVSYTRILTLKKRVLIPLCAFLSSRKAQTQGIAFIDSTKIAVCHNLRIPRHRVFEGMAQRGKTSTGWFYGFKLHLVINDCGELLAVKLTAGNQDDRQPVRALTKGLTGCLYGDKGYLSQALCDELEAEGVTLITNVRSNMKTKALSLWDRLMLRRRFLIETVVDQLKNISQIAHSRHRSQLGFLLEVAAGLIAYTFQPKKPSLNLRDNEIAIFKRS

SEQ ID NO: 8950 - protein, 398 aa, Xenorhabdus bovienii
  Coding DNA sequence: Name=SeqID_2842
  Homolog annotation: Query=64..387bp; Hit=109..426bp; Blast score=233; Percent Identity=44.0; E value=5e-60; Homolog= ref|NP_821845.1|
MLNVRIAGNWLNGWGKVPPMGFNICWNALIGMSIWPAISCGIMSLNIWAMNRVFSSLIKPVLSKKGHILPGYSVSNSGTAGRVENSQIGVFLCYAGNGGHAFVDRALYLPRQWTDARSRCEAAGIPASVTFATKPPLARQMLERTWDAGVPCRWVTADEVYGRDRRLRVWLESRYPPFVLAIPCNTPLGWRGPEYIRADRIADTLTAADWKTRSAGTGTKGEREYDWAVVPLWRLQLSEEDRHYGHYLLVRRSRDSRQERAYYVVYALREQVDLNTLVQVAGCRWEIESGFEETKGECGLDHYEVRRWQSWHRHITLSLLAHAVLAVLRVQEKKTPVGRVPLSVAELRKLLSKLMEKAGKTIEQILHWSDWRRRHQYRVQQCHCRRRGNHRLTEQLRL

SEQ ID NO: 8951 - protein, 35 aa, Xenorhabdus bovienii
  Coding DNA sequence: Name=SeqID_2843
MPVAPVPRFWQGMACDTAFYLRKKSPIIAHDGLRL

SEQ ID NO: 8952 - protein, 117 aa, Xenorhabdus bovienii; identical to SEQ ID NO: 7849
  Coding DNA sequence: Name=SeqID_2844
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 8953 - protein, 163 aa, Xenorhabdus bovienii; identical to SEQ ID NO: 7546
  Coding DNA sequence: Name=SeqID_2845
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 8954 - protein, 92 aa, Xenorhabdus bovienii
  Coding DNA sequence: Name=SeqID_2846
  Homolog annotation: Query=1..85bp; Hit=199..283bp; Blast score=111; Percent Identity=58.0; E value=3e-24; Homolog= ref|NP_716636.1|
MKTEGITLITHVRRNMKAKFLSLWDRVMLRKRFLIETVNDQLKNISQIEHSRYRSVVGFLLGIVSGLIAYTFQPKKPSLGLRDSEIGMLKQN

SEQ ID NO: 8955 - protein, 56 aa, Xenorhabdus bovienii
  Coding DNA sequence: Name=SeqID_2847
LGCLNKTEVFQIEHSRHRSQLGFLLEVAAGLIAYTFQPKKPSLNLRDNEIAIFKRS

SEQ ID NO: 8956 - protein, 175 aa, Xenorhabdus bovienii
  Coding DNA sequence: Name=SeqID_2848
  Homolog annotation: Query=1..172bp; Hit=114..291bp; Blast score=204; Percent Identity=62.0; E value=6e-52; Homolog= ref|NP_795312.1|
MCDEQIVNNKHQFFELPLPASFLRTRRAVRELHITLAYSPAVRTTRLDYAATQISYRLIKGTSLQDVQQYFNHDVQDGTKSRNDDAASNRSVTAQQRDHGTVQSFSWTFKRRSPDEKWFVVVTRNDREWGAPLNSQHESYALVVTATDRENAEANLYAEIEARIREQERSRARVS

SEQ ID NO: 8957 - protein, 616 aa, Xenorhabdus bovienii
  Coding DNA sequence: Name=SeqID_2849
  Gene classification: Gene name=AprE (BS); Function=Subtilisin-like serine proteases; Function class=O Posttranslational modification, protein turnover, chaperones
  Homolog annotation: Query=258..565bp; Hit=151..415bp; Blast score=60; Percent Identity=25.0; E value=5e-09; Homolog= BS_aprX COG1404
MTEQYKHLSIAKESLQNPRRTRQFNIPRTPRADLRLHGSMLSEQLRGITQLATPQIPGKDNDGRYMLKLQYTGMLDIAHLDRHGIEFVIQEDKTICIAFADERGIALFEEHLSQLGHGHITYQQILTALDSVDVWSSEDRKSWSVRHYGFPELESFGLDVELWPIETTRHPSRERICEEFENWLQENMIHRLDRINLDSLLMYRVRVNCEQAEKLLAHRDVRMVELLPSSGISYGKLNRDINVIPAHIPSPSPDAAKVCILDSGINTAHPLLRSAIAESASFVVNEDEFDHCGHGTAVAGIALYGDVEACDASNFWQPSVWLYNGKLLNSQGEFDTSTIETTLTEAVEYFVDLGYRIFNLSLGNANAPYDGKHIRGIAYVLDVLARRHNILFVVSAGNFSGSSDPDVPQESWRAEYPSYLIHNSSVIIDPAPALNVLTTGSYARHNATFDAQRRADEISHLSPAGEFQPSPFTRHGPSVKGAFKPEIVAHGGNFAVPMRNDGGQWREHAKGLGVLSCHHQFQGSTFFSEQSGTSFSAPYITHLAGRLLNEYPDMSANMLRAMLVNHAVLTSQMENTFSEEVVECYKAESATRNRSIIRDVVGYGVVEEDSLYRSSE

SEQ ID NO: 8958 - protein, 328 aa, Xenorhabdus bovienii
  Coding DNA sequence: Name=SeqID_2850
  Gene classification: Gene name=SpoVK (BS); Function=ATPases of the AAA+ class; Function class=O Posttranslational modification, protein turnover, chaperones
  Homolog annotation: Query=100..317bp; Hit=171..396bp; Blast score =134; Percent Identity=37.0; E value=1e-31; Homolog= AF0477 COG0464
MANGKVLRQLIKAGATGDVAAFRRVSEVIIEKERQKQHHLLANDLEHILYGDHTVQTSRVPAAPQMPVDKERGLPLLDIKQPSRSLNEIVLPESSSDAIEEILEENRRADVLRSYGMKAVSKVIFFGPPGCGKTLAAEVVACELDMPLAIVRLDTLVSSYLGETAANLRQIFDFISQYPMVVLFDEFDAIGKERGDSGDHGELRRVVNAVLQMMDAYQGQSLILAATNHEHILDSAIWRRFDDAIEFPLPDKHQLLELMKLKLRGIRRQFELEDDAVLSLFIGKSGADLERIVRRAIKRMILRSQEFLTLKDLKNALLRENVNKTRQG

SEQ ID NO: 8959 - protein, 60 aa, Xenorhabdus bovienii
  Coding DNA sequence: Name=SeqID_2851
MSAWHNADCFIWTSRNIQLFSVTQFVANFASQSYIRRLAIIPIYCAMVKSEPCLLIRLTD

SEQ ID NO: 8960 - protein, 94 aa, Xenorhabdus bovienii
  Coding DNA sequence: Name=SeqID_2852
  Gene classification: Function=Transposase; Function class=L DNA replication, recombination and repair
  Homolog annotation: Query=1..80bp; Hit=251..328bp; Blast score=67; Percent Identity=48.0; E value=2e-12; Homolog= PA2319 COG3547
LVPRQASSGGKTQLGKITKNSNRYLRCILIHGARAAMQRRTLRHDALGDWMQSLVNRRGFNKACVAYANKCKCARICWSIRINNDVFQVSKAFA

SEQ ID NO: 8961 - protein, 234 aa, Xenorhabdus bovienii
  Coding DNA sequence: Name=SeqID_2853
  Gene classification: Function=Transposase; Function class=L DNA replication, recombination and repair
  Homolog annotation: Query=6..234bp; Hit=6..235bp; Blast score=151; Percent Identity=40.0; E value=5e-37; Homolog= PA2319 COG3547
MRNKILGIDLAKSIFQLCLLDGNHVVFNKKVTRNRLLDAVRQMESGTLVAMEACSTAHYWGRMVGHLGFEVCLIPPQHVKAFVKNHKNDANDALAICEAANRPDMNFVPVKNLSQQDLCALHHVRQSLVQKRVATSNQIRGLAAEYGIVFPQRSAALRQSLYEALEDASNGLTVIARRILKQLYEDWLILLQRTEEIEETLKLLSSQTAQWQQLQSIPGIGPLIASAFIAYVGD

SEQ ID NO: 8962 - protein, 36 aa, Xenorhabdus bovienii
  Coding DNA sequence: Name=SeqID_2854
MLFHFGTIDAMWDVHLIRLGCAQIIDSVISSLIWYN

SEQ ID NO: 8963 - protein, 43 aa, Xenorhabdus bovienii
  Coding DNA sequence: Name=SeqID_2855
MAMGGGVIFGRYITRILRMNKLYWLIHGLLLWSLEYEQSNLDT

SEQ ID NO: 8964 - protein, 123 aa, Xenorhabdus bovienii
  Coding DNA sequence: Name=SeqID_2856
  Homolog annotation: Query=1..118bp; Hit=149..266bp; Blast score=135; Percent Identity=63.0; E value=2e-31; Homolog= ref|NP_458670.1|
MQLAYVLGLRTKEAVEAYKSLATWKKALENGHTSVRVVFGTKGGRSRQTTILDRAALQHAIAYAEQEQAGHSGKLIDKPTITQAIDRYRYIVRRAGLSGNKAPHSMLYCRSAIRRALYSARIQ

SEQ ID NO: 8965 - protein, 136 aa, Xenorhabdus bovienii
  Coding DNA sequence: Name=SeqID_2857
  Homolog annotation: Query=1..136bp; Hit=1..136bp; Blast score=128; Percent Identity=48.0; E value=2e-29; Homolog= ref|NP_458670.1|
MAQGSTRSKVEQFRKAFITHARQVGGSFVTVADRERMARQFLDYLKNNGIKLRQMDSLKVKYIERYMAERKANNLSHRTLQNEMSVLRAILAQAGKHKLADPDNARLSNRALGIADTSRKGTKMALAPAAFRDIFQ

SEQ ID NO: 8966 - protein, 58 aa, Xenorhabdus bovienii
  Coding DNA sequence: Name=SeqID_2858
VIKAFLNCSTFERVDPCAILASLATFSFLVVFKTIPCVSVQVHRSVVRQIMCSRAELC

SEQ ID NO: 8967 - protein, 68 aa, Xenorhabdus bovienii
  Coding DNA sequence: Name=SeqID_2859
LQELATCSARRWHAPRSVPDHVQDERLIILTCLISPFLLHQPVVRQRVENQTGRSFVNQTECQSMAYF

SEQ ID NO: 8968 - protein, 38 aa, Xenorhabdus bovienii
  Coding DNA sequence: Name=SeqID_2860
MSVNGLFLEVSLGNSWIKSVVKPVWTCSGRWPPGGVTW

SEQ ID NO: 8969 - protein, 66 aa, Xenorhabdus bovienii
  Coding DNA sequence: Name=SeqID_2861
VVPGSGKDLLPSHIVRHLNPGLAMKVSRFYCDTGLPTQLGRNILCLTLNDTVLTGAKFTLVFNSSR

SEQ ID NO: 8970 - protein, 119 aa, Xenorhabdus bovienii
  Coding DNA sequence: Name=SeqID_2862
MQPTVTGQVEQADTDIRSRKVNLLVVRRVIPVTKTKIIGEIRMAFFQPLFVIGACQCAAGQPGASDNTQSRRLTDFFRDGRRRIQPLRKVCCRYRGIRVFNAWCRVAGKIFCLRILSDT

SEQ ID NO: 8971 - protein, 72 aa, Xenorhabdus bovienii
  Coding DNA sequence: Name=SeqID_2863
MLSGEMLPERMYADTLIIDSEALTLAMTYRYHIEATSPLRVMEARFEMDPAAPLIRIASPDDKDEKEIHIYG

SEQ ID NO: 8972 - protein, 130 aa, Xenorhabdus bovienii
  Coding DNA sequence: Name=SeqID_2864
  Homolog annotation: Query=11..129bp; Hit=1..117bp; Blast score=92; Percent Identity=43.0; E value=1e-18; Homolog= ref|ZP_00031153.1|
MTKTRRRYIFMADNYLARTGTQWMVIGILPDVCKTPMGSSTPPIPYPVMAKLADSSVPVKSVRANGKPVVVFAQSFVPQTLGDEPGVANGIKSGTVGGKCHPKEQEHTKSVRVGNKLLLRHGDKFWMNGA

SEQ ID NO: 8973 - protein, 433 aa, Xenorhabdus bovienii
  Coding DNA sequence: Name=SeqID_2865
  Homolog annotation: Query=219..428bp; Hit=309..503bp; Blast score =129; Percent Identity=38.0; E value=1e-28; Homolog= ref|NP_792271.1|
MAKIKKIPPKPASDEALWKKRAHDDAPIGEGNTLGEITGQPPKSTQVPKEANPVIKPNTQSEEGFWGKVGDVGTGILKNLGNTAIDIAEVVYKGHQANAAVDMKLEALAHKAAGNKAEANRLTNKADALMENANLDEYRFKPEGAAEELGDTLADLNPKGVIKKAVKGIAKGGSKAMSIITGKEKGIARSNSRDKRRETRAAEKDKTTPSKDPDELKKELKEKQPNNGGKVKGVKKTKVPCFDPYDSNRYKSFKTPEERKAFLDEYADQLRGQQAAINDMSPEEFQIARQAYDADSAKAKEKGEKGGGRHDKAEGAQRRARRKAKKQIKHNIYQKLRKQNVPHSQANKVATEKADKALKGLAALHEPDMVAGGKNKYDPKRFGDKEINSAIGGSWNGPRLDSLDNAAKDAIKNGLGDAKMNVQLEVCRKKGNK

SEQ ID NO: 8974 - protein, 214 aa, Xenorhabdus bovienii
  Coding DNA sequence: Name=SeqID_2866
  Homolog annotation: Query=1..207bp; Hit=1..203bp; Blast score=178; Percent Identity=44.0; E value=7e-44; Homolog= ref|NP_792272.1|
MRDEHFNNFIEEFGEATQHIAVPSESIEKWRGKLPDQLLHYWRTEGWNSYQNGLFSTVNPDDYEGIVDMWLEDTPFESMDAYHVIGKSGFGDLCLCGENTGTNLTISCAFNTIYYNKENFYKKDKEEANLDIATFFESKSLDYFDLEEDDDDDDIGIFSNAIEKYGPLNENQIFGFEPALVLGGDIALKNIRKLDMYIHLDILRQFSSPQITEV

SEQ ID NO: 8975 - protein, 734 aa, Xenorhabdus bovienii
  Coding DNA sequence: Name=SeqID_2867
  Homolog annotation: Query=365..719bp; Hit=561..904bp; Blast score =114; Percent Identity=29.0; E value=6e-24; Homolog= sp|Q07591|EAE _CITFR
VTFIPVIHAKYPLARLELDTAELQQAGGKILYQQPDKVTLRLPKTTKNPVRLSGIAIDSRGNRSNRAEIMIVSLLTEKRWQVLANKTQAKADGHDSVIYTVLVTDQEGAPIPNQAVIWSNDKGELSQTRQNTDAQGQASVVLRSRQQGLHAVRVSVDGEVAVAPSVQFDAVLIPEITVDKHSIKADGKAIATLTVTVKNAGSQPVSNQAVGWQTSLGQFSAFSLMTDAKGQAMAYLTSKVSGSADVTVAVGSETVMSSPILFTASLTHTLQSDKQTAIADGQDSILYTVNVRDAADRPVANSKVQWSTDNGQLLDKQSQTNSQGEATARLVSRTAGMATVKAEVAGKTLNAPSMTFKRLLKSAITVDKVWAKSDGQDTVVLTATVKDSLGSPVANQPVIWQTDSGVLSSERTETDSRGQTQVKLSSPLTGEHQVQIRVGDEWVTAPMITFEEVLLSTVRVDKTRAAADGTEQVTFTVTVMDSRGWGLSDQAVEWSGDFNEMISVETRTDHWGNATATVVSHRPGKGVIIARIGDQQQASPVIEFVSPLSIEDTVAVDRQGGNANQKSFGLRGPSVLWHGAKFRLITAGNTGRVSWQSNSPSVTVSGDVVTVQQNPDGVRFTGTDETGQQVELTLTVHTWFERSGLTKAFYSEAKQLCKSLGSRIASKYALEQLYEEWGNFYLYDGWAREFYVTSTDYLTASSGFSEAQAKWVFWAESDSWMRNAWHHLAFACGR

SEQ ID NO: 8976 - protein, 348 aa, Xenorhabdus bovienii
  Coding DNA sequence: Name=SeqID_2868
  Homolog annotation: Query=6..337bp; Hit=107..444bp; Blast score=258; Percent Identity=40.0; E value=1e-67; Homolog= dbj|BAA15799.1|
VVQNVQSRRFSRGKSSIVGLLSLSLSFPGQAMSEVQNPDQHEHTLAEITAQWGQLTQSQSPGEAAKTMAAQQLSSAVTSTLTPWFNQYGNARLTLPFDSHFSLKDISFDWLLPFYQPVSGTAFSQLGVKTHHGQTTTAVGFGYRYVADNWLWGLNAFWDTLWPEQYHRYSLGLEAWYDNVKLSANLYQRLSHWKPSRLTDFDARPANGWDIQAEAWLPAFPHWGGQLKYEHYYGRQVALFGESERQKNPYSITAGLTYTPVPLVTLGADLRQGKQSASENRFTLNLNYRFGVPFNQQLDPNAVAPLRYLSSSQSDFVNRRRDMVLDYQKQTLLTLALPTSAMAMKERK

SEQ ID NO: 8977 - protein, 34 aa, Xenorhabdus bovienii
  Coding DNA sequence: Name=SeqID_2869
MMTTLPISLINNLVKLFYNEQIIFSIRKRINHSI

SEQ ID NO: 8978 - protein, 121 aa, Xenorhabdus bovienii
  Coding DNA sequence: Name=SeqID_2870
  Homolog annotation: Query=1..121bp; Hit=23..141bp; Blast score=139; Percent Identity=56.0; E value=1e-32; Homolog= ref|NP_404416.1|
MLSSFTNTLDRTLNTPITSDEEAEQYTPEQLLSWAQGCMLEGLPDDFNEAYVECLQQQHLDGKREVKITHQFKLNADSAYETFTPADYLYPTQCIERVLAGKDWKKAKLTFNPRKATFFWE

SEQ ID NO: 8979 - protein, 43 aa, Xenorhabdus bovienii
  Coding DNA sequence: Name=SeqID_2871
LRGDYGFDCVVPKVSDEPVLYFHKIHYRLYERLIPRKMLPFLG

SEQ ID NO: 8980 - protein, 142 aa, Xenorhabdus bovienii
  Coding DNA sequence: Name=SeqID_2872
  Homolog annotation: Query=1..140bp; Hit=800..939bp; Blast score=248; Percent Identity=87.0; E value=1e-65; Homolog= ref|NP_928410.1|
MTKVVKMWRKLGAWLWLSTQNLADYPDTAEKMLNMAEWWLCLTMPPDEVEQIARFKKLNEEQKAVLLSASKLPRCYTEGVVLAKKIEALFRVVPPSLYLALGMTEKEEKAERRALMREHQCSELEAAMLVARKMDIARGLRV

SEQ ID NO: 8981 - protein, 755 aa, Xenorhabdus bovienii
  Coding DNA sequence: Name=SeqID_2873
  Homolog annotation: Query=5..744bp; Hit=38..771bp; Blast score=1078; Percent Identity=69.0; E value=0; Homolog= ref|NP_928410.1|
MTNPKPLNRPGRLSESEEVAIYRANPSIIDYLPWVEYLEDGQCLLLDDGVSVGAVYRIEPIATEGRPLERLIEIRDQLEDAIQDSLEEDDISPWVVQFFCQDEDDPSSYLTTLRDYVKPWAQGTAFTDAFLAESERHLKSIAQPDGIFQDSLITGQPWRGQQRQTRMVVYRWLPAHKSKAYYQTVSSVAALNQVCERLISSLASAGILATQQDGEQIHSWLLRHFNPAPDWGMAKADFYRTVSYETPTPSDLPVHNDFAESLWFTPQVSDPENGIWWFDGLPHKAVPVERLRRPSEPGTLTGEMKRGDNINALMDMMPEGTVVTLTIVTQAQDTLEESFTRLAKNAVGENTESLRVRQDVQEVKELLGRRHKLYRSALTFLVRGKDLGNLNHRVHQLSSTLLMAGLQPVRPEFSVSPLNVYLRALPMCFNPQKDKKHWHSRLTWVQHLAGLLPVTGRSTGSGHPGFSFFNRGGAPLTFDPMNKQDRTQNAHLLLFGPTGAGKSATLCSSLVQLMAIHRPRLFIVEAGNSFGLLADYYASLGLTVNKIGIKPGCGVSLALFADAHQLLQLSPKQLRIHEADIPDTDEPQDDGDEQRDILGEMEIAARLMITGGEKKEEERLTRSDRGLIREAIMMAAHTSYEAGRQMVASDLQNALYAIARIHQQDKHGQPLITAHRRARADEMAGAMSMFTQGFEGELFNQPGTPWPEVDVTLIDLGTLARENYSAQMALAMVSLINTVNNLADATSIRTGNCNW

SEQ ID NO: 8982 - protein, 133 aa, Xenorhabdus bovienii
  Coding DNA sequence: Name=SeqID_2874
  Homolog annotation: Query=1..132bp; Hit=9..141bp; Blast score=148; Percent Identity=57.0; E value=2e-35; Homolog= ref|NP_928409.1|
MRKIKYAVVLCLTGLMAGCSTSKDTLLPAGEQTVLAMWQGNKAGYSTVQARHTLRRTLTSAERNRALEEPHHYSRSAANEISQQFPRLPNPDMVMYVYPHLVAGKTPILGYSTVFPFYQQVQYALPGERTEAR

SEQ ID NO: 8983 - protein, 38 aa, Xenorhabdus bovienii
  Coding DNA sequence: Name=SeqID_2875
MKTTSYQWLFRASQPYCLQINMTPPPEPMPVQLCWLEP

SEQ ID NO: 8984 - protein, 168 aa, Xenorhabdus bovienii
  Coding DNA sequence: Name=SeqID_2876
  Homolog annotation: Query=1..163bp; Hit=315..488bp; Blast score=207; Percent Identity=62.0; E value=4e-53; Homolog= ref|NP_807865.1|
VRGQVNSITFVFQDGTVRTLPGAGQNQQGIGWLSDENGIPCLSGERKSNASTYLPTLFALSAMNSAGDALNVSQHTAQTNGTGGITSALTGNAGQAALGKALSGGMKDLSEWLKQRYSQTFDAVYVPPGARVVVHITQPLAIDYETTGRKVRYGFSEPDQRYHQEALD

SEQ ID NO: 8985 - protein, 167 aa, Xenorhabdus bovienii
  Coding DNA sequence: Name=SeqID_2877
MTTSGTATHRALKTTRSPLPPVTNGQPATFYKGLAAQAAVPETGSGNDVQVSTIPAASDARLPVPLPVAAAEAGGKTAPPRTPPPATADFVRPVFPPVVTGHFLVCVVRSIPSPLFFRMAPCALCRAQGKTSRVSAGCPMKTAFPVSAVNVNPMPAPICRHCLPCQP

SEQ ID NO: 8986 - protein, 91 aa, Xenorhabdus bovienii
  Coding DNA sequence: Name=SeqID_2878
  Gene classification: Function=Transposase; Function class=L DNA replication, recombination and repair
  Homolog annotation: Query=1..86bp; Hit=1..86bp; Blast score=88; Percent Identity=50.0; E value=1e-18; Homolog= insA_g5 COG3677
MAKVDVVCRYCHKAEEVKGHGKGSSGHPRYHCYACRKTFQLNYTYQACKPGVKEQITDMAINNGGIRDTARVLNVGINTVLRTLKNLNPDK

SEQ ID NO: 8987 - protein, 83 aa, Xenorhabdus bovienii; identical to SEQ ID NO: 6529
  Coding DNA sequence: Name=SeqID_2879

SEQ ID NO: 8988 - protein, 84 aa, Xenorhabdus bovienii; identical to SEQ ID NO: 6530
  Coding DNA sequence: Name=SeqID_2880
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 8989 - protein, 81 aa, Xenorhabdus bovienii
  Coding DNA sequence: Name=SeqID_2881
MLHLGGHPSSVPLTDSLLQSAAEQVQSPLLNPVESAKPATDTRLSSSEPDPVIPPVTPGTVPAPDTTEDTRRLLSLFQAEE

SEQ ID NO: 8990 - protein, 40 aa, Xenorhabdus bovienii
  Coding DNA sequence: Name=SeqID_2882
LYIAETRPSGADAVRSDNFESLSLPFAFFLIKISFLCLKQ

SEQ ID NO: 8991 - protein, 335 aa, Xenorhabdus bovienii
  Coding DNA sequence: Name=SeqID_2883
  Homolog annotation: Query=6..333bp; Hit=2..323bp; Blast score=329; Percent Identity=55.0; E value=4e-89; Homolog= ref|NP_928478.1|
MLNNEEKMGWDALLDEYFFSRMLRPATEWSYRKVVRVFIRYMGETGLPESVTHRDVLCWRRHLLMEKNQSGYTWNNKVAHLRAIFNFGMERKLLSHPKNPFNDAAVKKEKKQKKTLSKAQITGMYLRMQQYEEEERLQTAPRGGRCALYPTGYWLTVLDTFRLTGMRLNQLLHLRLRDINLDNSYIELRVEGSKNHSEWRVPMIPQLKPRLAQLIEQAKACGAKEDDPLFDLTRLRFCHHGRHVSHQYHHDREKQHLRSFFNRLSKECGFAVSPHRFRHTLATELMKAPDRNLQLVRCLLGHRSVATTMEYIDIDMEIAGKTLANELAFYLDLAV

SEQ ID NO: 8992 - protein, 53 aa, Xenorhabdus bovienii
  Coding DNA sequence: Name=SeqID_2884
MGWFGGGDTKRRNREVCSKSNSDNHLTWHQNQLLKSLLSTQKGEHKLCSPDFV

SEQ ID NO: 8993 - protein, 41 aa, Xenorhabdus bovienii
  Coding DNA sequence: Name=SeqID_2885
MKIQQPTVFHGFFRRKSLTDLAECGLMRPVSPDSSVGRAGD

SEQ ID NO: 8994 - protein, 190 aa, Xenorhabdus bovienii
  Coding DNA sequence: Name=SeqID_2886
  Gene classification: Gene name=AcrR; Function=Transcriptional regulator; Function class=K Transcription
  Homolog annotation: Query=1..190bp; Hit=9..199bp; Blast score=201; Percent Identity=54.0; E value=3e-52; Homolog= yjdC COG1309
VQREYVLSHALNLLEQHGLSATLETLLTPLEVDINQIKHFWPDREALLYDCLRYHSQQIEIWQRQILLDEVLSPEQKLLARYDTLKEKVQKQRYPGCLFIAACSVFTDTEHPIHQLAELQKQNSFHYTIELLQQLEIENSERVAKQMELILEGCLSKLLVKRELEDVITAKLLAQDILTIAKCRKNGAFS

SEQ ID NO: 8995 - protein, 583 aa, Xenorhabdus bovienii
  Coding DNA sequence: Name=SeqID_2887
  Gene classification: Gene name=TrxA; Function=Thiol-disulfide isomerase and thioredoxins; Function class=O Posttranslational modification, protein turnover, chaperones
  Homolog annotation: Query=1..582bp; Hit=1..564bp; Blast score=663; Percent Identity=60.0; E value=0; Homolog= ZdsbD COG0526
MMKRILILLLLLSGIAISPIKANALFEPPGQNRYLPVAQAFVFDFQQKDNQLTLNWDIKPGYYLYRKQFIITPIKATLGHFDFSKSVDHEDEFFGKTEVHFGSARINIPILSASNDSNLQVTYQGCAEAGFCYAPETITVPLSAVIASIPSANEAAKQPDITTSQKASLPQEESPPNVSDVPFSPLWALLIGIGIAFTPCVLPMYPLISGIILGQRRPDSLKRIFWLAMSYVQGMALTYTVLGLIVAAAGLQFQAALQNPYILVGLSILFILLALSMFGMYSLQLPSSVQTRLVDWSNQQKSGSYIGVFVMGILAGLIASPCTTAPLSAILLYIAQSGNTLLGGLTLYLYALGMGLPLIAVTLFGHKLLPRRGPWMQYVKEAFGFIILALPVFLLERVLGDTWGIRLWSLLAVAFLGWAFALTLNSKKGWLRTLQLILLVLTLITSRPLQDWVWGNPTTTQQQPSLKFQQVSDWQELSQILAENRHQPIMLDLYADWCVACKEFEKYTFPDPQVQAQLSQFLVLQANVTENGSKQKELLDKLKVLGLPTILFFDAHGKELPDSRVSGFMDAGRFSRHLQHLQK

SEQ ID NO: 8996 - protein, 433 aa, Xenorhabdus bovienii
  Coding DNA sequence: Name=SeqID_2888
  Gene classification: Gene name=DcuB; Function=Anaerobic C4 -dicarboxylate transporter; Function class=R General function prediction only
  Homolog annotation: Query=1..433bp; Hit=1..433bp; Blast score=566; Percent Identity=80.0; E value=1e-161; Homolog= dcuA COG2704
MLAVELVIVLLAIFLGARLGGIGIGFAGGLGVLILATIGVKPGSIPFDVISIIMGVIAAISVMQIAGGLDYLVQQTEKLLRRNPKYITILAPIVTYCLTLLAGTGNISLATQPVIAEVAKEQGIKPCRPLSTAVVAAQIGLTSSPISAAVVYMSSVMEGQGVSYIQMLMVIIPSSFAAIILMSFIVSWFFDSKLSDDPVYQKRLADGLIELRGSHKVDIKPKAKLSVLLFLLGVVGIVIYAIINSPSLGLVEKPLMNTTSAILIIMLSIATLTTVICSVNTDAILNSSTFKAGMSACICIMGVAWLGDTFVQANMGWIKETAGSLIHAQPWLLAVIFFFCSALLYSQAATAKALMPMVLALHVTPLTALASFPAVSGLFILPTYPTLVAAVQMDDTGTTRIGRFVFNHPFFIPGTIAVALAVTFGFLVGGMIL

SEQ ID NO: 8997 - protein, 48 aa, Xenorhabdus bovienii
  Coding DNA sequence: Name=SeqID_2889
MADNIVYIVINRNIPPLNIRYFHHIKHYYLRYYRAYFYNYNWQYFTLN

SEQ ID NO: 8998 - protein, 474 aa, Xenorhabdus bovienii
  Coding DNA sequence: Name=SeqID_2890
  Gene classification: Gene name=AspA; Function=Aspartate ammonia -lyase; Function class=E Amino acid transport and metabolism
  Homolog annotation: Query=1..474bp; Hit=16..489bp; Blast score=800; Percent Identity=84.0; E value=0; Homolog= aspA COG1027
MSNNIRIEEDLLGKREVPAEAYYGIHTLRAIENFYISDRTINDVPEFIRGMVLVKKAAALANKELHTIPGKIADIIVKACDEVLNTGKCLDQFPVDVFQGGAGTSLNMNTNEVLANIGLELMGHPKGEYEYLNPNDHLNRSQSTNDAYPTGFRIAVYNSIMKLITSIELLQVGFDKKSVEFADILKMGRTQLQDAVPMTLGQEFRAFSVLLKEEIKNITRTAELLLEVNLGATAIGTGLNTAPGYQTLVVEKLAEVTGLPCLPAEDLIEATSDCGAYVMVHSALKRLAVKMSKICNDLRLLSSGPRTGLNEINLPELQAGSSIMPAKVNPVVPEVVNQVCFKVIGNDICVTMASEAGQLQLNVMEPAIGQAMFESISILSNACRNLVEKCVNGITANKEVCESFVFNSIGIVTYLNPFIGHHNGDIVGKICAETGKSVREVVLERGLLTEAQLDDIFSVENLKHPTYKAKRFDD

SEQ ID NO: 8999 - protein, 71 aa, Xenorhabdus bovienii
  Coding DNA sequence: Name=SeqID_2891
MLFDMRTFFNLDTFFYCSIYVFVENNVAVSNCRDINHLSLDCWRDHMWIYQKCLVPGSLYSANFINEITYV

SEQ ID NO: 9000 - protein, 50 aa, Xenorhabdus bovienii
  Coding DNA sequence: Name=SeqID_2892
MSINGEHANLRVVYWPCSSLLTIFKGNIFIPMILSLINERRTTCVGSHLS

SEQ ID NO: 9001 - protein, 168 aa, Xenorhabdus bovienii
  Coding DNA sequence: Name=SeqID_2893
  Gene classification: Gene name=FxsA; Function=Protein affecting phage T7 exclusion by the F plasmid; Function class=R General function prediction only
  Homolog annotation: Query=1..159bp; Hit=1..158bp; Blast score=146; Percent Identity=61.0; E value=8e-36; Homolog= yjeG COG3030
VRWLPFVLICLLVYIESVLFVRIASEVGVLLTLLLVIFTSCVGVSLVRNQGIKNFMSMQQKIAAGESPAKEAIKSVSLVIAGVLLILPGFFTDFLGLLLLLPPAQKLLTAKLLPHITFYRPNNNGRDGQGGHHGQTFEGEYERRQDDASHTLDGQKRHDEHGNGQDKK

SEQ ID NO: 9002 - protein, 97 aa, Xenorhabdus bovienii
  Coding DNA sequence: Name=SeqID_2894
  Gene classification: Gene name=GroS; Function=Co-chaperonin GroES (HSP10); Function class=O Posttranslational modification, protein turnover, chaperones
  Homolog annotation: Query=1..97bp; Hit=1..97bp; Blast score=150; Percent Identity=92.0; E value=2e-37; Homolog= groS COG0234
MNIRPLHDRVIVKRKEVESKSAGGIVLTGSAAGKSTRGEILAVGNGRILENGEMKALDVKVGDIVIFNEGYGVKAEKIDNEEVLIMSESDILAIVEA

SEQ ID NO: 9003 - protein, 548 aa, Xenorhabdus bovienii
  Coding DNA sequence: Name=SeqID_2895
  Gene classification: Gene name=GroL; Function=Chaperonin GroEL (HSP60 family); Function class=O Posttranslational modification, protein turnover, chaperones
  Homolog annotation: Query=1..532bp; Hit=1..532bp; Blast score=808; Percent Identity=88.0; E value=0; Homolog= groL COG0459
MAAKDVKFGNDARGKMLRGVNVLADAVKVTLGPKGRNVVLDKSFGSPVITKDGVSVAREIELEDKFENMGAQMVKEVASKANDAAGDGTTTATVLAQSIVTEGLKAVAAGMNPMDLKRGIDKAVIAAVEELKKLSVPCSDSTAIAQVGTISANSDETVGKLIAEAMDKVGKEGVITVEEGTGLEDELDVVEGMQFDRGYLSPYFINKPEAGSIELENPYILLVDKKISNIRELLPVLEGVAKASKPLVIIAEDVEGEALATLVVNNMRGIVKVAAVKAPGFGDRRKAMLQDIATLTNGTVISEEIGLELEKATLEDLGQAKRIVINKDTTIIIDGVGEAVAIAARVTQIRQQIEESTSDYDREKLQERVAKLAGGVAVIKVGAATEVEMKEKRARVDDALHATRAAVEEGVVAGGGVALVRAAAAISALTGDNEDQNVGIRVALRAMEAPMRQIVENAGEEPSVVVNNVKASQGNHGYNAATEEYGDMIEMGILDPTKVTRSALQFAGSIAGLMITTEAMITDLPRDDKADLGGAGGMGGMGGMGGMM

SEQ ID NO: 9004 - protein, 120 aa, Xenorhabdus bovienii
  Coding DNA sequence: Name=SeqID_2896
  Homolog annotation: Query=5..120bp; Hit=67..180bp; Blast score=152; Percent Identity=67.0; E value=1e-36; Homolog= ref|NP_667947.1|
MGKDMRIKILLGASILLLAGCTTNNQLTAAGSNVRFVDTQPGSECQRLGEVIGMQSNWLNGIGNESSSMRNAANDLRNKAAELGGNVIYGANSPLSRTENLLGSFVPLDSKMVGQVYKCP

SEQ ID NO: 9005 - protein, 47 aa, Xenorhabdus bovienii
  Coding DNA sequence: Name=SeqID_2897
MLASVVIRHVQERTTPETKTYTELTMLCHVFLAAALTDCLLNQTITL

SEQ ID NO: 9006 - protein, 343 aa, Xenorhabdus bovienii
  Coding DNA sequence: Name=SeqID_2898
  Gene classification: Gene name=KamA; Function=Lysine 2,3-aminomutase; Function class=E Amino acid transport and metabolism
  Homolog annotation: Query=1..341bp; Hit=1..341bp; Blast score=501; Percent Identity=71.0; E value=1e-142; Homolog= yjeK COG1509
MAHIITHIPPAREVWLKQLADVITDPNELLQLLSLNTHAMLKEGNEAKRLFPLRVPRAFAARMKKGDPHDPLLLQVLTAREEFETHPGFLTDPLDEQRSAVPGLLHKYRNRALLLVKGGCAVNCRYCFRRHFPYEDNKGNKNNWQLALDYIEQHPELDEIIFSGGDPLMAKDHELDWLITRLESISHIKRLRIHTRLPVVIPDRITLSLCNRFAQSHLQIVMVTHINHANEIDNTFRDKMMWLKQAGVTLLNQSVMLRNVNDSADTLADLSNTLFDAGILPYYIHILDKVQGAAHFLVGDEEAKAIMRELLTKISGYLVPCLTREIGGEPSKTPLDLGLKQNN

SEQ ID NO: 9007 - protein, 188 aa, Xenorhabdus bovienii
  Coding DNA sequence: Name=SeqID_2899
  Gene classification: Gene name=Efp; Function=Translation elongation factor P/translation initiation factor eIF-5A; Function class=J Translation, ribosomal structure and biogenesis
  Homolog annotation: Query=1..188bp; Hit=1..188bp; Blast score=335; Percent Identity=82.0; E value=1e-92; Homolog= Zefp COG0231
MATYSTNEFRSGLKIMFDGEPCAILESEFVKPGKGQAFARVRLRKLISGKLLEKTFKSTDSVESADVVDMNLTYLYNDGEFWHFMNNETFEQLAADEKSVGDSTKWLIDQAECILTLWDGRPISVTPPNFVELEITETDPGLKGDTAGTGGKPATLSTGAVVKVPLFVQVGEVIKVDTRSGEYVSRVK

SEQ ID NO: 9008 - protein, 104 aa, Xenorhabdus bovienii
  Coding DNA sequence: Name=SeqID_2900
  Gene classification: Gene name=EmrE; Function=Membrane transporters of cations and cationic drugs; Function class=P Inorganic ion transport and metabolism
  Homolog annotation: Query=1..104bp; Hit=51..154bp; Blast score=125; Percent Identity=74.0; E value=1e-29; Homolog= ZsugE COG2076
MSWLILLVAGLLEVVWAVGLKYTQGFSRLMPSLITISAMMVSIGLLAYAMKNLPAGTAYAVWTGIGAVGTAIFGIMVFGESANFARILSLGLIVAGIIGLKLTS

SEQ ID NO: 9009 - protein, 32 aa, Xenorhabdus bovienii
  Coding DNA sequence: Name=SeqID_2901
LFVNEPSVCSEGSPQISANKSKPCFGRFWRDI

SEQ ID NO: 9010 - protein, 150 aa, Xenorhabdus bovienii; identical to SEQ ID NO: 8646
  Coding DNA sequence: Name=SeqID_2902
  Homolog annotation: Query=3..150bp; Hit=250..397bp; Blast score=218; Percent Identity=72.0; E value=3e-56; Homolog= emb|CAC83041.1|

SEQ ID NO: 9011 - protein, 66 aa, Xenorhabdus bovienii
  Coding DNA sequence: Name=SeqID_2903
LAHYQKQNMHVAMVIFIFIKDRIKGENSKNHDIEWYENLRSKMDVRQQWNLGLFLLVWMILNLVRL

SEQ ID NO: 9012 - protein, 71 aa, Xenorhabdus bovienii; identical to SEQ ID NO: 8647
  Coding DNA sequence: Name=SeqID_2904
  Homolog annotation: Query=1..71bp; Hit=122..192bp; Blast score=108; Percent Identity=74.0; E value=3e-23; Homolog= emb|CAC83041.1|

SEQ ID NO: 9013 - protein, 112 aa, Xenorhabdus bovienii; identical to SEQ ID NO: 8648
  Coding DNA sequence: Name=SeqID_2905
  Homolog annotation: Query=1..112bp; Hit=11..122bp; Blast score=199; Percent Identity=83.0; E value=9e-51; Homolog= ref|NP_085189.1|

SEQ ID NO: 9014 - protein, 47 aa, Xenorhabdus bovienii
  Coding DNA sequence: Name=SeqID_2906
MTYFTYRHSSDLIDLVEQSVDHTTLCLSIFWGFLRAYAGSNFNYFLT

SEQ ID NO: 9015 - protein, 299 aa, Xenorhabdus bovienii
  Coding DNA sequence: Name=SeqID_2907
  Homolog annotation: Query=121..237bp; Hit=83..199bp; Blast score=171; Percent Identity=69.0; E value=2e-41; Homolog= ref|NP_927410.1|
MGRDFSVKSLGLGIVENLGLAETVDRAKNAVPKGSFGFGGDGGTVLSKNDNDFLAWVRRNNASPEFFRNSTPSKYTFTYGVGVLLKASDTYASLSVDYSTARVKVVAGNNSGNANSPVRELAFTDESYTKPESDNRFIRSNVNTKTSGYILSKTANYLEDTNSRHLGRSGFLRPNGMDNLGDLAIHVAHPSVEGPQHARGISFSYGSDSNGFGISTYAFDKNGKFQGKKRILTEDDIADMLYPVGIVVWFAQNKNPNTLFPKTQWKYIGENKTIRLANQNGSDVLSVGGNDSITLKLAS

SEQ ID NO: 9016 - protein, 271 aa, Xenorhabdus bovienii
  Coding DNA sequence: Name=SeqID_2908
  Gene classification: Function=Phage tail sheath protein FI; Function class=R General function prediction only
  Homolog annotation: Query=1..268bp; Hit=1..272bp; Blast score=242; Percent Identity=46.0; E value=4e-64; Homolog= Z2991 COG3497
MAQDYHHGVRVQEINEGTRTITTVSTAIVGMVCTGPDADEKTFPLNTPVLITDVMSASGKAGKKGTLYSSLKAIADQAQPVTVVVRVAEGESEEVTVSNIIGGVTDAGKKTGMQALLAAQSQLGVKPRILGVPGLDSKAVAIELASVAQKLKAMAYVSAYGSKNISEVIKYRDNFNQRELMLIWPDFLSWDTVSNSESIAYATARALGLRAKIDEETGWHKTLSNVGVNGVTGLSADVFWDLQDTATDADLLNKSGITTLIRKNGFRFLAS

SEQ ID NO: 9017 - protein, 537 aa, Xenorhabdus bovienii
  Coding DNA sequence: Name=SeqID_2909
  Gene classification: Function=Phage protein D; Function class=R General function prediction only
  Homolog annotation: Query=27..256bp; Hit=3..230bp; Blast score=144; Percent Identity=32.0; E value=3e-34; Homolog= PA0628 COG3500
MLDLKQRIPNTDWIPQFDLVTGKEGAPAFRLETNKKDITGKIQSRLMSLTLTDNRGLESDQLDIELDDADGKLIFPSRGDILELELGWHGDSLTPKGKFVVDEIEHTGAPDRLTIRARSADFRGDLNVKREESYHEHTLESIVSTIAARNQLTFKISEELKGISMHIDQTNESDVSFLTRVAKQEGAIASVKNGELLFIRQGQNKTGSGENILPVLITRESGDSHRFSLSDREAYTGVVAQWQDTRTTTKQTVKLKRVESKSGKVEIIIEYGSSENKSSGKGNAKKDKNPVQKDEIPVQEDKNLIPKEKYSAQKKESSTFKKEKDRKIESPREVISAKPAKTGVVNLEKKKGIDLTKKSHKTSHKTKVKDKPDYIKKGQKESKRKNRDNRNIDREKNIDIGGSLSSEKQSKSTTEHHQTTKVQKKSENYLVGAEENVLTLSRVYSNKENAERAAKAVWEKMQRGAAEFSIALAKGRADIYPETPVHIEGFKPEINGTSWTIIKVTHNLNDSGFTTSLDLELKIDDFEIKTEDVKIKA

SEQ ID NO: 9018 - protein, 171 aa, Xenorhabdus bovienii
  Coding DNA sequence: Name=SeqID_2910
  Gene classification: Function=Phage protein U; Function class=R General function prediction only
  Homolog annotation: Query=1..150bp; Hit=3..154bp; Blast score=138; Percent Identity=47.0; E value=2e-33; Homolog= Z2985 COG3499
MMAALGLFVFMLKTTPYQSFQYKQSWRHAFNSRVGARPAWQFIGSDNDTITLSGELYPELTGGSLSLFALKLMADSGKAWSFIDGSGAIYGMFVIESIDETKTEFMSGGAARKISFTLTLRRVDNNLFEMLGDLQDQLSDIKGKPPKSLDKPSGLTRKAIGEIKEHPNARS

SEQ ID NO: 9019 - protein, 1201 aa, Xenorhabdus bovienii
  Coding DNA sequence: Name=SeqID_2911
  Homolog annotation: Query=291..1197bp; Hit=8..923bp; Blast score=196; Percent Identity=26.0; E value=2e-48; Homolog= ref|NP_458686.1|
MSNIQSQLNKVLSTVGKLTGSFKSFQRHNKKLENSVDKIHNQFKKLNKTVESLKPIVGYAQETARIRTDLKAYNQTIKQSLSARQNSTRTMQVSAASQSANIIQTTQIIKQENSSSKKSEFNLGVTGNMTNNFTLLDKLVININPKITILFSILNKINAVLNVTTGAVKVVFQTLVGYIQLFGNVGIKTFDSLRVSLNIFTQLGIQAFVSLKVSLNIFAQLGIQALVSLRVSLNFFAQLGIQALDKLKSSLDAFAQLGLKAFEELKASLNFFAQLGVQALDKLKSTLDAFVQLGTQALNKLTAPLDVFAQLGTQALDKLKSTLDAFVQLGIQALNKLTAPLDVFAQLGTQALDKLKSTLDSFVQSGTQALNKLTAPLDVFAQLGTQALDKLKSTLDAFVQLGVQALNKLTAPLDIFVQLGTQALDKLKSTLDAFVQLGVQALNKLTAPLDIFVQLGTQALDKLKSTLDSFVQLGVQALNKLTAPLDVFAQLGTQALDKLKSTLDSFVQLGVQALDKLTAPLDIFAQLGTQALDKLKSTLDSFVQLGTQALNKLTAPLDVFAQLGTQALDKLKSTLDSFVQLGVQALNKLTAPLDIFAQLGTQALDKLKSTLDAFVQLGTQALNKLIAPLDVFAQLGTQALDKLKSTLDSFVQLGVQALDKLTAPLDVFAKLGMQALEELKASLNFFAQLGVQALDKLKSSLDIFTQVGVQALEELRANLNKFAQVGIQAMENLRDGLKVFAQLGTEALEALRAAMDFFGKTGNKVFGSLNDGADLLSNKGGQDTFGNQRKGLGILGNIGQKVFGVLGNGINILANVGVKGLSFLSSTFRVLGKSIMFIGRAMMANPILAIIGVIAMAAIYIWQNWGTLGPKFTALWESIKNVCSNAWQGIKDIVSAAWEGIKNFFMNGGLIGIIYQNWDAIKQSASEVWEAIKALLSEKWESIKQSVLATWENIKAQISGAWESVKQNTLEIWESIKKSISDRWNEIVSDVQAIPEKLKKAGSDMIDSLLTGIQEKWEALKGKISAITDIFTSWWSGDDKKEVVVKASQEITNSETTQQAAQVTKHDTGGSISAGKFGIVGERGPEIISGPANVTSRKNTAKLAAVGFAVSSMSLPIAAQDAPLHAQSLPAHTYEAVQAKKERSLPPQSSGVPQYNIYVYGAQGQSAQDIARVVRQELEQRERMQQARMRSSLSDRGEDFS

SEQ ID NO: 9020 - protein, 105 aa, Xenorhabdus bovienii
  Coding DNA sequence: Name=SeqID_2912
  Homolog annotation: Query=1..105bp; Hit=1..105bp; Blast score=139; Percent Identity=80.0; E value=1e-32; Homolog= ref|NP_927389.1|
MTETLNTQNDDLRTIELEAPLARGNGEITEVMVRKPTSGALRGARLQALLEMDVDSMLLVLPRVTTPVLTKNDLMMMSPGDLINLSVEVVNFLLPKSVKSDSQNN

SEQ ID NO: 9021 - protein, 172 aa, Xenorhabdus bovienii
  Coding DNA sequence: Name=SeqID_2913
  Gene classification: Function=Phage tail tube protein FII; Function class=R General function prediction only
  Homolog annotation: Query=1..160bp; Hit=1..157bp; Blast score=136; Percent Identity=45.0; E value=1e-32; Homolog= Z2990 COG3498
MALPRKLKYLNLFNDGNNYQGIVEELTLPKLSRKLEAYRGAGMNGSAMVDLGLDEGALDAEFTLGGIESQLYKQWGIATADGVMLRFAGSFEREDTGDVVAVEVVMRGRFQEFDHGTYKQGDNSQTKITAKNTYFKLTWDGEELIEIDTINMVEKVGGEDRLEQHRRNIGLF

SEQ ID NO: 9022 - protein, 390 aa, Xenorhabdus bovienii
  Coding DNA sequence: Name=SeqID_2914
  Gene classification: Function=Phage tail sheath protein FI; Function class=R General function prediction only
  Homolog annotation: Query=1..380bp; Hit=1..383bp; Blast score=353; Percent Identity=47.0; E value=1e-97; Homolog= Z2991 COG3497
MAQDYHHGVRVQEINEGTRTITTVSTAIVGMVCTGPDADEKTFPLNTPVLITDVMSASGKAGKKGTLYSSLKAIADQAQPVTVVVRVAEGESEEVTVSNIIGGVTDAGKKTGMQALLAAQSQLGVKPRILGVPGLDSKAVAIELASVAQKLKAMAYVSAYGSKNISEVIKYRDNFNQRELMLIWPDFLSWDTVSNSESIAYATARALGLRAKIDEETGWHKTLSNVGVNGVTGLSADVFWDLQDTATDADLLNKSGITTLIRKNGFRFWGSRTCSDDALFQFESYTRTAQVLADTMADAHMWAIDKPLTPSLVRDIIEGINAKFRELKSGGYIIDGRCWYDEKANDKDTLKVGKLTIDYDYTPVPPLENMMLRQRITDSYLMNFAKSINK

SEQ ID NO: 9023 - protein, 286 aa, Xenorhabdus bovienii
  Coding DNA sequence: Name=SeqID_2915
  Homolog annotation: Query=20..166bp; Hit=1..146bp; Blast score=193; Percent Identity=65.0; E value=2e-48; Homolog= ref|NP_927393.1|
MGRDFSVKSLGLGIVENLGLAETKNQAQNALPRSGGEVTGDITISTDSEIAWRKNTDMAAIGFKNTGDGDTDSYMWFKTADNGNEYFKWQHSLSGGGTNEWMSLKSDNLRVKGHQVYHEGYKPTAAIVGAYTKSEAESKYQPKGNYAVRGENYTKQESDGKYQPRGNYQPIGNYILRGDCYTKGESDSRYLSFQNRSPRTVLSGVSLNDGETANLGVDCRGKVMWVWCTEREFPAAMTVIPIDNYGVSTHYGYQGSIDLTLINGGRTIKVIFTRKDTRLWRIDIWD

SEQ ID NO: 9024 - protein, 208 aa, Xenorhabdus bovienii
  Coding DNA sequence: Name=SeqID_2916
  Gene classification: Function=Putative transposase; Function class=L DNA replication, recombination and repair
  Homolog annotation: Query=11..156bp; Hit=10..169bp; Blast score=57; Percent Identity=28.0; E value=1e-08; Homolog= BH2521 COG3415
MTITLTDAQKEALELMHDTTRDGRVRDRIKAVLLASEGWTAQMIAQALRIHESTVSRHLKDYVSEEKLAPENGGSESRLSAEQTTELVEYLTANLMHTTAQIVACVWARWQVTFTVAGMTKWLHRQGFSYKKPMGTPHKSDAGKQQHFIETYNALKAECGQNAPILFIDAMHPTQSTKLSYGWMRRGREHVKVVETTGSRTRTCRHQA

SEQ ID NO: 9025 - protein, 178 aa, Xenorhabdus bovienii
  Coding DNA sequence: Name=SeqID_2917
  Gene classification: Function=Predicted transposase; Function class=L DNA replication, recombination and repair
  Homolog annotation: Query=16..144bp; Hit=3..128bp; Blast score=68; Percent Identity=36.0; E value=3e-12; Homolog= DR0255 COG3335
LLDKIKAGARAGRYRLVYFDEAGFAASPPVQYGWSPRGKPHETEPQHHDRRSVLGALNYTDNTLFYQAPSGSITRADVIDFLEQVAKQGDNRLTFLVLDNARIHHGIEKKIRNRWLREHNLLLFYLPAYSPELNLIEIIWKQAKYHWRRFITWTQDTVEYELNTLLEGYGAKFAINYS

SEQ ID NO: 9026 - protein, 91 aa, Xenorhabdus bovienii
  Coding DNA sequence: Name=SeqID_2918
VGKLIQQKRLNTLIGSRSISFLGSFCKYHVKKSLKNSLFAGCYSVLRKKNTNGKKIQKNYCQAAKSPYNAPPLTDAERRHAAADSERTARK

SEQ ID NO: 9027 - protein, 182 aa, Xenorhabdus bovienii
  Coding DNA sequence: Name=SeqID_2919
  Gene classification: Gene name=FldA; Function=Flavodoxins; Function class=C Energy production and conversion
  Homolog annotation: Query=1..175bp; Hit=1..175bp; Blast score=201; Percent Identity=53.0; E value=2e-52; Homolog= hemG COG0716
MNYLLLYSTQDGQTKKIITCIAENLRRAGAECDLRDLATIKHINLKPYHKVMIGASIRYGHFNSVLHQFAIRHQKQLNQMPTAFFGVNLTARKPEKRTPETNAYIRKFLMKSPWKPNLCDVFAGALLYPRYRWLDRIMIQFIMRMTGGETDTTKEIEYTDWEQVDLFSGKFLQISCEKESQK

SEQ ID NO: 9028 - protein, 483 aa, Xenorhabdus bovienii
  Coding DNA sequence: Name=SeqID_2920
  Gene classification: Gene name=TrkG; Function=Trk-type K+ transport systems, membrane components; Function class=P Inorganic ion transport and metabolism
  Homolog annotation: Query=1..483bp; Hit=1..483bp; Blast score=697; Percent Identity=84.0; E value=0; Homolog= ZtrkH COG0168
MHFRAITRIVGLLVILFSVTMIIPGLVALIYRDGAGRAFSQTFIFALVIGLMLWVPNRNQKHDLKPKEGFLIVVLFWTVLGSVGALPFIFSEKPNLSVTDAFFESFSGLTTTGATTLIGLDSLPKAILFYRQMLQWLGGMGIIVLAVAILPLLGVGGMQLYRAEMPGPLKDNKMRPRIAETAKTLWLIYVLLTIACAIALWAAGMSIFDAISHSFSTIAIGGFSTHDASIGFFNSPAINTIIAIFLLISGCNFGLHFAVLSGRSLKVYWRDPEFRMFITIQLALLVICVLILWQQSVYESGLDALNHAFFQVVSMATTAGFTTVSFANWPLFLPFLLLCSAFIGGCAGSTGGGLKVIRILLLFLQGSRELKRLVHPNAVYTIKLGQRALPERIIEAVWGFFSAYALVFLISMLLLIATGVDEFSAFSAIAATLNNLGPGLGAVSDNFTTMNPAAKWILVVTMLFGRLEVFTLLVLFTPTFWRE

SEQ ID NO: 9029 - protein, 203 aa, Xenorhabdus bovienii
  Coding DNA sequence: Name=SeqID_2921
  Gene classification: Function=Uncharacterized ACR; Function class=S Function unknown
  Homolog annotation: Query=1..199bp; Hit=2..200bp; Blast score=229; Percent Identity=62.0; E value=1e-60; Homolog= ZyigZ COG1739
MKPYLIPVASVNFTEEIKKSRFITLLEHTSGVNEAKLFIQNIKEQYPDARHHCWAFVAGAPDDSQQLGFSDDGEPTGTAGKPMIAQLIGSGVGEITAVSVRYFGGIKLGTGGLVKAYGNGVQQALKLLETEYKVPQKLYQLQCGYAHISMVEQLLQKFSGQVIASEYAENVTLQVSLPATLAGEIGDKLRDLSRGALFLTPKS

SEQ ID NO: 9030 - protein, 446 aa, Xenorhabdus bovienii
  Coding DNA sequence: Name=SeqID_2922
  Gene classification: Gene name=PepP; Function=Xaa-Pro aminopeptidase; Function class=E Amino acid transport and metabolism
  Homolog annotation: Query=3..446bp; Hit=1..443bp; Blast score=649; Percent Identity=69.0; E value=0; Homolog= pepQ COG0006
MKMEKLASLYHEHIKILQRRAREILTRNQLDALLIHSGESLRVFLDDCDYPFKVNAHFKAWVPVTKVPNCWLWIDGVNKPKLWFYSPVDYWHSVEALPNSHWTEEVELIHLAKADDIKAELSGLSKQNTAYIGEQTERAKDLGILEYNINPKMVLDYLSYHRSYKTDYELVCMREAQKTAVNGHLAAYDAFTSGVSEFEINMFYLMATGHRDTDVPYNNIIALNENAAVLHYTKLQQTVPSEIRSFLIDAGAEYNGYAADITRTYAAKHNNDFASLIKDLNGEQQAIIGSIKAGIRYTDYHINMHRRIAKLLKKHGIINGITEETMVEKGLTTPFFPHGLGHPLGLQVHDAAGFMQDDTGTHLAAPTLHPYLRCTRILEPRMVLTIEPGIYFIETLLAPWRENEYSKHFDWKKIDMFKLYGGIRIEDNIVIHDGKIENMTRDLQLS

SEQ ID NO: 9031 - protein, 46 aa, Xenorhabdus bovienii
  Coding DNA sequence: Name=SeqID_2923
LIIWQEYKSYHNSLFLVSPWGNLTLAQLTNNIYIFHNYNKKYCRPS

SEQ ID NO: 9032 - protein, 41 aa, Xenorhabdus bovienii
  Coding DNA sequence: Name=SeqID_2924
LSSIINLPCDPLYKKFIIGLHSINTLITINRIWSYQMVCTH

SEQ ID NO: 9033 - protein, 728 aa, Xenorhabdus bovienii
  Coding DNA sequence: Name=SeqID_2925
  Gene classification: Gene name=FadB; Function=3-Hydroxyacyl-CoA dehydrogenase; Function class=I Lipid metabolism
  Homolog annotation: Query=308..715bp; Hit=2..409bp; Blast score=615; Percent Identity=72.0; E value=1e-176; Homolog= fadB_2 COG1250
MLYLSDTIQVNWLKDGIAELIFNAPAAINKLDTKTVASLDKAVAVLEQQTELKGLLLRSEKQAFIVGADITEFLSLFDAPKEKLQEWLKFANDIFNRIEDLPVPTISAINGYALGGGCEVVLSTDFRVASPDLRIGLPETKLGIMPGFGGSVRLPRLIGPDNALEIITAGKDIGAEDALKNGLVDAVVPTEKLVDAAASILEQAIKGDLDWQAVRQPKLSPLNLNDVERTMSFTVAKGMVMKVAGPHYPAPITAVKTIEKAATLGRDEALKLEVESFVPLAHTTVARALVGIFLNDQYVKGLAKKHLKEVTVPQHATVLGAGIMGGGIAYQSARKGVPVLMKDINQKALDLGVNEAAKLLHKQFERGRLDAMKMAKILSSIQPTLSYAGIEQSQIVVEAVVENPKIKAAVLAETESHINDDCILASNTSTIPITELAKSLKRPENFCGMHFFNPVHRMPLVEIIRGEKTSDKTISTVVAYASKIGKTPIVVNDCPGFFVNRVLFPYLAGFGMLLRDGGDFRQIDKIMEKEFGWPMGPAYLIDVVGIDTAHHAQAVMAQGFPERMTRDYHDAIDVLFENQRYGQKNDVGFYKYTQDKKGKPKKEQDETVDQLLAGISQPKQVFSGEDIIARTMIPMINEVVRCLEEGVIASPAEADMALVYGLGFPPFHGGVFRYLDTMGTAAYVKLAERYAHLGAMYHVPAGLKAKSESNESYYPVAAKIAVNPGEKA

SEQ ID NO: 9034 - protein, 387 aa, Xenorhabdus bovienii
  Coding DNA sequence: Name=SeqID_2926
  Gene classification: Gene name=PaaJ; Function=Acetyl-CoA acetyltransferases; Function class=I Lipid metabolism
  Homolog annotation: Query=1..387bp; Hit=1..387bp; Blast score=591; Percent Identity=77.0; E value=1e-169; Homolog= ZfadA COG0183
MENVVIIDGIRTPMGRSKGGVFRQVRAEDLSAHLMKSILKRNPSVQPEHIDDISWGCVQQTLEQGFNIARNSALLAGIPHSVPAVTVNRLCGSSMQSLHDGARMIMTGDASIAMIGGVEHMGHIPMTHGVDFHPKLSRNVAKAAGVMGLTAEMLAKMHGISREMQDEFALRSHLLAAQATESKTFANEIAPIHGHDADGNLKFIDFDEVIRPDTNLKNLAGLRPVFDPVTGSVTAGNSSALSDGASAMLIMSESKANELGLKARARIRSMAVVGCDPSIMGYGPVPATQMALKKAGLSLADIGLIELNEAFAAQSLACMKGLNLLDSMDDRINLNGGAIALGHPLGCSGARITTTLLNLMERKDVQFGLATMCIGLGQGIATIIERV

SEQ ID NO: 9035 - protein, 233 aa, Xenorhabdus bovienii
  Coding DNA sequence: Name=SeqID_2927
  Gene classification: Gene name=UbiB; Function=2-polyprenylphenol hydroxylase and related flavodoxin oxidoreductases; Function class=H Coenzyme metabolism
  Homolog annotation: Query=1..233bp; Hit=1..233bp; Blast score=364; Percent Identity=75.0; E value=1e-101; Homolog= ubiB COG0543
MTTLSCKVTSVDSITDTVYRVHLLPDSPFSFRAGQYLMVVMDERDKRPFSMASPPSEKQTIELHIGASELNLYAMAVMDRILDQKVIDIDIPHGQAWFREDSENPMLLIAGGTGFSYTRSILLSALEKNPNRDISIYWGGRELHHLYDLGELQGLSERYPNLAVVPVVEQVDEYWQGRTGTVLSAVLEDFGSLANHDIYIAGRFEMAKIARERFCSERDASIDRMYGDAFEFI

SEQ ID NO: 9036 - protein, 493 aa, Xenorhabdus bovienii
  Coding DNA sequence: Name=SeqID_2928
  Gene classification: Gene name=UbiD; Function=3-polyprenyl-4 -hydroxybenzoate decarboxylase and related decarboxylases; Function class=H Coenzyme metabolism
  Homolog annotation: Query=1..490bp; Hit=1..490bp; Blast score=908; Percent Identity=87.0; E value=0; Homolog= ZyigC COG0043
MNNMKYRDLRDFLSLLEQSGELKRIRMEVDPYLEMTEIADRTLRAGGPALLFENPKGYSMPVLCNLFGTPKRVAMGMGQDDVKALHDVGKLLAFLKEPEPPKGFRDLVDKLPKFKQVLNMPTKRLNSAPCQEQVWTGDEVDLTRIPVMHCWPEDAAPLITWGLTVTRGPNKERQNLGIYRQQVLGKNKLIMRWLSHRGGALDFQEWCQAHPGERFPVSVALGADPATILGAVTPIPDTLSEYAFAGLLRGHKTEVVKCLSNDLEVPASAEIILEGYIEPDEMAPEGPYGDHTGYYNEVDMFPVFTITHITQRRDAIYHSTYTGRPPDEPAVLGVALNEVLVPILQKQFPEIVDFYLPPEGCSYRLAVVTMKKQYAGHAKRVMMGVWSYLRQFMYTKFIIVCDDDINARDWNDVIWAITTRMDPQRDTVLMENTPIDYLDFASPVSGLGSKMGLDATNKWPGETQREWGRPIVMSDEIRARVDEIWDQLEILKR

SEQ ID NO: 9037 - protein, 32 aa, Xenorhabdus bovienii
  Coding DNA sequence: Name=SeqID_2929
MSEGFKLFQHGKTFPEQCDTQALVDWIPFCCI

SEQ ID NO: 9038 - protein, 31 aa, Xenorhabdus bovienii
  Coding DNA sequence: Name=SeqID_2930
VCLTYIPNRLQIAAQWQVNERSQQNSNLKDE

SEQ ID NO: 9039 - protein, 34 aa, Xenorhabdus bovienii
  Coding DNA sequence: Name=SeqID_2931
LPAFTVQKIPVSHNIPTPLHNMSSITKPGLQDHQ

SEQ ID NO: 9040 - protein, 162 aa, Xenorhabdus bovienii
  Coding DNA sequence: Name=SeqID_2932
  Gene classification: Gene name=NusG; Function=Transcription antiterminator; Function class=K Transcription
  Homolog annotation: Query=1..162bp; Hit=1..162bp; Blast score=212; Percent Identity=61.0; E value=1e-55; Homolog= rfaH COG0250
MGNWYLLYCKRGQISRAIGNLERQDVICLTPTAKIEKIVRGKRTTVTEPLFPNYLFVNFDPEIIHTTTINSTRGVNHFIRFSTYPAVVPQTLIDELMSATEQEYIAPETPITGDTVLITEGIFEGIQAIYNEPDGETRSILLLNILNKEVSKVLDNKQFIKI

SEQ ID NO: 9041 - protein, 356 aa, Xenorhabdus bovienii
  Coding DNA sequence: Name=SeqID_2933
  Gene classification: Gene name=HemB; Function=Delta-aminolevulinic acid dehydratase; Function class=H Coenzyme metabolism
  Homolog annotation: Query=19..353bp; Hit=1..335bp; Blast score=512; Percent Identity=72.0; E value=1e-145; Homolog= VC0105 COG0113
MTKLTQRIVAGFYIRRSVMSYVFPGTFPGRRMRRVRRHDFSRRLVAENQLTVNDLIYPVFVMEGSNQRQEVSSMPGVYRLTIDLLLKEAEEIARLGIPVLSLFPVIEADKKSLDAKEAYNPDGLIQRSIRALKDAVPELGLLTDVALDPFTTHGQDGVIDQDGYVINDITKEILVKQALSHAEAGAEIVAPSDMMDGRIGAIRDQLEVDGHINTQIMAYSAKYASCYYGPFRDAIGSSGNLKGGNKMTYQMDPANSDEALQEIAQDLQEGADSVMVKPGMPYLDVIRRVKDTFGVPTFAYQVSGEYAMHMAAIQNGWLKEQPAIMESLLCFKRAGADGVLTYFAKRVAQWLHEQKY

SEQ ID NO: 9042 - protein, 259 aa, Xenorhabdus bovienii
  Coding DNA sequence: Name=SeqID_2934
  Gene classification: Gene name=TatC; Function=Sec-independent protein secretion pathway component TatC; Function class=N Cell motility and secretion
  Homolog annotation: Query=1..258bp; Hit=1..258bp; Blast score=349; Percent Identity=73.0; E value=1e-96; Homolog= tatC COG0805
MSVDDTQPLIGHLIELRKRILNSLITVLVIFLALVYFSNDIYRLIAAPLMEQLPKGANMIATDVASPFFTPIKLTIMVSIVVSAPMILYQVWAFIAPALYKHERRLIMPLLFSSSVLFYLGMAFAYFVVFPIAFGFFVKTVPAGVVISTDISNYLSFVMALFMAFGVSFEVPVAIILLCWSGVVTPESLKRKRPYILVGAFVVGMLLTPPDVFSQTLLAIPMYLLFEVGILLSQFYVGGRKSDRAENESEYDAGNNSEK

SEQ ID NO: 9043 - protein, 130 aa, Xenorhabdus bovienii
  Coding DNA sequence: Name=SeqID_2935
  Gene classification: Gene name=TatA; Function=Sec-independent protein secretion pathway components; Function class=N Cell motility and secretion
  Homolog annotation: Query=15..125bp; Hit=1..114bp; Blast score=86; Percent Identity=56.0; E value=7e-18; Homolog= tatB COG1826
MVIGLVVLGPERLPIAVKTVAGWIRVLRSLAANVQNELAQELKVQELQDSLKKMEEKADLQSLSPELKASMDELREAAESLKKSYQLTPEEAKALEEDETHFHSSVSHSVPEPASKQNKNQSPEKANSEH

SEQ ID NO: 9044 - protein, 84 aa, Xenorhabdus bovienii
  Coding DNA sequence: Name=SeqID_2936
  Gene classification: Gene name=TatA; Function=Sec-independent protein secretion pathway components; Function class=N Cell motility and secretion
  Homolog annotation: Query=2..84bp; Hit=18..103bp; Blast score=88; Percent Identity=64.0; E value=1e-18; Homolog= tatA COG1826
MISIPQLLIIAVIVVLLFGTNKLRSLGSDLGASIKGFKKAISDDEKPDQVEKNSHDADFETKSIAEKSTVAESEKSESKNKEQV

SEQ ID NO: 9045 - protein, 558 aa, Xenorhabdus bovienii
  Coding DNA sequence: Name=SeqID_2937
  Gene classification: Gene name=AarF; Function=Predicted unusual protein kinase; Function class=R General function prediction only
  Homolog annotation: Query=17..558bp; Hit=1..546bp; Blast score=843; Percent Identity=76.0; E value=0; Homolog= aarF COG0661
MICLIWKNGWRHWRENMTPSEIKRLYFIVRVFLSYGLDELIPNIRLTWPLRFGRYFLFWLPNRHKDKPLGERLRLALQELGPVWIKFGQMLSTRRDLFPPAIADQLSMLQDRVVSFDGAVARKSIETALGGPLETWFDDFDSQPLASASIAQVHTARLKENGKEVVLKVIRPDILPVIKADVRLMYRMAHLVPLLPNGYRLRPREVVREYEKTLLDELNLLREAANAIQLRRNFEDSSMLYVPEIYPDYCRENVLVMERIYGIPVSDIATLEARNTDMKLLAERGVQVFFTQVFRDSFFHADMHPGNIFVSYERPEDPTYIGIDYGIVGSLNKDDKRYLAENFIAFFNRDYRRVAELHVDSGWVPADINVEDFEFAIRTVCEPIFEKPLAEISFGHVLLNLFNTARRFNMAVQPQLVLLQKTLLYIEGLGRQLYPQLDLWKTAKPFLEDWLHDQVGIPAIVRAFKEKAPYWAEKLPEFPELVYGALQQHKRLQTSIDQISQQLQKQQVSQKKSLYLLGIGATLFICGSLFFMTDQIHLSWWLMGAAVISWIFGWRRLK

SEQ ID NO: 9046 - protein, 217 aa, Xenorhabdus bovienii
  Coding DNA sequence: Name=SeqID_2938
  Gene classification: Function=Uncharacterized BCR; Function class=S Function unknown
  Homolog annotation: Query=17..213bp; Hit=5..201bp; Blast score=214; Percent Identity=52.0; E value=5e-56; Homolog= yigP COG3165
METPELSDNLNSTVLFPVLTAFLETTLNHLLYRETVLKSARMRLAGKVLSIELKEIKTPLVLIFSEKQVDVLSQWSESADCSMKTTFTALLKLRDRQCLSSLINSGEIVIEGDMQVMQQWSALLDMSEWDPAHYLSPYVGDIVAEGLSRVMKEGVKFASNAITRQKTYLTESLTEEWRMAPNPLEVAYFSEEVNAVANDMSHMEKRLAALEGKYDSQ

SEQ ID NO: 9047 - protein, 251 aa, Xenorhabdus bovienii
  Coding DNA sequence: Name=SeqID_2939
  Gene classification: Gene name=UbiE; Function=Methylase involved in ubiquinone/menaquinone biosynthesis; Function class=H Coenzyme metabolism
  Homolog annotation: Query=1..251bp; Hit=1..251bp; Blast score=419; Percent Identity=79.0; E value=1e-117; Homolog= ZubiE COG2226
MADQSKKTTDFGFRTVEKDEKQIMVAEVFHSVASKYDLMNDLMSFGIHRIWKRFTIDASGIRRGHKVLDLAGGTGDLTAKFSRIVGEKGEVVLADINESMLKVGREKLRDIGIVGNVNYVQANAEELPFPDNYFDCITISFGLRNVTDKEKALRSMCRVLKPGGRLLVLEFSKPVLAPLSKVYDAYSFHVLPRIGQMIVKDADSYRYLTESIRMHPDQETLKAMMEEAGFDQVSYTNMTGGIVALHKGFKF

SEQ ID NO: 9048 - protein, 251 aa, Xenorhabdus bovienii
  Coding DNA sequence: Name=SeqID_2940
  Gene classification: Function=Uncharacterized BCR; Function class=S Function unknown
  Homolog annotation: Query=2..243bp; Hit=202..443bp; Blast score=324; Percent Identity=67.0; E value=5e-89; Homolog= yigN COG1322
MQGDWGEMVLARVLESSGLREGYEFHTQVNIKTENGERFQPDVIVHLPQEKDVIIDAKMSLIAYERYFNSDDDTQQAQALQEHINSIKGHIRGLSRKDYQQLPGLRSLDYVLMFIPVEPAYLVALNQAPELLDEALKHNIMLVSPSTLLVAVRTINNLWRYEYQSQNARLITDKATKMYDKMRLFVDDMQGLGHSLNKAQESYHLAMKKLAEGRGNLISQAEGFRDLGVDVKRPIDSQLIDKSFQSLQVNE

SEQ ID NO: 9049 - protein, 48 aa, Xenorhabdus bovienii; identical to SEQ ID NO: 6457
  Coding DNA sequence: Name=SeqID_2941

SEQ ID NO: 9050 - protein, 48 aa, Xenorhabdus bovienii
  Coding DNA sequence: Name=SeqID_2942
  Gene classification: Function=Uncharacterized BCR; Function class=S Function unknown
  Homolog annotation: Query=2..47bp; Hit=153..198bp; Blast score=72; Percent Identity=89.0; E value=1e-13; Homolog= yigN COG1322
LRSQVQDSFGQEARERHTLTHEIRNLQQLNAQMAKEAINLTKALKGDT

SEQ ID NO: 9051 - protein, 69 aa, Xenorhabdus bovienii
  Coding DNA sequence: Name=SeqID_2943
MGQSMAFASFLSETVLYLTAQPVKLLAKRHQEVIKALAAVFIGTAPILLKNTIGEIFRLGIEALFTIDQ

SEQ ID NO: 9052 - protein, 45 aa, Xenorhabdus bovienii
  Coding DNA sequence: Name=SeqID_2944
LRRCSLLINRRCFSSAASLLSSSRVLNSRNSTSCTLLISRCASSS

SEQ ID NO: 9053 - protein, 36 aa, Xenorhabdus bovienii
  Coding DNA sequence: Name=SeqID_2945
MADSKLTMQFTQFQLFLLNSLVNGKPDENPSAQQST

SEQ ID NO: 9054 - protein, 176 aa, Xenorhabdus bovienii
  Coding DNA sequence: Name=SeqID_2946
  Gene classification: Gene name=DedA; Function=Uncharacterized membrane-associated protein; Function class=S Function unknown
  Homolog annotation: Query=13..164bp; Hit=11..162bp; Blast score=125; Percent Identity=46.0; E value=2e-29; Homolog= mll0121 COG0586
LSLHEIIELVTDFVKAHEDWAIPIVFLLAFGESLAFISLLLPATIILLGLGALIGESGLNFWPIWIAAAAGAFFGDWVSYLFGVHYKDNVGKMWPLSRHPQTLVRGHRFFERWGVWGVFIGRFFGPLRAVIPLVAGIFAMPKRHFQLANFASALIWAFGILAPGAFGLRWLAEWMG

SEQ ID NO: 9055 - protein, 260 aa, Xenorhabdus bovienii
  Coding DNA sequence: Name=SeqID_2947
  Gene classification: Function=Protein tyrosine/serine phosphatase; Function class=T Signal transduction mechanisms
  Homolog annotation: Query=11..259bp; Hit=4..256bp; Blast score=97; Percent Identity=30.0; E value=1e-20; Homolog= CC2955 COG2365
MTTTLLSHPSLLPLHGGINFRDFGNKTLHNGAKIKSGLLFRSGSLDMLTENDQTFLMDQNLFQIIDYRDSSEIEDKPDRVWRGANYHHAPANPLSKEVDANLEKLGQELLEQFDAQAFMLRLYELLPINNPAYKQLANLLMQPEKGGIVQHCAVGKDRTGVGSALVLFALGADLDTVMEDYLVTNITLAPYREYLLNEHAKVMSDRVIEKFAYVYSVREEFLLTALNSINQHYGSVDIWLEKDIGLDMTAREKLQSYFLE

SEQ ID NO: 9056 - protein, 34 aa, Xenorhabdus bovienii
  Coding DNA sequence: Name=SeqID_2948
MTLSDFRTKERLVAHLAFNSLIQSTCKPSGYRVN

SEQ ID NO: 9057 - protein, 72 aa, Xenorhabdus bovienii
  Coding DNA sequence: Name=SeqID_2949
MAFSLLTAQFDFLCCPVIRYAGCKEQNQLRSLAMITTIDPRIDDVFQRFFLVDTQAYCRDFSHKKQVHRMVI

SEQ ID NO: 9058 - protein, 79 aa, Xenorhabdus bovienii
  Coding DNA sequence: Name=SeqID_2950
  Homolog annotation: Query=17..77bp; Hit=279..337bp; Blast score=67; Percent Identity=54.0; E value=5e-11; Homolog= gb|AAB81642.1|
VEAGARYNWLSAQEEQQIRYVTPSQRHRGEDKAILMKRDTVYRAAQLSHPERERWSGKTRNWQPVGAVTLNPEREKQAA

SEQ ID NO: 9059 - protein, 72 aa, Xenorhabdus bovienii
  Coding DNA sequence: Name=SeqID_2951
LSLRASSRFSCLFSFWLCFSVAFSSLSGTCKKACFHCLIAPGKVLSYGNIQRGFGYAFNLSYSRNGHVIRWQ

SEQ ID NO: 9060 - protein, 50 aa, Xenorhabdus bovienii
  Coding DNA sequence: Name=SeqID_2952
MTRISPERKSSALAKLLPPDNMTVAAVAQIEGISEATLNIAVRKDFTRSN

SEQ ID NO: 9061 - protein, 69 aa, Xenorhabdus bovienii
  Coding DNA sequence: Name=SeqID_2953
  Homolog annotation: Query=10..64bp; Hit=19..73bp; Blast score=70; Percent Identity=56.0; E value=5e-12; Homolog= ref|NP_670649.1|
MRVTTILTEKDRLKQIVAHVFGDRSRKTLDKLLALLSPFNIRFYCTDDYVVYDKLPEEDHLTEKCLPNV

SEQ ID NO: 9062 - protein, 48 aa, Xenorhabdus bovienii
  Coding DNA sequence: Name=SeqID_2954
  Homolog annotation: Query=1..47bp; Hit=120..166bp; Blast score=71; Percent Identity=72.0; E value=4e-12; Homolog= gb|AAG53990.1|AF327446_2
MFTQRIKRTNLTHRSRIKRLNRKTIGYSKSEEIHDKVIGTFIEREHYF

SEQ ID NO: 9063 - protein, 38 aa, Xenorhabdus bovienii
  Coding DNA sequence: Name=SeqID_2955
LSASTIFSTQSNYLIHDRPTSYTVAVNNSLNILVSLGY

SEQ ID NO: 9064 - protein, 32 aa, Xenorhabdus bovienii
  Coding DNA sequence: Name=SeqID_2956
MQLTNNNKANSAIHIGLLCLFRDCNIITLITC

SEQ ID NO: 9065 - protein, 59 aa, Xenorhabdus bovienii
  Coding DNA sequence: Name=SeqID_2957
MLSNIPATPRFIQQYKHATSELNFLYNVSTEWHQHPCIQLSLSLHTHESLDGVVINKFM

SEQ ID NO: 9066 - protein, 163 aa, Xenorhabdus bovienii; identical to SEQ ID NO: 7546
  Coding DNA sequence: Name=SeqID_2958
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 9067 - protein, 117 aa, Xenorhabdus bovienii; identical to SEQ ID NO: 7849
  Coding DNA sequence: Name=SeqID_2959
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 9068 - protein, 37 aa, Xenorhabdus bovienii
  Coding DNA sequence: Name=SeqID_2960
LNESENHEWSESHPVLIRLDSVVIRHLTKEQDSGSEQ

SEQ ID NO: 9069 - protein, 218 aa, Xenorhabdus bovienii
  Coding DNA sequence: Name=SeqID_2961
  Homolog annotation: Query=2..204bp; Hit=71..279bp; Blast score=160; Percent Identity=44.0; E value=1e-38; Homolog= ref|NP_931832.1|
MHKVDSSNTCSITLLIEPIDEHYHLFSHLTENVEVILLEHDDIVAVTDYLVKSFLCGEKPETFTVYLLLSPYLSCHCQFDKRILKAVSFIESLSVKRVSSRQVADKIYLSESRFLHLFRDQVGINFRAYLLWLRLSDAIEEIHMTDSLTLIANNCGFSDSAHFSRTCKMAYGIRPSDLKHIIQQNLQFNCHTTQCLYNINKQIINSIHHEEEANLQIT

SEQ ID NO: 9070 - protein, 510 aa, Xenorhabdus bovienii
  Coding DNA sequence: Name=SeqID_2962
  Gene classification: Gene name=ProP; Function=77 Permeases of the major facilitator superfamily; Function class=G Carbohydrate transport and metabolism
  Homolog annotation: Query=12..504bp; Hit=7..499bp; Blast score=570; Percent Identity=63.0; E value=1e-162; Homolog= emrB COG0477
MKIEDHTAMELLSASQRWWLILSLAIIAFLQILDLTIANVALSTIAGDLGSSVSQGTWVITSFGVANAISIPLTGWLAKRVGEVRLFIISTLLFIISSWLCGISNSLEMLIISRVIQGAVAGPIIPLSQSLLLANFPKKQHSMALAIWSMTVIIAPVCGPILGGWISDNYHWGWIFLINVPIGLAAIFITYLLLKKRETKTEVIPVDKVGLVLLIVGVGCLQLMLDRGKELDWFNSNEIILLAIIATVGIILFIIWELTDDNPIVDLSLFKSRNFTVGTICISLAFLLHIGVLVLQPQLLQTVFGYTATWAGLALAPLGILPIFLALVIGRFGAKIDMRYLVTLSFIVFSFCFFWRAYTFELGMDFSSAAWPQFVQGIAIACFIMPLNVIILSNIPQEKIASAGSLFNFFRTLAISIGTSLTNTLWVQREAVHHSQLTENITQNNVLVDLAYQDIKLLGLSDLQATVFLAKRITNQSLILAANEIFWLFGFIFLALILILWFSRSNLSST

SEQ ID NO: 9071 - protein, 395 aa, Xenorhabdus bovienii
  Coding DNA sequence: Name=SeqID_2963
  Gene classification: Gene name=EmrK; Function=Multidrug resistance efflux pump; Function class=Q Secondary metabolites biosynthesis, transport and catabolism
  Homolog annotation: Query=1..390bp; Hit=1..388bp; Blast score=377; Percent Identity=49.0; E value=1e-104; Homolog= emrA COG1566
MGNNQIEKMPEQPQEKNNKKKRKIILSFFVLLFLFAGLAYLFYWYIVLRFYQSTDNAYVVGNQIQVMSQTHSSVKNIYVDNTDFVQQGDLLLTLDSADAENTFEKNKHVLAQAVRETRETILSNPKLLANMELKQLTLDKLKSNLARREKLGKVNVIAVEELDHSRKAVDIAKADLKVAMQQYKINQALLMGTPLNKLPNIEKAASNLREAWLSLQRTKIYAPVSGYVSRRSIQVGSQINQSTPLMIIVPPDQIWVEANFKEVQFTDMRLGQPVKLISDFYGDSVTYQGRITGIDMGTGSAFSILPAQNATGNWIKVVQRLPVRIELEPKQVALNPLRIGLSMHVTVDTSETAGTTLADKTPQRVIYQTDVFSFNNNEIDEIIEQIIKSNVSDEN

SEQ ID NO: 9072 - protein, 49 aa, Xenorhabdus bovienii
  Coding DNA sequence: Name=SeqID_2964
LIPTTSVRLFNPITLLSYKVGMPITIDVLAGRVPKYGVHSMNGVFILII

SEQ ID NO: 9073 - protein, 38 aa, Xenorhabdus bovienii
  Coding DNA sequence: Name=SeqID_2965
VVWSQNRHFTSTNAITIPHVFTLIIREKQRDEYVTNIH

SEQ ID NO: 9074 - protein, 91 aa, Xenorhabdus bovienii
  Coding DNA sequence: Name=SeqID_2966
  Gene classification: Function=Transposase; Function class=L DNA replication, recombination and repair
  Homolog annotation: Query=1..89bp; Hit=1..89bp; Blast score=80; Percent Identity=44.0; E value=3e-16; Homolog= insA_g5 COG3677
MALVEVKCRFCDQTTPVKKHGKGEGGHQRYYCQSCRRTFQLEYTYRACHSGMKEQIVELAMNNAGIRDTARALHASINAVVRTLKNSRRDA

SEQ ID NO: 9075 - protein, 121 aa, Xenorhabdus bovienii
  Coding DNA sequence: Name=SeqID_2967
  Gene classification: Gene name=InsB; Function=Insertion element IS1 protein InsB, putative transposase; Function class=L DNA replication, recombination and repair
  Homolog annotation: Query=4..120bp; Hit=49..166bp; Blast score=113; Percent Identity=50.0; E value=4e-26; Homolog= insB_g4 COG1662
MGSFISNKKRQRWLWYAWEPRLKRIVAHAFGARSKQTLMTLLEKLSAFDVAFWCTDNFGAYDILADEKHITDKLYTQRIERENLNLRNRLKRLNRKTLGYSKSVEMHDKIIGTFIEREFYY

SEQ ID NO: 9076 - protein, 45 aa, Xenorhabdus bovienii
  Coding DNA sequence: Name=SeqID_2968
MENIPIIYRRIKLASLFKKNKNIIVIFALLIRITYLLYSSDISTH

SEQ ID NO: 9077 - protein, 152 aa, Xenorhabdus bovienii
  Coding DNA sequence: Name=SeqID_2969
  Gene classification: Function=Predicted transposase; Function class=L DNA replication, recombination and repair
  Homolog annotation: Query=1..126bp; Hit=1..117bp; Blast score=105; Percent Identity=46.0; E value=2e-23; Homolog= mll8100 COG3293
MARYDIPDDAWIVIEPCLPPVHSERAGRPHVEHRRVMNGMFWVLCSGAPWRDLPERYGPWKTVYNRFNRGSKSGIINKIFNRLLSILDEKGLIDWAEICLDGSNIRASKDAAGAKKNLPISLTIMRWVAHAVVMAPKSIWQPTDGVFPSTCF

SEQ ID NO: 9078 - protein, 46 aa, Xenorhabdus bovienii
  Coding DNA sequence: Name=SeqID_2970
MKPFLRCIPMPSSKGMADRLSWACPAVKSRLRGKPRLSVARWILVP

SEQ ID NO: 9079 - protein, 101 aa, Xenorhabdus bovienii; identical to SEQ ID NO: 8261
  Coding DNA sequence: Name=SeqID_2971
  Gene classification: Function=Predicted transposase; Function class=L DNA replication, recombination and repair
  Homolog annotation: Query=8..97bp; Hit=163..248bp; Blast score=61; Percent Identity=41.0; E value=1e-10; Homolog= mll8100 COG3293

SEQ ID NO: 9080 - protein, 73 aa, Xenorhabdus bovienii
  Coding DNA sequence: Name=SeqID_2972
MAIFRFKSGYWNDRDIYQVRITLDIIGFYTFLFTLFTIVNIIFKMICKGISNNMCFLVLVVLHLKVDRENCCL

SEQ ID NO: 9081 - protein, 284 aa, Xenorhabdus bovienii
  Coding DNA sequence: Name=SeqID_2973
  Homolog annotation: Query=1..281bp; Hit=110..390bp; Blast score=439; Percent Identity=70.0; E value=1e-122; Homolog= ref|NP_931834.1|
MRSTGTSGIPSVARRCNETMDYTTIGIYNSYRDMLKLSSGAGLCLCPSTEEIPEMGMIKAFNWLTGLLDTNRFMVREERFIPEEAVGQLKEWQGKFTRHLIGPPFLIHRFISFLKATNTKLELDSGSMVITLGGWKRFTGAMISRTEFNQELETWLGISASRIRDMYGLVEANFLAIEDEFNQKHIPPYIHFSVRDPENLSREVADGETGQLVIFDPIAHSTPGMLLTEDMIYLRTDNDLSGRNSQRMQYVMRAPSATEFGCCAVNLESKMSADEQRDTCPVTQ

SEQ ID NO: 9082 - protein, 118 aa, Xenorhabdus bovienii
  Coding DNA sequence: Name=SeqID_2974
  Gene classification: Gene name=IscU; Function=NifU homologs involved in Fe-S cluster formation; Function class=C Energy production and conversion
  Homolog annotation: Query=2..116bp; Hit=5..124bp; Blast score=70; Percent Identity=32.0; E value=3e-13; Homolog= aq_896 COG0822
MFNEIITDNFCHPDCQGSLENPDIQLKLGNPVCGDKVNIDLSLNEEKRISDARFQAWGCTASLAMSNQFCRQIQGKTLTELAQLNIQEIDQMLGKLQPSQQHCLEMLHALFQQVRMHI

SEQ ID NO: 9083 - protein, 212 aa, Xenorhabdus bovienii
  Coding DNA sequence: Name=SeqID_2975
  Gene classification: Gene name=NifS (BS); Function=Cysteine sulfinate desulfinase/cysteine desulfurase and related enzymes; Function class =E Amino acid transport and metabolism
  Homolog annotation: Query=3..211bp; Hit=1..207bp; Blast score=145; Percent Identity=38.0; E value=3e-35; Homolog= BS_nifS COG1104
MTILYFDFNATTPMSHKSKMAIQGVLDQFANPSSRYRLSNNLITLIHQAKESVAQLVGGLPERIIFTSGGTESNNLALHSVFGQLPAGQLSRYHAICSAIEHSSILEPLRWYEKQGLKLTIIEPSKTGRIDLDTLCNAITPQTCFIALMAINNETGVIQPYDELAYRLKGKGIHLHCDAIQAVGKWPIRCFDDIPLTISFSGHKFYGPKGIS

SEQ ID NO: 9084 - protein, 496 aa, Xenorhabdus bovienii
  Coding DNA sequence: Name=SeqID_2976
  Gene classification: Gene name=CaiC; Function=Acyl-CoA synthetases (AMP-forming)/AMP-acid ligases II; Function class=I Lipid metabolism
  Homolog annotation: Query=1..480bp; Hit=70..559bp; Blast score=298; Percent Identity=34.0; E value=7e-81; Homolog= PA2424_1 COG0318
MYPPGLEFIIGLVACFKAGAIAAPSNVVRGSHHLQRLTQILNDSEAKVILTTLELSKTLSHEFPNQHVMYYSENQTVDGITQLPSISPKQLAFLQYTSGSTDTPKGVMVTHNNLIHSLRAMNNTFGLHEGLIIGGWIPQFHDMGLVGHILLTMALGGQYNFMPPLSFIQHPLRWLQLMHDYGAEFCCAPNFAYDLCADQDCAGLNLDLSRWRWAGNGAEPVRNETLMHFYQAVKEYGFVYQSQIPCYGMAEATLVISSSTSEDPPFSLTLCNSSLEKGKLVLQPDGVVMQACGQVAPSHRVVIVNPDTKALCQPDEIGEIWVQGPSIAVGYWNNQEQTEQNFKAYTTTGEGPFLRTGDLGCLYEHHLLITGRLKDLIIIRGRNIYPQNIEYAATMQSTVFRLGKAIAFELEQQVVVAIELRKNVGQENNFRELRRNVIQALHATFDINIAELVFIQANKLPTTSSGKVQRRLCRALYLQDKLLLANVLPATEIQGA

SEQ ID NO: 9085 - protein, 93 aa, Xenorhabdus bovienii
  Coding DNA sequence: Name=SeqID_2977
MYCLPPKFKEHNMTELELKGWLLEYLTPYFQRHEISISEHVSFDSLGLDSVSRVKLISQLEKVLQQKLDPILGYEYPTIHALSGHILQLEQRP

SEQ ID NO: 9086 - protein, 197 aa, Xenorhabdus bovienii
  Coding DNA sequence: Name=SeqID_2978
  Homolog annotation: Query=1..197bp; Hit=41..237bp; Blast score=303; Percent Identity=76.0; E value=1e-81; Homolog= ref|NP_928250.1|
VLGKRRQEKSGQLPKISVAFDHRGIFRLQFLSENLTNSQKRNPRLSQLHTSIVNVFQSIAEKHQIPLSEIRVIHEDSARQHIVHTLSLREIPETVKQRMVSKTLADSKPQTSDALYEEPTQKLTCAAITKEYFERAADDSQDTDTILEVFFEDCEWSRSLAYVRGIQLSHMLGVSTSIRLNLVNEAGGVSQGDIVSA

SEQ ID NO: 9087 - protein, 392 aa, Xenorhabdus bovienii
  Coding DNA sequence: Name=SeqID_2979
  Gene classification: Gene name=NifS (BS); Function=Cysteine sulfinate desulfinase/cysteine desulfurase and related enzymes; Function class =E Amino acid transport and metabolism
  Homolog annotation: Query=1..387bp; Hit=2..393bp; Blast score=360; Percent Identity=48.0; E value=2e-99; Homolog= yfhO COG1104
MYNLSRPIYLDNNATTALDPDVLQSMMPYFINDYGNASSYGHAFGWKAMEAVDDARKVISTSINAKSHSDIIFTSGSTESINLAIAGFQHRSKKGHIITSMIEHKAVLDCCARLEAMGTEVTYLPPQSDGIVSPGSISLALRDDTYLVSIMTANNEIGSIQKIEEIGAICKEHDIPFHTDATQALGKIEFDVQRMNISLASFSAHKIYGPKGIGALYINSRNKHVALSPLIVGGGHERGLRSGTLNVPGIVGFGHAVELSLKNLTTESTRLRYLRNLLRQYIIENVPDVRINGHLTECLPGLLNVSFDGIDADSLLLELSEVALSSGSACTSANRAPSHVLKAIGVSDELSQACLRFGLGRFNNEDEMRYVCFRLKEAVNKLRAMVPRSFAH

SEQ ID NO: 9088 - protein, 233 aa, Xenorhabdus bovienii
  Coding DNA sequence: Name=SeqID_2980
  Homolog annotation: Query=1..233bp; Hit=1..233bp; Blast score=332; Percent Identity=86.0; E value=3e-90; Homolog= ref|NP_928252.1|
MRTMPALFLLFGTLFTAGGYGATFLISEYFRSQGGSDIDTGTTLSVALIGTLIGVPLVGWFSGQLEASRLAAFAALSMSCGYFLFGGFGGELSYIQNIAALLIGLGWGMFYISGPMALSERVTDTDRGQWFTRFSAFQMAGICGSPILLTVAVEQGGFSIQTTFLLVGVVGILASLLLAIFGVREPLEQRKSLLRPWVKKITKISAASTIRPIVMVGLGGCVFSGMMSFQGSL

SEQ ID NO: 9089 - protein, 45 aa, Xenorhabdus bovienii
  Coding DNA sequence: Name=SeqID_2981
MIKHDINVMTSGIQGTVDKYRAKKRRDTTTVAACTAKNVLAFALE

SEQ ID NO: 9090 - protein, 118 aa, Xenorhabdus bovienii
  Coding DNA sequence: Name=SeqID_2982
  Homolog annotation: Query=1..112bp; Hit=276..387bp; Blast score=151; Percent Identity=76.0; E value=2e-36; Homolog= ref|NP_928252.1|
MSCLIIGLLSLLGIPIHPVFQIVAAMLTGIGYGLVYPVIQTWAVNDSPLEDRHAALTWFVVSYFAGIFGFPLIGGWILVDAGKNLFILILAAIAFIELVVALLGKSHLCYIKGWPKRG

SEQ ID NO: 9091 - protein, 79 aa, Xenorhabdus bovienii
  Coding DNA sequence: Name=SeqID_2983
  Homolog annotation: Query=1..76bp; Hit=1..76bp; Blast score=97; Percent Identity=67.0; E value=7e-20; Homolog= ref|NP_927571.1|
MINLLKIRDAVALNGCTDARSLSHQFSAPLPMVEAMLKQLVMMGKLEEVDASSCLSGGCKQCPETQKYDTKVYQLAVKN

SEQ ID NO: 9092 - protein, 86 aa, Xenorhabdus bovienii
  Coding DNA sequence: Name=SeqID_2984
VTQILTVACEDPQASGHPLSHWTLPSKHASWLNQIECWFSLISRHLLRRLFVSSKEILRALILKYIEYYNRVLAKLFKWLYRGNKQ

SEQ ID NO: 9093 - protein, 48 aa, Xenorhabdus bovienii
  Coding DNA sequence: Name=SeqID_2985
VTQRVSTRLRIFTRHCQYLSHLLSAEFLLPLRCKSLNSASRAFIRLFE

SEQ ID NO: 9094 - protein, 91 aa, Xenorhabdus bovienii
  Coding DNA sequence: Name=SeqID_2986
MAFSLSRLSSQRFLQYPAYLLPNSTFFAARLLDTPNAKSKISYARWRLSQRLIRELTMCSTASFWWTLRFTAGAFYIKNRYIGWPLKQSAN

SEQ ID NO: 9095 - protein, 251 aa, Xenorhabdus bovienii
  Coding DNA sequence: Name=SeqID_2987
  Gene classification: Gene name=Udp; Function=Uridine phosphorylase; Function class=F Nucleotide transport and metabolism
  Homolog annotation: Query=2..251bp; Hit=4..253bp; Blast score=437; Percent Identity=87.0; E value=1e-123; Homolog= udp COG2820
MSDVFHLGITKSDLQGATLAIVPGDPNRVEKIAKLMDNPVHLASHREFTTWRAEIDGKPVVVCSTGIGGPSTSIAVEELAQLGVSTFLRIGTTGAIQPHINVGDVLVTTAAVRLDGASLHFAPMEFPAVADFECTNALYEAAKASGSATHVGITASSDTFYPGQERYDTYSGRVVRRFQGSMQEWQQMGVMNYEMESATLLTMCASQGLRAGMVAGVIVNRTQQEIPDVELLKKTESNALGIVVDAARRLL

SEQ ID NO: 9096 - protein, 44 aa, Xenorhabdus bovienii
  Coding DNA sequence: Name=SeqID_2988
LFESYTQSVVLGYECDYYHKIMYVFLYFFQLKMIFITKKCQIRH

SEQ ID NO: 9097 - protein, 130 aa, Xenorhabdus bovienii
  Coding DNA sequence: Name=SeqID_2989
  Gene classification: Function=Uncharacterized BCR; Function class=S Function unknown
  Homolog annotation: Query=1..127bp; Hit=4..133bp; Blast score=95; Percent Identity=40.0; E value=1e-20; Homolog= ZyidB COG3753
MGFFDQITNMLSGGKNQQLQHMMDWVEGQGGISGLIEKFSQQGLGGTIHSWIGSGENSPIHADQISSVFGSSTIQQLAEKMGIDPNEASSLISQHLPSLIDKVTPNGEVPENLDLKSAGMNLLKDKLLEK

SEQ ID NO: 9098 - protein, 764 aa, Xenorhabdus bovienii
  Coding DNA sequence: Name=SeqID_2990
  Gene classification: Gene name=MetE; Function=Methionine synthase II (cobalamin-independent); Function class=E Amino acid transport and metabolism
  Homolog annotation: Query=1..754bp; Hit=1..751bp; Blast score=1241; Percent Identity=79.0; E value=0; Homolog= metE COG0620
MTVLNHTLGFPRIGLKRELKKAQENYWAGKISQQELLETGRELRARHWQQQKEAGVDLVPVGDFAWYDQVLTTNLLLGNVPPRHQNEDGSIDLDTLFRIGRGRAPTGAPAAASEMTKWFNTNYHYIVPEFQQGQEFKLGWTQLLDEVGEALALGHKVKPVLLGPVTYLWLGKVKGKAFDRLSLLTDILPVYQQVLAELAKRGIEWVQIDEPALVLELPKEWLEAFSTAYQALQGQAKLLLTTYFDSISHNLATIKSLPVQGLHVDLVAGKDSLDELDQSLPETWLLSLGVINGRNVWRADLSAKYQLVAPLAGKRDIWIGTSCSLLHSPIDLNDETGLDEEVKSWFAFALQKCAELSLLAQALNAPEGSKQAELDAYSAPIRARRSSTRVNNPTVTERITAIKPQDSERNLVYPERAKLQRERYNLPLWPTTTIGSFPQTTEIRSLRLDFKKGRVDNTHYRTNISEHIKQAINEQENLGLDVLVHGEAERNDMVEYFGEHFDGYVFTQNGWVQSYGSRCVKPPVIIGDISRPEAITVNWATYAQSLTDKPVKGMLTGPVTILCWSFPREDISRETIAKQIALALRDEVDDLQKAGIGIIQIDEPALREGLPLRREEWQAYLEWAVDAFKLSAAIAEDDTQIHTHMCYCEFNDIMPSIAALDADVITIETSRSDMELLDSFEDFSYPNEIGPGVYDIHSPNVPSVEWIEALLRKAADRIPVERLWVNPDCGLKTRGWTETRQALANMVEAAKRLRASVNNTSVNN

SEQ ID NO: 9099 - protein, 318 aa, Xenorhabdus bovienii
  Coding DNA sequence: Name=SeqID_2991
  Gene classification: Gene name=LysR; Function=Transcriptional regulator; Function class=K Transcription
  Homolog annotation: Query=1..307bp; Hit=1..307bp; Blast score=454; Percent Identity=74.0; E value=1e-128; Homolog= metR COG0583
MIEIKHLKTLQALNHCGSLAAAANHLHQTQSALSHQFSELEHRLGFKLFIRKSQPLRLTPQGEVLLKLAEKVLPLVTASLRECSEPEEINLRIAIECHSCIQWLTPALKRFSESWPQVSVDFKSGVTFDPQPALQQRELDIVLTSDIIADSKLNYTSLFDYEVKLVLAPDHPLANKRDIYPQDLAPETLLIYPVQRQRFDIWRRFLQPAAVTPTLKSVDNTLLLIQMVAARLGIAALPHWAVETFERQGLVVTKTLGEGLWSRLYAACREGEQHQPAINTFIRSARQHAVDNLPLVKRVSVSNGDAPKEMQQSGCFLW

SEQ ID NO: 9100 - protein, 299 aa, Xenorhabdus bovienii
  Coding DNA sequence: Name=SeqID_2992
  Gene classification: Gene name=RhaT; Function=7 Permeases of the drug/metabolite transporter (DMT) superfamily; Function class=G Carbohydrate transport and metabolism
  Homolog annotation: Query=1..299bp; Hit=1..299bp; Blast score=341; Percent Identity=65.0; E value=5e-94; Homolog= yigM COG0697
MWLLTITTFLWAASFSLIGAFLAGQVDSWFSVLVRVVLAALVFLPFLRWRGLSLKVISLYMAVGACQLGVMYLFVFHAYHYLTVAEFLLFTVMTPLYVTLIYDVMGRQRLRWGYALSSLLAVAGAAIIRYDQLSESFWIGLILVQLANIFFAIGQIGYKRLMEVHPIPQRIAFSWFYLGACVVAIIGWLLFGDPHKLPTTQLQWGVLIWLGAGASGIGYFMWNYGATQVDTGTLAIMNNMLVPAGLLVNFVIWQQHPDWLGFTIGSSLIVASLWVHHRWILKPALQAANCPPRAGAQNE

SEQ ID NO: 9101 - protein, 549 aa, Xenorhabdus bovienii
  Coding DNA sequence: Name=SeqID_2993
  Gene classification: Gene name=NhaP; Function=NhaP-type Na+/H+ and K+/H+ antiporters; Function class=P Inorganic ion transport and metabolism
  Homolog annotation: Query=1..549bp; Hit=1..549bp; Blast score=704; Percent Identity=70.0; E value=0; Homolog= yjcE COG0025
MEIFFTILILILVVSVSGVLTKMIPFRIPLPIVQIAMGALLAWPHFGLHVTFDPELFLVLLIPPLLFVDGWKTPTREFFQHGREIVILVLFLVLVTVVGIGYLIYWLLPGIPLIAAFALAAVLSPTDAVALSSIVGKGRIPKNMMSVLEGEALMNDASGLVALKFAVAIAMGTMVFTVTGATIEFFKVAIGGLLSGIAITWLYSKSLRLMSRWSGDDPATQIMFMMLLPFASYMIAEHIGVSGILAAVAAGMTISKSGVIRNAPLAMRLRADNVWGMLAFVFNGLVFVMLGLQLPGIWETSVEQAELDPQVETWVLFAAVGIIYVALVLLRFCWLWLMKNASKVLMKKKPLEFASYTTRELCLASLAGVRGAITLAGALSVPLFLPDGDPFPARYQLIFIAAGVIMFSLFVGVVVLPLLLRGMKVGDKQADINEIRMAKAAMAEVAIVSMNKMEERLSASTEEKLDAEVVSEIASRVTGYLRRRTVGKDEIEHNLLVEELERRFRLTALRAERGELYHLRATRKISNETLQTLLHDLDLLEALLVVKDQ

SEQ ID NO: 9102 - protein, 448 aa, Xenorhabdus bovienii
  Coding DNA sequence: Name=SeqID_2994
  Gene classification: Function=Permeases; Function class=R General function prediction only
  Homolog annotation: Query=9..448bp; Hit=15..455bp; Blast score=560; Percent Identity=82.0; E value=1e-160; Homolog= Z4223 COG2252
MSGMQAPTQCKLDKYFKITERGTTVRQEILAGLTTFLAMVYSVIVVPGMLGQAGFPHTAVFISVCLVTGIGSLLMGLWVNLPMAIGCAISLTAFTAFSLVLGQQVSIPVALGAVFLMGCLFTVISVTGIRSWILRNMPMGIAHGTGIGIGLFLLLIAANGVGMVIKNPHAGLPVAFGSLTAFPVIMALLGLAAIIGLERKKVPGGILLVIIVISIIGLIFDPAVKYQGFFKLPTLGEDGLSLMFSMDIMGALQPMVLPSVLALVMTAIFDATGTIRAVAGQANLLDKGGQIINGGKALTADSVSSIFAGAIGSSPAAVYIESAAGTAAGGKTGLTATVVGILFLLILFLSPLSYLVPAYATAPALMYVGLLMLSNVRKLNFDDSVEAMSGLLCAVFIVLTCNIVTGIMLGFSALVVGRVFSGEWRKLNIGTVIIAIVLVIFYAGNWAI

SEQ ID NO: 9103 - protein, 39 aa, Xenorhabdus bovienii
  Coding DNA sequence: Name=SeqID_2995
LLWVISVCTENTPMLACCLHLRPVYLRMYGEHTKSIYLF

SEQ ID NO: 9104 - protein, 564 aa, Xenorhabdus bovienii
  Coding DNA sequence: Name=SeqID_2996
  Homolog annotation: Query=19..555bp; Hit=122..677bp; Blast score=300; Percent Identity=34.0; E value=4e-80; Homolog= ref|ZP_00029673.1|
MNNIHRFSNTDIKALFLFVAFMLLYLLPGIYSHTPWKQDENYSFGMIQTMYETGNWLVPINAGEPFMEKPPLYYWTATTFTHLLSQWLPIYDAARTATLFFSIINFSFFILLARRAFDVHNFTNSRIWIAFALYACAPGIVRHSHDMFTDTALITGTTIGLYGLLGLIKNEKKRYSILWLAIGTAITMLSKGVFIPGLLWICLLLTPVFLKNCRAKQYWLNVFFAGIIALILILPWPVMLLIEHPDLFKVWFLDNNIGRFLGFSVEDLGARADPSRIPEAVLLFSFPAGLLAFIFIIKNPIKTLTNQRYFIFSAFILLGIILLQISASSRALYLLPFIAPMAILATGIFTQLPEKIYSALSLCFSMLWSILILFVWATYFLSLSSDYKHWLAPLGKWLPMSYQMHFSGFIFTSAVIITIIWLAKSRILSKSPALRTAQNWTLGIAVVWGLVFTLFIGWIDYTKGYKEVFTDLKQHLAGEYKADDCMSSYFIGESEAPMLYYFAHILHQRQKDFAAPQTCRWLIMLSEDIEPAPTGMTLFWSGHRPNDKNKNLVVYKKVMPEMAK

SEQ ID NO: 9105 - protein, 45 aa, Xenorhabdus bovienii
  Coding DNA sequence: Name=SeqID_2997
MNASLSMPKRKTRSVFYRRIPEQVNFPLGTPKKNKFCALAQNLLL

SEQ ID NO: 9106 - protein, 418 aa, Xenorhabdus bovienii
  Coding DNA sequence: Name=SeqID_2998
  Homolog annotation: Query=1..418bp; Hit=1..420bp; Blast score=600; Percent Identity=65.0; E value=1e-170; Homolog= ref|NP_415342.1|
MNTSFTSTVFPDDYRQKIRQMKQAMREQIGDVEGLFAQVCDKIEKEIAAARVDEKNIGSAWPEIHWSDVAERKVTEQTLQKIKRRGCLVVRQNFPRDKALAWDQSMLDYLDINNFDRVYQGPGDNFFDSLEASRPEIYPIYWSHSQMEARQSEEIARVQSFLNRLWKFESNGVSWFDPNINMIYPDRIRRRPPGTTSKGLGAHTDSGTLERWLQPTYQKVFNKIFTNRFEEYDPWDAAYRPEVTEYDNTTKCSVFRTFQGWTALSYMTLGQGLLHVVPVPEAMAYILLRPLLNDVPEDGLCGVAPNKALPISEKWHPHLVQGLCSIPSLQAGDSVWWHCDLIHSVAPVENQQGWGNVMYIPAVPLCDRNLAYAHHVADALEHGTSPAYFPKEHYEKNWKGRFTAADLNIIGLRGLGLN

SEQ ID NO: 9107 - protein, 47 aa, Xenorhabdus bovienii
  Coding DNA sequence: Name=SeqID_2999
LRNFLKTLTRFPCTCGAVILALRIWCIQNSLWGQYCKGSSDAIPANR

SEQ ID NO: 9108 - protein, 325 aa, Xenorhabdus bovienii
  Coding DNA sequence: Name=SeqID_3000
  Gene classification: Gene name=ThiJ; Function=Putative intracellular protease/amidase; Function class=R General function prediction only
  Homolog annotation: Query=73..197bp; Hit=48..172bp; Blast score=100; Percent Identity=36.0; E value=1e-21; Homolog= PA4436_1 COG0693
MKIAFVLYDKALQSGITLASDMLNSASSLRSWVQQREEPFYMSVIGDAKENNEHIAQITLHTHHKFSDPVDFDLVFLPPMWGNPSPSMAGREDILEWLRRQKENQAIIVATGTGVYWLAKAGLLEEKTVTTHWSFYGKFERQFPTVGLNRKASITYCDNIYCVRSINSQTELLVYLIAQFFSAPIAKIIEKHFMHEVSNFQSEPFFQVGGNTQFDEMVSIAQSYIKQHVTSQITIKDIATHVGVSESTLIRRFKGQVGISPHKYMLDQRLLIAKQLLQDNSLTLLYIAQLVGFKDPHYFSKVFEQHFKLTPVAYRKLVKAKVFHA

SEQ ID NO: 9109 - protein, 40 aa, Xenorhabdus bovienii
  Coding DNA sequence: Name=SeqID_3001
MLTLSRFVTLYHIRQMLFSFLFSRIVRTSFLYHHQYLASR

SEQ ID NO: 9110 - protein, 117 aa, Xenorhabdus bovienii
  Coding DNA sequence: Name=SeqID_3002
  Gene classification: Function=Predicted transposase; Function class=L DNA replication, recombination and repair
  Homolog annotation: Query=1..115bp; Hit=133..248bp; Blast score=81; Percent Identity=39.0; E value=2e-16; Homolog= mll8100 COG3293
MPVRIIITSGTTADCSQAETLIKGLDAEHLLADRGYDSNAIVEKAEQQGMQVQIPSRKNRKAAREYDRELYRLRHLVENAFLHLKRWRGIATRYAKNSASFLAAVQIRCLVLWLKVS

SEQ ID NO: 9111 - protein, 158 aa, Xenorhabdus bovienii
  Coding DNA sequence: Name=SeqID_3003
  Gene classification: Function=Predicted transposase; Function class=L DNA replication, recombination and repair
  Homolog annotation: Query=11..115bp; Hit=6..110bp; Blast score=103; Percent Identity=45.0; E value=5e-23; Homolog= CC0928 COG3293
MSTPAHRRHDISDRVWSLLEPHLPGRQGAWGRVAEDNRRFINGVFWILRTGAPWRDLHTDYGDWKNTHRRFCRWRDKGIWEKLLEQLVNDPDFEWLMIDASHIKVHPDAAGAKGGNQDMGLTKGGSIPRYIWPWMRMVCRSELLLQAVPQQIVHKLRP

SEQ ID NO: 9112 - protein, 37 aa, Xenorhabdus bovienii
  Coding DNA sequence: Name=SeqID_3004
VYSWLINSYDGMVGHYYCTNFFMTTPSRLQEKSFRSS

SEQ ID NO: 9113 - protein, 558 aa, Xenorhabdus bovienii
  Coding DNA sequence: Name=SeqID_3005
  Gene classification: Gene name=FabB; Function=3-oxoacyl-(acyl-carrier- protein) synthase; Function class=I Lipid metabolism
  Homolog annotation: Query=79..558bp; Hit=155..633bp; Blast score=445; Percent Identity=45.0; E value=1e-125; Homolog= PA5174 COG0304
MSNLPVIVGLGGINAAGRSSGFHSYKRIVSDSLSDEIMQDTWLDLCHRMGIVKNTASVTGAHIESAKNGTLIRKITHFDTQKVSSVTSAGQLPEGFEVGDLYNANHHPRGLRLTVYGASDLLSSIGISWPDIAKLVEPDQISVYASSALGQIDRFSLAGLIGNPQNGTRISSKMLALSLADMPANFINSYIINSIGNTSANLGACASFLYNLKQGVNDIKQGKAKISLVGCSEAAIVPEIIEGFRVMGALAEDHQLCKLDGTDIVNNRRATRPFSTNVGFTIAESAQFVLLMSDDLALQCGANILGAVPDVFVNADANKKSISSPGIGNYITMMKAASLADHLLDGKLQYSYVQAHGTGTPQNRVTESHIINEVAKVFGLNCWDVTAIKSYVGHSIAASAGDQLACTLGVWQYGWIPGIKTIDHIAEDVHATNLNILMQNKFAGEHGEEMRATIINTKGFGGNNASAVILSPQQTMQMLNKKHGSSAVYTYHQRNQIVKRISEDQDRAICRGEESVVYNFGNAVMQSSDIKLSRQEVKLSGFKHSIKLPNAEEFSAFL

SEQ ID NO: 9114 - protein, 31 aa, Xenorhabdus bovienii
  Coding DNA sequence: Name=SeqID_3006
MQRNSAHSCEKAIGNSQVQCSIQALFYGFTA

SEQ ID NO: 9115 - protein, 101 aa, Xenorhabdus bovienii
  Coding DNA sequence: Name=SeqID_3007
LIFLTRVRTRFFSSGEWGINKHLLDSGGEYSWMLGGCIWLVVIDGVRSHYWNYFHHRIGNSFALFIRQSFCLLIKQLIWDFMDKHEKWHLMDYLMLKQWIG

SEQ ID NO: 9116 - protein, 91 aa, Xenorhabdus bovienii
  Coding DNA sequence: Name=SeqID_3008
  Gene classification: Function=Uncharacterized BCR; Function class=S Function unknown
  Homolog annotation: Query=1..91bp; Hit=8..98bp; Blast score=94; Percent Identity=54.0; E value=1e-20; Homolog= yaiN COG1937
MPHSPEEKKRVLTRVRKIKGQIEALESALQQQADCGPVLQQIAAIRGAVNGLMAGVLESHLREELTNTEQTPEAQKASIEDAVSLIRTYLR

SEQ ID NO: 9117 - protein, 369 aa, Xenorhabdus bovienii
  Coding DNA sequence: Name=SeqID_3009
  Gene classification: Gene name=AdhC; Function=Zn-dependent alcohol dehydrogenases, class III; Function class=C Energy production and conversion
  Homolog annotation: Query=1..369bp; Hit=1..369bp; Blast score=654; Percent Identity=86.0; E value=0; Homolog= sll0990 COG1062
MKSRAAVAFGPGQPLEIVEIDVAPPQAGEVLVKISHTGVCHTDAFTLSGDDPEGVFPAILGHEGAGVVVEVGEGVTSVKPGDHVIPLYTAECGECLFCKSGKTNLCVAVRATQGKGVMPDGTTRFSYNGQPIYHYMGCSTFSEYTVVAEVSLAKINPEANHEEVCLLGCGVTTGIGAVHNTAKVQSGDSVAVFGLGGIGLAVIQGARQAKAGRIFAIDTNSAKFELAKQFGATDCLNPNDYDKPIQQVIIEMTEWGVDHTFECIGNINVMRAALESAHRGWGQSVIIGVAGAGQEISTRPFQLVTGRSWRGTAFGGVKGRSQLPKMVEEAMKGEIELKPFVTHTLPLERINEAFDLMHEGKSIRTVIHY

SEQ ID NO: 9118 - protein, 288 aa, Xenorhabdus bovienii
  Coding DNA sequence: Name=SeqID_3010
  Gene classification: Function=Predicted esterase; Function class=R General function prediction only
  Homolog annotation: Query=8..281bp; Hit=1..274bp; Blast score=373; Percent Identity=63.0; E value=1e-103; Homolog= sll0992 COG0627
MFYREEKMERIERRACFGGWQDVYQHDSAVLGCTMNFAVYLPPQAEHQKLPVLYWLSGLTCNEQNFITKAGAQRYAAEQGIIFVAPDTSPRGENVADNDAYDLGQGAGFYLNATQEPWVPHYRMYEYVVSELPALIETHFPVTENRAISGHSMGGHGALTIALRNPDRYHSVSAFSPIVAPSQVPWGEKAFRAYLGDDRDTWKAYDTIELIANSAKPLHLLIDIGIDDPFLAEQLRPELLKEVCEKAGQPYTLNLRTGYDHSYYFVASFIGEHIAYHAEVLKGCCADN

SEQ ID NO: 9119 - protein, 326 aa, Xenorhabdus bovienii
  Coding DNA sequence: Name=SeqID_3011
  Gene classification: Gene name=FabH; Function=3-oxoacyl-[acyl-carrier- protein] synthase III; Function class=I Lipid metabolism
  Homolog annotation: Query=50..316bp; Hit=87..355bp; Blast score=92; Percent Identity=30.0; E value=4e-19; Homolog= VCA0751 COG0332
MTRVAIASLGIWHPPTSVDNNWFIEHYAAQGIDMSGLLNALGHKNRYLIRDSSDTTLTMSVAASNDAIQRLGCQAKDLDFIVFASQTPEYLIPSTALKIHHAIGGGERALAFDMNANCAGLLVAVEMVSRAMMANPSCQLALVVGSDYLGAHSSNAPVYHSCFSESAVAVILHKTEQGNGFIDSEFRIQTSVIDNSLFPACGLSNIHRHDVSAQVKFTPFDDDICITAASESIQLLLSRHNLVPADIKGFMFSQFSVSNIRRLCEELGVDQDKALFIGDEYGYTATNSPFVALYETLERKKIVRGDFLIFWTIGAGWQSIAVLMQY

SEQ ID NO: 9120 - protein, 38 aa, Xenorhabdus bovienii
  Coding DNA sequence: Name=SeqID_3012
MKLFSINQAFPMTTIINRSNDDKSGDCIVRNLASSNFG

SEQ ID NO: 9121 - protein, 343 aa, Xenorhabdus bovienii
  Coding DNA sequence: Name=SeqID_3013
  Gene classification: Gene name=FabH; Function=3-oxoacyl-[acyl-carrier- protein] synthase III; Function class=I Lipid metabolism
  Homolog annotation: Query=56..314bp; Hit=95..365bp; Blast score=59; Percent Identity=22.0; E value=4e-09; Homolog= VCA0751 COG0332
MRNNVSIISAAGILPPEKIIIHPEDNIRNEFSAPGEQQLSRSRTLWRLEHKKDLIELMKVSLLAAVKQVQMDISDIDYLILSQVWSDNILGDEAGRLARELKLSCPVVSINVGTSGGATGLEIATAMFANSEFHNIAVIAGCNYSHWFSMSDPARTLLSDGAACLVLSRKQGMTVAGCHTLSTAHYDVLQFNEVPERYVYYKPKGGEYIFNNMKETIYQCCNKVCQSNGISLNEVSAFYVYDPSDWVASAAAEALGVGKDKIISIFHKYGSLGPAQSFFGFMEMQDNKNLTDSDWVIVMGMGPSTTATAVLFRWQHISCNVYCYDHKTQLSNPMLPSSVTQNI

SEQ ID NO: 9122 - protein, 565 aa, Xenorhabdus bovienii
  Coding DNA sequence: Name=SeqID_3014
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=6..541bp; Hit=4..530bp; Blast score=139; Percent Identity=26.0; E value=1e-32; Homolog= AF1720 COG0028
MSVNIAKTLVKLLEDCEVKAAFGVSGGFIAPIWQALTESEKIKIFHCRHESGGAFSASEFSLCQQVPAVAFATAGPGISNALTGLRAAKLDGAKVIFISSITSVTPSGKWNLQETTVQDIDGLCLPDGHGYFDEIIIINQKDDYFDVEKKLRKGLNKKDGYVVGIFLTAKVQQEIINYENDEVLSLSHDDLDENAKRHSQEIADLLVNENAVFWAGFGARHASALLTQIAVKTNSRVISTPRGKGIFNEKHSLYAGTSGLGSDTESIYKTLHCPLLSAVIIMGSRLGELSSSYAQNNLEKVKVYYIGLNAQEIKGNLPPHTVLIDSDIETFLTSIDACMAEKVIPPSHIKAISAPHDSHKCYSDAAKDVIHPLDVMSVVQEIAIDMFDCYVASEAGNSFVWTNRYLKFSNPLRYRISTAYGAMGHYACGLVGLAASKERCAIGIIGDGSILMSNEVSTAVRFGLPAIWLVMNDAGYNMCRQGQELLGYPPLDCSIPQVDFALFGQSIGATGYNVRNKKELREALIHAIEEKKPAVINAFIDKYEIPPLGDRVETFRKLKEELDAK

SEQ ID NO: 9123 - protein, 53 aa, Xenorhabdus bovienii
  Coding DNA sequence: Name=SeqID_3015
MSLITERSITRVLTEDNNLLWEVSVTIHMTPSLRRRGYSVKNKKTQHICWVMN

SEQ ID NO: 9124 - protein, 174 aa, Xenorhabdus bovienii
  Coding DNA sequence: Name=SeqID_3016
  Gene classification: Gene name=Ssb; Function=Single-stranded DNA -binding protein; Function class=L DNA replication, recombination and repair
  Homolog annotation: Query=1..174bp; Hit=1..178bp; Blast score=225; Percent Identity=78.0; E value=2e-59; Homolog= ssb COG0629
MASRGVNKVILVGNLGQDPEVRYMPNGGAVANITLATSESWRDKQTGEMREKTEWHRVVIFGKLAEVAGEYLRKGSQVYIEGSLQTRKWQDQGGQERYTTEVVVNIGGSMQMLGGRGGASQDAPAQGGNWGQPQQPQASQQFSGGGQPSPSRPAQSPAPQSNEPPMDFDDDIPF

SEQ ID NO: 9125 - protein, 943 aa, Xenorhabdus bovienii
  Coding DNA sequence: Name=SeqID_3017
  Gene classification: Gene name=UvrA; Function=Excinuclease ATPase subunit; Function class=L DNA replication, recombination and repair
  Homolog annotation: Query=1..940bp; Hit=1..940bp; Blast score=1699; Percent Identity=87.0; E value=0; Homolog= uvrA COG0178
MDNIEVRGARTHNLKNINLIIPRDKLIVITGLSGSGKSSLAFDTLYAEGQRRYVESLSAYARQFLSLMEKPDVDHIEGLSPAISIEQKSTSHNPRSTVGTITEIHDYLRLLFARVGEPRCPDHDIPLAAQTISQMVDNVLVLPEGQRLMLLAPVVKERKGEHTKLLDNLAAQGYIRARIDGEVCDLSDPPKLELQKKHTIEVVVDRFKVRADLAQRLAESFETALELSGGTAVIANMDDEQAEELIFSANFACSICGYSMSELEPRLFSFNNPAGACPTCDGLGVQQFFDPERVIQNGDISLAGGAIRGWDRRNFYYFQMLKSLSDHYKFDIEVPFNDLDPAIRKTVLYGSDKESIEFKYTNDRGDTTVRHHPFEGVLHNMERRYKETESTAVREELAKYISNRSCISCDGTRLRKEARYVFIESTTLPQISEFSIGHAMAFFQNIKLSGQRAQIAEKILKEIRDRLKFLVNVGLNYLTLSRSAETLSGGEAQRIRLASQIGAGLVGVMYVLDEPSIGLHQRDNERLLETLLHLRNLGNTVIVVEHDEDAIRAADHVIDIGPGAGVHGGRIVAEGTIEDIMTNKESLTGKFLSGKCKIAIPEQRVPANPDKILELIGAKGNNLKKVTLKLPVGLFTCVTGVSGSGKSTLINDTLFPIAQRQLNGATNINPAPYLDVQGLEHFDKVIDIDQSPIGRTPRSNPATYTGVFTPVRELFSGVPESRARGYTPGRFSFNVKGGRCEACQGDGVIKVEMHFLPDVYVPCDHCKSKRYNRETLEIKYKGKNINEVLNMTIEEAREFFDAVPALARKLQTLMDVGLSYIRLGQSATTLSGGEAQRVKLSRELSKRGTGQTLYILDEPTTGLHFADIQQLLSVLHQLRDQGNTIVVIEHNLDVIKTADWIVDLGPEGGNGGGEILVSGTPEEVAQCEESHTARFLKPILERQ

SEQ ID NO: 9126 - protein, 35 aa, Xenorhabdus bovienii
  Coding DNA sequence: Name=SeqID_3018
MIVGNALYCMGKNKIGQQMGITPHRVGRIFVYVRC

SEQ ID NO: 9127 - protein, 44 aa, Xenorhabdus bovienii
  Coding DNA sequence: Name=SeqID_3019
MEIQHVYVFTFLNCVSYHCHGYYRQEKTDLHSLVCIINHHGILV

SEQ ID NO: 9128 - protein, 188 aa, Xenorhabdus bovienii
  Coding DNA sequence: Name=SeqID_3020
  Homolog annotation: Query=1..188bp; Hit=1..189bp; Blast score=211; Percent Identity=59.0; E value=6e-54; Homolog= ref|NP_927602.1|
MNNTMSASRSLNPAMVLNILGLFGISVVLIIAFYYQLARFELPCPLCLLQRAGIIMIGLGFLFNIYFGIKNAHYSLSLLGCLVTGFIAMRQVSLHILPGDTGYGSTFLGLHFYTWAAVLSILTIIAIAVIMPLKAGNTDSSRYTPPTLGKIAMGLFAFLIAANLVSTVLECGSGQCDDNPTFYQLLKK

SEQ ID NO: 9129 - protein, 393 aa, Xenorhabdus bovienii
  Coding DNA sequence: Name=SeqID_3021
  Gene classification: Gene name=AmpC; Function=Beta-lactamase class C and other penicillin binding proteins; Function class=M Cell envelope biogenesis, outer membrane
  Homolog annotation: Query=27..393bp; Hit=13..377bp; Blast score=426; Percent Identity=56.0; E value=1e-119; Homolog= ampC COG1680
MEDFPMMKKFVINTLVFATIGTSSFYASAQKTLTAQQVAEIVNNTLTPLLEKQDIPGMAVAVIYDGKPQFFNYGVADIKTRRPITENTLFELGSVSKTFTGIAGGYAMQTDTLNLNDPVTAYSSELTGSQWRGVKMLHLATYTAGGLPLQLPDSVTDQKSLWQYYQQWQPLWAPGMMRNYSNASIGLFGALTANKSQLTFETYMTKYVFLPLKLTHTFITVPESMQSDYAWGYKNGQPVRVTPGMLSSEAYGVKSTTQDMVKYMQANMAPDSLPADNDKLKKAILAAQSRYYRAGNMFQGLGWEMHNWPINPQRVIADSGNDIALQPLKVEELIPPRSAVPASWVHKTGGTDGFGAYIAFIPEEKIGIVMLANKNYPNPVRVEAAYHILKALR

SEQ ID NO: 9130 - protein, 57 aa, Xenorhabdus bovienii
  Coding DNA sequence: Name=SeqID_3022
  Homolog annotation: Query=16..57bp; Hit=524..568bp; Blast score=62; Percent Identity=68.0; E value=2e-09; Homolog= gb|AAK66553.1|
VPDKCGLVTGCAYPTVEDPLLSPLSWEHINLTGVYVWRSRARIRAGKFRPLRQLKLA

SEQ ID NO: 9131 - protein, 38 aa, Xenorhabdus bovienii
  Coding DNA sequence: Name=SeqID_3023
VPEARSKFLSKKTKSWRPSGNDYVSLSFAKPVLVDAVA

SEQ ID NO: 9132 - protein, 379 aa, Xenorhabdus bovienii
  Coding DNA sequence: Name=SeqID_3024
  Gene classification: Gene name=PcnB; Function=tRNA nucleotidyltransferase/poly(A) polymerase; Function class=J Translation, ribosomal structure and biogenesis
  Homolog annotation: Query=10..366bp; Hit=15..404bp; Blast score=90; Percent Identity=26.0; E value=2e-18; Homolog= DRB0098 COG0617
MSWVFSKNKSWDNLSATYSFIADMHGVQQDPIHHAEGDLAIHTQMVLAALVQLPEYQKLTPEEQEILWTAALLHDVEKRSTTRVDWDGRIVSPGHARKGEMTARQILFQQIPTPFEIREQIAALVRFHGLPLWLMERPDPQKALLAASLRVDTHLLVLLAKADVLGRTCHDAQELLERIELFELYCREQNCWRNPRSFPSGEARFHYFSTESKQPDYQPYDDYGSQVILLCGLPGMGKDHFIQQYYAGMPVISLDAIRRENQISPEDKDANGWVVQQVKQQAREKLRSQQSFIWNATNLTGQIRQQLIKLFISYNARVRIVYIEQDYKRWRQQNSNRQYIVPDKVMDRMLCKLEVPTPEEAHEVCYFIDSVMLNNVSSA

SEQ ID NO: 9133 - protein, 236 aa, Xenorhabdus bovienii
  Coding DNA sequence: Name=SeqID_3025
  Homolog annotation: Query=6..117bp; Hit=5..116bp; Blast score=188; Percent Identity=78.0; E value=5e-47; Homolog= ref|NP_755122.1|
MDMQSRKYGRTFHYPFSPGTTSDDRINHSWWQDVQKIKHLIHTEKLDGENNCLNQYGVFARSHAAPTQSAWTQQIRQRWQLIKGDLDDIEIFGENLYAIHSIEYRQLEEYFFVFAVRIKEVWLGWEEVKFYAALFDFPTVPEIIIPETRSESVFMKNIIETAKQQSCFSSWDTKTKQSCSMEGVVSRDAEAYSVIDFPHHVFKYVRKNHVKTDIHWKRHWQRAPLYFEYHSGGDTK

SEQ ID NO: 9134 - protein, 52 aa, Xenorhabdus bovienii
  Coding DNA sequence: Name=SeqID_3026
MKELKNWHYIFFIPDFNPLIYGILILCGNKNPLPNTVTRDYSYIFKGIKIIN

SEQ ID NO: 9135 - protein, 397 aa, Xenorhabdus bovienii
  Coding DNA sequence: Name=SeqID_3027
  Gene classification: Gene name=TyrB; Function=Aspartate/aromatic aminotransferase; Function class=E Amino acid transport and metabolism
  Homolog annotation: Query=1..396bp; Hit=1..396bp; Blast score=592; Percent Identity=70.0; E value=1e-169; Homolog= tyrB COG1448
VFQNIDAYAGDPILSLVEAFKKDLRAEKINLSIGLYYDEQGITPQLQAVATAEEQMSALPQSASLYLPMEGLLAYRSAIQELLFGKDHPLLGQKRIATIQTVGGSGALKVGADFLHRYFPDSEVWCCDPTWENHASIFAGAGINVNYYPYFDDKTKGVKFGEMLATFNQLPAKSIILMHPCCHNPTGSDLTSDQWDQVVQVAKERELIPFLDIAYQGFADGVEEDAYAIRAMANAELPCLVCNSFSKIFSLYGERVGGLSVVCNDVEAGECVLGQLKASVRRIYSSPPNFGAQVVARVLSDPELKALWLKEVEQMRLRIKEMRTVLVNALKSALPEKNFDHLLKQRGMFSYTGFSQEQVDRLREEFGVYLVVSGRICMAGVNHQNVQKIAEAFAAVS

SEQ ID NO: 9136 - protein, 359 aa, Xenorhabdus bovienii
  Coding DNA sequence: Name=SeqID_3028
  Gene classification: Gene name=Alr; Function=Alanine racemase; Function class=M Cell envelope biogenesis, outer membrane
  Homolog annotation: Query=1..358bp; Hit=1..359bp; Blast score=514; Percent Identity=69.0; E value=1e-146; Homolog= alr COG0787
MKAATAVIDRRALRHNLQQVRVKAPDSKLVAVVKANAYGHGFLEVAYTMEDADSFGVARIAEALALRSGGIVKPILLLEGFFEAADLPVLVVNHIETVVHSIEQLEALEQANLSHPIKVWMKLDTGMHRLGVRIDEAEDFYQRLSRCHNVEQPVNIVSHFSRADELTVDTTPQQIDRFMAFIADKSGEKSIAASGGILLWPQAHLDWVRPGIMMYGASPIADKTAADFNLIPAMTLKSSLIAVRKHKADESVGYGGTWISERDTTLGVVAMGYGDGYPRSAPSGTPVLINGREVPLVGRVSMDMITVDLGPECHDKVGDEVTLWGSILPVEKIAEHTGISAYELITKLTSRVVMEYLDE

SEQ ID NO: 9137 - protein, 469 aa, Xenorhabdus bovienii
  Coding DNA sequence: Name=SeqID_3029
  Gene classification: Gene name=DnaB; Function=Replicative DNA helicase; Function class=L DNA replication, recombination and repair
  Homolog annotation: Query=1..469bp; Hit=1..471bp; Blast score=772; Percent Identity=84.0; E value=0; Homolog= dnaB COG0305
MAGKKPTNNSMAEPKDRQVEGLKLPPHSLEAEQSVLGGLMLDNERWDNVSERVSSNDFFSRPHRRIFAEMQRLLERGQPIDLITLSESLEQNGQLDSVGGFAYLAELSKNTPSAANINAYADIVRERAVVRDMIAVAHEIADAGYDPQGRTSEDLLDLAESRVFQIAENRANKDEGPKGIEQILEETVERIEQLYQRPHDGVTGVSTGYQDLDKKTAGLQKSDLIIVAARPSMGKTTFAMNLCENAAMMQDKPVLIFSLEMPGNQIMMRMLASLSRVDQTRIRTGQLDDEDWARISSTMGILLEKRNMYIDDSSGLTPTEVRSRARRVFREHGGLSLIMIDYLQLMRVPSLSDNRTLEIAEISRSLKALAKELQVPVVALSQLNRGLEQRADKRPVNSDLRESGSIEQDADLIMFIYRDEVYHDNSELKGVAEIILGKQRNGPIGRIRLTFNGQWSRFDNYVGPSYSDE

SEQ ID NO: 9138 - protein, 36 aa, Xenorhabdus bovienii
  Coding DNA sequence: Name=SeqID_3030
MKSPQTALMYSKSLQTIYNYSRLFSWRILMRYFVLV

SEQ ID NO: 9139 - protein, 327 aa, Xenorhabdus bovienii
  Coding DNA sequence: Name=SeqID_3031
  Gene classification: Gene name=Qor; Function=NADPH; Function class=C Energy production and conversion
  Homolog annotation: Query=1..327bp; Hit=1..327bp; Blast score=469; Percent Identity=72.0; E value=1e-132; Homolog= qor COG0604
MAKHIEFSTSGDPEVIQYCEFTPTDPAPDEVQVQNKAIGINYIDTYMRSGLYPTANLPSGLGTEAAGIVTKIGSSVTSIKVGDRVAYAQATLGAYSEVHNVLESKLAVLPDAISFEQAAASLLKGLTVYYLFYKTYKIQTGETFLFHAAAGGVGLIACQWAKALGAKLIGTVGSDEKAALAKAAGAWQTINYNRENIVESVTEITGGEKVGVVYDSVGKATWLNSLDCLKRQGLMVSFGNASGPVTGVDLGILNQKGSLFVTRPAINGYITTREELNEASKALFDLIASGKINVDVTENQKFPLSEAAKAHRTLESRATHGSSLLIP

SEQ ID NO: 9140 - protein, 345 aa, Xenorhabdus bovienii
  Coding DNA sequence: Name=SeqID_3032
  Gene classification: Function=Predicted TIM-barrel enzymes, possibly dehydrogenases, nifR3 family; Function class=R General function prediction only
  Homolog annotation: Query=1..344bp; Hit=1..344bp; Blast score=558; Percent Identity=75.0; E value=1e-159; Homolog= yjbN COG0042
MQQNKKIENIDTTKNVSKKEVEFPLNRFSVAPMLDWTDRHCRYFHRLLSKKALLYTEMVTTGAIIHGKGNYLAYNEQEHPLALQLGGSEPQALAQCAKIAEERGYDEINLNVGCPSDRVQNGRFGACLMGEAKLVADGVKAMQDVVDIPVTVKTRIGIDEQDSYEFLCDFIDTVVKNSDCDNFIIHARKAWLSGLSPKENREIPPLDYPRVYQLKKDFPQLTLSINGGIKSLEEAKQHLQYVDGVMIGREAYQNPSILAHVDRELFNEAASMVNTIDAIKALYPYIERELSKGTYLGHITRHILGIFQGIPGARQWRRHLSENAHKTGADIMVVEKALEMVTERM

SEQ ID NO: 9141 - protein, 52 aa, Xenorhabdus bovienii
  Coding DNA sequence: Name=SeqID_3033
LLHFCTFKAIFSFSESLVVPSFIRKLIQRIGGNLWSTIAQRSSRAQTGIHTN

SEQ ID NO: 9142 - protein, 45 aa, Xenorhabdus bovienii
  Coding DNA sequence: Name=SeqID_3034
MVYYSTEKLQSADRNPYELKATIVVLSRRFEEGKKDNYQLFAHFI

SEQ ID NO: 9143 - protein, 83 aa, Xenorhabdus bovienii
  Coding DNA sequence: Name=SeqID_3035
VRLNLIKSYLRLIVRIETLFPSETIASNAMNSASILRLSSVFGIGVEKIACNVLLCLAFNVFIQIDFHYLSFPSPSYKSDMIF

SEQ ID NO: 9144 - protein, 34 aa, Xenorhabdus bovienii
  Coding DNA sequence: Name=SeqID_3036
MVTNNLPCVLKMLMLKHKINQYQYCFYVQFFARD

SEQ ID NO: 9145 - protein, 41 aa, Xenorhabdus bovienii
  Coding DNA sequence: Name=SeqID_3037
MDVSKYPEKWQERFKFFEQYSSPASKEFKVGIKTYRKKNEF

SEQ ID NO: 9146 - protein, 38 aa, Xenorhabdus bovienii
  Coding DNA sequence: Name=SeqID_3038
LACLYLWNFLFLSYRIMEKRFELIHFFHFISYRRYINI

SEQ ID NO: 9147 - protein, 61 aa, Xenorhabdus bovienii
  Coding DNA sequence: Name=SeqID_3039
LSLFIFSILLAIGVTSISETLIYGTMPLTYIMWGFTANYAYYLKEIKGDDGWNPFKGIFTK

SEQ ID NO: 9148 - protein, 246 aa, Xenorhabdus bovienii
  Coding DNA sequence: Name=SeqID_3040
  Gene classification: Gene name=Fur; Function=Fe2+/Zn2+ uptake regulation proteins; Function class=P Inorganic ion transport and metabolism
  Homolog annotation: Query=77..245bp; Hit=21..189bp; Blast score=219; Percent Identity=62.0; E value=2e-57; Homolog= zur COG0735
LFSAYFIVLIYQLIFIFILNSHSSVNKVLRNSRIVSHLFTDAFNHQRCSRLPGFHFQTEKHDNITTIGIMLGVKGVMKTINPKKLLTQAKTICLSRGVRLTPQRLEILRLISTQPGAISAYDLLDLLREVEPQAKPPTVYRGLEFLLEQGFVHKIESTNSYVICHHFEEPSHTSAMFICENCSSVTERDAKDIESAIQQLAQGVGFHLRHSVIEVHGLCSPCHEIDSCTERDTCQHNHKTEENKKK

SEQ ID NO: 9149 - protein, 204 aa, Xenorhabdus bovienii
  Coding DNA sequence: Name=SeqID_3041
  Gene classification: Gene name=LexA; Function=SOS-response transcriptional repressors (RecA-mediated autopeptidases); Function class=K Transcription
  Homolog annotation: Query=1..204bp; Hit=1..202bp; Blast score=333; Percent Identity=82.0; E value=8e-92; Homolog= lexA COG1974
MKALTARQQQVYNLVRDHISQTGMPPTRAEIAARLGFRSPNAAEEHLKALARKGVIEIISGASRGLRLLLEEEGAAGLPLIGRVAAGEPLLAQEHIESHYKVDPALFKPNANFLLRVSGMSMKDIGIMDGDLLAVHKTQDVHNGQIIVARIEDEVTVKRFRQIGNRIELIAENPEFEPIVVDLSEQSFTIEGLAVGIIRNGDWI

SEQ ID NO: 9150 - protein, 123 aa, Xenorhabdus bovienii
  Coding DNA sequence: Name=SeqID_3042
  Gene classification: Gene name=DgkA; Function=Diacylglycerol kinase; Function class=M Cell envelope biogenesis, outer membrane
  Homolog annotation: Query=1..121bp; Hit=1..121bp; Blast score=135; Percent Identity=69.0; E value=7e-33; Homolog= dgkA COG0818
MANQSTGLIRIIKAAGYSAKGIRAVWQNEAAFRQEVIVAILAIIIAFSLDFGMSERLLLIGSVMLVVIVEILNSAIEAVVDRIGSEYHELSGRAKDMGSAAVFLTMILALFIWGMILWSYFMH

SEQ ID NO: 9151 - protein, 848 aa, Xenorhabdus bovienii
  Coding DNA sequence: Name=SeqID_3043
  Gene classification: Gene name=PlsB; Function=Glycerol-3-phosphate O -acyltransferase; Function class=I Lipid metabolism
  Homolog annotation: Query=27..832bp; Hit=21..823bp; Blast score=1206; Percent Identity=74.0; E value=0; Homolog= plsB COG2937
LSYFHRSQNLFLVCLRRVANKRLKVVMSSWRKIYYKLLNFPLKFLVKSKLIPTDPIAELSLDTTRPILYVLPYHSKTDLLTLRQQCLAQDLPDPLNPLEMGDTLLPSYVFIDDGPRVFRCYAPKHESVKIFHSYLDLHRNNPDLDIQMVPVSVMFGRSPGREGQEGNTAPQLRLLNGVQKFFAILWLGRDSFVRFSTPVSLLSMANDHGTDDIIANKLARVARIHYSRQRLAAVGPRLPARQDLFNKLLASKAIEKAIADEARSKKISPEKAKQNAINMLEEIAADFSSETVRLTDRVLSWTWNRLYQGINVHNAERVRQLAQDGHELVYVPCHRSHMDYLLLSYVLYHQGLVPPHIAAGINLNFWPAGPIFRRLGAFFIRRTFKGNKLYSTIFREYLGELFSRGYSVEYFVEGGRSRTGRLLDPKTGTLSMTLQAMLRGDSRPITIVPIYVGYEHVMEVATYAKELRGATKEKEGFFQMINGLRKLRNLGQGYVNFGEPIPLIQYLNHHVPDWRDSIDPIDAQRPSWLTPTVSKLAGNIMVNINNAAAANAINLCTTALLSSRQRALTREQLIEQLNCYLQLLCNVPYADDITVPNKTAEALLDHALLMNKFEVEKDSLGDIIILPRESAVLMTYYRNNIQHLLILPSLITSIVMHHRRISRSELLRQVELIYPLLKQELFMRYSKKTLPAVVNTLIDELVRQCLICNKEQDMLVLNPERIRPLQLLAAGIRETLQRYAITLSLLNATPEISRGVLEKESRMLAQRLSVLHGINAPEFFDKAVFASSVNTLREEGYIHDNSDKSTTSAQKLYQVLSELMSPEIRLTIESASMPPEQNDTEQTNKNQH

SEQ ID NO: 9152 - protein, 48 aa, Xenorhabdus bovienii; identical to SEQ ID NO: 6591
  Coding DNA sequence: Name=SeqID_3044

SEQ ID NO: 9153 - protein, 284 aa, Xenorhabdus bovienii
  Coding DNA sequence: Name=SeqID_3045
  Gene classification: Gene name=UbiA; Function=4-hydroxybenzoate polyprenyltransferase and related prenyltransferases; Function class= H Coenzyme metabolism
  Homolog annotation: Query=1..283bp; Hit=5..287bp; Blast score=355; Percent Identity=67.0; E value=4e-98; Homolog= ubiA COG0382
MTQNKWLAYCRLMRINKPIGVLLLLWPTYWALWIAAKGMPDLYILLVFTIGVYTMRAAGCCINDFADRKFDGHVERTKSRPLPSGDVSEKESKILFVTLGLISFALVLMLNKMTIALSFIGLALAWVYPFVKRVSNLPQIVLGAAYGWSIPMAFAAVSESLPLECWLLFLVNIIWSVIYDTQYAMVDRDDDLKVGVKSTAVLFGRFDKLILGILQFIMLGILVSVGCIVNLGGMYYWTLLLAGSLFIYQQKLISGRKKALCFQAFMNNNYVGFILFLGILFSYV

SEQ ID NO: 9154 - protein, 175 aa, Xenorhabdus bovienii
  Coding DNA sequence: Name=SeqID_3046
  Gene classification: Gene name=UbiC; Function=4-Hydroxybenzoate synthetase (chorismate lyase); Function class=H Coenzyme metabolism
  Homolog annotation: Query=26..166bp; Hit=62..202bp; Blast score=154; Percent Identity=54.0; E value=6e-38; Homolog= ZubiC COG3161
MADDTILTPAPIRWFSADNSNIPEDILDWLMEVGSMTRRFEEHCQQVSVVPFRECFITAAELGDESEHLPISERYWLREIVLYGDNIPWLLGRTVIPEETLTGTDKRLVDVGTVPLGRYLFSDKNLTRDYIQIGQQGQHWARRSLLRLSGKSLLLTEVFLPESPVYKMNKIKGGK

SEQ ID NO: 9155 - protein, 46 aa, Xenorhabdus bovienii
  Coding DNA sequence: Name=SeqID_3047
MMIYINCYQLFILFTCNVISSLPIRCAVGENDVPRNGKMTWQMTQY

SEQ ID NO: 9156 - protein, 548 aa, Xenorhabdus bovienii
  Coding DNA sequence: Name=SeqID_3048
  Gene classification: Gene name=Pgi; Function=Glucose-6-phosphate isomerase; Function class=G Carbohydrate transport and metabolism
  Homolog annotation: Query=1..548bp; Hit=1..548bp; Blast score=943; Percent Identity=81.0; E value=0; Homolog= pgi COG0166
MKNINPSQTEAWKALHQHFEQMKNVHLRDLFKQDKARFTAFSATFDEQILVDYSKNRITAETLEKLQALAKETDLSGAIRSMFSGEKINCTEDRAVLHIALRNRSNTPIVVDGKDVMPQVNAVLAKMKSFSERIISGEWKGYTGQAITDAVNIGIGGSDLGPYMVSEALKAYKNHLNMHFVSNVDGTHIAETLKTLNPETTLFLIASKTFTTQETMTNAYSARNWFLQSAEIEAHVAKHFAALSTNEQEVSKFGIDPQNMFEFWDWVGGRYSLWSAIGLSIALSIGYENFEQLLSGAHAMDKHFEQTSPEQNIPVLLALIGIWYNNFFGAETEAILPYDQYMHRFAAYFQQGNMESNGKYIDRNGSPVDYQTGPIIWGEPGTNGQHAFYQLIHQGTKLIPCDFIAPAISHNPLSDHHSKLLSNFFAQTEALAFGKNREQVEAEFVAAGKNAQGVANVVPFKVFEGNRPTNSILLREITPFSLGALIAMYEHKIFAQGAILNIFSFDQWGVELGKQLANRILPELHDDEAVNSHDSSTNGLINRFKTWR

SEQ ID NO: 9157 - protein, 457 aa, Xenorhabdus bovienii
  Coding DNA sequence: Name=SeqID_3049
  Gene classification: Gene name=LysC; Function=Aspartokinases; Function class=E Amino acid transport and metabolism
  Homolog annotation: Query=10..456bp; Hit=3..449bp; Blast score=617; Percent Identity=75.0; E value=1e-177; Homolog= ZlysC COG0527
MYAVSSPYPQYVVAKFGGTSVADFDAMNHCADIILANADVRVVVLSASAGVTNLLVALATGCDSDKREKCLKQIRDIQYAIIDRLNDVDVICEEIERLLENIEMLSEAASLATSEALTDELVSHGEVMSTLLFVELLRQRNANAEWFDIRRIMRTNDHFGQAEPDTLQLHISAVEHLQPRLNNTVVITQGFIGREEKGRTTTLGRGGSDYTAALLGEALNLQRVDIWTDVPGIFTTDPRVAPTAKRIDKIAFDEAAEMATFGAKILHPATLLPAVRCGIPVFVGSSKDPQAGGTLVCDKIENPPLFRALALRRKQTLLTLHSLKMLHARGFLAEVFTLLLRHNISVDLITTSEVSVALTLDTTGSTSTNGSLLTNALLTELSTLCRVEVEEDLTLVAIIGNELSQAKGLGKEIFGTLESFNIRMISYGASSHNVCLLVPGKDAESVIQKLHQNLFKV

SEQ ID NO: 9158 - protein, 52 aa, Xenorhabdus bovienii
  Coding DNA sequence: Name=SeqID_3050
MDDKAGENTSDEWSHSEISNLSTSGRGWIILMTSAHTANIIVAEDSFSISTV

SEQ ID NO: 9159 - protein, 59 aa, Xenorhabdus bovienii
  Coding DNA sequence: Name=SeqID_3051
VAPLIGCVFPRFIIHNKKTKINSIFALAKSGLLHRHFQRAFYEYSRCQQTYQKNQNNGK

SEQ ID NO: 9160 - protein, 276 aa, Xenorhabdus bovienii
  Coding DNA sequence: Name=SeqID_3052
  Gene classification: Gene name=IclR; Function=Transcriptional regulator; Function class=K Transcription
  Homolog annotation: Query=1..276bp; Hit=14..287bp; Blast score=363; Percent Identity=66.0; E value=1e-100; Homolog= iclR COG1414
MSTAVANKRTKKTKITANSAAASGQVQSLSRGLTLLEYISDSQVGVALTDLAIQAGLPNSTTHRLLTTLQQHGFVRQVGDLGLWVIASHAFVVGSSFLQSRNLMVLVHPILRQLMEDSGETVNLAILNLDEYEAVIVDQVQCNALIRMSAPIGGKLPMHASGAGKALLSTLSEQKRLQLLHKKGLHTYTQHTYTTAAALKENLEQIRKQGFSLDDEEHALGLRCIAACIYDEHHEAFAAISISGSISRISDDRVTELGALVMRAAKEISREYGGIK

SEQ ID NO: 9161 - protein, 30 aa, Xenorhabdus bovienii
  Coding DNA sequence: Name=SeqID_3053
MQQAPCSAPDSLIVGFAVNQTVQIDLLREI

SEQ ID NO: 9162 - protein, 40 aa, Xenorhabdus bovienii
  Coding DNA sequence: Name=SeqID_3054
LVHCEPNYQAIGCRTRRLLHHILITGILNPLYPNLARGNC

SEQ ID NO: 9163 - protein, 213 aa, Xenorhabdus bovienii
  Coding DNA sequence: Name=SeqID_3055
  Gene classification: Gene name=Eda; Function=2-keto-3-deoxy-6 -phosphogluconate aldolase; Function class=G Carbohydrate transport and metabolism
  Homolog annotation: Query=1..212bp; Hit=1..212bp; Blast score=306; Percent Identity=80.0; E value=8e-84; Homolog= eda COG0800
MNNWKITAENILTDGPVVPVIVISEIEHAVPLAKALIAGGIRVLEVTLRTECALEAIRLIAKEVPEAIIGAGTVINPEQLAAVTEAGAQFAISPGLTDALLKAATTGSIPLIPGISTVSELMLGMSYGVNCFKFFPAEANGGVKALKAIAGPFPQVRFCPTGGISPDNYRDYLALNSVLCIGGSWLVPGDALKKGDYAQITELAHAAIAGAKA

SEQ ID NO: 9164 - protein, 187 aa, Xenorhabdus bovienii
  Coding DNA sequence: Name=SeqID_3056
  Homolog annotation: Query=1..185bp; Hit=1..188bp; Blast score=202; Percent Identity=58.0; E value=2e-51; Homolog= ref|NP_931566.1|
MANVILYGDILHIKNRHENGSYLDVYGQSASLGEKYNVVTSVSSNRDTGSGSWQILSAESKSLGTEIYSGDTVFLVNFYRNNGGYLRVSGYAPSPELYNVYTADRPVNALDTAIWHIFTDTANEFDGKIREGNAIRLLNSFNNVHGGFLDTCWLVNQPGAVYKVYTSLLSDRGNGTGTWILSKAINQ

SEQ ID NO: 9165 - protein, 574 aa, Xenorhabdus bovienii
  Coding DNA sequence: Name=SeqID_3057
  Homolog annotation: Query=2..573bp; Hit=1..572bp; Blast score=992; Percent Identity=86.0; E value=0; Homolog= ref|NP_931567.1|
MMEIDLAHLIAQTILQGFDAQYGRFLEVTSGAQQRFEQADWHAVQRAMKKRINLYDHHVGLVVEQLKCIHGTLQYDEDYIAKAKAVYTRLLPDYPRFEIAESFFNSVYCRLFQHRNLKPENLFIFSSQPACRFRHISRPLSRDFSSNSNIASMLRTILNDVPLRLKWEDLDRDIDYITQYLQKTFSEHDLLQATFQIANELFYRNKAAWLVGKIRLGTTVYPFLLPIHHNESGGIFIDTCLTCRDDASIVFGFARSYFMVYASLPAALVEWLREILPTKSTAELYMAIGCQKHGKTEYYREYLMFINASQEQFSIAPGVKGMVMLVFASPSFDRVFKVIKDKFAPQKEVSQERVQECYRLVKEHDRVGRMADTQEFENFVIEKRHISQELMEELQKEIPAKLEDLGDKVLIKHLYMERKMIPLNIYMEQVDKVQLKDVIEEYGNAIKQLAAANIFPGDMLFKNFGVTRHGRVIFYDYDEICYMTEVNFRNIPPPRYPEDELASEPWYSVAANDVFPEEFRHFLCGDNRVRRYFEESHSDLFKADYWLALQERIKNGHVEDVFAYRRKQRFSQRN

SEQ ID NO: 9166 - protein, 435 aa, Xenorhabdus bovienii
  Coding DNA sequence: Name=SeqID_3058
  Gene classification: Gene name=AceA; Function=Isocitrate lyase; Function class=C Energy production and conversion
  Homolog annotation: Query=4..435bp; Hit=8..439bp; Blast score=761; Percent Identity=86.0; E value=0; Homolog= ZaceA COG2224
MNISRTQQIAQLEQEWKQPRWEGITRPYSAEDVVKLRGSVNPEHTLAQMGAKKLWELLHGKSKKGYVNALGALTGGQALQQAKAGIEAVYLSGWQVAADANTASSMYPDQSLYPVDSVPNVIKRINNSFRRADQIQWANGIGPDSQEYTDYFLPIVADAEAGFGGVLNAFELMKAMIEAGAAAVHFEDQLAAVKKCGHMGGKVLVPTQEAVQKLVAARLAADVSGVSTLLVARTDADAADLLTSDCDPYDSEFITGKRTAEGFFCTRAGIDQAISRGLAYAPYADVVWCETSTPDLEAARRFAEAIHAEYPGKLLAYNCSPSFNWKKNLDDKTIASFQEQLSAMGYKFQFITLAGIHSMWFNMFDLAYDYARGEGMKHYVEKVQGPEFAALERGYTFSSHQQEVGTGYFDKVTTIIQGGTSSVTALTGSTEEQQF

SEQ ID NO: 9167 - protein, 532 aa, Xenorhabdus bovienii
  Coding DNA sequence: Name=SeqID_3059
  Gene classification: Gene name=AceB; Function=Malate synthase; Function class=C Energy production and conversion
  Homolog annotation: Query=1..531bp; Hit=1..532bp; Blast score=842; Percent Identity=75.0; E value=0; Homolog= aceB COG2225
MTQQALTTDLTFTKPFGEAENQILLPESIGFIEDLVVEFSDRRKKLLEERIHWQEKIDDGALPNFISETISIREGDWKVQGIPDDLKDRRVEITGPVERKMVINALNSNVKVFMADFEDSLAPSWDKVISGQINLRDAVNGTISYTSEQGKRYELKSEPAVLVARVRGLHLSEKHVLYKKEPISGGLFDFALYFYLNHKNLLANGSGPYFYLPKIQSYHEAQWWSDVFSFAEERFNLPKGTIKATVLIETLPAVFQMDEILYHLRHHIVGLNCGRWDYIFSYIKTLKNHSDRVLPDRQSVTMTQPFLSAYSRLLIKTCHKRGAFAMGGMSAFIPSKDIEQNQWVMDKVRADKELEAKNGHDGTWIAHPGLADITMTVFNTTLGERPNQLAVSREEDETITAEQLLEPCLGERTEEGMRANIRVAVQYIEAWISGNGCVPIYGLMEDAATAEISRTSIWQWIRHEKSLSNGKKVTKELFRQMLKEELDTIKQEVGEMNFNQGRFMEASNLMERITTQDELIDFLTLPGYQLLD

SEQ ID NO: 9168 - protein, 309 aa, Xenorhabdus bovienii
  Coding DNA sequence: Name=SeqID_3060
  Gene classification: Gene name=MetA; Function=Homoserine trans -succinylase; Function class=E Amino acid transport and metabolism
  Homolog annotation: Query=1..309bp; Hit=1..309bp; Blast score=490; Percent Identity=76.0; E value=1e-139; Homolog= ZmetA COG1897
MPIRVPDELPAVNILRNENIFVMTSTRANIQDIRPLKVLLLNLMPKKIETENHFIRLLSNSPLQVDIQLLRIDSRQCKNTPEEHLDNFYCDFESIKDQNFDGLIVTGAPLGLVEFEDVTYWAEIEKIVNWAKNHVTSTLFVCWAVQAALNVLYNLPKYTRTTKLSGVYSHITLDPFALLTRGFDESFLAPHSRFADFPEAVIREHTDLDILARSEDAGAYLFASKDKRLVFVTGHPEYGVDTLAAEYWRDLAAGLEPALPVNYFLNNDPENKPVASWRSHGHLLFLNWLNYYVYQITPYDLTYMNPTLD

SEQ ID NO: 9169 - protein, 43 aa, Xenorhabdus bovienii
  Coding DNA sequence: Name=SeqID_3061
MYLVREATPPGGFFAFVFFYYLLNFCFIIFHFPYYPFLFDRIK

SEQ ID NO: 9170 - protein, 61 aa, Xenorhabdus bovienii
  Coding DNA sequence: Name=SeqID_3062
  Homolog annotation: Query=1..47bp; Hit=68..115bp; Blast score=86; Percent Identity=87.0; E value=8e-17; Homolog= ref|NP_667667.1|
MSGSALLSHGETPHYHRRYGVSLLSSAWDQVGPPRYGRQTNSVFNPEQAAVFHLKLRLSLT

SEQ ID NO: 9171 - protein, 107 aa, Xenorhabdus bovienii
  Coding DNA sequence: Name=SeqID_3063
  Gene classification: Gene name=RuvA; Function=Holliday junction resolvasome DNA-binding subunit; Function class=L DNA replication, recombination and repair
  Homolog annotation: Query=1..106bp; Hit=10..115bp; Blast score=175; Percent Identity=81.0; E value=7e-45; Homolog= ruvA COG0632
LEKQPPLVLLETNGVGYEVHMPMTCFYELPEIGQQAILFTQFIVREDAQLLYGFNDKQERALFRELIKVNGVGPKLALAILSGMSAQQFVTAIEQEAITSLVKLPGG

SEQ ID NO: 9172 - protein, 173 aa, Xenorhabdus bovienii
  Coding DNA sequence: Name=SeqID_3064
  Gene classification: Gene name=RuvC; Function=Holliday junction resolvasome endonuclease subunit; Function class=L DNA replication, recombination and repair
  Homolog annotation: Query=1..173bp; Hit=1..173bp; Blast score=253; Percent Identity=83.0; E value=5e-68; Homolog= ruvC COG0817
MAIILGIDPGSRITGYGVIRQQGRQLIYIGSGCIRTKVDDLPNRLQRIYAGVTEIITQFRPDVFAIEQVFMAKNADSALKLGQARGVAIVAAVNESIPVFEYAARQVKQTVVGTGAAEKSQVQHMVRSMLKLSADPQADAADALAIAITHCHFNQNLLRIGDVRLNLTRGRLK

SEQ ID NO: 9173 - protein, 51 aa, Xenorhabdus bovienii
  Coding DNA sequence: Name=SeqID_3065
MVKSLMKLQRSCNYHQGSQRRESVPYLRALSLTFLSHITSGINRYGDYSWY

SEQ ID NO: 9174 - protein, 247 aa, Xenorhabdus bovienii
  Coding DNA sequence: Name=SeqID_3066
  Gene classification: Function=Uncharacterized ACR; Function class=S Function unknown
  Homolog annotation: Query=1..247bp; Hit=1..246bp; Blast score=385; Percent Identity=83.0; E value=1e-107; Homolog= yebC COG0217
MAGHSKWANTKHRKAAQDSKRGKIFTKIIRELVTAARLGGGDPASNPRLRAAVDKALSNNMTRDTLNRAIARGVGNDDADNMETIIYEGYGPGGTAVMVECLSDNRNRTVSDVRHAFTKTGGNLGTDGSVSYLFTKKGVISYAPSLDEDAVMEAALEAGADDVETYDDGAIDVYTTPESFGDVKDALDAAGFKAESAEVSMIPSTKAELDAETAPKLLRLIDMLEDSDDVQEVYHNGEISDEIAAQL

SEQ ID NO: 9175 - protein, 144 aa, Xenorhabdus bovienii
  Coding DNA sequence: Name=SeqID_3067
  Gene classification: Gene name=MutT; Function=NTP pyrophosphohydrolases including oxidative damage repair enzymes; Function class=L DNA replication, recombination and repair
  Homolog annotation: Query=3..144bp; Hit=6..147bp; Blast score=194; Percent Identity=69.0; E value=3e-50; Homolog= ntpA COG0494
MDYKRPESVLVVIYAATSKRVLMLQRRDDPEFWQSVTGSLEGNEKPWEAALREVQEEIGIDIVNAGFELTDCQRCLYYEIFSHLRYRYAPGVTRNKEHWFLLALPEEREILLTEHLTYQWLAVEEAARLTKSWSNRQAIEEFVI

SEQ ID NO: 9176 - protein, 589 aa, Xenorhabdus bovienii
  Coding DNA sequence: Name=SeqID_3068
  Gene classification: Gene name=AspS; Function=Aspartyl-tRNA synthetase; Function class=J Translation, ribosomal structure and biogenesis
  Homolog annotation: Query=1..586bp; Hit=1..586bp; Blast score=984; Percent Identity=79.0; E value=0; Homolog= ZaspS COG0173
MRTNYCGQLSLAHEGQKVTLCGWVNRRRDLGGLIFIDMRDREGIVQVFFDPDQKEAFAQASELRNEFCIQITGIVRARPDSQINKEMATGEVEVFADSLMVFNRSEALPLDSNQNNSEEQRLKYRYLDLRRPEMSLRLKTRAKVTSFVRRFMDNAGFLDVETPMLTKATPEGARDYLVPSRVHKGKFYALPQSPQLFKQLLMMSGFDRYYQIVKCFRDEDLRADRQPEFTQIDVETSFMTAEQVREIMEKMIRELWLDARGVDLGNFPIMTFAEAMRRFGSDKPDLRNPLELVDVADLVKNVEFAVFAEPANNPKGRVATICVPGGAELSRKQIDEYGKFVGIYGAKGLAWMKVNNRAAGLEGVQSPVAKFLSAEVVEGLLSRTNAQDGDILFFGADKKNVVTDAMGALRLKLGRDLNITDLASWKPLWVIDFPMFEDNGEGGLHAMHHPFTSPCDMSATELEHDPESAIANAYDMVINGYEVGGGSVRIHRNEMQQVVFRILGINEEEQQEKFGFLLNALKYGTPPHAGLAFGLDRLVMLLTDTDNIRDVIAFPKTTAAACLMTEAPSYANPASLEELAISVVKKKSE

SEQ ID NO: 9177 - protein, 136 aa, Xenorhabdus bovienii
  Coding DNA sequence: Name=SeqID_3069
  Gene classification: Function=Uncharacterized BCR related to glutathione S-transferase, MAPEG superfamily; Function class=R General function prediction only
  Homolog annotation: Query=5..133bp; Hit=11..139bp; Blast score=158; Percent Identity=65.0; E value=1e-39; Homolog= ZyecN COG3788
MELKMVSSLYIVLGALLLIKLSLDVVKLRTQYRVAYGDGGFYELQTAIRVHGNAVEYIPISMLLLLMMEMNGAAVWMLHICGLLLLSGRILHYFGLRHREIRWRRMGMGATYISMIIMIITNIYYLPWEQIFSFYA

SEQ ID NO: 9178 - protein, 30 aa, Xenorhabdus bovienii
  Coding DNA sequence: Name=SeqID_3070
MQTLMYIMTPMHKRSPSLPRAVFLPPEGFC

SEQ ID NO: 9179 - protein, 252 aa, Xenorhabdus bovienii
  Coding DNA sequence: Name=SeqID_3071
  Gene classification: Gene name=SmtA; Function=SAM-dependent methyltransferases; Function class=Q Secondary metabolites biosynthesis, transport and catabolism
  Homolog annotation: Query=8..251bp; Hit=2..245bp; Blast score=410; Percent Identity=77.0; E value=1e-115; Homolog= ZyecO COG0500
MSNQDPHNQRDSLFSAPIANLGDWSFDERVAEVFPDMVKRSIPGYSNIISMIGMLASRFVTPSSQIYDLGCSLGAATLSIRRSINADNCRIIAIDNSPAMIERCRRHIDSFKASTPVEVIEQNILDTDIQNASMVVLNFTLQFLHPDDRQKILKKIYAGLKPGGVLVLSEKFNFEDQKIGELLFNMHHDFKRANGYSELEVSQKRSMLENVMRTDSVDTHKSRLKEAGFQHVEVWFQCFNFGSLLAIKGTEQ

SEQ ID NO: 9180 - protein, 323 aa, Xenorhabdus bovienii
  Coding DNA sequence: Name=SeqID_3072
  Gene classification: Gene name=SmtA; Function=SAM-dependent methyltransferases; Function class=Q Secondary metabolites biosynthesis, transport and catabolism
  Homolog annotation: Query=1..323bp; Hit=1..323bp; Blast score=501; Percent Identity=73.0; E value=1e-142; Homolog= ZyecP COG0500
MIDFGNFYQLIAKHPLSHWLDSLPAQLSHWQKTSQHAQFSSWVKILENLPEIKPSHLDLKNGVIATHEPDLSKGEKARLHNILKILMPWRKGPFSLYDVEIDTEWRSDWKWERVLPHISPLEGKTVLDVGCGSGYHMWRMVGEGAQLVVGIDPTQLFLCQFEAIRKLLGNNQRAHLLPLGIEQLPELQAFDTVFSMGVLYHRRSPLDHLWQLKNQLVSDGELVLESLVIEGDENQCLIPGERYAQMRNVYFIPSAKMLKVWLEKCGFVDVRIVDHAATTPDEQRRTEWMKTESLVDFLDPSDHSKTIEGYPAPLRAVLIARKP

SEQ ID NO: 9181 - protein, 248 aa, Xenorhabdus bovienii
  Coding DNA sequence: Name=SeqID_3073
  Gene classification: Gene name=CutC; Function=Uncharacterized protein involved in copper resistance; Function class=P Inorganic ion transport and metabolism
  Homolog annotation: Query=1..243bp; Hit=1..242bp; Blast score=278; Percent Identity=55.0; E value=3e-75; Homolog= cutCm COG3142
MIRLEICCYSISCALVAQNAGADRIELSASPLEGGLTPSFGALQQSLQRLSIPVHPIVRPRGGDFCYNNMDFEAMKNDVARIRDMGFPGIVFGILSENGHIDRLRMRQLMSLSGNMAVTFHRAFDMCFNPHVALEQLTELGVQRILTSGQQQNAELGLTLLKELMQASRGPIIMPGAGVRVSNISKFLEAGMTEVHSSAGKIVPSTMKYRKAGVAMSSDDRDVDEYSHYSVDGELVESMKGVMSLIER

SEQ ID NO: 9182 - protein, 37 aa, Xenorhabdus bovienii
  Coding DNA sequence: Name=SeqID_3074
MTCWKSQGQNFLLEQHDKNVIFAGYTSLLTISLIQKG

SEQ ID NO: 9183 - protein, 184 aa, Xenorhabdus bovienii
  Coding DNA sequence: Name=SeqID_3075
  Gene classification: Function=Uncharacterized BCR; Function class=S Function unknown
  Homolog annotation: Query=1..183bp; Hit=3..187bp; Blast score=195; Percent Identity=52.0; E value=2e-50; Homolog= ZyecM COG3102
MSHFSKISELQDLVADLAGFEQKLKQFEGHLGLHFEQYSADHISLRCNESKIADRWRKGFLQCGQLISESIINGRPICLFDLNQPIVLLDWKIDCVELPYPSQKHYVHQGWEHVELVLPVPPEQLICEAKKLLPQPLPDNFRMKESHPKGKNERLPNPILAVTDGEITIKYHPFCIKEIVKSEV

SEQ ID NO: 9184 - protein, 54 aa, Xenorhabdus bovienii
  Coding DNA sequence: Name=SeqID_3076
LSIFAKISLSKRLIEVGITTNHLKDRLKTKSNTPEVADGSMQNPEYGINPVIFS

SEQ ID NO: 9185 - protein, 576 aa, Xenorhabdus bovienii
  Coding DNA sequence: Name=SeqID_3077
  Gene classification: Gene name=ArgS; Function=Arginyl-tRNA synthetase; Function class=J Translation, ribosomal structure and biogenesis
  Homolog annotation: Query=1..576bp; Hit=1..577bp; Blast score=945; Percent Identity=80.0; E value=0; Homolog= argS COG0018
VNIQVILSEKISNALIEAGAPTDSEAHVRQSAKAQFGDYQANGVMAAAKKVGMPPRQLAEKVVSQLDLQGIASKVEIAGPGFINIFLDKAWVAANIETTLKDEKLGITPVEPQTIVIDYSAPNVAKQMHVGHLRSTIIGDAAARTLEFLGHKVIRANHVGDWGTQFGMLIAYLEKIQNENADDMALADLEAFYREAKKHYDEDEEFAIRARNYVVKLQGGDEYCRKMWRKLVDITMSQNQETYNRLNVTLTEKDVMGESLYNDMLPGIVADLKQRGIAVKSDGATVVYLDEFKNKEGEPMGVIIQKKDGGYLYTTTDIACAKYRHETLNASRVLYYIDSRQHQHLMQAWAIVRKTGYIPESMSLEHHMFGMMLGKDGKPFKTRAGGTVRLSDLLDEAIERADTLIREKNPDMPEDELKKVVEAVGIGAVKYADLSKSRTTDYVFDWDNMLAFEGNTAPYMQYAYTRVSSIFKRADIDENSLTLPVMLNEEREQALATRLLQFEETITTVAREGTPHVMCAYLYDLAGLFSGFYEHCPILNADSEELRQSRLKLALLTAKTLKQGLDTLGIQTVERM

SEQ ID NO: 9186 - protein, 38 aa, Xenorhabdus bovienii
  Coding DNA sequence: Name=SeqID_3078
MEKYLAIILFFLVMVVLNLKSNIIYFIINNPFNGYKLL

SEQ ID NO: 9187 - protein, 512 aa, Xenorhabdus bovienii
  Coding DNA sequence: Name=SeqID_3079
  Gene classification: Gene name=MviN; Function=Uncharacterized membrane protein, putative virulence factor; Function class=R General function prediction only
  Homolog annotation: Query=1..509bp; Hit=1..509bp; Blast score=692; Percent Identity=80.0; E value=0; Homolog= mviN COG0728
MNLLKSLAAVSSMTMFSRVLGFIRDAIIARIFGAGMATDAFFVAFKLPNLLRRIFAEGAFSQAFVPILAEYKNQQGDEATRTFIAYISGMLTLILAIVSVIGVIAAPWIIYVTAPGFTDTPDKFVLTRDLLRITFPYIFLISLASLAGAILNTWNRFSVPAFAPTLLNVSMIVFALFVAPYCNPPVLALGWAVVAGGVLQLAYQLPHLKKIGMLVLPRISFRDSAVWRVIRQMGPAILGVSVGQISLIINTIFASFLVSGSVSWMYYADRLMELPSGVLGVALGTILLPSLAKSFSSGNHEEYRKLMDWGLRLCFLLALPCAVALGILAEPLTVSLFQYGHFSAFDAEMTQRALIAYCFGLMGLIVVKVLAPGFYSRQDIKTPVKIAIATLILTQLMNLAFVGPLKHAGLALSIGLAACFNASMLYWQLRKRDIFTPLVGWGIFLFKLVVAIAVMVGVLLAVLWVMPAWEQGNMAMRLLRLMGVVIAGAGSYFAVLALMGFRLKDFSHRGLQ

SEQ ID NO: 9188 - protein, 37 aa, Xenorhabdus bovienii
  Coding DNA sequence: Name=SeqID_3080
MAYKAIWRDSSRCLKSNRQKPCLHFLYYAPLALPRDS

SEQ ID NO: 9189 - protein, 195 aa, Xenorhabdus bovienii
  Coding DNA sequence: Name=SeqID_3081
  Gene classification: Gene name=RimL; Function=Acetyltransferases, including N-acetylases of ribosomal proteins; Function class=J Translation, ribosomal structure and biogenesis
  Homolog annotation: Query=1..190bp; Hit=1..190bp; Blast score=272; Percent Identity=67.0; E value=2e-73; Homolog= rimJ COG1670
MFGYRSASPKIRFITDRMVVRLVYERDAYRLAEYYSENKDFLKPWEPKRDGSFYQPSGWTNRLNYITELQRQNATFNFVLLDSDEREIMGVANFTNVVRGAFHSCYLGYSLAEKLQGQGLMYEALQPAIRYMQRYQRMHRIMANYMPHNHRSGNLLKKLGFEQEGYAKNYLMIDGVWQDHVLTALTDDAWGKVGL

SEQ ID NO: 9190 - protein, 412 aa, Xenorhabdus bovienii
  Coding DNA sequence: Name=SeqID_3082
  Gene classification: Gene name=ProP; Function=77 Permeases of the major facilitator superfamily; Function class=G Carbohydrate transport and metabolism
  Homolog annotation: Query=12..411bp; Hit=11..410bp; Blast score=512; Percent Identity=71.0; E value=1e-145; Homolog= yceL COG0477
MFNPLISQWCAMSLVSQARSLGKYFLLFDNLLVVLGFFVVFPLISIRFVEQLGWAALIVGFALGLRQLVQQGLGIFGGAIADRFGAKPMIVTGMLLRALGFALMAMAHEPWILLLSCVLSGLGGTLFDPPRAALVIKLTRPHERGRFYSILMMQDSAGAVVGALIGSWLLQYDFNIVCWIGASIFVLAALFNAWLLPAYRISTIRTPIKEGMMRVIRDRRFLYYVLTLTGYFVLSVQVMLMFPIIIHEITGTPTAVKWMYAIETVISLTLLYPIARWSEKHFRLEQRLMAGLFLMTICMFPIGWVNQLHTLFGLLCLFYLGLVTADPARETLSASLSDPRARGSYMGFSRLGLALGGAIGYTGGGWLYDTGRDLNMPQLPWILLGLSGLITIYALHRQFNQKKIDPVMLGRH

SEQ ID NO: 9191 - protein, 187 aa, Xenorhabdus bovienii
  Coding DNA sequence: Name=SeqID_3083
  Homolog annotation: Query=1..187bp; Hit=1..187bp; Blast score=228; Percent Identity=66.0; E value=3e-59; Homolog= ref|NP_929349.1|
MKRFFLGAALVLVGLVSGCDQFKDFSINEGLMNDYLLKKVHYQKKISIPGIANANITLGDLSSQIGRQDPEKIELSTQAKVQLATLLGTIQADMKLTIKAKPVFDAEKGAIFVKELEIVDYQTTPEKAAAPVKALIPYLNTSLSEFFDTHPVYVLNPEKSKAEAAASQFAKRLEIKPGKLVIGLTDK

SEQ ID NO: 9192 - protein, 180 aa, Xenorhabdus bovienii
  Coding DNA sequence: Name=SeqID_3084
  Gene classification: Gene name=TorD; Function=Uncharacterized component of anaerobic dehydrogenases; Function class=R General function prediction only
  Homolog annotation: Query=1..180bp; Hit=1..181bp; Blast score=214; Percent Identity=60.0; E value=4e-56; Homolog= ycdY COG3381
MNEFSIVCRILGTLFNRAPQDPVLQPLITMIAEGKLKQAWPLEQDEWLDRLQQNSELSVMAADYHALFTGESASVAVCRCDYTDGEESEVRQFLTERGMPLSDTPADQFGSLLLAVSWLEDQAAEDEIQAQITLFDEYLLPWCGQFLGKVEAHATSGFYRTLAIVTREALQALRYELESE

SEQ ID NO: 9193 - protein, 313 aa, Xenorhabdus bovienii
  Coding DNA sequence: Name=SeqID_3085
  Gene classification: Gene name=SerA; Function=Phosphoglycerate dehydrogenase and related dehydrogenases; Function class=E Amino acid transport and metabolism
  Homolog annotation: Query=1..313bp; Hit=14..325bp; Blast score=350; Percent Identity=53.0; E value=1e-96; Homolog= ycdW COG0111
MNIIFFHPSFNTDEWIQGIQARLPDAKVRQWVSGDQEPADYALVWQPPYEMLANRQGLKGIFALGAGVDAIFKQESKNPGTLPADVPLIRLEDTGMGRQMQEYAITSVLHYFRRMDEYKRYQEQRLWAPMAPHNRKEFVIGVLGAGILGRSVIGKLMEFDFNVRCWSRTSKQLDSVESFYGKEQLGDFLSGCKVLINLLPDTPDTRGILNLSLFSQLKSGSYVINLARGAQLVEQDLLVAIDKGYIAGATLDVFAEEPLSNMHPFWTHPRINVTPHIAANTVPEAAMDVICENIRRMARGEMPTGLVDRVRGY

SEQ ID NO: 9194 - protein, 53 aa, Xenorhabdus bovienii
  Coding DNA sequence: Name=SeqID_3086
MVASLCWKARNENINNVTQLTYLPLHITKSASALVNDYRTFKLFFICVISQKA

SEQ ID NO: 9195 - protein, 52 aa, Xenorhabdus bovienii
  Coding DNA sequence: Name=SeqID_3087
MVILFGYVLWISLEQGVIKPQIFKTFPLEQVVEVNPCEVFHLYFGEYKCEKA

SEQ ID NO: 9196 - protein, 263 aa, Xenorhabdus bovienii
  Coding DNA sequence: Name=SeqID_3088
  Homolog annotation: Query=143..263bp; Hit=3..123bp; Blast score=210; Percent Identity=80.0; E value=2e-53; Homolog= ref|NP_929534.1|
MLTLNFSTSVNAKPSHIWAHYVDFDLRKKWEVDLEYFQFEGEVKTGQYGRMILSGMPEIRFYLSNIEVNKEFTDQVNFPQMGILTFRHQIITDENNMACRIQVTVSFEPDANISAVQAESFFKQGTQDLVETVLRLKSVVEIVSPKPNLQLVYVSDIERSSAFYKTIFNAEPIFASSRYVAFPAGGEVLFAIWSGGAKPDRAIPRFSEIGIMLPSGKDVDRCFEEWRKNPEIKIVEEPHTEVFGRTFLAEDPDGHIIRVCPLD

SEQ ID NO: 9197 - protein, 264 aa, Xenorhabdus bovienii
  Coding DNA sequence: Name=SeqID_3089
  Gene classification: Function=Predicted transcriptional regulator; Function class=K Transcription
  Homolog annotation: Query=37..258bp; Hit=1..221bp; Blast score=241; Percent Identity=55.0; E value=5e-64; Homolog= mll3208 COG2378
MILYKGSKNYLFNQLNYDSCVLLEVDESVNLNGWDELSRAQRLLSLMEILRRYHFPVQGKVLAQKLNISLRTLYRDIASLQAQGAIIEGEPGIGYVLRPGFVLPPLMFTQNEIEALALGANWVAKRADPQLKESANNAISKIAAVIPAELKQMLEASSLLIGPAATAVQPVVEIQQIRQAINTRHKITFAYLDIKDIPSERTIWPFALGYFENISIVIGWCELREEFRHFRSDRIMRLKIEKQCYPRSRQVLLKEWRAMEKISR

SEQ ID NO: 9198 - protein, 207 aa, Xenorhabdus bovienii
  Coding DNA sequence: Name=SeqID_3090
  Gene classification: Gene name=PgsA; Function =Phosphatidylglycerophosphate synthase; Function class=I Lipid metabolism
  Homolog annotation: Query=1..190bp; Hit=3..192bp; Blast score=190; Percent Identity=58.0; E value=8e-49; Homolog= Z2319 COG0558
MTIYDLKPRFQNLLRPIVIYLYKQGITANQVTLTALFLSIFAGSLLSLFPSPHLYWLLPVFLFIRMALNAIDGMLAREHNQKSHLGAIYNELGDVISDVALYLPFCLLPGVNSLSLLIILFLTILTEFIGVLAQTIGASRRYDGPIGKSDRAFIFGAYGLIIAIFPSTLGWSSSLFAFMIILLLVTCYQRVVKALREIRLAEQSHSK

SEQ ID NO: 9199 - protein, 589 aa, Xenorhabdus bovienii
  Coding DNA sequence: Name=SeqID_3091
  Gene classification: Gene name=PldB; Function=Lysophospholipase; Function class=I Lipid metabolism
  Homolog annotation: Query=6..277bp; Hit=3..274bp; Blast score=378; Percent Identity=63.0; E value=1e-104; Homolog= ynbC_1 COG2267
MTPQLDQRIAEEHYFTTSDNASLFYRYWPQQQANPDRAIIIFHRGHEHSGRIQHVVDGLDLPDVPMFAWDARGHGKTEGPRGYSPSMGTSIRDVDEFVRFIAIQYGIAMGNIVVIGQSVGAVLVSAWVHDYAPKIRAMILAAPAFDIKLYIPFATQGLQLMQKARGIFFVNSYVKARYLTHDETRIASYNSDPLITREIAVNILLDLYQTAERVVKDAAAITLPTLLFISGSDYVVNKKPQHQFYQQLNTPIKEKHVMDGFYHDTLGEKDRHLVFDKIRVFIERIFALPRYQHDYSREDTWSHSADEFRTLSTSLPCLCPKKLSYQLMRKVMSTRWGRTSEGVCIGLKTGFDSGSTLDYVYRNQPQGKGILGRILDKHYLNSIGWRGIRQRKIHIEMLIRHAIRSLREQNMPVHMVDIAAGHGRYILDAINDFSKVDSILLRDYSEINVNQGQAYIEERDLTDKIRFIIGDAFNAESIASITPAPTLGIVSGLYELFPDNNLLRNSLRGFADVMTENGYLVYTGQPWHPQIEVIARVLSSHRDSQPWIMRRRTQGEMDALVEAAGFEKLYQLTDNWGIFTVSIAKRVHR

SEQ ID NO: 9200 - protein, 439 aa, Xenorhabdus bovienii
  Coding DNA sequence: Name=SeqID_3092
  Gene classification: Gene name=PgpB; Function=Membrane-associated phospholipid phosphatase; Function class=I Lipid metabolism
  Homolog annotation: Query=17..349bp; Hit=2..341bp; Blast score=262; Percent Identity=46.0; E value=5e-70; Homolog= ynbD_1 COG0671
MEHHMHSSLDSRRRLWLTGVIWLLFLAPFFFLTYGQVNQFTAQRGDVGTVMFGWEHNIPFWSWSIIPYWSIDLFYGISLFICTHRREQWLHGWRLMTASLIACVGFLLFPLKFSFSRPTTEGLFGWLFNQLELFDLPYNQAPSLHIILLWLLWLRYSAYVSGYWRGLLHIWSVLIALSVLTTWQHHFIDVLTGFAVGVILSYLLPVSYRWRWQPNQDRYARKLFGYYLTGSALFALIASLLGGSFWILLWPAVSLLMIALGYAGLGSSVFQKQPDGRMSLSARWLLAPYQLGAWLSYLWFRRKSAPFNRITEGIILGSLPCQPVTAVSVLDITAEWHRRSDARSVNYVCQPQIDLLPLAPEALQSAVCTLDKLRQQGDVFVHCTLGLSRSAMVVAAWLLKQHPEYDINTVVAILRKARPHVTFRQTHLDALSQWAKGYL

SEQ ID NO: 9201 - protein, 166 aa, Xenorhabdus bovienii
  Coding DNA sequence: Name=SeqID_3093
MSRSDKHISMLCLNGQKATYNGEHNMQPENLISKVIIATLKSWRFISALSAFSILIATAMLIAVFNTTALNNIALYAVLLFTTLYCQYYCWRIWLDCHYFQILNSSPEKSAEFDQTLLLIFNKLPQSRTQNDRFNGAIKLLKKATIGLILQWILFFLFLLTLKYSA

SEQ ID NO: 9202 - protein, 578 aa, Xenorhabdus bovienii
  Coding DNA sequence: Name=SeqID_3094
  Gene classification: Gene name=SUL1; Function=Sulfate permease and related transporters (MFS superfamily); Function class=P Inorganic ion transport and metabolism
  Homolog annotation: Query=11..561bp; Hit=2..550bp; Blast score=664; Percent Identity=69.0; E value=0; Homolog= ychM COG0659
MNTRKINGIRPFSAFIDSCLKESYSFPRFIRDIIAGITVGVIAIPLAMALAIGSGVAPQYGLYTAAIAGIVIAMTGGSRYSVSGPTAAFVVILYPVSQQFGLSGLLIATLMSGVILIVMGLARFGRLIEYIPMSVTLGFTSGIAITIATMQVQNFFGLKLAHIPENYIDKVVALYQALPSLQLSDTLIGLTTLLVLIFWPKLGVKLPGHLPALIAGTAVMGTMHLLSYDVATIGSSFSYTLADGSQGQGIPPILPQFVLPWNLPDTHSLNISWNTVSALLPAAFSMAMLGAIESLLCAVILDGMTGKKHHSNGELLGQGLGNIAAPFFGGITATAAIARSAANVRAGATSPIAAVVHSLLVLLTLLVLAPMLSYLPLAAMSAILLIVAWNMSEAHKVVDLIRHAPKDDIIVMLLCLSLTVLFDMVVAITIGIVLASLLFMRKIANMTRISTSSLTSAEKGLLVVRINGPLFFAAAERIFAELREKSVDYQTIIMQWDAVPVLDAGGLHAFQGFVRELGKEKHIVVCDIPFQPLKTLARAKVMPIEGELSFYATLPKALKEMAVDYTPEVCASSEKIQG

SEQ ID NO: 9203 - protein, 284 aa, Xenorhabdus bovienii
  Coding DNA sequence: Name=SeqID_3095
  Gene classification: Gene name=KdsA; Function=3-Deoxy-D-manno -octulosonic acid (KDO) 8-phosphate synthase; Function class=M Cell envelope biogenesis, outer membrane
  Homolog annotation: Query=1..284bp; Hit=1..284bp; Blast score=513; Percent Identity=90.0; E value=1e-146; Homolog= ZkdsA COG2877
MQQKVVNIGDIKVANDLPFVLFGGMNVLESRDLAMRICEHYVTVTQKLGIPYVFKASFDKANRSSIRSYRGPGLEEGMKIFQELKQTFGVKIITDVHEPAQAQPVADVVDVIQLPAFLARQTDLVEAMAKTGAVINVKKPQFVSPGQMGNIVEKFKEGGNDQVILCDRGSNFGYDNLVVDMLGFGVMQQATQGAPVIFDVTHALQCRDPLGAASGGRRAQVAELARAGMAVGIAGLFLEAHPDPENAKCDGPSALPLAKLESFLMQIKAIDDVVKSFPELDTSK

SEQ ID NO: 9204 - protein, 269 aa, Xenorhabdus bovienii
  Coding DNA sequence: Name=SeqID_3096
  Gene classification: Function=Uncharacterized ACR; Function class=S Function unknown
  Homolog annotation: Query=1..269bp; Hit=1..269bp; Blast score=312; Percent Identity=56.0; E value=2e-85; Homolog= ychA COG2912
MKPIVNYEFNNTPLIDGIILVSKIIRPDFPQTLVSEQLTALVEEARQRLSSITDSKVKLDSLLTLFYREWKFGGANGVYCLSDTLWLDRLLHSRQGSPVSLGTVFTHIAQALGLSVQPVIFPIQLILRIDLLDQPTWFINPLNGDTLNEHTLDVWLKGNIGPTVRLKKQDLQEADNVSLVRKITDTIKVSLMEEKKMELALKASEVVLTFDPDDPYEIRDRGLIYAQLDCNHIAVSDLSYFVEHCPEDPISEMIKMQINTIEQRLIVLH

SEQ ID NO: 9205 - protein, 286 aa, Xenorhabdus bovienii
  Coding DNA sequence: Name=SeqID_3097
  Gene classification: Gene name=HemK; Function=Predicted rRNA or tRNA methylase; Function class=J Translation, ribosomal structure and biogenesis
  Homolog annotation: Query=1..279bp; Hit=1..275bp; Blast score=361; Percent Identity=62.0; E value=1e-100; Homolog= ZhemK COG2890
MNYQCWLQHAATQLSESDSPKRDAEILLGYVTGRSRTYLIAFDETLISSEELHQLDSLLVRRIQGEPVAYIIGEREFWSLPFAVSPATLIPRPDTECLVEKALELLPDSPARILDLGTGTGAIALALASERNDCYVTGVDINSDAVMLAQHNAEKNAGKLAIHNVNFLQSEWFAAVGNQQFDMIVSNPPYIDERDPHLQEGDIRFEPATALIAAQNGMADLQAIVGQARHFLSPNGWLLLEHGWKQGTVVRNLFLEKGYQQIATFQDYGGNERITIGRWNKNETHS

SEQ ID NO: 9206 - protein, 360 aa, Xenorhabdus bovienii
  Coding DNA sequence: Name=SeqID_3098
  Gene classification: Gene name=PrfA; Function=Protein chain release factor A; Function class=J Translation, ribosomal structure and biogenesis
  Homolog annotation: Query=1..360bp; Hit=1..360bp; Blast score=564; Percent Identity=85.0; E value=1e-161; Homolog= ZprfA COG0216
MKPSIVAKLEALQERHEEVLVHLGDASVIADQDRFRALSKEYAQLTDVTHCFKSWKTVQEDLQTAEMMLDDLEMREMAQEELKEAKIRNEELEQQLQLLLLPKDPDDERNCFLEVRAGTGGDEAAIFAGDLFRMYSRYAEARRWRVEIISANEGEHGGYKEVIAKVSGDQVYGHLKFESGGHRVQRVPETESQGRIHTSACTVAVMPEIPEAELPDISPGDLKIDTFRSSGAGGQHVNTTDSAIRITHLPTGIVVECQDERSQHKNKAKAMSVLAARIRAAEMRKRQEVEASERRNLLGSGDRSDRNRTYNFPQGRVTDHRINLTLYRLDEVIEGKLDMLIQPIIIEYQADQLSALSEQD

SEQ ID NO: 9207 - protein, 420 aa, Xenorhabdus bovienii
  Coding DNA sequence: Name=SeqID_3099
  Gene classification: Gene name=HemA; Function=Glutamyl-tRNA reductase; Function class=H Coenzyme metabolism
  Homolog annotation: Query=1..418bp; Hit=1..418bp; Blast score=579; Percent Identity=77.0; E value=1e-165; Homolog= hemA COG0373
MTLLALGINHKTAPVSLRERVAFSPDTIGLALDNLLQQPLVRGGVVLSTCNRTELYLSVEQQDNLKEQLISWLCEYHQLNPDDLKASLYWHLDNDAVSHLMRVASGLDSLVLGEPQILGQVKKAFAESQNYQSLSGELERLFQKSFSVAKRVRTETEIGANAVSVAFAACTLARQIFESLSKLNILLVGAGETIELVARHLKEHRVRHMMIANRTKERAQTLASQVNAEVISLSEIDTRLAEADIVISSTASPLPIIGKGMVERALKVRRNQPMLLIDIAVPRDIEPDVEKLSDVYLYSVDDLQAIIQQNLAQRKAAAVVAEGIVQQESRYFMDWLRSQGAVNTIREYREQAEKVRAEMTAKALMSIRQGADAEQIINQLTHQLTNRLLHTPTKSLQQAASDGDLERLNLLRDSLGLDHN

SEQ ID NO: 9208 - protein, 49 aa, Xenorhabdus bovienii
  Coding DNA sequence: Name=SeqID_3100
MHQFNKSQSDGYAVIYSRNVDKISLNYHLDYRLGWRISYPSDYFIAKGY

SEQ ID NO: 9209 - protein, 205 aa, Xenorhabdus bovienii
  Coding DNA sequence: Name=SeqID_3101
  Gene classification: Gene name=LolB; Function=Outer membrane lipoprotein involved in outer membrane biogenesis; Function class=M Cell envelope biogenesis, outer membrane
  Homolog annotation: Query=6..202bp; Hit=8..204bp; Blast score=229; Percent Identity=55.0; E value=2e-60; Homolog= hemM COG3017
MKTSSLFCLLPLSAVLLTACTVTQPPTGTGSANSPQWHTREQQLQKLKNYQTRGSFAYLANEKKIYARFFWQQYSPDNYKLLLLNPLGTTELELFVQPNMIQLTDNKGKKYLSDTPEALIYQLTDMNIPLNNLKNWIIGLPGDAKDFQLDENYLLKSVSSKKNGEIWKINYQGYDASTMPALPNRLELTQGKNRIKLKMDNWTTQ

SEQ ID NO: 9210 - protein, 297 aa, Xenorhabdus bovienii
  Coding DNA sequence: Name=SeqID_3102
  Gene classification: Gene name=IspE; Function=4-diphosphocytidyl-2C -methyl-D-erythritol 2-phosphate synthase; Function class=I Lipid metabolism
  Homolog annotation: Query=1..285bp; Hit=1..279bp; Blast score=394; Percent Identity=69.0; E value=1e-110; Homolog= ychB COG1947
MTLTWPSPAKLNLFLYITGQRPDGYHELQTLFQFLDYGDEITITPRQDNQIHLLTPVEGVAHDDNLIVRAARLLQNHLLQNQLLQNNSQGTEHLGADIHIDKCLPMGGGLGGGSSNAATVLIALNYHWQANLSDDELAQLGISLGADVPVFVKGHAAFAEGIGEKLRPASPEEKWFLVAHPGIEISTPTIFTDPELKRNSPIRSLPALLQAPFTNDCESIARKRFREVEQLLSWLLEYAPSRLTGTGACVFGEFESEASARKVLNQSPEWMQGFVAHGVNISPLHTFRSGIYMLLNQ

SEQ ID NO: 9211 - protein, 312 aa, Xenorhabdus bovienii
  Coding DNA sequence: Name=SeqID_3103
  Gene classification: Gene name=PrsA; Function =Phosphoribosylpyrophosphate synthetase; Function class=F Nucleotide transport and metabolism
  Homolog annotation: Query=1..312bp; Hit=4..315bp; Blast score=558; Percent Identity=95.0; E value=1e-159; Homolog= prsA COG0462
MKLFAGNATPELAQRVANRLYTSLGDAAVGRFSDGEVSVQINENVRGGDVFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQKGLENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVENIKNSVIDEFIVCDTIPLSAEIKALNKVRTLTLSGMLAEAIRRISNEESISAMFEH

SEQ ID NO: 9212 - protein, 660 aa, Xenorhabdus bovienii
  Coding DNA sequence: Name=SeqID_3104
  Gene classification: Function=Phospholipase/lecithinase/hemolysin; Function class=I Lipid metabolism
  Homolog annotation: Query=18..374bp; Hit=13..396bp; Blast score=136; Percent Identity=29.0; E value=7e-32; Homolog= PM0076_1 COG3240
MKKAFLFTPALLALSISAISNAHAYNNTYVFGDSLSDSGNNGRYTTDGKTSQLYGEYVAQHITGSKPTASKDGGTNYAQGGATAIESLNPKYNTAEQVKNYLAAHNNRADANGVYIHWIGGNDLAAALMAGQKNPLDAYNIVNMSASAAGEQINQLVNAGAGLIIAPTAPDVGITPKLLETVIEDGLKKVGASDSMIKQTLEKIHQEINENPIPNNEIRNLAIQQVFHKLAQKAAELKPGLNADEVEKELNVKYKVANEGATKLTNDYNNLVDDKISQSNGNIMRVDANGLLKEVIANPLIYGIENTLGYACAQGKEAKECSATDPQTDPQYDKSKPFLFTDNFHPTPLGHLILGQYIESIYNAPSQVMTLNQVNRIPVKGVRASLDGHLQQLRNGGNAQGKIGIFGGYTGSHNNTFTLGGDYQLTDNLLLGAVYSNYKDERTSASNFTHEGRAHVVTTYALWNFYDKGWLSGDLHYSNNKYDSLTRSIQLGQATRRETGSTTGKQWGGRLTAGWDIAVTNQITTSPIIQYAWDKGDIKGYRESGDNSTSMHFADQDYTSKVGTLGWRVDTQLGRINPYASVQFNHEFGDTRYKLRSAINSTETSFVRESGKQNTDWRQYTVGVNANLFNNWRGFASVTRNESNSQEHNYNFSLGINASF

SEQ ID NO: 9213 - protein, 91 aa, Xenorhabdus bovienii
  Coding DNA sequence: Name=SeqID_3105
  Homolog annotation: Query=1..89bp; Hit=1..89bp; Blast score=105; Percent Identity=57.0; E value=1e-22; Homolog= ref|NP_929326.1|
MKRKNAFILGNIFMGLGMAAMLISLSYVLLSHVFSLDQSGLATGISLMGLFVGALVWLAGASIGGREQVTDKYWWLKNYDERYRRKKHRTS

SEQ ID NO: 9214 - protein, 77 aa, Xenorhabdus bovienii
  Coding DNA sequence: Name=SeqID_3106
MKAFLRFITNLQYFSELNLQMKRTQKHESRYILGYIIALLSKRLLRRRSQVVQISTHFYTSPKGDSATIICPPCLTH

SEQ ID NO: 9215 - protein, 253 aa, Xenorhabdus bovienii
  Coding DNA sequence: Name=SeqID_3107
MLVRNWLPRPSPFEAPFTRPAISTNSIVVGSMRWGLTISANWSRRESGIGTTPVFGSIVQKGKFAASIPALVSALNNVDFPTLGRPTIPHLNPIYLLPQITYKPAGKMPVGELYKIGAIIHAITSHAMHSLLSAGFKSMQTVNGLVHAIFHQNVRAAQCFINGIIDQLLLTGRRLAKYKTHHFIFVTRMADANAQTVEVRVITELVLNVFQTVMATVTAPQFHFCYAGWQIKFIVRDQNFIRLDAVESGEGKD

SEQ ID NO: 9216 - protein, 363 aa, Xenorhabdus bovienii
  Coding DNA sequence: Name=SeqID_3108
  Gene classification: Function=Predicted GTPase; Function class=R General function prediction only
  Homolog annotation: Query=1..363bp; Hit=1..363bp; Blast score=676; Percent Identity=93.0; E value=0; Homolog= ychF COG0012
MGFKCGIVGLPNVGKSTLFNALTKAGIEAANFPFCTIEPNTGVVPMPDSRLDQLAEIVKPQRILPTTMEFVDIAGLVKGASKGEGLGNQFLTNIRETEAIGHVVRCFENDNIIHVSGQVDPASDIEIINTELALADLDTCERAIHRVQKKAKGGDKDAKAELEALEKCLPHLEQAGMLRALDLSAEEKAAIRYLSFLTLKPTMYIANVNEDGFENNPHLDTVRAIAEAEGSVVVPVCAAIESDIAELEDGDREEFMAELGLEEPGLNRVIRAGYQLLNLQTYFTAGVKEVRAWTIPVGATAPQAAGKIHTDFEKGFIRAQTIAFEDFINYKGEQGAKEAGKMRAEGKDYIVKDGDVMNFLFNV

SEQ ID NO: 9217 - protein, 134 aa, Xenorhabdus bovienii
  Coding DNA sequence: Name=SeqID_3109
  Homolog annotation: Query=4..112bp; Hit=328..436bp; Blast score=107; Percent Identity=46.0; E value=3e-23; Homolog= ref|ZP_00031745.1|
MLPEFSRRARAVEVWAAISELGVQGIQVLIERCCLYAKMLAEGLELLGFKVLNEIVLNQVVACLPDIILQRAMLQKVQQSGECWFGQTIWQGQEAIRLSVSSWATTEDDIQRSLKAIADAIDEVKYADGMVRQS

SEQ ID NO: 9218 - protein, 328 aa, Xenorhabdus bovienii
  Coding DNA sequence: Name=SeqID_3110
  Gene classification: Gene name=GadB; Function=Glutamate decarboxylase and related PLP-dependent proteins; Function class=E Amino acid transport and metabolism
  Homolog annotation: Query=20..324bp; Hit=57..364bp; Blast score=107; Percent Identity=27.0; E value=2e-23; Homolog= mlr4653 COG0076
MKDPIRDASLSAVKVASEIAYNYVSKVRNQRVFPDSGALSGLQNLDRPLPQHGTDCQQVLAQLHRYGSPATVATTGGRYFGLVVGGSTPAAMGANIVTSAWDQIALMESSSPVADQLEKIAGRWVLELLNLPPEAFVGFVTGTTMAHVSALAAARQYLYQKKGYDFAEHGLQNAPQLKVVLSEEVHISVLKALRLLGFGRSQLNIVPCDSQGRIIESAVPEFSDNTILVLQAGNVNSGSSDNFHALIPRAKKAGSWVHVDGAFGLWARASSAQSALVKGVEEADSWAVDAHKWLNTPYDCGMCIVRHKHALREVMTTSAAYVETQDMW

SEQ ID NO: 9219 - protein, 307 aa, Xenorhabdus bovienii
  Coding DNA sequence: Name=SeqID_3111
  Gene classification: Gene name=AraC; Function=AraC-type DNA-binding domain-containing proteins; Function class=K Transcription
  Homolog annotation: Query=10..305bp; Hit=28..326bp; Blast score=228; Percent Identity=41.0; E value=5e-60; Homolog= PA2047 COG2207
MSALHHHSGATEIEIQLQQLIGKVASLTRPNTHAAKTAIPEMTLCHLEQPTAPVGWLYEPSIMIIAQGKKRITIGGCSYCCDASQFMVTSTDIPTITQVCTASKEEPFFAMMLQFNIQEASELLIENHVAIRQDSPETCGLAVTPVTAELLVCFNRLLDLLNTPEDIPVLSPLIQKEIVYRLLKSELGGRLQQMASQESPSHQISKTINWLKDHFADPIKVEQLAQIARMSPSSFHHHFKAVTSMSPLQYQKWLRLNEARRILLTQHHNVSATAFQVGYESPSQFNREYSRLFGEPPCRDIKRLRVR

SEQ ID NO: 9220 - protein, 41 aa, Xenorhabdus bovienii
  Coding DNA sequence: Name=SeqID_3112
MMINQSPSNDLDKTLNAKTISLWRIRQRLEITGHPSGQNWI

SEQ ID NO: 9221 - protein, 194 aa, Xenorhabdus bovienii
  Coding DNA sequence: Name=SeqID_3113
  Gene classification: Gene name=MdaB; Function=Putative NADPH-quinone reductase (modulator of drug activity B); Function class=R General function prediction only
  Homolog annotation: Query=5..190bp; Hit=3..188bp; Blast score=243; Percent Identity=59.0; E value=6e-65; Homolog= PA2580 COG2249
MIITHILVINSAKEFGESKGELNNALTEIIKDHLTGMGHEIQITHVDKGYDIQAEVDKFIWADSVIYQMPGWWMEAPWILKKYVDEVFSAGDGTLFQDDGRTRSDLTKKYGSGGLSQGKTYMFSVTWNAPLESFEDPEQFFEGKGINNVYYPFHKANQFLGMSPLPTFACYDVVKQPQIAQDIKRLKMHLSDHY

SEQ ID NO: 9222 - protein, 551 aa, Xenorhabdus bovienii
  Coding DNA sequence: Name=SeqID_3114
  Gene classification: Gene name=MdlB; Function=ABC-type multidrug/protein/lipid transport system, ATPase component; Function class=Q Secondary metabolites biosynthesis, transport and catabolism
  Homolog annotation: Query=13..536bp; Hit=12..542bp; Blast score=340; Percent Identity=35.0; E value=2e-93; Homolog= PA2397 COG1132
MTLIAYLYRQSWILLLLSTISALISGFAGASVVSTISKGITETIELNSFLWSFFGICIIFFITKTLSEVILSHLTQATIYSLRLSLSAKILRAPYKKLNKLGRHGLLAVLTKDVDVFIQSFMLAPTAFGNITLIFACFGYLAWISWQLFVILILLCLVMMYIFYLLEKRPIRLMTEMRDQVDRLYLNFQSLIDGSKELQLNTQKGDAFIDKVISPGARKFKEICIKATTGYAWVLNASSIAFYMIIGIMVFVVPIWLPQDPASLVTVTLVVLFLAGPISEVVGAIPELREAEISLNKMRQLDSDLDEGQENQSVQGDTPNPFLSEKPLVLELKDIVHHYTTDKEDRQFMLGPLSLKISQGEIVFIVGGNGSGKTTLAMMLVGLFEQESGSIWLNGVKMDASNNVHYRQFFSAVFSNYHLFDQLLNTGTDVTEKATHYIQALNMGHKVKIIDGKFSTTELSAGQRKRLALVAAYLEDRPLYLFDEWAADQDPVFKRLFYTELLPELRSRGKTVIVISHDDAYFDIAERVIKLEDGNIKEINNHSHETITELK

SEQ ID NO: 9223 - protein, 32 aa, Xenorhabdus bovienii
  Coding DNA sequence: Name=SeqID_3115
MVSCVLLMYLILLQVMCIFVVNNLYYIIILIM

SEQ ID NO: 9224 - protein, 46 aa, Xenorhabdus bovienii
  Coding DNA sequence: Name=SeqID_3116
MPSLEKEWHILKKLISKFHFVQKIYFDFFMTFERMNYILNQCILHG

SEQ ID NO: 9225 - protein, 1089 aa, Xenorhabdus bovienii
  Coding DNA sequence: Name=SeqID_3117
  Gene classification: Gene name=EntF; Function=Non-ribosomal peptide synthetase modules and related proteins; Function class=Q Secondary metabolites biosynthesis, transport and catabolism
  Homolog annotation: Query=12..1061bp; Hit=6..1021bp; Blast score=676; Percent Identity=38.0; E value=0; Homolog= PA2402_3 COG1020
MNHPEKLKPFALSEAQSSRWFQYQINPSQRGRNNGAFCARVEGLNAQDLEDALNHLIKRHPMLRASFGLYDGELGYRIAENSEIKVQTHDARHLSEDTLQQLVFDDCRHVLDLENPLRFYASWYQCNAQESVMVLTFDHLVVDGWSYWLLLEELGMILTSQELEPISEHSYQDYVSWQQQWLNSKSAKKQQQFWCDNLAGNLSALSWPMKIGSIQNGADNNAAPPATDKITAFGRIPDDLALKLCAMASEYGNSLFAIFLSAYQILLNRYTAQDDIVIGSMMPGRSQAKWGKLVGEFVNPVALRGQINGNVTVQEHILQTAKTIRQAIENQRYPFTKVLEQFKLQRTADTHPIFQTLMTFQKPRYVSELPTLWMDDDSSTTVHWGGAELRPFPHPLYADTPVPLMVNMMEVNQQIRCHFHYDPQVFDAELINQLIKNLITLLTAMADNQQQSIDSLPLMDEQELRQVLYDFNKTDKPFPQHALIHQLFEQQVERTPDAIALSCGDKALSYTELNQQANRLAHALIKAGIRPDNRVAICMERSLEMVIGLLGILKAGAAYVPLDPEYPTDRLGHILSDSDPALLLIHHGLQDHLPMTTMPVWVLESEEYRTNIASQPTDNPVATDLGLTSRHLAYVLYTSGSTGLPKGVMNEHRGVVNRLLWAQDEYQLTQHDRVLQKTPFSFDVSVWEFFLPLLAGAQLVMARPGGHKEALYLLEEIEARGITTLHFVPSMLQSFIHLTPAGRCPSLRQILCSGEALSYSLQQQCLAHFAHSELHNLYGPTEAAIDVTSWRCVPDQHIGLVPIGHPIDNTQIYILDKHDQPVPIGVIGEIYIAGAGVARGYLNKPELTAERFIRDPFSQHPDMRMYKTGDIGRWLADGSIDYLGRNDFQVKIRGNRIELGEIEARLAQSDGVQNVIVIAREYDAGDTRLVAYLIPKPGVTLSIPALREQVGGSLPDYMIPSAFVMLDAFPLTLNGKLDRKALPAPDHSAVLTREYAAPQGETEEQLADIWQRLLKIDRVGRNDNFFELGGHSLLMLQLQSRISENFDVELSIQQLFAHPTICQLEEHIIDAQLLQFDAESLQDLYKTMG

SEQ ID NO: 9226 - protein, 3316 aa, Xenorhabdus bovienii
  Coding DNA sequence: Name=SeqID_3118
  Gene classification: Gene name=EntF; Function=Non-ribosomal peptide synthetase modules and related proteins; Function class=Q Secondary metabolites biosynthesis, transport and catabolism
  Homolog annotation: Query=878..2165bp; Hit=1..1276bp; Blast score =950; Percent Identity=43.0; E value=0; Homolog= PA2400 COG1020
MNDNELISLPLAERKRLLELAKAAKLTRQQTQKTEIHAQPHDGNVPLSWAQQRLWFLTQLDPAAQTAYHMSAGLNLQGHLNQNALKAALDQIVARHEILRTTIVDVEGQPQQIIGSADSGFALSVQDLSQLPTTEQQAAVEECAQREALLPFDFTQGPLIRGRLLRLAEESHVLLLTQHHIISDGWSVNILMQELSTLYQAFCQDQADPLPALTLQYADYALWQRQWLQGDVLEKQLDYWRSELQGAPVILELPTDKPRPTQQSYAGSRVDITLPPALSTELKAFSQRHGITLFMTLLAGWAVLLSRISGQHDLVIGSPVANRQRHELEPLIGFFVNTLALRIQLGDNPSVSELLARVKNHALGAYAHQDLPFEQLVEALKPPRSLGHSPIFQVMLALDNTPGQQYFELDGLHLHELPRTRDSAYFDLTLTLNDTEQGLVGDLEYASDLFEHASIERMVGYLQTTLSAMVADDSLRVDDLPLLTSSQRTQLLANFNDTAIPYPKNALIHQLFEQQVERTPDKIALVWGETQLSYSELNQRANQLAHSIMASGVHPDDRVAICAERSLDMVIGLVGILKAGASYIPLDPNHPTERLAYMLSDSQPVLMLTQQHLKARLPVTNIPVWALDSEEHQTCIASQPKDNIDASQLGLTSQNLAYVLYTSGSTGLPKGVMIEHQNVVHLIHSQFQMSKLTPHDCVLQFASFGFDNSVAEIFPTFAIGATVVLRPDHIKVPDTEFITFLQNQGITVVDLPTAFWHLWAQEISAGYSWPPEQLRSVAAGGEKAEHRHLVTWLSSPGTQKCRWLNTYGPTETTVNATSIVIDKENLCTYEDIPIGRPIANTRIYILDQRGQPVPIGVNGEIHISGSGVARGYLNRSELTAERFIQDPFSDIPGARMYKTGDLGRWLPDGTISYSGRNDFQVKIRGFRIELGEIEAQLATCAGVKDAVVIVREDNSGDKRLVAYLIPQSGATLNVASLREQLSVNLADYMLPSAFVTLEAFPLNQNGKIDRSALPAPDRSASVSREYAEPQGEIEQQLAAIWQNLLGLERVGRYDSFFELGGHSLLTVQVASRLRQSLNIEITLQDLFTQPVLADLAQSLVTATQSTQPMILPANREQTLPLSWTQQRLWFLAQLDPAAQTAYNMSGGLHLQGHLNQNALKAALDRIVARHEILRTTIVQAEGKARQVIGDADGGFSLTVRDLSQLSSSAQQATIEECAQFEASHPFDFAQEPLIRAQLLKLGEQQHVLLLTQHHIISDGWSLNVLMNELSALYQAFGQGQADPLPALAIQYADYAVWQRQWLQGERLEKQLSYWRNELQDAPTLLELPTDKVRPSVQSYHGDQVTFTLSPELNSGLRALSQRHGATLFMTLLAGWGILLSRLSGQPDLVIGTPVANRQYSELEPLIGFFANTLVLRIKLEDNPTVSALLARVKAHALEAYAHQDLPFEQLVEVLQPPRSLSHSPIFQVMLALDNTSSKQSFELAELSLNPLALTRNSAHFDLTLALSDTENSLTCELEYASDLFERSSIERMAGYLQNLLAAMVADDNLRVADLPLLMPHERTQLLTDFNDTAVTYPQDKLLSQLFEQQVEHTPDAIALIWEDAQLSYAELNQRANQLAHALIAFGVQPDDRVAICIERNLNMVIGMLGILKAGAGYVPLDPEYPAERLAYILSDSAPKLLLTQQHLQAQLPVEKLPVWQLDDTGHLNSVAQQPTDNPDPRQLGLFPHHLAYIIYTSGSTGLPKGVMIEHHNVVNFTYSQCQTSELKPTDRVLQFASVSFDTAVSEIFPTLSVGATLILRPAHIRIPDATFSHFLQEQAISVIDLPTAFWHQWVQEMKAGRSGFSSHVRSVTVGGEKAEHRHFVTWQSMPETRHCRWIDTYGPTETTVSATALTLDGPASYVTESLSIGRPLINTHVYILDTQGQPVPIGVTGEIYIGGAGVARGYLNRPELTAERFVSDPFREQPHARMYRTGDLGCWRPDGTIVYLGRNDFQVKIRGFRIELGEIESQLAACTGVSDAVVVAREEGSGDKRLVAYLVPKSDVTLDAASLREQLSTHLAEYMLPSAFVILDAFPLNPNGKLDRKALPAPDHAATVSREYQAPQGEMEQQLAVIWQTLLGLEQVGRQDNFFELGGHSLLVVSLIEQLRQSSLNLDVSAVFSSPTLAAMAARLIVKTSDGATGTSVQNVPPNLITDGCQSITPEMLPLVALTQDNIDQIVAQIPGGVSNIQDIYPLGPLQEGILFHHLLETTGDTYLDNQLMTFDSRPRLDTFLLALQQVINRHDILRSAVHWNGLPEPVHVVHRQAPLPIAELTLSPEHDAEQQLRDATDSRSVRMDLTQAPLLSIKLAKDPHSETWFLALLHHHLVCDHLSLEMIFNEVQAMLLGQDDSLAPSLPYRNFIAQTRTVPLEKHQDYFHQLLGDIDEPTLPFGLLDIQGNSDEQSEIAEANFTLDNELARKIRDCARQQGVSAAVLFHVAWAQVVAQCSGRDDVVFGTVLLGRLQGGSGADQVLGMFINTLPVRVLLQERTVRQTVQETYQQLSLLLEHEQTPLAIAQRCSRVQAPQPLFNSLLNFRHSQRDDKQSASPAWEGIQILSGEERSNYPLSLDVDDFDDGFALTAQCNRQVDPARINTFMDTVLRELVAALQNVSEQSIQSLAVLPPDERTRLLVDFNNTAASYPQNVLLHQPFEQQVERTPEAIALIWEGTQLSYTELNQRANQLAHHLISSGVQPDDRVAICIERNLDMVISMLGILKAGAGYVPLDPAYPAERLAYILSDSAPKLLLTQQHLQGRLAVEDLPVWRLDDADHLSTVAQQPTDNPDSRRLELQPHHLAYIIYTSGSTGLPKGVMIEHRNVVNFTYAQCQVSELKSTDRVLQFASVSFDTAVSEIFPTLAVGATLILRPAHIQVPDTTFSDFLREQAISIVDLPTAFWHQWVQEMKAGRSGFSSLLRSVTVGGEKAELRHYLTWQSMPETRNCRWIDSYGPTETTVITTALALDNPTADASRAMETLSIGRPIANTRIYILDTRGQPVPTGVTGEIYIGGAGVARGYLNRPELTTERFVSDPYSEQPNARMYRTGDLGCWQPDGTIVYLGRNDFQVKLRGFRIELGEIETQLAACLGVKDAVVVAREEDAGDKRLVAYVIPQPDASLDAASLREQLSTHLTEYMLPSAFVILDAFPLTPSGKLDRKALPAPGRSASTSHEYEAPQGEIEPQLAAIWQTLLGLEQVGRHDNFFELGGNSLSIMRLSTHLREEFHLEIPIADIFHHSTLYKLAELILSRQIETFLAQDIESVQKELENLSEEELLAMLNGDQQ

SEQ ID NO: 9227 - protein, 3578 aa, Xenorhabdus bovienii
  Coding DNA sequence: Name=SeqID_3119
  Gene classification: Gene name=EntF; Function=Non-ribosomal peptide synthetase modules and related proteins; Function class=Q Secondary metabolites biosynthesis, transport and catabolism
  Homolog annotation: Query=43..1107bp; Hit=43..1098bp; Blast score =759; Percent Identity=42.0; E value=0; Homolog= PA2399_1 COG1020
MNINEQTLDKLRQAVLQKKIKERIQNSLSTEKYQIQPRTDPQQALPLSWAQQRLWFLAQLDPAAQTAYHIPAGLHLQGQLNQSALQATLGSLVARHEILRTTIALVEGKAQQIIGDADCGFALTIQDLSQLPEAEQQTTVEEYTQSEASHPFDFEHGPLIRGRLLKLSQDSHILLLTQHHIISDGWSINVLMQELSTLYHTFDQGLANPLPPLTLQYADYALWQRQWLQGEVLEKQLDYWCNALQDAPALLTLPTDRPRPPQQSYAGGSVEITFPATLNAQLKTLGQRHGTTLFMTLLAGWAVLLSRISGQKDLVIGTPVANRQHRELEPLLGFFVNTLALRVQLHDNPTVSELLAQVKAHTLNAYVHQDLPFEQLVEALKPPRSLSHSPIFQVMLSQENTPGQQNVELPGLTISELDLPENSSHFDLSLSLNDSENGLVGALEYARDLFDSSSIERMVGYLTTLLTAMTADDTLRVEALPLLMSQERTRLLVDFNETTVAYPKDILLHQMVEQQVERTPYAIALIWEDTQLSYAELNQRANQLAHALIDFGVQPNDRVAICAERSPDMIIGMLGILKAGAGYIPLDTEYPAERLAYILSDSAPKLLLTQQHLQARLAVDGLPVWRLDDISHLNAVAQQSTHNPELCQAGLLPHHLAYIIYTSGSTGQPKGVMIEHRNVVNFVHSQCQINELKSTDRVLQFSSVSFDTAVSEVFPTLSVGATLILRPAHIRIPDAAFGHFLQEQRISIAELPTAFWHQWVQEMKAGRSGFSSHLRSVTVGGEKAEHRHFVTWQSMPETQNCRWLDTYGPTETTVIATALTLNSHAARSFCAAETLSIGRPIANTQIYILDTQGQPVPIGVAGEIYIGGAGVARGYLNQPELTAERFVSDPFSEQPHARMYRTGDLGCWRPDGTIVYLGRNDFQVKIRGFRIELGEIEAQLADCSGVSDAVVVAREEGAGDKRLVAYIVPKSDVTLDAASLREQLSTHLAEYMLPSAFVILDAFPLNPNGKLDRKALPVPDRTAIISREYQAPQGETEQQLAAVWQNLLGLEQIGRQDNFFELGGHSLLVVSLIEQLRQRGLAVGVSAVFSAPTLAAMAAHLTDDAASDTRTQAVPPNLIPDDCQAITPEMLPLVTLTQDNIDQLVTRVSGGAANIQDIYPLGPLQEGILFHHMLETTGDTYLDSQLMTFDSRQRLDAFLLALQQVIDRHDILRSAVHWHGQPEPVQVVYHQAPLPVIVLALSPEEDAEQQLRRHTDSRSIRMDITQAPLMSANIAKDPHSETWLLSLLHHHLVCDHLSLELIFNEVQTLLLRQGEHLQPALPYRNFIAQTRSVPVEKHQAYFQQLLGDVDEPTLPFGLLDVQASNNEIAEAVLTLDDELAQRIRDCARQQGVSAAVLFHVAWAQVLAQCSNREDVVFGTVLLGRLQGGEDTTRILGMFINTLPVRVILQDRSVQQTVQETYQQLSQLLAHEQAPLAVAQRCSGIPVSLPLFNSLLNFRHSSDDDEQDLSLAWEGIQTLSGEERSNYPLSLDVDAFDDGFALTAQCSQQIDPARINAYMDIALKGLVAALQNQPEQSIQSVTILPPAERSQLLVDFNNTTVAYSQDKLLPQLFEQQVEHTPDSIALIWEDHSLSYTELNQRANQLAHALIAFGVQPDDRVAICIERNLDMVIGMLGILKAGAGYVPLDPEYPAERLAYILSDSAPKLLLTQQHLQARLPIEDLTVWQLDEASHLNSVAPQPTDNPDPRQLGLHPHHLAYIIYTSGSTGLPKGVMIEHHNVVNFTYAQCQNSELKSTDRVLQFASVSFDTAVSEIFPTLAVGATLILRPAHIRIPDATFSQFLQEQAISVADLPTAFWHQWVQEMKAGRSGFSSHLRSVTVGGEKAEHRHFITWQSMPETRHCRWIDTYGPTETTVSATALALDDPASYGMETLSIGHPLINTYIYILDTRGQPVPIGVTGEIYIGGAGVARGYLNRPELTAERFVSDPFSEQPHARMYRTGDLGCWRPDGTIVYLGRNDFQVKIRGFRIELGEIENQLAACAGVSDAVVVAREEGAGDKRLVAYLVPQSDVTLDAADLREQLSIHLAEYMLPSAFVILDTFPLNPNGKLDRKALPAPDHAASVSREFQAPQGETEQQLASVWQTLLGLEQVGRHDNFFELGGHSLLVVSLIEQLRQRNLTLDVSSVFSSPTLAAMAVRLAASDSDGSAGISVPPNLITDDCQVITPEMLPLVALTQTNIDQIVTQVSGGISNIQDIYPLGPLQEGILFHHLLETEGDTYLDNLLMTFDSRQRLDAFLLALQQVFHRHDILRSAILWDDLPQPVQVVYRQAPIPVTELTLSPEEEAEQQLRRHIDPRSVRMDITQAPLMSASLAKDPQSETWFLALLHHHLVCDHQSLEMIFNEVQAIMVGQSDNLPPSLPYRNFIAQTRAVPFEKHQDYFRQLLGDVDEPTLPFGLQEVYGEDSNIIEAEFDLDASFAQTLRECARQQGVSAAVLFHVAWAQVLAQCSGRDDVVFGTVLLGRLQGVAGADQTLGMFMNTLPIRIKLSTFNVQQVVRQTYRLLSELLEHEQAPLAMAQNCSGVTPPLPLFSSLLNYRHNQDDTQQTTLTAWEGIGLLNVDERTNYPLSLSVDDTAQGFTLVAQCVPELDPMRINHFMNTVLQGLVESLKNSPEQTCLQLNILPQEERTQLLRTFNNTREAYPQDQLIHQLIEQQVERSPTATALIYDDNQLSYDELNRRANQLAHYLIAFGVRPDDRVAICVERGLEMVIGLLAIMKAGAGYIPLDPEYPGERLSYMLSDSQPTVLLTQHSQQTRLSETDTPILILDSDEYQANIIHQPECNLPAADLGITSRNLAYVLYTSGSTGRPKGVMVEHIGVVNLLLSMKDRLKISVNDTLLTATTIGFDVAALELYLPLCNGSTCVIAPSLTARDPDQLAELITARNIKVMQATPTTWRMLLDSGWTGAAIKATSGGEALPHELAQRLKEKVSGLWNLYGPTETTICSTASGNLQTEPESRYTTLQITIGRPIANTQIYILDKNGHPVPMGVAGEIHIGGIGVTRGYFNRPDLTAERFVPDPFSDEAGAPADRRMYKTGDLGRWLPDGNIDYLGRNDFQVKIRGFRIELGEIEARLLACADIKEAVVMVREDTANDKRLVAYLVLQPEASLNPEKLRETLQASLASYMVPNAFVALDSFPQTPNGKLDRQALPLPDDSAVIAQVGYEAPVGGTENIIADVWQESLGLERVGRHDHFFELGGHSLLTLQVVVRLRQALGMDIAIRDLLIHPTINELAAYLQAKNPLSPPLAQQQNIVTIRKGNGKSSLFFIHPAGGDVQYAYDLTAYIDDKDRSIYGIIASDTFGEENARLTISEIAKEYVACLRQTQIQGPYDLAGWSVGGTIAYEMACQLMAEGEAVNFVGLFDSGASYQDAFSLEEKQAGLPFNETATLLEVLPENMPTSLHDEIQRLAENHDCEAILMLAQQNDLFPASENIRHQLHLYHNISVAAYHYIPSTATVDVTLFRATEDNDQSSHALGWEAVIPKERLTVVPINGSHESIMEPPRIQDVGKALLSAMTTPRGH

SEQ ID NO: 9228 - protein, 538 aa, Xenorhabdus bovienii; identical to SEQ ID NO: 8321
  Coding DNA sequence: Name=SeqID_3120
  Homolog annotation: Query=1..538bp; Hit=1..538bp; Blast score=821; Percent Identity=74.0; E value=0; Homolog= ref|NP_927678.1|

SEQ ID NO: 9229 - protein, 84 aa, Xenorhabdus bovienii; identical to SEQ ID NO: 6530
  Coding DNA sequence: Name=SeqID_3121
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 9230 - protein, 83 aa, Xenorhabdus bovienii; identical to SEQ ID NO: 6529
  Coding DNA sequence: Name=SeqID_3122

SEQ ID NO: 9231 - protein, 91 aa, Xenorhabdus bovienii; identical to SEQ ID NO: 6528
  Coding DNA sequence: Name=SeqID_3123
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 9232 - protein, 76 aa, Xenorhabdus bovienii
  Coding DNA sequence: Name=SeqID_3124
  Homolog annotation: Query=8..70bp; Hit=125..187bp; Blast score=62; Percent Identity=52.0; E value=2e-09; Homolog= ref|NP_718581.1|
MEDSRVMASEILRSFEIHVFSKIGKLPHDEVILHVWLALIEDVAKRTPSIGARILTYSKRAHKWAVRRGIQWAGCE

SEQ ID NO: 9233 - protein, 82 aa, Xenorhabdus bovienii
  Coding DNA sequence: Name=SeqID_3125
MHYDINLDGRLITRAACAARTPRAPSGPRFNGRIASGSASPINPAPCANLNKVGLFTTCPLYPPPNSPFMCPLRICQYTRSY

SEQ ID NO: 9234 - protein, 110 aa, Xenorhabdus bovienii
  Coding DNA sequence: Name=SeqID_3126
  Homolog annotation: Query=2..110bp; Hit=3..112bp; Blast score=85; Percent Identity=40.0; E value=2e-16; Homolog= ref|NP_037711.1|
MIKTFDFPARVGAAGEFEPVVRSVQFGDGYKQTSGDGINSQRESWLLSFVGVLPEIEPIMAFLREHQGWRSFKWRNPLSELGLYQAGKFNIQANGAYFTLSVTFTRVYHP

SEQ ID NO: 9235 - protein, 245 aa, Xenorhabdus bovienii
  Coding DNA sequence: Name=SeqID_3127
  Homolog annotation: Query=1..245bp; Hit=1..250bp; Blast score=332; Percent Identity=62.0; E value=3e-90; Homolog= ref|NP_405670.1|
MTINATLQRLEPGSKILLFSVDGSAFGGPELYFHNHPIPYTEDELENSDQLPMKSIWWQGQEYKPWPVKIEGLGVSSDGSAASPTLSVANIDGTISAMCLAYQNMAQARVTVHMTFAHYLDARNFPEGNPEADPTQEKIDVYYIDSKTHEDNTEIHFALSSPADLQGIRIPTRQIHSLCTWCMRGLYRKSPCNYMGDRYFDEDGNPTHDPSRDSCGGLMSDCKARHGEAAQLPFGGFPGSALLRK

SEQ ID NO: 9236 - protein, 180 aa, Xenorhabdus bovienii
  Coding DNA sequence: Name=SeqID_3128
  Homolog annotation: Query=1..180bp; Hit=1..178bp; Blast score=212; Percent Identity=62.0; E value=3e-54; Homolog= sp|P16454|AIL_YEREN
MKKLVLASLVAAGMSIVSMGACAAGESTISAGYAQSHVKSGGDKLKENPKGFNIKYRYEFDNNWSVIGSLAYTHQGYEYYYGGHKTGTVDLDYYSLTAGPAYRINEYVSAYGLVGSGHGKVEAKNKINGSSHSENKTELAYAAGLQINPIPNIAIDASYEYSKLGEVKVGTWMIGVGYRF

SEQ ID NO: 9237 - protein, 150 aa, Xenorhabdus bovienii
  Coding DNA sequence: Name=SeqID_3129
  Homolog annotation: Query=3..150bp; Hit=250..397bp; Blast score=216; Percent Identity=72.0; E value=1e-55; Homolog= emb|CAC83041.1|
MVRKSQVKDGRSAAMEPWLIFTSMDDFKPRQVMKIYSRRMQIEQNFRDEKSERFGFGLRASYSHGAGRLSVLSLLATLSSVVLWLIGFYAENKGIHLNYQANSIKSRRVISHLTLAENVLRHSPLILFEIVLNNTLKYLAKIYQNMVLIY

SEQ ID NO: 9238 - protein, 163 aa, Xenorhabdus bovienii; identical to SEQ ID NO: 7546
  Coding DNA sequence: Name=SeqID_3130
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 9239 - protein, 117 aa, Xenorhabdus bovienii; identical to SEQ ID NO: 7849
  Coding DNA sequence: Name=SeqID_3131
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 9240 - protein, 71 aa, Xenorhabdus bovienii; identical to SEQ ID NO: 8647
  Coding DNA sequence: Name=SeqID_3132
  Homolog annotation: Query=1..71bp; Hit=122..192bp; Blast score=108; Percent Identity=74.0; E value=3e-23; Homolog= emb|CAC83041.1|

SEQ ID NO: 9241 - protein, 112 aa, Xenorhabdus bovienii; identical to SEQ ID NO: 8648
  Coding DNA sequence: Name=SeqID_3133
  Homolog annotation: Query=1..112bp; Hit=11..122bp; Blast score=199; Percent Identity=83.0; E value=9e-51; Homolog= ref|NP_085189.1|

SEQ ID NO: 9242 - protein, 49 aa, Xenorhabdus bovienii
  Coding DNA sequence: Name=SeqID_3134
MTYFTYRHSSDLIDLVEQSVDHTTLCLSIFWGFLRAYSWLIVYIRNIHK

SEQ ID NO: 9243 - protein, 419 aa, Xenorhabdus bovienii
  Coding DNA sequence: Name=SeqID_3135
MTINFHKEIWEGFDEKTNHGKTPFLFESILPLNEGFSNHETVKNAFYNLCNKSNLLKTDCRLRIYDGEKRRDDLVEKLSSETILSDETLIHFMQRLSGKERFSLVINNLEQSCPKLAADFGLFAQSFFAYKGIPIGGIEQATFCGNYSGTAFGIHEGFEHAFLCHLGPGIKYFYCWSRELYLEITGSREPTFSDSELYDKLIEKGTLYILKPGDALYLPASVYHVGRQEEFSVSIALPFYTYPLSRFMALKILPALSKKSLPFDQEGMSELINFDNNQFDTEPLSTLLTETINKWLQQDLPKYLHYYWHRLRSNGGWELPTAINADPLKEPEHQNDLIINPDSQVSLQAPFIVSYEHGLDCSSDEIRVFIATKSVILPASSETLKLLDTLNTRQPITINSEEIYTSLKTLIVTGGLLSH

SEQ ID NO: 9244 - protein, 283 aa, Xenorhabdus bovienii
  Coding DNA sequence: Name=SeqID_3136
MYRNFPALVDDYLNKNIPTRNLINSIISEGKAKVDGNELIDKHFDPMIAIIYNQIKDLINPSNLSKEEAKLYIGELSVFARYNSTMLLRAADNIRGFCPEFAQELTRNFLEEGGERGKLPAHYVVFSGALIADLDFRVNGWMPRTSSTRALISLIDILTWSHCPSTVLGMYYATEAIAIAETLLLQDITNRLGQITGQGTGNSLKKLDFYYRMHLDETHSAATDNVAVERGHQEGIARFIRDADLFHFQQPQIVDGFLQMLTPFVDQWVEIHHLTRTDHCYSH

SEQ ID NO: 9245 - protein, 128 aa, Xenorhabdus bovienii
  Coding DNA sequence: Name=SeqID_3137
  Gene classification: Function=Uncharacterized ACR; Function class=S Function unknown
  Homolog annotation: Query=6..101bp; Hit=9..101bp; Blast score=66; Percent Identity=39.0; E value=7e-12; Homolog= mlr7801 COG3791
MKKVEYSGGCLCGHIRFIATGEAGNPHTCSCSMCQQHSGGLTLCWIEFPKAAVHWNGPGGVPSVFRSSDYSSRAFCSQCGSSLGAIDDGPTVGLLLGNFDSKNKKNLRPVSHSFISSRPRWWKIDTQS

SEQ ID NO: 9246 - protein, 295 aa, Xenorhabdus bovienii
  Coding DNA sequence: Name=SeqID_3138
  Gene classification: Gene name=LysU; Function=Lysyl-tRNA synthetase class II; Function class=J Translation, ribosomal structure and biogenesis
  Homolog annotation: Query=9..273bp; Hit=192..486bp; Blast score=96; Percent Identity=27.0; E value=4e-20; Homolog= DR0372 COG1190
MLNSPILYKAAMIRRIRTFLDSQEFIEIMTPVMRRYSGDDSRPRLSLHNGGWLRESSAFALRYNLQYYDRIYEIGPSFRPDAVDDTHLPAFTMLDLYKKDSTLDEMLQLAQSIIEIFYQGKISVLSFADHLKQRFSVDFFEDFSASEIFIDCLREMYCDKTTPPLNLIDRYIIENIEPLSQQCCIIVTDFPLLTEIRAKKRTGTKGIVERFEILINGIEIVHGYTDEDDVERFETQARKRNMFGSEDEVMCTMMRNKLVSPSSAGFAIGIERLCQVALGEKQISAFATSRPFSPF

SEQ ID NO: 9247 - protein, 536 aa, Xenorhabdus bovienii
  Coding DNA sequence: Name=SeqID_3139
  Gene classification: Gene name=PotD; Function=Spermidine/putrescine -binding periplasmic protein; Function class=E Amino acid transport and metabolism
  Homolog annotation: Query=204..533bp; Hit=15..344bp; Blast score=324; Percent Identity=46.0; E value=2e-88; Homolog= mll2885 COG0687
MVTFNEWFIMAFSIALVLIVPGPTNTLLLSAGLQQGLSKSLILVIAEAIGYTVAIAIWGFFLLSLTQTLPWMYQLVKLLSATYVLWLAFKLWMYSLKMDYFTDNEVNLINIFAHKGTNFVDVMVATFLNPKALLFVSTFIPISAFKSVNTFFPMLGVFLIILVPIGTLWISFGSLIHSYKYLRRFTAIFLRISSVILILFSFSLTYSGIAKAESSLVLYNWQSYTSPEMLQKFKKEHNISITLLEYKSNEEALESIQLGKIDADLAVVADNFLLHWINAGLLQPIDAQSMTNFKNITPRWRTSPADPQRTYGIPWSWGIVGTVVHTDVYDGDINTWKVVLEPPTSLFGTINVGSDMNDLIYAAIRYHGGKICDSNPKLLEKVKKTLLEAKKHWAAMEYGSVNMMASGKFKAGIDWNGAALRQRRINSHIQFGLPREGVLIFSDNLVILKKSKNYENARLFLNFIMQPENAALNSAFHGYDSTIEGADKYLPLWMKNAPELKIPEHVLKNSDHSVMCSPFVQKEYLNIWQQLLKISY

SEQ ID NO: 9248 - protein, 347 aa, Xenorhabdus bovienii
  Coding DNA sequence: Name=SeqID_3140
  Gene classification: Function=Predicted periplasmic binding protein; Function class=R General function prediction only
  Homolog annotation: Query=1..337bp; Hit=15..350bp; Blast score=237; Percent Identity=41.0; E value=1e-62; Homolog= VCA0144 COG2358
MTVKKVTKTKLLLATLAAMAVIIIAVAGKLENANKRFLSVATASTGGTYYPMGVGLANIWSNHLKNEHIQVTGQSSAGSIENIDLLQKDEAQLAILQSLIAFEAYQGVRHFENRPYHDLRSISVLWPNVEHFALLEDKIKEGTLNDIAGTHFSVGPQASGTEQSTLIILQGVNLSKKDIRPEYLGYGDTVSAMRDGRLEGGALPAGVPASAVTDMYASGVPSRILNVTDDQLAKINTIADSWFRFVIKPETYPRQIQPVHTIAQPNILMTTRKIDEKTIYELTKVLFENLKKVQQIHSAAKYITSENALKGVSVPLHIGAYRFYRERGLDIPDNLVPPEAKLTATQP

SEQ ID NO: 9249 - protein, 658 aa, Xenorhabdus bovienii
  Coding DNA sequence: Name=SeqID_3141
  Gene classification: Function=Integral membrane protein, possible transporter; Function class=S Function unknown
  Homolog annotation: Query=10..629bp; Hit=13..633bp; Blast score=394; Percent Identity=44.0; E value=1e-109; Homolog= BH2945 COG1593
MSTDTLTSSSPHELDKEAGSGSRHLSGIYLKLTAILAIVISLYAIYSNALSNTQEFYRNATFLGGILILGFILFPLSKRYATPKFNRWDYLFILLTLLSYGYFYFTYVDLHVVRNSIPDTLDYVMAVIGIGVLFEAARRTTGYFIPGLSLFAIIYALFGQYFIGIFGHAGFSLERLLFRLFMTSEGIFGITLSTASTAIIVFILFGAFLSVSGATALFNDLALAIAGRRRGGPAQVAVISSALTGSLSGSAVANVATTGTFTIPLMKSIGLSPRFAGAVEAAASTGGMIMPPIMGAAAFIMAGFLGISYTTIVMAAIIPALLYYAALIIAIDLEAKKQGLQGISKENIPQVKTVLKARGLLLLPLFIVIGILLMGKTPIYAGFLGIITIIIASWITPDTSARMTPKKIAKALSEAARGSIQVTIACAAIGVIICVVTMTGIGSTLAFNIVSLTDNTLWMILLVVMVVCIVLSMGLPSTALYIVVSVTVSPILIKAGVLPLAAHFFVFWFGVLSNITPPVALASYTAASIARSDPIQTSWSAVRLALPGFIIPFILVYNPALLMQGNDLNVLSIIYMIMTALIGIYSLSVATANFWMIKTHWLERIFFAIAAILLIKPGMLTDLAGVIFIATAGVVHRLRYNRQRAFPLELIRKNNKNV

SEQ ID NO: 9250 - protein, 396 aa, Xenorhabdus bovienii
  Coding DNA sequence: Name=SeqID_3142
  Gene classification: Function=Predicted dehydrogenase; Function class= R General function prediction only
  Homolog annotation: Query=2..388bp; Hit=4..390bp; Blast score=409; Percent Identity=54.0; E value=1e-114; Homolog= sll1495 COG0579
MYDVIIIGAGLVGLGTANALQEHHPSLRLLVLDKENGAAAHQSGHNSNVVHSGIYYPPGSLKARLAKQGNRSIYTFCQQHGLYHDRCGKMIVATQPKELPLLENLYQRGLQNGLDVSRLSQAELKEREPYVNGIEAILVPDAGIVNYPEIAAKLAEIIQARGGDIHYQQQVQNIREHNGYVEVQTQQTHYQAKWLVNCAGLHSDRIAQLAGYDTGMKIVPFRGEYYVLNSSKNYLVNHLIYPVPNPDFPFLGVHFTRMYNGKRDVGPNAVLAFKREGYRKTDFSPRDLAEVLTYKGFWKIASRYFGEGVAEMRRSFSRQLFTENARQLIPDLQPEDVTPGPAGVRAQALTADGKLVDDFHFVVGRRSLHVCNAPSPAATASMEIGREIVRRYFAEL

SEQ ID NO: 9251 - protein, 57 aa, Xenorhabdus bovienii
  Coding DNA sequence: Name=SeqID_3143
MLVSIFYAGKQYKYRAVDSHKYEGDGIGMTTLVPSNSSYEMKSNDYTLHTDVMVRDN

SEQ ID NO: 9252 - protein, 118 aa, Xenorhabdus bovienii
  Coding DNA sequence: Name=SeqID_3144
  Gene classification: Function=Predicted transposase; Function class=L DNA replication, recombination and repair
  Homolog annotation: Query=1..74bp; Hit=208..281bp; Blast score=119; Percent Identity=72.0; E value=4e-28; Homolog= Z4330 COG3335
VSYVGGNNKDSSLFIKLLAHLKAAYRRAKSITLIVDNYIIHKSQKTQEWLAQNPKFKLIYQPIYSPWINHIEKLGLALHETITRNHCCCYMWQLLRKVRGFMNTVSPFPGNKHGTAKV

SEQ ID NO: 9253 - protein, 269 aa, Xenorhabdus bovienii
  Coding DNA sequence: Name=SeqID_3145
  Homolog annotation: Query=1..232bp; Hit=3..232bp; Blast score=194; Percent Identity=41.0; E value=1e-48; Homolog= ref|NP_417941.1|
MKELVDVFSDFPDPRCQGKVKHRVIDILVIAVCAVIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDSHGRTVRRRGWVLPLTSETNEYGDKSSGMIFIAGFLDSFLH

SEQ ID NO: 9254 - protein, 38 aa, Xenorhabdus bovienii
  Coding DNA sequence: Name=SeqID_3146
MDDFFGLAINQIVQFGLSSLQVIYPSFRTSFLGHAPNS

SEQ ID NO: 9255 - protein, 91 aa, Xenorhabdus bovienii; identical to SEQ ID NO: 6528
  Coding DNA sequence: Name=SeqID_3147
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 9256 - protein, 83 aa, Xenorhabdus bovienii; identical to SEQ ID NO: 6529
  Coding DNA sequence: Name=SeqID_3148

SEQ ID NO: 9257 - protein, 44 aa, Xenorhabdus bovienii
  Coding DNA sequence: Name=SeqID_3149
MNLTLRTRIKRLNRKTICYSKSEILHDKIIGTFIEREYYLARII

SEQ ID NO: 9258 - protein, 107 aa, Xenorhabdus bovienii
  Coding DNA sequence: Name=SeqID_3150
  Gene classification: Gene name=XerC; Function=Integrase; Function class=L DNA replication, recombination and repair
  Homolog annotation: Query=1..66bp; Hit=3..68bp; Blast score=70; Percent Identity=53.0; E value=3e-13; Homolog= VCA0281 COG0582
MAITDSWLRSINGKPQEIMITKSDRDGLSVRVTPKGKVIFQFRYRWDGKGDRIDIGTYPATSLKDARDSVTSYRGELEQHRNPKIVKRVRKESALNAMTVEGHAPNS

SEQ ID NO: 9259 - protein, 214 aa, Xenorhabdus bovienii
  Coding DNA sequence: Name=SeqID_3151
  Gene classification: Function=Predicted phosphatase/phosphohexomutase; Function class=R General function prediction only
  Homolog annotation: Query=1..213bp; Hit=8..220bp; Blast score=263; Percent Identity=60.0; E value=1e-70; Homolog= yniC COG0637
MAAIFDMDGLLIDSEPYWKQGEETVFGELGLDLSLANKLPDTLGLRIDKVVELWYQVSPWQGTSKKEVEQRIINHVIRLVKENRPLLPGGEYALNLCHKHGLKVGLASASPHNMLEQVLELFNLRHYFNVVVSAANLPYSKPHPEVYLQTASQLEVNPINCLTLEDSFNGMVETKAARMRSIVIPAFHHFDDPRWSLADIKLNSLEELTIKNIT

SEQ ID NO: 9260 - protein, 193 aa, Xenorhabdus bovienii
  Coding DNA sequence: Name=SeqID_3152
  Gene classification: Function=Predicted membrane-bound metal -dependent hydrolases; Function class=R General function prediction only
  Homolog annotation: Query=1..166bp; Hit=5..170bp; Blast score=176; Percent Identity=54.0; E value=9e-45; Homolog= ydjM COG1988
MTAEGHLLFSVASLVLAHQLEITPEIAQGDWLHMLPGVLLASLLPDIDHPSSTLGRLFRFISIPIARLCGHRGFTHSLLALMVGIILFQAEIPSGWPIPTDFFHAMIVGYISHLIADMLTPAGIPLLWPLRIRFCIPILRGKERKKAERFIAVLVVVIAILLPHHIDFSFIHHYFDKLQIDKLQIDKLQNLYK

SEQ ID NO: 9261 - protein, 463 aa, Xenorhabdus bovienii
  Coding DNA sequence: Name=SeqID_3153
  Gene classification: Function=Predicted Na+/dicarboxylate symporter; Function class=R General function prediction only
  Homolog annotation: Query=1..461bp; Hit=1..461bp; Blast score=576; Percent Identity=75.0; E value=1e-164; Homolog= ydjN COG1823
MNLPLVINVLVFVALLIILAKASSNKWSLSKKVVVALVVGVVFGLALNIIYGAHNVIVKESIKWFNIVGNGYVQLLQMVIMPLVFASILSAVARLHKASALGKISFLTIGTLLFTAAISALIGIIIANVFGLTAAGLIQGTQETARLSAIETNYIGKVSDLGVPQLILSFIPKNPFADLTGASPTSIIGVVIFAAFLGIAALQMLKDDHERGERALIAIDTLQAWAMKLVRLVMRLTPYGVMALMTKVVASSNIHDIAQLGNFVVASYIALGLMFVVHGGLLALTGINPIKFFKKAGPALTFAFTSRSSAASIPLNVETQTRRLGVPESIASFSASFGATIGQNGCAGIYPAMLAVMVAPTVGIDPFDPLWIATLVGIVTISSAGVAGVGGGATFAALIVLPAMGLPVTLVALLISIEPIIDMGRTALNVNGAMTAGTITSQLMGKTNKEILEQDEEVGLSQS

SEQ ID NO: 9262 - protein, 37 aa, Xenorhabdus bovienii
  Coding DNA sequence: Name=SeqID_3154
MNPGFMFTEYLLQAITEQITMALLYIFTTAKGFNTLI

SEQ ID NO: 9263 - protein, 294 aa, Xenorhabdus bovienii
  Coding DNA sequence: Name=SeqID_3155
  Gene classification: Gene name=HtpX; Function=Zn-dependent protease with chaperone function; Function class=O Posttranslational modification, protein turnover, chaperones
  Homolog annotation: Query=1..294bp; Hit=1..293bp; Blast score=441; Percent Identity=80.0; E value=1e-124; Homolog= ZhtpX COG0501
MMRIALFLLTNLAVMVVFGIILSLTGVQRSSVAGLMIMAGLFGFGGAFISLLMSKWMALRSVGGQVIEKPSNEMELWLMETVRRQSDQVGITMPQVAIYDAPDINAFATGARRNASLVAVSTGLLNNMSRDEAEAVIAHEISHIANGDMVTMTLLQGIVNTFVIFISRIIAQAASSFLSSNDNENEGSSNGNPIVYMVLSMVLEIVFGILASIITMRFSRYREFHADAGSAKLVGREKMIAALQRLKTSYEPQEEDRMMAFCINGKSKSFSELFLSHPPLDKRIEALRSGEYIK

SEQ ID NO: 9264 - protein, 40 aa, Xenorhabdus bovienii
  Coding DNA sequence: Name=SeqID_3156
MGIPPILFNFFKMLSDRINITLQCYKKGRLPSRPFICNEL

SEQ ID NO: 9265 - protein, 690 aa, Xenorhabdus bovienii
  Coding DNA sequence: Name=SeqID_3157
  Gene classification: Gene name=Prc; Function=Periplasmic protease; Function class=M Cell envelope biogenesis, outer membrane
  Homolog annotation: Query=44..685bp; Hit=31..676bp; Blast score=897; Percent Identity=68.0; E value=0; Homolog= prc COG0793
MNKLINLAFVLGLSFSGIGYANTANVIGSSTINGNNAPVITLSQLPDLKPEQQHSTVSKRIVSRFLRSHYRHFYLDVAFSGKVFDRYLNALDYGHNVFLASDIAQFAEQRGLLGKALENGDLRLPYALFNLMQKRRFERYQYVLSRLEQPVNLDGNDTFETERTKAPWSTSVEELNKLWDAKIKSDWINLKLSGKDDKEIKEILTKRYRTHLKRLNQSKSEDVFQIIMMAFAREIDPHTSYLSPSNTEQFNSEMSLSLEGIGAVLQYDDEYIAIRSLVGGGPAAKSNLLKDGDKIIGVGQAGKPIVDVVGWRLEDVVTLIKGPKGSKVRLEIIPSTKGAKNHIVTLTRENIRLEDNAVKMSVKTVGKEKIGVLDIPSFYVGLTNDVKIQLQKLTKQGVSSIVIDLRSNGGGALTEAVSLSGLFISTGPIVQIRDNTGRIKQDSDTDEAIYYKGPLVVLVDGRSASASEIFAAVMQDYGRGLIVGDPTFGKGTVQNHRSLNRIYDQMLKPDWPEIGSVQYTVQKFYRVNGGSTQLKGVTPDILMPTAEEPADIGESQEDNALPWDSIQPASYPFSKVISASVPLLTQLHNQRIANAPEFKYIKQDIAYYKLIKARNGVYSLNYAQREKENKEYESIKLNRINERFKREGKKPLKSLDDLPKDYKGPDPYLDESVQIALDLAHQPAEITLTK

SEQ ID NO: 9266 - protein, 240 aa, Xenorhabdus bovienii
  Coding DNA sequence: Name=SeqID_3158
  Gene classification: Gene name=ProQ; Function=Activator of osmoprotectant transporter ProP; Function class=T Signal transduction mechanisms
  Homolog annotation: Query=1..240bp; Hit=1..232bp; Blast score=251; Percent Identity=62.0; E value=5e-67; Homolog= proQm COG3109
METEPKLNSSKEVIAFLAERFPLCFAAEGEARPLKIGIFQDIVERIQGEECLSKTQLRSALRLYTSSWRYLYGVKEGAQRVDLDGNACGELEVEHIEHARQQLAEAKARVQAQRAEQRAKKRETENASDKKSEHPVNKKMAPRRQASGDGEKRSPRSQNRLQQSRKPADNVTRKIAQPRISQPELTSVTDVSSLKVGQTIKVNVGKSLMDASVLEIAKDGVRVQLPTGLAMIVRAEHLKF

SEQ ID NO: 9267 - protein, 33 aa, Xenorhabdus bovienii
  Coding DNA sequence: Name=SeqID_3159
MTSLLLFNLGSVSMKFPDYNGFANQRRHEQATL

SEQ ID NO: 9268 - protein, 165 aa, Xenorhabdus bovienii
  Coding DNA sequence: Name=SeqID_3160
  Gene classification: Function=GAF domain-containing protein; Function class=T Signal transduction mechanisms
  Homolog annotation: Query=1..159bp; Hit=19..177bp; Blast score=211; Percent Identity=64.0; E value=3e-55; Homolog= yebR COG1956
MDKHKFYQELSDSLMALLSGEYDLIASLANTSALLSDRLDDVNWIGFYLVDGNTLVLGPFQGKIACVRIPIGKGVCGTAVAKNSIQRISDVHAFPGHIACDAASNAEIVLPLEINGQIIGVLDIDSTVFERFDENDEHGLKALVIRLCKHLGQCVVPKYLQQNVT

SEQ ID NO: 9269 - protein, 124 aa, Xenorhabdus bovienii
  Coding DNA sequence: Name=SeqID_3161
  Homolog annotation: Query=7..118bp; Hit=4..115bp; Blast score=138; Percent Identity=67.0; E value=2e-32; Homolog= ref|NP_929921.1|
MSIRGMIMKRVYWVLAFLFFSFQSIAAPIQTVSKLQFGKQWAFTREEVMLDCRSDGALFVINPSTLMQYPLNDRATQLMESNKIIATSLNKILLDDPEHSNQKMSIEPFQKAALALCDNTRDKK

SEQ ID NO: 9270 - protein, 314 aa, Xenorhabdus bovienii
  Coding DNA sequence: Name=SeqID_3162
  Gene classification: Gene name=PcoD; Function=Putative copper export protein; Function class=P Inorganic ion transport and metabolism
  Homolog annotation: Query=8..313bp; Hit=6..289bp; Blast score=131; Percent Identity=33.0; E value=9e-31; Homolog= Z2888 COG1276
MISLEALYVLCRFFHFVVVMLMFGLSLFTAMLASGRFSVLMRERLRVGVSISTVLALITSIVWFIIQAGLMGDGWHDVYQFDIWLAVLGTTFGQVWKWQLLVAALAVACLFFFHTKTRNFLLLGCSVILLSSHAFIGHAAMHEGNIGLLLQANQIVHLLSAGYWFGGLWPFLLCLQFLRLKNTLNSNLYRDGTYSSYIVDKLSGESVAAMRKFSNYGHFAVFMVIITGIVSSIILIPDWPVFSTTISEYQSMLWLKIALVAGMVLLALINRYILVPRLNQKGSYEWLIMNSWLEIILATSVLLCIAIFATESPV

SEQ ID NO: 9271 - protein, 140 aa, Xenorhabdus bovienii
  Coding DNA sequence: Name=SeqID_3163
  Gene classification: Gene name=CopC; Function=Uncharacterized protein, homolog of Cu resistance protein CopC; Function class=R General function prediction only
  Homolog annotation: Query=27..140bp; Hit=11..124bp; Blast score=114; Percent Identity=50.0; E value=5e-26; Homolog= Z2889 COG2372
MKIHLYIKGLSIMSILSIRSFWAKLSALVVLFVGMSCQQALAHAHLKDQTPAENTTVEAAPQAITLSFSERIELGFSKVKLIGPEKKTVKTGKLELDSDTKTKLILPVEDKLAAGEYSVDWSVLSVDGHKTKGAYNFTVK

SEQ ID NO: 9272 - protein, 167 aa, Xenorhabdus bovienii
  Coding DNA sequence: Name=SeqID_3164
  Gene classification: Gene name=Ftn; Function=Ferritin-like protein; Function class=P Inorganic ion transport and metabolism
  Homolog annotation: Query=1..162bp; Hit=7..168bp; Blast score=228; Percent Identity=70.0; E value=2e-60; Homolog= VC0078 COG1528
MLKQEMVKKLNEQLNLEFYSANLYLQMSAWCSDKGYEGAAAFLRAHSQEEMQHMQRLFDYLGDTGAMPVLGAVQAPPVEFNSISDVFNQTYEHEKLITEEINKLAHVAMMTQDYSTFNFLQWYVAEQHEEEKLFKSILDKLGMVGESGKSLFLLDKDLKGLSVPAHA

SEQ ID NO: 9273 - protein, 76 aa, Xenorhabdus bovienii
  Coding DNA sequence: Name=SeqID_3165
  Homolog annotation: Query=1..76bp; Hit=1..76bp; Blast score=105; Percent Identity=77.0; E value=2e-22; Homolog= ref|NP_929925.1|
MVHNLAKLSKDEMDKVNVDLAASGVAFKERYNMPVIPDTVEQSQPQHLREYFQQRLNHYRQQSRYFSRLPYEPRSR

SEQ ID NO: 9274 - protein, 317 aa, Xenorhabdus bovienii
  Coding DNA sequence: Name=SeqID_3166
  Gene classification: Gene name=MhpC; Function=Predicted hydrolases or acyltransferases (alpha/beta hydrolase superfamily); Function class=R General function prediction only
  Homolog annotation: Query=3..317bp; Hit=4..318bp; Blast score=411; Percent Identity=62.0; E value=1e-115; Homolog= mlr7803 COG0596
MVELRKLYPAYDAYQTGYLDTGDGHQVYWELCGNPKGKPAVFIHGGPGGGIANYHRQLFDPECYHVMLFDQRGCGRSKPHASLENNTTWHLIDDIERLRNLMGVDSWLVFGGSWGTTLSLAYAQKHPSRVSELVLRGIFLLRTQELHWYYQDGASRFFPDKWERMISILSEEEREDVMDAYRKRLTSDDPEVQLEAARLWSLWEGETVTLLPSENANSFSEDKFALALARIENHYFVNNGFMDNTQQLLDHIDLIRHVPAAIIHGRYDMVCQLQNAWDLAKAWPEAELHIVEGAGHSFDEAGILHQLIKATDKFAGK

SEQ ID NO: 9275 - protein, 124 aa, Xenorhabdus bovienii
  Coding DNA sequence: Name=SeqID_3167
  Homolog annotation: Query=1..124bp; Hit=1..124bp; Blast score=158; Percent Identity=60.0; E value=1e-38; Homolog= ref|NP_929927.1|
MKANQFIHRIGLLGTGILLSVSLTTASAAENDHVAKFVSCKNLTKDQIAAQVKQDFLQNRIHHWDKDRKQLGTSKPIAWVNVNDMTGDRNALQVPLIVRGSQRDKSYNVTIDCQKDTINYSEVK

SEQ ID NO: 9276 - protein, 60 aa, Xenorhabdus bovienii
  Coding DNA sequence: Name=SeqID_3168
  Homolog annotation: Query=1..59bp; Hit=1..59bp; Blast score=67; Percent Identity=67.0; E value=6e-11; Homolog= ref|NP_405341.1|
MFSGMPALSHEEQQVAVERIHQFISEGMSSGEAIAIVAQELREKHQGKEQIHVLFEDDEK

SEQ ID NO: 9277 - protein, 456 aa, Xenorhabdus bovienii
  Coding DNA sequence: Name=SeqID_3169
  Gene classification: Gene name=TrpE; Function=Anthranilate/para -aminobenzoate synthases component I; Function class=E Amino acid transport and metabolism
  Homolog annotation: Query=10..450bp; Hit=11..451bp; Blast score=595; Percent Identity=64.0; E value=1e-170; Homolog= pabB COG0147
MKIALQKRLLPYSPDLATRYFAPLSVSPWAMLLHSGTAEHPHNRFDILVAEPVTTLITRGESTEINCNGEVSLSQEDPFLLLKKHLHIRNIALQFDPDYPFQGGALGLWGYDLGRKIEKLPSIAANELDFPDMAVGIYDWALIIDHHRQKATLLGYHNLDNRLAWLESQQKNRETNFSLSSQWQSNMTAQQYHEKIAQIHRYLRDGDCYQVNLSQRFHASYQGDEWQAFTQLNDSNRAPFSAFIRLPENCIISVSPERFLLLEDKQIQTRPIKGTLPRLQDPEEDYLQAKKLANSRKDRAENLMIVDLLRNDIGRVATPGSVKVPELFVVEPFPAVYHLVSTITATLPDEYQATDLLRACFPGGSITGAPKIRAMEIIEELEPHRRHGYCGAIGYISFCGTMDSNITIRTLLTEKGKIYCWAGGGIVADSIAEKEYQETFDKLGRILPQLGELHIP

SEQ ID NO: 9278 - protein, 189 aa, Xenorhabdus bovienii
  Coding DNA sequence: Name=SeqID_3170
  Gene classification: Gene name=MutT; Function=NTP pyrophosphohydrolases including oxidative damage repair enzymes; Function class=L DNA replication, recombination and repair
  Homolog annotation: Query=3..185bp; Hit=7..188bp; Blast score=162; Percent Identity=54.0; E value=2e-40; Homolog= ZyeaB COG0494
MTSLSDFIHRFQLQLPAQPADLANNQRNAAVLLPIICKPEPTLLLTQRAKNLRSHAGQIAFPGGAADPEDHSLIATALREAEEEVSIPHHKVQVLGQLAPLDSSGGYRVTPVVGLVSPSLSFRTNPTEVARIFEIPLFDALSLPHYQHLDIKSRKRQHRVYFYWYREQMIWGLTAAIIYRLAQQVQRSV

SEQ ID NO: 9279 - protein, 448 aa, Xenorhabdus bovienii
  Coding DNA sequence: Name=SeqID_3171
  Gene classification: Gene name=SdaA; Function=L-serine deaminase; Function class=E Amino acid transport and metabolism
  Homolog annotation: Query=1..448bp; Hit=7..454bp; Blast score=771; Percent Identity=83.0; E value=0; Homolog= sdaA COG1760
MFKVGIGPSSSHTVGPMKAGKQFVDDLVNQGVMSSITRVAVDVYGSLSLTGKGHHTDIAIIMGLAGNMPATVDIDSIPGFIRDVEQTQRLPLANGLHEVDFPRDGGMNFRNDNLSLHENGMQVHAFAGDEKIYSKTYYSIGGGFIVDEEHFGKPSQDTKPVSYPFSSAADLLMNCSKTGLSVSGLMMKNELDLHSREEIGEYFADVWNTMQACIDRGLNTEGLLPGPLRVPRRAAALHRMLTSSNNFSNDPMNVVDLINMFALAVNEENAAGGRVVTAPTNGACGIVPAVLAYYNHCIEPVTPNLYIRYFLASGAIGILYKMNASISGAEVGCQGEVGVACSMAAAGLAELLGASPEQVCIAAEIGMEHNLGLTCDPVAGQVQVPCIERNAIASVKAINASRMALRRTSEPRVSLDKVIETMYETGKDMNAKYRETSRGGLAIKVQCD

SEQ ID NO: 9280 - protein, 32 aa, Xenorhabdus bovienii
  Coding DNA sequence: Name=SeqID_3172
MRKQRIKNHNKIKTKAKILFSSLKTVHLNFSD

SEQ ID NO: 9281 - protein, 318 aa, Xenorhabdus bovienii
  Coding DNA sequence: Name=SeqID_3173
  Gene classification: Function=Phosphotransferase system, mannose/fructose/N-acetylgalactosamine-specific component IIB; Function class=G Carbohydrate transport and metabolism
  Homolog annotation: Query=159..317bp; Hit=1..159bp; Blast score=255; Percent Identity=79.0; E value=5e-68; Homolog= manX_2 COG3444
MIGTHGAAAEQLLHTAEMLIGEQENVSYIDFVPGENADTLFDKYNQKLESLNTEQGVLFFVDTWGGSPFNAANRIVVDKSNYEIITGVNVPMLVEAFMCRDDDPSMEELVSVALETGREGIRALKTEQAEETQKPEPVKPTAPTIAPASSPTVSGGGHMKIALARIDDRLIHGQVATRWTKETNVKRIIVVSDDVAQDTIRSTLLKQVAPPGVSAHVIDVAKCVRVYNNPKYAGERVMLLFTNPTDVLRIVEGGVSLESINIGGMAFRQGKTQINNAISVDSADIEAFEKLNSRGIELEARKVSSDTRLNMIDLLKKA

SEQ ID NO: 9282 - protein, 266 aa, Xenorhabdus bovienii
  Coding DNA sequence: Name=SeqID_3174
  Gene classification: Function=Phosphotransferase system, mannose/fructose/N-acetylgalactosamine-specific component IIC; Function class=G Carbohydrate transport and metabolism
  Homolog annotation: Query=1..266bp; Hit=1..266bp; Blast score=328; Percent Identity=84.0; E value=3e-90; Homolog= ZmanY COG3715
MEITVVQLLLIFIVACIAGMDSILDEFQFHRPLVACTLVGLVLGDMKTGIIIGGTLEMIALGWMNIGAAVAPDAALASIISTILVIAGGQDVGAGIALAIPLAATGQVLTIIVRTLTVGFQHAADKAAENGNLRAISALHISALMLQAMRIALPALVVALSVGTSEVQSMLNAIPQVVTSGLNIAGGMIVVVGYAMVINMMRAGYLMPFFYLGFVTAAFTDFNLVALGVIGVVMAILYIQLSPKYNQSQTAASAGNTSNDLDNELD

SEQ ID NO: 9283 - protein, 285 aa, Xenorhabdus bovienii
  Coding DNA sequence: Name=SeqID_3175
  Gene classification: Function=Phosphotransferase system, mannose/fructose/N-acetylgalactosamine-specific component IID; Function class=G Carbohydrate transport and metabolism
  Homolog annotation: Query=1..285bp; Hit=1..285bp; Blast score=457; Percent Identity=83.0; E value=1e-129; Homolog= manZ COG3716
MNNMSDTTNIGQKKLTQSDIRGVFLRSNLCQGSWNFERMQALGFCFSMVPVIRRLYPENTEERKQAIKRHLEFFNTHPYVAAPILGVTMAMEEQRANGADIDNGAINGIKVGLMGPLAGVGDPIFWGTVRPVFAALGAGIAMSGSMMGPILFFFLFNLVRLLTRYLGVAYGYKKGLDIVKDMGGGFLQKMTEGASILGLFVMGALVNKWTKVNIPLVVSEVPDPTTGVIKVTTVQTILDQLMPGLMPLLLTFGCMWLLRKKVNPLWIIMGFFVLGIVGFRFGFLG

SEQ ID NO: 9284 - protein, 152 aa, Xenorhabdus bovienii
  Coding DNA sequence: Name=SeqID_3176
  Homolog annotation: Query=1..152bp; Hit=1..152bp; Blast score=151; Percent Identity=66.0; E value=4e-36; Homolog= ref|NP_929935.1|
MSLNDIILMILVLLMLAFAIYDEFIINQFKGKTLLNIKLKRKHRIDALIFIVLISIVIYNNVIVQGNQLTTHLLLFIILVTIYLGYIRSPKLIFKKQGFYYANRFFQYKKINTMNLSEDGILMISFEKNNIYIAVNKLDDLEKIYQFLVNNR

SEQ ID NO: 9285 - protein, 62 aa, Xenorhabdus bovienii
  Coding DNA sequence: Name=SeqID_3177
MVLPTDLELIFIRLFRHSYHVLLQTSMLIRIFQKCFGTGYSPMTGKDNTRFKIKGKKYLVIY

SEQ ID NO: 9286 - protein, 206 aa, Xenorhabdus bovienii
  Coding DNA sequence: Name=SeqID_3178
  Gene classification: Function=Predicted membrane protein; Function class=S Function unknown
  Homolog annotation: Query=4..198bp; Hit=10..203bp; Blast score=202; Percent Identity=57.0; E value=2e-52; Homolog= Z2864 COG1971
MCIWNHPAEAMLMNLYATLILAFALSMDAFAAAVGKGAVLHRPRFREAIRTGIIFGLVEACTPLIGWFLGFYASQYIMEWDHWIAFSLLFMLGCRMVIESLKNNVQTTVESTPRRHSSTTLVITAIATSLDAMVIGVGLAFLQVDILHTAMTIGIITMIMATLGMLIGRYIGPLLGKRAELIGGLILIIIGFNILFEHLKLFMYAA

SEQ ID NO: 9287 - protein, 271 aa, Xenorhabdus bovienii
  Coding DNA sequence: Name=SeqID_3179
  Gene classification: Gene name=SmtA; Function=SAM-dependent methyltransferases; Function class=Q Secondary metabolites biosynthesis, transport and catabolism
  Homolog annotation: Query=1..270bp; Hit=7..277bp; Blast score=317; Percent Identity=57.0; E value=6e-87; Homolog= VC2003 COG0500
MSYQCPLCHSPLLFTHHQWRCENNHQFDCAKEDYVNLLPVQHKRSKEPGDSVEMMQARRAFLHSGYYQELQQKTIQLLDKYLPEGAGTLLDIGCGEGYYTAAVQAQLNLHRDMTVYGLDVAKIAVRYGAKRYPKVNFCVASSHRLPFADSSLDGILRIYAPCKATELARVVKPHGIVLTVTPGPRHLYQLKELIYQEVNLHPENKEQWEGFELISTEMLAYAMPLDGEQAHNLLQMTPFAWRASEQVKTNLMTEKLFNCEADFMLKVYRRI

SEQ ID NO: 9288 - protein, 186 aa, Xenorhabdus bovienii
  Coding DNA sequence: Name=SeqID_3180
  Homolog annotation: Query=8..179bp; Hit=6..176bp; Blast score=179; Percent Identity=52.0; E value=1e-44; Homolog= ref|NP_928808.1|
MIMPFDNLETERLLLRKLAYDDAPQIQQKFPYWEVVKYLDSNAVPWPYPDNGAEYFVNHIAMPEIQTGKVWIWSIRMKNNPDKLIGVIGLYDKPDNNRGFWLSPEYHGRGLMREASERVTDYWFNELDRTVLRTLKACINENSRKISLIQGMRLISTNKKQYVSGRYDSEMWEITKDEWLNKYSLP

SEQ ID NO: 9289 - protein, 127 aa, Xenorhabdus bovienii
  Coding DNA sequence: Name=SeqID_3181
MLNTFTNRGNMRFLANFISPLDARIVLGRMLSEGINAELIDENVVWNNYMYSQALGGVKLLVHNSDIEQAKNVITQIDRGCYQLDDSSENSPVSKNNVTDNTLNTFLSIALFLITGIAIPFKSSYFR

SEQ ID NO: 9290 - protein, 31 aa, Xenorhabdus bovienii
  Coding DNA sequence: Name=SeqID_3182
MLVFLVVIFKLLEIYFLILISSPKRIKKINA

SEQ ID NO: 9291 - protein, 67 aa, Xenorhabdus bovienii
  Coding DNA sequence: Name=SeqID_3183
MISAVSHQRRSSGNDPKLFHISPFYDDLINKTLISGSFYFNGFCCYYAKPRVRFYNAGVFSCHFQIA

SEQ ID NO: 9292 - protein, 525 aa, Xenorhabdus bovienii
  Coding DNA sequence: Name=SeqID_3184
  Gene classification: Gene name=GuaA; Function=GMP synthase - PP -ATPase domain; Function class=F Nucleotide transport and metabolism
  Homolog annotation: Query=207..525bp; Hit=1..319bp; Blast score=577; Percent Identity=86.0; E value=1e-164; Homolog= ZguaA_2 COG0519
MTTNIHQHRILILDFGSQYTQLIARRIREIGVYCELWTWNVTEEQIREFNPSGIILSGGPESTTENNSPSAPEYVFDAGVPVLGICYGMQTMSTQLGGKVGNSTEREFGYAQVEIKSDCELFRGIQDALSESGKPLLDVWMSHGDKVTVVPEGFITVASTDTCPFAIMVNDEKRFYGVQFHPEVTHTHQGLNILQRFVLDICQCEALWTSASIIDDIVERLRTQIGDDHVILALSGGVDSSVTALLLNRAIGKRLTCVFVDNGLLRLNEADQVMAMFEGKFDLNLVHVKAEERFLSALTGIDEPEAKRKTIGHVFIDVFDEEASKQTQVKWLAQGTIYPDVIESAASATGNAHVIKSHHNVGGLPDDMKLGLVEPLKELFKDEVRRIGLELGLPYDMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVSGISRVVYDISGKPPATIEWE

SEQ ID NO: 9293 - protein, 488 aa, Xenorhabdus bovienii
  Coding DNA sequence: Name=SeqID_3185
  Gene classification: Gene name=GuaB; Function=IMP dehydrogenase/GMP reductase; Function class=F Nucleotide transport and metabolism
  Homolog annotation: Query=241..487bp; Hit=1..247bp; Blast score=424; Percent Identity=87.0; E value=1e-118; Homolog= PM0295_3 COG0516
MLRIKKEALTFDDVLLVPAHSTVLPNTADLSTQLTSTIRLNVPMLSAAMDTVTESALAIALAQEGGIGFIHKNMPIERQAEEVSRVKKHESGVVTNPVTVTPQTTLREVHELTKRNGFAGYPVVTEENELVGIITGRDVRFVTDLDQPVTAVMTPKERLVIVKEGEAREVVLQKMHEKRVEKALVVDDSFHLLGMITVKDFQKAERKPNACKDEEGRLRVGAAVGAGAGNEERVDALVAAGVDILLIDSSHGHSEGVLQRIRETRAKYPDLQIIGGNVATGEGAKALFEAGVNAVKVGIGPGSICTTRIVTGVGVPQITAIADAVDALEGTGIPVIADGGIRFSGDIAKAIAAGASCVMVGSMLAGTDESPGEIELYQGRSFKSYRGMGSLGAMSKGSSDRYFQTDNAADKLVPEGIEGRVAYKGLLKSIVHQQMGGLRSCMGLTGCATIDELRTKAEFVRISGAGIQESHVHDVTITKESPNYRLGL

SEQ ID NO: 9294 - protein, 455 aa, Xenorhabdus bovienii
  Coding DNA sequence: Name=SeqID_3186
  Gene classification: Gene name=XseA; Function=Exonuclease VII, large subunit; Function class=L DNA replication, recombination and repair
  Homolog annotation: Query=3..453bp; Hit=2..453bp; Blast score=543; Percent Identity=65.0; E value=1e-154; Homolog= xseA COG1570
MSLPTNTGIFSVSRLNQTVRQLLELEMGRIWLSAEISNFSQPSSGHWYFTLKDERAQIRAAMFRSSNLRATFRPQNGQQVLVRAQITLYEPRGDYQLIVESIQAAGDGLLQQQFEVLKQKLTSEGLFDSIHKKPLPSPAKRLGVITSASGAALHDILNILKRRDPSLPIIIYPTAVQGAEAPLQIIRAIELANDRQECDVLIVGRGGGSLEDLWCFNDEQVARAIFQSRIPIVSAVGHETDVTIADFIADLRAPTPSAAAELVSRNQIELLRQVQSLQQRLEMAMDYFFAQKLRIFNTLQHQLQQQRPDLRLARQQNKLVELRQKLVDSFLRCLKQHSLSHEKLNLRLLQTNPDQQIRHDSQQIQQYDFRLKQAIERQLGHYREKFAVSCSQLNAVSPLATLQRGYSISETSDGTLLKETKQVKVGDTLNTRLQDGWVKSQVIQVKRQTKREKSQ

SEQ ID NO: 9295 - protein, 752 aa, Xenorhabdus bovienii
  Coding DNA sequence: Name=SeqID_3187
  Gene classification: Gene name=CirA; Function=Outer membrane receptor proteins, mostly Fe transport; Function class=P Inorganic ion transport and metabolism
  Homolog annotation: Query=19..752bp; Hit=11..755bp; Blast score=411; Percent Identity=35.0; E value=1e-114; Homolog= Cj0178 COG1629
MKIVAKIAGASVILIGLQGIAYAENASDNKKEKVMRFSSLKVSGAQDNNSPQTQAMEKPGAYSSVGEDNKLESMDSVLRSLPGTYTQMDVSQSAVSVNIRGLSGFGRVNMMVDGVSQSFYGTAPSEFSHGQQPYNQTGALIDPNFIVRVDVARGQSDDSASVNALVGSANFRTLGVGDVIFDGNNLGVRTKWTYGNNGIGKSGMMAFAGKTQAFSPDGSIGAMLAVSGHSIDAHYKNAMGVSSDEFGTRDTFKQKPNSQLMKLNIKPNEFHDLELSGRFYHNKFNQRHIDSSDYYLKYHYTPFSELVDTKLLLSSSKSQQDFENRSMGVLGEGESKNQSNAIDISNTSRFNYADTDFAFTLGSKWMNTGYRKKISTEIEDKKVAGEAIENNGFAPSGKQDIASIYSRLKIEHGIYTADLALNYMDYSVKGIKPACEERVNCFPQGETQLNLKERGFNPGILLSAEIIPEFQPFVSYTHSMRAPNAQEIFHSNDGGNSMNPFLKGEKADTYQIGFNSYRPNLIVDGDTFRLKATLFQTKIKNYITSDQYVLCIEKRMCKMDGTLTGEEFAAINTNVTAVIYSNSLTRVNMRGYEIEAHYDAGIFYSSLAYSQQKTQQPTSMGATYFGDSPASQLPERYITLDTGVRLLDEKLSIGAIVKYTGESYRQHPDATLDDDGTILMKKDDKIPTIIDLYSDYQVNKNLFIKFSIQNLMNKNYSDALNRMNSSPMMDEQNARTQTARGRTYIMGAEVRF

SEQ ID NO: 9296 - protein, 723 aa, Xenorhabdus bovienii
  Coding DNA sequence: Name=SeqID_3188
  Gene classification: Gene name=PtrB; Function=Protease II; Function class=E Amino acid transport and metabolism
  Homolog annotation: Query=42..711bp; Hit=3..675bp; Blast score=756; Percent Identity=54.0; E value=0; Homolog= ZptrB COG1770
MLQHKTVFSPQTTRVVRSFLLGGSLLCNSFATIAMEKNMVPPMATKQPHKMTFHDDTRVDNYYWLRDDTRQDKDVIDYLTAENKYTEQMLKSGQELRETLYNEMAGRMSKEDQSAPYTYNGYVYRTVYEAGKDFPIYQRKPVDNSTDWQVMVDGNERAKGHKFYRVSGFAVTRDNKRIAVAEDTQGRRNYQVSFKNLGDGEWQNSVIENTSGNIVWANDGNTLFYVRRDPQTLLPYQLFRHQYGTDIQQDKKIYQEDDDRFYLGISESTSLDYILISIASSTTSEYRLIDANNPQSETQIFSARQAGREYDLDHFRGQFYIRSNHEHPLFGLYQAGAINKLWETVIAPQEETDLENFALFNNWLVVQERTKGLSTIRQIDWKTQQEKRVKFDEPAYMVSLDYNPEPDTDLLHYSYSSMTTPSSVFQWNMQTGERELLKQQEVKGFDKENYESQRIWVKARDGVEVPVSLVYRKSLFKKGENPILIYGYGSYGISMDPYFSSPLLSLLDRGFVYALVHVRGGGELGKNWYLQGKVENKMNSFHDFIDATKTLLADGYGDSQRVYAEGGSAGGLLMGTVINQAPELYRGVIAKVPFVDAVTTMLDPSIPLTTGEYEEWGNPNNKEDYFRIKSYSPYDNVKHQRYPHLLVTTGLHDSQVQYWEPAKWMAKLREIKQGDSLLLLETNMDTGHGGKPGRFNRLNDIAFDYSFLLMLDDAKVYFPQLKD

SEQ ID NO: 9297 - protein, 267 aa, Xenorhabdus bovienii
  Coding DNA sequence: Name=SeqID_3189
  Gene classification: Gene name=TonB; Function=Periplasmic protein TonB, links inner and outer membranes; Function class=M Cell envelope biogenesis, outer membrane
  Homolog annotation: Query=19..263bp; Hit=9..239bp; Blast score=70; Percent Identity=26.0; E value=2e-12; Homolog= Cj0181 COG0810
MLTYTTYQTTHVGHVTKSFLAAITLHALLVGWFIYTPKDIDIEEFLPPPAVMVELSLQTEAIHKIQNQPIGIEQQLSVASQQQESKVDEINMPKLDVNENANILVHKPKKKQKEQDAPKKTQPVKRVKAEKQESEKSRSSAAPTTSNATADNITSRTAASYESNSDAIADARAVWQAEVSGHLNRYKKYPPDAQRRNRTGRPMVKFTVNQFGTVIDSELIKRSGTNSLDREARLVLERSQPLPLPPDVILINGRVTVELPIDFYLSQ

SEQ ID NO: 9298 - protein, 300 aa, Xenorhabdus bovienii
  Coding DNA sequence: Name=SeqID_3190
  Gene classification: Gene name=PhuW; Function=Uncharacterized iron -regulated protein; Function class=S Function unknown
  Homolog annotation: Query=13..292bp; Hit=7..280bp; Blast score=214; Percent Identity=41.0; E value=1e-55; Homolog= PA4705 COG3016
MKASTCIKSTFLACAFLFGGCVTPQHDPQNGSQRALQTLSSELVQSGMLLDMKTGKAITSAELLEQLAAYPRVIVGEKHDNPYHHQIELWLVQQLGQKRPHGSVLLEMINPNQQEKVNKVKSWLQSNPIVREERIKQLLAWQQGWPWELYGELVTELVKAPYPLLAANLDRSEIDQAYKNHSPTDKTAWVSDDVKKLIEETIKNSHGADIEAKHLSAMTMIQQMRDRRMAEQLVNAPSPALLFAGGYHAVKAMGVPQHVKKIAPNEQVAVFVIAEQGVSLNREYADFVWFTPKVTKAITQ

SEQ ID NO: 9299 - protein, 759 aa, Xenorhabdus bovienii
  Coding DNA sequence: Name=SeqID_3191
  Gene classification: Gene name=SfcA; Function=Malic enzyme; Function class=C Energy production and conversion
  Homolog annotation: Query=1..434bp; Hit=1..434bp; Blast score=731; Percent Identity=85.0; E value=0; Homolog= maeB_1 COG0281
MDEKLKQSALDFHEFPQPGKITVTPTKPLTTQRDLALAYSPGVAAPCLEIAKDPLAAYKYTARGNLVAVISNGTAVLGLGNIGALAGKPVMEGKGVLFKKFSGIDVFDLEVDESNPDKLIDIIAALEPTFGGINLEDIKAPECFYIEQKLRERMKIPVFHDDQHGTAIICTAAVLNGLRIVNKDIGKVRLVVSGAGAASIACMNLLVALGLKRENITVCDSKGVIYRGREENMEKTKADYAIEDNGCRTLMDVIPDADIFLGCSGPGVLTPEMVKTMAKDPLIMALANPEPEILPPLAKAVRPDAIICTGRSDFPNQVNNVLCFPFIFRGALDVGATTINEEMKLACVHAIADLALAEQSQEVASAYGDQDLFFGSEYIIPKPFDPRLIVKIAPAVAKAAMDSGVATRPIADFGAYIEKLNEFVYKTNLFMKPIFSQAKKEKKRIVLAEGEDIRVLHATQELVSLGLAFPVLIGRPSVIEMRIKKQGLHIEVGKDFEVVNNENDPRFKEYWQEYYQLMKRRGISQEQARRTVIGNPTLIGAIMVHRGEADGLICGTVGSYSEHYQVVKDFFGFRQGVHTAGAMNALMLPMGNTFIADTYVNEDPTPEELAEITLMAAETVRRFGIEPKVALLSRSSFGSSDCVSAQKMRKVLELVQKAAPSLEIDGEMHGDAALVENIRRDIMPDSPLKGAANLLIMPNMEAARISYNLLRVTSSDGVTVGPVLMGVSKPVHILTPIASVRRIVNMVALAAVEAQTNPL

SEQ ID NO: 9300 - protein, 211 aa, Xenorhabdus bovienii
  Coding DNA sequence: Name=SeqID_3192
  Gene classification: Gene name=CitB; Function=Response regulator containing a CheY-like receiver domain and an HTH DNA-binding domain; Function class=T Signal transduction mechanisms
  Homolog annotation: Query=6..206bp; Hit=7..207bp; Blast score=194; Percent Identity=49.0; E value=5e-50; Homolog= PM1810 COG2197
MHNHSVMIVDDHPIIRHGLKRLIELERELIVTAETDNGEDAINIACQIKPDIILMDLKIHGLSGIDTIKSLRRKGLDSYVLVLSDSDNRGDIYDAIDAGANGYLLKDIELAPLMSNIKKAANGDAVYSEKVYQYLSTRHLHIDPLSKLTKRELDVLKEISEGMTNKEIADFLFISEETVKVHTRNLLKKLKSRSRLEATIIYLRHRKPELI

SEQ ID NO: 9301 - protein, 126 aa, Xenorhabdus bovienii
  Coding DNA sequence: Name=SeqID_3193
  Gene classification: Gene name=ArsC; Function=Arsenate reductase and related proteins, glutaredoxin family; Function class=P Inorganic ion transport and metabolism
  Homolog annotation: Query=11..123bp; Hit=3..115bp; Blast score=149; Percent Identity=63.0; E value=3e-37; Homolog= yffB COG1393
MSDTTSHKAFTLYGIKNCDTMKKARRWLEDQEIPYQFHDYRVDGLSSELLQLFIEQAGWEPLLNTRGTTWRKLSDDQKSAINNTEAAKKLMLEQPSIIKRPLLVSETGNYLLGFNAEQYQQFFFHD

SEQ ID NO: 9302 - protein, 375 aa, Xenorhabdus bovienii
  Coding DNA sequence: Name=SeqID_3194
  Gene classification: Gene name=ArgE; Function=Acetylornithine deacetylase/Succinyl-diaminopimelate desuccinylase and related deacylases; Function class=E Amino acid transport and metabolism
  Homolog annotation: Query=1..374bp; Hit=1..374bp; Blast score=596; Percent Identity=72.0; E value=1e-170; Homolog= dapE COG0624
MTCPVIELTQQLIKHPSVSPDDQGCQDILIQRLQNTGFTIERMPFGDTLNFWAYHGTGTTFALAGHTDVVPAGDTSKWQTPPFDPVIRDGMLYGRGAADMKGSLAAMVVAAERFVKANPDHPGRLAFLITSDEEASATNGTVKVVETLISRHERLDYCLVGEPSSQQRLGDIIKNGRRGSLTASLTIHGIQGHVAYPQLADNPIHRSLPFLQELINSQWDNGNEFFPATSMQIANIQAGTGSNNVIPGKLWVQFNFRFSTELTDTEIRQRVEEMLKKHNLKYDIDWWLSGQPFLTCKGELVDAVVESIEQCCGYKPEISTSGGTSDGRFIAKMGAQVVELGPINATIHKVNEGISVSDLQKLSLIYQRIMEQLIK

SEQ ID NO: 9303 - protein, 224 aa, Xenorhabdus bovienii
  Coding DNA sequence: Name=SeqID_3195
  Gene classification: Gene name=VanY; Function=D-alanyl-D-alanine carboxypeptidase; Function class=M Cell envelope biogenesis, outer membrane
  Homolog annotation: Query=1..217bp; Hit=4..226bp; Blast score=222; Percent Identity=51.0; E value=3e-58; Homolog= PM1021 COG1876
MMTPEMLTGLSTDHLVTLAGNHRLQFNATKAFLAMQRDAAKAGFKLQPASSFRDFARQQTIWNEKFRGQRPVLDDNSQPLDITKMTEGEICEAILRWSALPGASRHHWGTELDIYDPFLLPQGKKLLLEPWEYENGGYFEPLSDWLTENMSVYDFYRPFNRHNSGVAYEPWHISFWPLSHEAENLFNEQVLLNVWQDHNIAGIDWLSANLSSLFEKYVKIAEPD

SEQ ID NO: 9304 - protein, 64 aa, Xenorhabdus bovienii
  Coding DNA sequence: Name=SeqID_3196
  Homolog annotation: Query=1..64bp; Hit=15..78bp; Blast score=83; Percent Identity=70.0; E value=1e-15; Homolog= ref|NP_668746.1|
MHWLMDYWWVILLLLVGIIVNAIKELSRVDTKRFLDNKPELPPHRDFNDKWDDEDDCSQKHRKK

SEQ ID NO: 9305 - protein, 719 aa, Xenorhabdus bovienii
  Coding DNA sequence: Name=SeqID_3197
  Gene classification: Function=Predicted P-loop ATPase fused to an acetyltransferase; Function class=R General function prediction only
  Homolog annotation: Query=11..693bp; Hit=10..655bp; Blast score=572; Percent Identity=48.0; E value=1e-163; Homolog= ypfI COG1444
MTVLDSIWKKLQEQMQQQGQRRLVVLSGDVQWSEQIVIHLKKQFQGDWVTVASGDEDAIEPAKAFSLLGREFMHGVFDVTRGFNAEALAILAGTLKAGSWLVMRVPTWSQWPAQPDEDSSRWNESAGVISTPHFIQHIQQQILELPNILLWQQGKPFQPVQLSQTVPWQMPDGNPTASQQAILEQLLRASQGVWVVTAPRGRGKSALAGMLIQQWQGKCWLCAPAKITTEVIRHYSGTSDPEQDSPVDKTPFWAVDNLLKYCRLKNNREGHDIDADWLLIDEAAAIPTPQLAELIRYFPRVLLTTTVQGYEGTGRGFLLKLCATLPDCHVRELETPMRWAENDPLETWLDSSLLFDDKRLFNEKSLPDEPLVYSEPEKNLHFYPITQAMWLRQPELLRQFYGLLTSAHYRTSPLDLRRLLDGNGMTFLAAISRSAVNNQQLIGALWMVSEGELPQTLAHEVWAGRRRPRGNLVAQSLAAHGGFPQAATMRSQRVSRIAVQAQYRRRGIAQRLVTQQCQEARAQKQDFLSVSFGYTAELWSLWQTCGFRLVRMGTHLEASSGCYTAMAILPLSEKGKWLAESAQQQLCRDAYWLELLIGFSLPIYHHGDNQLSDSDWQELAGFAFAHRPLSASYFALQRLLLAHDLALPALRKYLQQQIDIEQCARDLSLSGRKALLKRCREETAGALASIDEILANQWKNWTISCGVSGNNRPHHPIYH

SEQ ID NO: 9306 - protein, 150 aa, Xenorhabdus bovienii
  Coding DNA sequence: Name=SeqID_3198
  Gene classification: Function=Uncharacterized membrane protein; Function class=S Function unknown
  Homolog annotation: Query=5..149bp; Hit=3..147bp; Blast score=141; Percent Identity=72.0; E value=2e-34; Homolog= yeaL COG2707
MNYIDPTLLILLVLAGLGIISHNMTVTLAMLFLLIVRITPLNQFFPWVEKYGLTIGILILTIGVMAPIASGKISAQDIFSSFLNWKSLLAIAVGIIVSWLGSRGVALMSSQPSTVAGLLVGTVLGVALFKGVPVGPLIAAGILSIMIGKP

SEQ ID NO: 9307 - protein, 51 aa, Xenorhabdus bovienii
  Coding DNA sequence: Name=SeqID_3199
MATLVEKTVCKKKYIRFPLPYYLTITLIYSYIYLFDYEKINILNHIQYVIN

SEQ ID NO: 9308 - protein, 38 aa, Xenorhabdus bovienii
  Coding DNA sequence: Name=SeqID_3200
MGKGYLKALSETIGYSGEGSYYRYKMVIWINVLNDYLN

SEQ ID NO: 9309 - protein, 76 aa, Xenorhabdus bovienii
  Coding DNA sequence: Name=SeqID_3201
VTIYLLVQHQATLTIRHKHTLRLLTGKMQKGCKESLTNGMHSYERYEKNTLLNHVQCGINWLHHSMGAGRKSLYPF

SEQ ID NO: 9310 - protein, 126 aa, Xenorhabdus bovienii
  Coding DNA sequence: Name=SeqID_3202
MKDMKKTLFSIMFSVALTGCTTQWVPVGSHYTPFNEANAECNIEALQQFPVRNEVAQRSSIKTVKHYCPACCKSDKADKSDKDCYFDQSVPTTESYVMDVNERSRHQLYSSCMERNGWEEQTKYLF

SEQ ID NO: 9311 - protein, 37 aa, Xenorhabdus bovienii
  Coding DNA sequence: Name=SeqID_3203
LAILNIPYYHTSFSHLSNKYPRHHDQRYPHYFSVGYL

SEQ ID NO: 9312 - protein, 237 aa, Xenorhabdus bovienii
  Coding DNA sequence: Name=SeqID_3204
  Gene classification: Gene name=PurC; Function =Phosphoribosylaminoimidazolesuccinocarboxamide (SAICAR) synthase; Function class=F Nucleotide transport and metabolism
  Homolog annotation: Query=1..237bp; Hit=1..237bp; Blast score=411; Percent Identity=87.0; E value=1e-115; Homolog= purC COG0152
MQKKAELYRGKAKTVYSTDNPDLLVLEFRNDTSALDGERIEQFDRKGMVNNKFNHFIMNKLEEAGIPTQMERLLSDNECLVKKLDMVPVECVIRNRAAGSLVKRLGVEEGMVLNPPLFDLFLKNDAKHDPMVNESYCETFGWVSKVHLAEMKRLSYKANEVLSKLFNDAGLILVDFKLEFGLFNGNVVLGDEFSPDGSRLWDQQTLDKMDKDRFRQSLGGLIEAYEEVARRIGVILD

SEQ ID NO: 9313 - protein, 348 aa, Xenorhabdus bovienii
  Coding DNA sequence: Name=SeqID_3205
  Gene classification: Gene name=NlpB; Function=Uncharacterized lipoprotein; Function class=M Cell envelope biogenesis, outer membrane
  Homolog annotation: Query=1..344bp; Hit=2..345bp; Blast score=349; Percent Identity=52.0; E value=2e-96; Homolog= nlpB COG3317
MATLLQKSKVMKVAGLSLVVLLAACSKDQHYKRQVSGDESYLETPPLKALNVPAGMILPPQNSEYTISSATEKGAVGKSLDIRPPVQAMQLLAGSHMGNNVRTGKLLIENTPEHSNLWSQVVSLLAKKNYQISEKDDTKQTLVTDWISWSRADENIPYRGRYRIEVSPQGSQIALSVTNESLEHDGKVVSDPAIIQDYDLIMLNELSDGLNQQQELASLNSTKNTGALVVNSGSDNTALPQIIVRAPYTVVWNRLPHTLESIGMRVTDRTRATGMIEVTYKELSSSGWKELGVEAPSISEGNYKLQVGDLDNRSSLQFIKEKGQPLTQAENDQMMAVFKAAFSRTTDK

SEQ ID NO: 9314 - protein, 299 aa, Xenorhabdus bovienii
  Coding DNA sequence: Name=SeqID_3206
  Gene classification: Gene name=DapA; Function=Dihydrodipicolinate synthase/N-acetylneuraminate lyase; Function class=E Amino acid transport and metabolism
  Homolog annotation: Query=8..299bp; Hit=2..292bp; Blast score=436; Percent Identity=73.0; E value=1e-122; Homolog= dapA COG0329
MVSGNSGFTGSMVAMVTPMNSDGQIDKTSLKKLIDYHIASGTSSIVSVGTTGECATLSQDEHVDVVLTTLELADGRIPVIAGTGANATAEAISLTRRFENTGIAGCLSVTPYYNRPSQEGLYQHYKAIADNTDLPQILYNVPSRTACDLLPSTVARLAKLENIVAIKEATGNLSRVSQIQELVNDENFILLSGDDASFLDFVQLGGKGVISVTANVAAAEMAQIYELAQKGEFVKARSLNNRLMELHHQLFVEPSPTPAKWACRKLGLIADDTLRLPMIPLTQAGQVSVNNALKLAGLL

SEQ ID NO: 9315 - protein, 185 aa, Xenorhabdus bovienii
  Coding DNA sequence: Name=SeqID_3207
  Gene classification: Gene name=GcvR; Function=Glycine cleavage system regulatory protein; Function class=E Amino acid transport and metabolism
  Homolog annotation: Query=1..180bp; Hit=23..202bp; Blast score=233; Percent Identity=65.0; E value=1e-61; Homolog= gcvR COG2716
LPKSEQYFLVITALGADRPGIVNTITRLASVCGCNIEDSRLAMFGEEFTFIMLLSGSWNAITLIESTLPQKGAELELLIVMKRTRCGVQTKFPSTISVRVDVDDSPGIVERFTNLFTTQNFNIAELASKTHPAEENMPARLQIYITGHNPLDDNGLIFKESFYRLCTELNAQGSISVLDHLNKND

SEQ ID NO: 9316 - protein, 157 aa, Xenorhabdus bovienii
  Coding DNA sequence: Name=SeqID_3208
  Gene classification: Gene name=Bcp; Function=Peroxiredoxin; Function class=O Posttranslational modification, protein turnover, chaperones
  Homolog annotation: Query=1..156bp; Hit=1..156bp; Blast score=265; Percent Identity=80.0; E value=2e-71; Homolog= bcp COG1225
MSRLKAGDKAPKFSLPDQDGETVSVSDFKGQRVLVYFYPKAMTPGCTVQACGLRDKMNELKEIGVEVLGISTDTPERLSRFAEKERLNFTLLSDVDHQVAEQFGVWGEKQFMGKTYDGLHRISFLVDPKGDIEHVFDKFKTSNHHQIVLDYLKQHSS

SEQ ID NO: 9317 - protein, 354 aa, Xenorhabdus bovienii
  Coding DNA sequence: Name=SeqID_3209
  Gene classification: Gene name=PerM; Function=Predicted permease; Function class=R General function prediction only
  Homolog annotation: Query=1..350bp; Hit=1..350bp; Blast score=393; Percent Identity=64.0; E value=1e-109; Homolog= perM COG0628
MLDMIMRWYHRRFADPQVAALSVILLVGFGVIYFFNGILAPVLAAIVLAYLLEWPTVKLEKLGCSRTLSVTIVLTIFMGISALVILIVAPTVWQQGLNLFSDLPNMFNRFNEYAHTLTSRYPALVDAGIIEMIADNLRTKLPLAGESFLKISVASVIGLLTLAIYLILVPLMVFFLLKDKSQMVAALQSVLPRNHGLAGKLWHEMNQQIVNYIRGKVTEMVILTICTYAVFAFFGLRYSLLLAVFVGLSVLIPYIGTVIVTIPVIIVALFQWGLGTDFWTLFIAYLVVQGLDGNLLVPILFSEAVNLHPLVIILSVIIFGGFWGLWGVFFAIPLATLIKAIIRVWSEEKIVGSE

SEQ ID NO: 9318 - protein, 38 aa, Xenorhabdus bovienii
  Coding DNA sequence: Name=SeqID_3210
MICYHTHIHNLITNWDTLFLRESFYDKNTQEIPDSDID

SEQ ID NO: 9319 - protein, 489 aa, Xenorhabdus bovienii
  Coding DNA sequence: Name=SeqID_3211
  Gene classification: Gene name=HtpX; Function=Zn-dependent protease with chaperone function; Function class=O Posttranslational modification, protein turnover, chaperones
  Homolog annotation: Query=1..309bp; Hit=1..307bp; Blast score=374; Percent Identity=60.0; E value=1e-103; Homolog= Z3757_1 COG0501
MIKTPKKSLIVTLISLLLFGNSPALSVSSENSLPDIGTSAGATLSINQEIEMGDFFIRQIRAGAPLIDDPLLNQYINKLGHKLVNHADSVKTPFQFYLINNPAINAYAVFGGNVVLHSGLFRYSRNESELASVMAHEISHVTQRHLARFMEDTQRKAPFAWAGILGSILLMMANPQAGMATLSGTLGGFQQGIISFTQSNEQEADRIGMQILNNSGFNPHGMPDFMQILVDQTRYSSKPPEMLLTHPLPDSRLSDARNRANQYPKKTIPESESQDFLFARVRILTISATDQLNYIEQILNNYSQGTAKEQLAASYGRVLLLSQAQKYAEAKTVLSPLLDKQPDNIWFIDAMTDIDIEQKQYEQAITRLQYALQKHQNNPVLQINLANAYIQAKHYPQASQLLFRYTFNNPNDPTGWSLMTELAKKQGKRDKELVSYAETMALQGKFDMAINYLSQASSLVTLNSDDQARYDARIDQLRQLQQRYSQYDK

SEQ ID NO: 9320 - protein, 123 aa, Xenorhabdus bovienii
  Coding DNA sequence: Name=SeqID_3212
  Gene classification: Gene name=ArsC; Function=Arsenate reductase and related proteins, glutaredoxin family; Function class=P Inorganic ion transport and metabolism
  Homolog annotation: Query=9..122bp; Hit=3..116bp; Blast score=143; Percent Identity=64.0; E value=3e-35; Homolog= VC2165 COG1393
MRTFYMPQVIFYHNPRCSKSRETLKLVEDLGIAPEIIHYLDTPPTVEQLTVLLKQLGFKDARQLMRTKEELYKDLNLGDDTLSQAALLQAMAKHPILIERPIVVVGDKARLGRPPEQVKEILG

SEQ ID NO: 9321 - protein, 235 aa, Xenorhabdus bovienii
  Coding DNA sequence: Name=SeqID_3213
  Gene classification: Gene name=DnaA; Function=ATPase involved in DNA replication initiation; Function class=L DNA replication, recombination and repair
  Homolog annotation: Query=1..235bp; Hit=14..248bp; Blast score=388; Percent Identity=80.0; E value=1e-108; Homolog= yfgE COG0593
VLLNTPSQLSLPLYLPDDEIFASFFAGENTSLLAAIKLAISQSHGSYIYFWSRDGGGKSHLLHASCAELSQQGEAVGYVPLDKRAYFVPEVLDGMEHLSLVCIDNIECIAGDQEWEMAIFNLYNRIVEIGRTCLLITGDRPPRQINLTLPDLASRLDWGQIYKLQPLSDDEKIQALQLRAKLRGFELPEDVGRFVLKRLDREMQTLFRTLDELDRASIVAQRKLTIPFVKDILDL

SEQ ID NO: 9322 - protein, 31 aa, Xenorhabdus bovienii
  Coding DNA sequence: Name=SeqID_3214
MPVLNSAFISFIVTFCGRLSAVRYPFCLRCF

SEQ ID NO: 9323 - protein, 436 aa, Xenorhabdus bovienii
  Coding DNA sequence: Name=SeqID_3215
  Gene classification: Gene name=UraA; Function=Xanthine/uracil permeases; Function class=F Nucleotide transport and metabolism
  Homolog annotation: Query=1..416bp; Hit=1..416bp; Blast score=594; Percent Identity=85.0; E value=1e-170; Homolog= uraA COG2233
MTRRTIGVDERPSLIQTIPLSLQHLFAMFGATVLVPVLFKVNPATILLFNGIGTLLYLFICKGKIPAYLGSSFAFISPVLLLLPLGYELALGGFIVCGLLFCLVSLIVKIAGRGWINVIFPPAAMGAIVAVIGLELAGVAADMAGLRPAIGAEVNTANLTISMVTLAVTILGSVMFRGFMAIIPILIGVLAGYALAFFMGVVDFTPVLEAPWFALPTFYTPRFEWFAIMTILPAALVVIAEHVGHLVVTANIVQKDLLKDPGLHRSMFANGFSTMISGFFGSTPNTTYGENIGVMAITRVYSSWVIGGAAILAILLSCVGKLAAAIQVIPVPVMGGVSLLLYGVIGASGIRVLIDSKVDYSKAQNLILTSIILIIGVSGAKIQIGTAELKGMALATVVGIGLSLIFKLISVIRPEEPYITSSVESIDNDKKREAVE

SEQ ID NO: 9324 - protein, 41 aa, Xenorhabdus bovienii
  Coding DNA sequence: Name=SeqID_3216
MVCISDGLSSTPIVRRVIIYILYVTLLEAKKNRLFSRLNVI

SEQ ID NO: 9325 - protein, 208 aa, Xenorhabdus bovienii
  Coding DNA sequence: Name=SeqID_3217
  Gene classification: Gene name=Upp; Function=Uracil phosphoribosyltransferase; Function class=F Nucleotide transport and metabolism
  Homolog annotation: Query=1..208bp; Hit=10..217bp; Blast score=363; Percent Identity=90.0; E value=1e-101; Homolog= upp COG0035
MKIVEVQHPLVKHKLGLMRDHDISTKRFRELASEVGSLLTYEATADLEVEKVTIEGWCGPVEIDQIKGKKITVVPILRAGLGMMDGVLENIPSARISVVGVYRDEKTFEPVPYFQKLVSDISERMALVVDPMLATGGSMIATIDLLKKAGCPVIKVLVLVAAPEGVAALEKAHPDVELYTASIDECLNEHGYIVPGLGDAGDKIFGTK

SEQ ID NO: 9326 - protein, 44 aa, Xenorhabdus bovienii
  Coding DNA sequence: Name=SeqID_3218
MQVSCQTKIKGKMLMLDKNQWIDSGSVSKRRYNPAIFLSAGYIQ

SEQ ID NO: 9327 - protein, 361 aa, Xenorhabdus bovienii
  Coding DNA sequence: Name=SeqID_3219
  Gene classification: Gene name=PurM; Function =Phosphoribosylaminoimidazol (AIR) synthetase; Function class=F Nucleotide transport and metabolism
  Homolog annotation: Query=9..359bp; Hit=1..344bp; Blast score=592; Percent Identity=80.0; E value=1e-169; Homolog= purM COG0150
MQPPGGYAVTNKTSLSYKDAGVDIDAGNTLVNRIKGVVKQTRRPEVMGGLGGFGALCALPQKYREPILVSGTDGVGTKLRLAMDLKRHDTIGVDLVAMCVNDLVVQGAEPLFFLDYYATGKLDVDTAASVITGIAEGCKQSGCALVGGETAEMPGMYHGEDYDVAGFCVGVVEKSEIIDGSQVQVGDALIALASSGPHSNGYSLIRKILDVSQTNPETTELEGKSLADHLLVPTRIYVKPVLELIEQFEIHAIAHLTGGGFWENIPRVLPENMQAKINASSWQWPAIFTWLQQAGNVSNHEMYRTFNCGVGMIIALPQSQTKQAVEWLNATGENAWQIGTITEFDTNTELNTNEQQVIISE

SEQ ID NO: 9328 - protein, 212 aa, Xenorhabdus bovienii
  Coding DNA sequence: Name=SeqID_3220
  Gene classification: Gene name=PurN; Function=Folate-dependent phosphoribosylglycinamide formyltransferase PurN; Function class=F Nucleotide transport and metabolism
  Homolog annotation: Query=4..212bp; Hit=3..211bp; Blast score=305; Percent Identity=69.0; E value=3e-83; Homolog= purN COG0299
MKKIVVLVSGNGSNLQSIIDASQQNRINGHICAVFSNNANAYGLQRAEQAGIPAHFLNPQAFPDRTAYDCALLTAIDQYQPDLVVLAGYMRILSPDFVQHYCGRMLNIHPSLLPKYPGLHTHRKAIENGDQEHGTSVHFVTEELDGGPVILQAKVPIFEEDQEEDVIRRVQAQEHDIYPLVIGWFLDGRLSMSDNIAILDGKTLPQQGYASE

SEQ ID NO: 9329 - protein, 35 aa, Xenorhabdus bovienii
  Coding DNA sequence: Name=SeqID_3221
MLTHPGHIVSYAPGDSFPCRRTATRNPFGIDYSEA

SEQ ID NO: 9330 - protein, 187 aa, Xenorhabdus bovienii
  Coding DNA sequence: Name=SeqID_3222
  Gene classification: Gene name=RimL; Function=Acetyltransferases, including N-acetylases of ribosomal proteins; Function class=J Translation, ribosomal structure and biogenesis
  Homolog annotation: Query=10..182bp; Hit=7..179bp; Blast score=261; Percent Identity=75.0; E value=3e-70; Homolog= speG COG1670
MSSGSENPPVNLRPLEREDLPFAHQIDNNASVMRYWFEEPYEAFVELCDLYDKHIHDQSERRFIIESMNAKVGLVELVEIDYIHRRAEFQIIITPAYQGQGYATKAAKLAMEYAFCVLNLYKLYLIVDKENEKAIHIYNKLGFHTEGELIDEFFVNGSYHTAIRMCTFQHHYFANKARESQTSSLAH

SEQ ID NO: 9331 - protein, 689 aa, Xenorhabdus bovienii
  Coding DNA sequence: Name=SeqID_3223
  Gene classification: Gene name=Ppk; Function=Polyphosphate kinase; Function class=P Inorganic ion transport and metabolism
  Homolog annotation: Query=1..686bp; Hit=1..688bp; Blast score=1085; Percent Identity=80.0; E value=0; Homolog= ppk COG0855
MSHDRLYNEKELSWLSFNERVLQEAADKSNPLIERMRFLGIYSNNLDEFYKVRFADVKRRILISEERGSATSGRQLLKKIQAKVVKIDQEFDELYNDLLLEMARNQIFLINERQISPNQQIWLRQYFRQHLRPHITPIVINPETNLVEFLKDDYTYLAVEIIRGQETKYALLEIPSDKVPRFVNLPPEMPRRRKSMILLDNILRYTLDEIFKGFFDYDTLNVYSMKMTRDSEYDLATEMESSLLELMSSTLKQRLTAEPVRFVYQRDMPDEMVDLLRSKLGLSNDDSVIAGGRYHNFKDFIKFPNEGNRNLLNKTMPRLRHTWFEHFRNGFDAIREQDVLLYYPYHTFEHVLELLRQASFDPSVLSIKINIYRVAKDSRIIDSVIHAAHNGKKVTVVVELQARFDEEANIHWAKRLTEAGVHVIFSAPGLKIHAKLFVISRLEGDEIVRYAHIGTGNFNEKTARSYTDYSLLTAKPEVTNEVRRVFNFIENPYRPVTFENLMVSPQNSRAMLNQLITQEIENAKAGEAAGITLKINNLVDKELVDRLYDASEAGVKVRLLIRGMCSLVPNQAGFSENIQVTSIVDRFLEHDRVYVFTNKGDEKVFLSSADWMTRNIDYRIEVAVCLLDPQLKQRVLDILELQFSDTVKARYIDKELSNRYVPRGNKRKIRAQIAVYDYLKTLEQPEPRA

SEQ ID NO: 9332 - protein, 498 aa, Xenorhabdus bovienii
  Coding DNA sequence: Name=SeqID_3224
  Gene classification: Gene name=GppA; Function=Exopolyphosphatase; Function class=F Nucleotide transport and metabolism
  Homolog annotation: Query=2..498bp; Hit=12..508bp; Blast score=717; Percent Identity=72.0; E value=0; Homolog= ppx COG0248
MEIATIDLGSNSFHMVIARIVNGALQVIGRLKKRVHLADGLNNKNELSEEAINRGLACLSLFAERLQGFSANNVCLVGTHSLREATNTQEFLKRAKEVIPYPIEIISGHEEARLIFMGVEHTQPEKGRKLVIDIGGGSTELVIGENFEPLLIESRRMGCVSFSRQFFPDNIINEQNFRRARLQAAQKLENLVWQFRVKGWDFALGASGTIKAVHELLVGLGEKDGLITPERLNMLVKRVLKYKNFKSLDLPGLSEDRKQTFVSGLAILCGVFDVLHIQELRLSDGALREGVLYEMEDRFRHQDIRQRTAKSLADHYNIDREQADRVWSTAKTLYGQWATQNPKRLQPQLESILLWAAMLHEVGLSINLNGLQRHSAYILQHTDLPGFNQEQQSLLATLVRYHRKAIKVHEHPRFYLFKKKQYLPMLQILRLATLLNNQRQSTTTPESLRLDTSHGHWTLYLPQNYLTQNALMQLDLEKEQAYWSDVIGWYLHIKEEST

SEQ ID NO: 9333 - protein, 54 aa, Xenorhabdus bovienii
  Coding DNA sequence: Name=SeqID_3225
MKKKKNTVQITTLILLISFLILFGRFIYSSIAALEHHRQKQQHSMEHIRNTKTK

SEQ ID NO: 9334 - protein, 487 aa, Xenorhabdus bovienii
  Coding DNA sequence: Name=SeqID_3226
  Gene classification: Gene name=MgtE; Function=Mg/Co/Ni transporter MgtE (contains CBS domain); Function class=P Inorganic ion transport and metabolism
  Homolog annotation: Query=45..487bp; Hit=38..482bp; Blast score=469; Percent Identity=55.0; E value=1e-132; Homolog= PA0913 COG2239
MLQSAFKSGNSTVASQHSQKLAVVRQRLLSLFINDKLFVDTLLGQADEHSTISDEQLLEKIEEVSAQLTDLHAADIADILEALPYDERLALWRLIDNNQRGEVLVEASIPVWDNLIKDMSDLELLKAIGTLHVDEQAYIAEYLPRDTTRRLLTYLEPSQRNRIREVLQYHKDSIGQMMDFEFVTVRGNITLSTVQRFLRSRGSIPDATDKIFVIDRKNRLQGELPLTTLLINAPDKLVAEVMNTDTVTFLPEQKGEDAASAFERYDLISAAVVDNNGRLMGRLTVEDIIDTLSEETDTNIRRMGGLSREEDVFAPVGQTVKTRWAWLAINLCTAFVASRVIGLFEHTISQLVALATLMPIVAGIGGNTGNQTITMIVRALALHQIQSGSFSYLLLREFGVALINGVIWGGIMGVVTYLLYGDLAMGGVMTMAMILNLLMAALMGVLIPFIMMKLGRDPAIGSSVMITAMTDTGGFFIFLGLATLFLV

SEQ ID NO: 9335 - protein, 77 aa, Xenorhabdus bovienii
  Coding DNA sequence: Name=SeqID_3227
MVEKIWKLWQLLNYRQTIRTVLPMRKCSQKKLFLLNIKTLFVVTIWQGHLDIVFGTKGFINSLRKNADIIYKSAFLP

SEQ ID NO: 9336 - protein, 413 aa, Xenorhabdus bovienii
  Coding DNA sequence: Name=SeqID_3228
  Gene classification: Gene name=AcrA; Function=Membrane-fusion protein; Function class=Q Secondary metabolites biosynthesis, transport and catabolism
  Homolog annotation: Query=7..404bp; Hit=53..455bp; Blast score=405; Percent Identity=54.0; E value=1e-113; Homolog= yegM COG0845
MKNKRRTYFFRFAVLAVVIAAAYFAWNYFKTPTISEEKSAQASKSPRNLRHSPQPPVQVATAKIQTVPHYLGGLGTVQAANTVTVTSLVAGQLTALHFDEGQFVKQGDLLAELDPRSFQIQLAKTQGQYARDQATLANARQDLARYQQLAKNNSISQQDLDKQISAVRQYEALLKADQSGIDDAKLQLTYSRITAPISGRVGLKKIDVGNYISAGGGTPLVIITQVDPIDVLFALPENDISTVLKAQENNKDVVVTAWDRNNQQQLAQGKLLSIDNLIDVTTGTIKIKARFDNQNNVLFPNQFVNIQIKVNTLENAIVIPNAALQMSNEGHYVWKVDKENKVNKHKVTIGLQNAQLVVISKGLATGDRVVTDGTDQLTEGTGINIVKPLKSESANTHDHTGKSKPSNSKVENT

SEQ ID NO: 9337 - protein, 1056 aa, Xenorhabdus bovienii
  Coding DNA sequence: Name=SeqID_3229
  Gene classification: Gene name=AcrB; Function=Cation/multidrug efflux pump; Function class=Q Secondary metabolites biosynthesis, transport and catabolism
  Homolog annotation: Query=6..1032bp; Hit=6..1032bp; Blast score=1398; Percent Identity=75.0; E value=0; Homolog= ZyegN COG0841
MHSDSPMTGGGPSRLFILRPVATTLFMMAILLAGIIGYRMLPVSALPQVDYPTIQVVTLYPGASPDIMTSVVTAPLERQFGKMSGLKQMTSQSSGGASIITLVFQLSLPLDVAEQDVQAAINAATNLLPHDLPYPPIYSKVNPADPPILTLAVTSDALPMTQVQDMVETRIAQRISQVGGVGLVTLAGGQRPAVRVKFNAQAIAAQGLNSEAIRTTIMNANVSSAKGSFDGPTRSVTLTTNDQMKSIDEYRNLIVAYKNGAPIRLRDVATIERGAENTKLGAWANEKPAIVINVQRQPGANVIDTTDNIRAMLPELINSLPKSVNVDILTDRTVTIRASVQDVQFELLLAIALVVMVIYLFLRNATATLIPSIAVPLSLVGTFAVMYFCGFSVNNLTLMALTIAAGFVVDDAIVVIENISRYIERGEKPMAAALKGAGEIGFTIISLTFSLIAVLIPLLFMGDIVGRLFREFAITLAVAILISAVVSLTLTPMMCARMLKAEAEIKHNRFEQASEHFFERIIAIYGEWLKRVLNHPWITLGVAFSTLAFTVLLYLTIPKGFFPLQDNGLIQGTLEAPQSISFNAMSDKQRQVTALLLQDPDVENVTTFIGVDGSNSTLNSGRLQITLKSLNQRNIRVDEIIPRLQARVANVPDAKLYLQPTQDLTIDTQVARTQYQFTLQATVSSDLNIWVPKLQEALKQRPELVDVGTDWQNRGLVAYINVNRDMASRLGISMTAIDNALYNAFGQRLISTIYTQANQYRVILEQDTQNEAGINALNNVHLIGTDNKVVPLSTIATVEQKLGYLSINHLQQFPAVTFSFNVAQEASLEAAVNAVKETEQSIGMPKNINTQFQGATLAFQNALGNTLWLILAAVISMYIVLGILYESFIHPVTILSTLPTAGVGALLALMMGGYELDIIAIIGIILLIGIVKKNAIMMIDFALAAEREKGMSPYDAIFQACLLRFRPILMTTMAALLGALPLMLSTGIGAELRRPLGICMVGGLIMSQILTLFTTPVIYLLFDRLANYFKNKRQNRLQSQNQGELDHSSVNHQEPL

SEQ ID NO: 9338 - protein, 1027 aa, Xenorhabdus bovienii
  Coding DNA sequence: Name=SeqID_3230
  Gene classification: Gene name=AcrB; Function=Cation/multidrug efflux pump; Function class=Q Secondary metabolites biosynthesis, transport and catabolism
  Homolog annotation: Query=1..1016bp; Hit=1..1018bp; Blast score=1340; Percent Identity=70.0; E value=0; Homolog= yegO COG0841
VKFFALFIQRPVATTLLSLAITLCGALSFVLLPVSPLPKLDFPFISVSAYMPGASPETMASSVATPLERSLGKIAGVKEMTSDSSLGNTNITLEFELSRDINGAARDVQAAINAAESLLPSGMPSRPRYYKANLSDAPIMVLTLTSTNYSEGQLYDIASTYLAQKLSQVEGVSNVSVGGSSLPAVRIELNPNALFNQGVSLNDVSQAINSANAQRPTGHVDSAQQNWQIHTNDELKSADSYRSIIVHYRNGSPVRLQDVANLKDSVEDIRAAGMSGGNPAIVLMIRRESGANIIATIDRIRAELPALRESIPANIQLNVAQDRSPPIRASLQEVKQSLAIAVALVILVVFLFLRSGRATLIPAIAVPVSLIGTFTAMYLCGFSLNNLSLMALTIATGFVVDDAIVVLENISRHLEAGLKPAQAALKGVREVGFTVLAMSVSLVAVFIPLVLIDELLGRLFRDFAVTLATAIGISLLISLTLTPMMCARLLKSSPKKSQKRIRGFSKVLLKIQQGYGRSLKWVLNHTRWVLLTLVGIVVLNVWLYINIPKTFFPQQDTGRLLGFVVADENSSFQAMRDKMKHFMQVIDADPTVENVSGFTESRSGVMLIALKPLRERTESIEQVITRLKGKLSNEAGAQLYLIPIQDLRSGGRGGAKSIYQFTLLSDDLGELRKWEPVIRKALAKLPQLTDVNSDYEGKGSEIAIIYDRDLMARLGISVNEANALLSNAFGQQSISTIYLPRNQYKVVMEVAPEYTQDASSLEKMFVINAKGERIPLSYFARWQPANAPLGVYHQGLSASSTIAFNVAKDYTLSDAISAIERTMTELSVPSAVRSSFAGTAQDFQKTQSSQLWVILAAIVTVYLVLGVLYESYIHPLTILSTLPSAGVGALLALELFNTPFSLIAMIGIMLLIGIVKKNAIIMVDFALEAQKSGKLSAQEAILQASLLRFRPIMMTTLSALFGALPLVLNSGDGAELRQPLGITIVGGLVMSQLLTLYTTPVVYLFFDRLREKWHHRRTIKSQAMKPS

SEQ ID NO: 9339 - protein, 481 aa, Xenorhabdus bovienii
  Coding DNA sequence: Name=SeqID_3231
  Gene classification: Gene name=BaeS; Function=Signal transduction histidine kinase; Function class=T Signal transduction mechanisms
  Homolog annotation: Query=21..472bp; Hit=5..459bp; Blast score=497; Percent Identity=57.0; E value=1e-140; Homolog= ZbaeS COG0642
MAPPPYDKISGDETIMRHIMRAGISGKLFLAIFATCMLVLVTMHWGIRLSFQHSFIGYIKQNSQMRANKMAEALTEQYQKYGNWDFLLQNDRMIFQIMRTIEQNSDSRQSPSSRGWRSQFWVVDNQMHRLVGHGSQIPTDTYRKSVIYQDNIVGWVIVRTSDKITRQADIRFDRQQQLTSWIIAGFSTLLALIATFLLSRGFLKPVKRLVEGTHKLAAGDFSVRVKPSSTDEIGQLASDFNRLASTLEKNEQMRRDYMVDISHELRTPLSVLRGELEALQDGVRQSTPETIHSLLTEITTLTKLVDDLHLLSLSDRGSLAYRQELTNASDLLQVTLAAYRGRFADKQITLELNLTENAILFADPGRLTQLFQNLLENSLRYTAAPGKIIIRAHLTPQKWILDWQDSAPGLTVEQCQQIFERFYRCESSRNRASGGSGLGLAICYNIVEAHDGVIYAERSSLGGLKIHVELPLVELPEYKAQ

SEQ ID NO: 9340 - protein, 235 aa, Xenorhabdus bovienii
  Coding DNA sequence: Name=SeqID_3232
  Gene classification: Gene name=OmpR; Function=Response regulators consisting of a CheY-like receiver domain and a winged-helix DNA -binding domain; Function class=T Signal transduction mechanisms
  Homolog annotation: Query=10..235bp; Hit=13..240bp; Blast score=306; Percent Identity=68.0; E value=1e-83; Homolog= baeR COG0745
MSTHSTQYTVLIVEDEPKLGQLLIDYLQAADYQTQWLTRGDEVIAHVQKHQPDIILLDIMLPGLDGISICREIRRFSDIPIVMMTARTEEIDRLLGLEIGADDYICKPYSPREMVARVKTILRRCYRPQDIISEHGSLTIDENHFQARYLDRVLELTPVEFRLLKIMSSQPGRVFSRDQLLNNLYDDHRIVNDRTIDSHIKNLRRKLEQLDDDKSFIRSIYGLGYRWEAEICRLM

SEQ ID NO: 9341 - protein, 43 aa, Xenorhabdus bovienii
  Coding DNA sequence: Name=SeqID_3233
MPFNVKLHPTGTVIINPICRISEEAQNITVNHFKVIRFFCPET

SEQ ID NO: 9342 - protein, 40 aa, Xenorhabdus bovienii
  Coding DNA sequence: Name=SeqID_3234
MFFKEPAGDSNSGVNIINNVLDLSSSQALSLKARLRKQEF

SEQ ID NO: 9343 - protein, 458 aa, Xenorhabdus bovienii
  Coding DNA sequence: Name=SeqID_3235
  Gene classification: Function=Collagenase and related proteases; Function class=O Posttranslational modification, protein turnover, chaperones
  Homolog annotation: Query=1..453bp; Hit=1..453bp; Blast score=788; Percent Identity=83.0; E value=0; Homolog= ZyegQ COG0826
MFTPELLSPAGSLKNMRYAFAYGADAIYAGQPRYSLRVRNNEFNHETLAQGIKETHELGKRFYVVVNIAPHNAKLKTFIRDLKPVVEMGPDALIMSDPGLIMMVREAFPEIDIHLSVQANAVNWATVKFWKQMGLTRVILSRELSLEEIAEIRQQVPDMELEVFVHGALCMAYSGRCLLSGYINKRDPNQGTCTNACRWEYNVQEGKEDNVGNIVHMHDPILVKNIEPTLGQGAPTDKIFMIEEAKRPGEYMSAFEDEHGTYIMNSKDLRAIEHVERLANIGVHSLKIEGRTKSFYYCARTAQVYRRAIDDAAAGKPFDSTLMTTLEGLAHRGYTEGFLRRHTHDAYQTYEYGYSMSDTQQFVGEFTGNRVNGLAEVTVKNKFLVGDQLELMTPSGNINFTLESMANKKGQTIEVAPGDGHIVYLPIPEEIILNYALLIRNLKGTNTRTPHTKEIQEK

SEQ ID NO: 9344 - protein, 56 aa, Xenorhabdus bovienii
  Coding DNA sequence: Name=SeqID_3236
MKKQKVLIKTIFFYCGFIFNHLNLLYFIYFGIKEKASSREIELAKEVVPSLTVKLF

SEQ ID NO: 9345 - protein, 349 aa, Xenorhabdus bovienii
  Coding DNA sequence: Name=SeqID_3237
  Gene classification: Gene name=FbaB; Function=DhnA-type fructose-1,6 -bisphosphate aldolase and related enzymes; Function class=G Carbohydrate transport and metabolism
  Homolog annotation: Query=1..349bp; Hit=25..374bp; Blast score=598; Percent Identity=85.0; E value=1e-171; Homolog= fbaB COG1830
MTDIAKLLGKDAESLLQHQCTTIQSEHLYLPGADFVDRVMIENNRPNTVLRSMQTLLNHGRLAGTGYLSILPVDQGVEHSASASFAANPLYFDPKNLVELAIEAGCNCVASTYGVLASVSRRYAHKIPFLVKLNHNEALTYPAQYDQTLYTSVEQAFDMGAVAVGATIYYGSTESRRQIGEISAAFERAHELGMVTVLWAYLRNSAFKKDGVDYHTSADLTGQANHLAATIGADIVKQKMAETNGGYTAIGFGHTDKRVYTHLTTEHPIDLVRYQLANCYMGRAGLINSGGASGANDLSDSVRTAVINKRAGGMGLILGRKAFKKSMKEGVELIHSVQDVYLDKKVTIA

SEQ ID NO: 9346 - protein, 284 aa, Xenorhabdus bovienii
  Coding DNA sequence: Name=SeqID_3238
  Gene classification: Gene name=ThiD; Function =Hydroxymethylpyrimidine/phosphomethylpyrimidinekinase; Function class=H Coenzyme metabolism
  Homolog annotation: Query=21..284bp; Hit=3..266bp; Blast score=379; Percent Identity=73.0; E value=1e-105; Homolog= thiD COG0351
MVSPIRILAFLWLVLGVTIMRINSLTIAGTDPSGGAGIQADLKTFSALGAYGTTVITALVAQNTMGVQSVYDIDPRFVAAQLESVLSDVRMDSIKIGMLSNVANVNVVAEALNRYPVPHIVLDTVMVAKSGDPLLSSEAITTMVEQLLPNVSLITPNLPEAAAILKCNIAGTEGEMLHQGRELLSMGCQAVLLKGGHLVNEESPDWLFTAEGEWRFTAPRINTRHTHGTGCTLSAALAALRPRYPDWKNTLPAAKTYLQNALAQADTLDVGKGIGPVHHFHQWW

SEQ ID NO: 9347 - protein, 121 aa, Xenorhabdus bovienii
  Coding DNA sequence: Name=SeqID_3239
MLKTKTDIQRFTIPDGKTMKKEIVFNNGLTGLYFAARRNPSGVITKSWRYIVGSNDITLGTYPAYSLEETRKWHLQQVQKTRQGFAPSKTLIGKPTTMDGLVQEWLEVKCAKPSKPGRQAI

SEQ ID NO: 9348 - protein, 245 aa, Xenorhabdus bovienii
  Coding DNA sequence: Name=SeqID_3240
  Homolog annotation: Query=41..217bp; Hit=206..385bp; Blast score=66; Percent Identity=24.0; E value=4e-10; Homolog= dbj|BAC96883.1|
MLYAFQVHGIQGQQPGQPVYVPQKLSEIHDRKKVAALVGKIRDNHLQAEQYRILWHFLGNTPSHAAMRFIMVFGTRKSESAKLVWPEIDLKAKTWTLPAERTKTKQERVYPLPDYLISLLEEWSWTQHNLGKQIWTHIGHTTMSHSAVRLRETVGNDFTTHDLRRSTASMMSNEAGIDPIIVDLMLGHSLSMVISKILATYQPKAFQKKVDKAWPVWFQWFEKNIINKKPKEWQEEQPKLADASK

SEQ ID NO: 9349 - protein, 98 aa, Xenorhabdus bovienii
  Coding DNA sequence: Name=SeqID_3241
  Gene classification: Gene name=XerC; Function=Integrase; Function class=L DNA replication, recombination and repair
  Homolog annotation: Query=1..95bp; Hit=318..412bp; Blast score=157; Percent Identity=73.0; E value=2e-39; Homolog= Z4313 COG0582
MSENTINKALRKMGYDTQQDICGHGFRTLACSALIESGLWSEDAVELQMSLKESNSVRGAYTHKAKHLDQRRLMLQWWADYLDANRKGMVRPFEFTNR

SEQ ID NO: 9350 - protein, 94 aa, Xenorhabdus bovienii
  Coding DNA sequence: Name=SeqID_3242
MISGLDGGNFILSLMAKERVKSGILNRATIEGFKGEYTVIFDGSELKGKPLVLCSSRQPYEARIFKSIDGAVAELLRIGLSEASVKNTSKPNSK

SEQ ID NO: 9351 - protein, 153 aa, Xenorhabdus bovienii
  Coding DNA sequence: Name=SeqID_3243
  Gene classification: Function=Adenine specific DNA methylase Mod; Function class=L DNA replication, recombination and repair
  Homolog annotation: Query=17..126bp; Hit=14..129bp; Blast score=62; Percent Identity=39.0; E value=2e-10; Homolog= PM0698 COG2189
MDIQKETLFSEIETANSKQLAVLKANFPQCFDKKGAFIQEKLLEIVKSADIELSKESYSLNWLGKSYARLLANLPPKTLLTEDKEHNHIEQNKNSQNLLIKGDNLEVLKHMVNAYSEKVKMIYIDPHITQVRMDSYIMMIVTSLENNSVNLLV

SEQ ID NO: 9352 - protein, 425 aa, Xenorhabdus bovienii
  Coding DNA sequence: Name=SeqID_3244
  Gene classification: Function=Adenine specific DNA methylase Mod; Function class=L DNA replication, recombination and repair
  Homolog annotation: Query=1..317bp; Hit=199..520bp; Blast score=140; Percent Identity=32.0; E value=3e-33; Homolog= HP0593 COG2189
MCDEIFSEQNFIGNIVRATGQTTGQDSGGLGASFDYILVYTKSNNIDLSGLPLTDHDLKRFQNKDDVGYYAYDQMRKTGSNDKREERPNMFYAVLDPDGNEVFPIASAGYEGRWRFSKETYLKQVEDNMVLWKKTNRNGEEVWWPYVKYYVEGRTKRPSPLWTEFEGNKKAARDLRSLFDGKKIFDFPKPIQVIQSLIYIVPNASKDDLILDFFAGSGSTSHAVMAINANDLGNRKFVSIQIPENTPETSEAYNSGYKNIFEITKERLVRASNKIKKEHPDFNGDLGFKIFETVDDFRVKDESELTLSNHTFFDDAVLTQKQYDTLLTTWCLYDGSLLTTPIEDVDLQGYKAHLCDGRLYLIAPNFSSESLKALLQKLDSDKDFAPNKVVFFGGNFESAKQMELNEALKSYANKKSIELDLVVRN

SEQ ID NO: 9353 - protein, 969 aa, Xenorhabdus bovienii
  Coding DNA sequence: Name=SeqID_3245
  Gene classification: Function=Restriction endonuclease; Function class=L DNA replication, recombination and repair
  Homolog annotation: Query=4..967bp; Hit=3..967bp; Blast score=1018; Percent Identity=56.0; E value=0; Homolog= NMA1466 COG3587
MSKGFTFEKNLPHQKAGVDAVMNVFVSAILHKTDNVAIRLLANPELNLTEQQYYNNLKAVQQFNGIEHTKQHYDAKSNIIDISMETGTGKTYTYTKTIFDLNKAFGINKFIIIVPTLSIKAGTVNFLKSEALKEHFRDDYERELKAYVVESQKNSGKNTKSYMPQAIHDFVEASNFNKKYIHVLVINSGMINSKSLTDTYDVGLLDNQFDTPFSAISAVKPFVIIDEPHKFPTAKKTWENIEKFNAQYIIRYGATFSDGYENLVYRLTAVDAFNQDLVKGIDAYVEDIVGDSSASLKFVKSDGKEARFDLSENEKKSSYHLTKGESLSITHSSIHDLYIDSLNKSTVVLSNGIELKTGESINPYSYDQTLEDNMMRKAVKEHFKLEKDYLTQRPRIKPLTLFFIDDIEGYRDGNEIAGSLKTKFEEIVLAEANELLKSEKDNFYRKYLEKTVQDISLVHGGYFSKDNSDRDEKIEQEINEILHDKELLLSLENPRRFVFSKWTLREGWDNPNVFQICKLRSSGSTTSKLQEVGRGLRLPVNEYMCRVKDRNFTLNYYVDFTEKDFVDSLVKEVNDSSFKETVPSKLTQELKDKILSQYPALSSMKLMIELVNNEIIDENENFKDSDAYARLKVKYPAAFPIGVKPNKIKKASDGKRRTKMRAGKFNELRELWELINQKAVIEYKINSENEFLSIFRSFMLEEAERFTKSGLHTRIDRIYIHNDTAMSKSIVSDDDNFAKLNTMAYQEFLDNLSQTVFVKRDTLHKVFCEIKDTINITDYLNIQTIRKIKSGFSKYLLNNSFNKFSLGYNVISGSIHPTKFTNADGEPLNEILSSDLGILNDSIKPPLDSYLFEEVFYDSELEKLNITDGEITSVAVFTKIPKNSIKIPVAGGYTYSPDFAYVVKTTKGDYLNFIIETKNVDGKDSLRLEEDRKIKHAQALFNQISKSVKVEFKTQFSADTIGELIKQVR

SEQ ID NO: 9354 - protein, 94 aa, Xenorhabdus bovienii
  Coding DNA sequence: Name=SeqID_3246
  Homolog annotation: Query=4..93bp; Hit=16..105bp; Blast score=61; Percent Identity=44.0; E value=3e-09; Homolog= ref|NP_929108.1|
MTRKDIKQQIASAQERLYFLEAKKKQQTKKENTRQKIIFGAEVAKVLGCDIGYVDKELVFGILLNISNLPERDIQVYRAQGQVYIENAINKSKY

SEQ ID NO: 9355 - protein, 80 aa, Xenorhabdus bovienii
  Coding DNA sequence: Name=SeqID_3247
MYKNNDEAIDWETKMLLDDGIYTDTEQAYLEAEKIVNQIREQAKQHQIKQQFKLKVKSIKRQISNGYDYVNVPYANKKKH

SEQ ID NO: 9356 - protein, 53 aa, Xenorhabdus bovienii
  Coding DNA sequence: Name=SeqID_3248
MYPISYLIISIIKLKSLIHFTHWRFTFPCARLALTLFSPFCKWNYIIARLFIG

SEQ ID NO: 9357 - protein, 87 aa, Xenorhabdus bovienii
  Coding DNA sequence: Name=SeqID_3249
MVHEMLLKLLPQNWRYLLSSYLLIILVVILLKVVFFVMIHKDLTEQRAERFKNAPVSHAQYDPSKLTHRMVKFDESNGIISDKEAYK

SEQ ID NO: 9358 - protein, 318 aa, Xenorhabdus bovienii
  Coding DNA sequence: Name=SeqID_3250
  Gene classification: Function=Predicted transposase; Function class=L DNA replication, recombination and repair
  Homolog annotation: Query=15..299bp; Hit=1..281bp; Blast score=301; Percent Identity=54.0; E value=7e-82; Homolog= Z4330 COG3335
MPIIAPIPRNERQKMKKLIQKTQNKDYARRMMALLMLHKGDTVSHVAKTLCASRSSVNRWVNWFTLYGLDGLKSLPPGRPAIWNLEPLLAVVSFLLKHSPQHFGYLRSRWSLELITHKINVLLDISLSQSTLYRYFYRAGIVWRRAAPTLRLSDPEHDEKRAKITGALSNASEQHPVFYEDEVDIDLNPKIGADWCFKGQQKRVVTPGKNQKHYLAGCLNAKTKEITYVGGLRKNSDLFIKLLDVLNNQYVNAKTITLILDNYGIHKSQKVIAWLAKNPKFNLLFLPVYSPWLNKIERLWQSLHETVTRNHCCQFMWQ

SEQ ID NO: 9359 - protein, 49 aa, Xenorhabdus bovienii
  Coding DNA sequence: Name=SeqID_3251
MISGLSKILSTPTDELTHLLFRPTVINGGGLNIGSSNNKSSLKLNKNSK

SEQ ID NO: 9360 - protein, 48 aa, Xenorhabdus bovienii
  Coding DNA sequence: Name=SeqID_3252
MKNDISIIVNMLCEKTPKVMNLIQESFDIFIALRVYSVEEVMNDIRAF

SEQ ID NO: 9361 - protein, 97 aa, Xenorhabdus bovienii
  Coding DNA sequence: Name=SeqID_3253
MTKENIIENESTGLFLDLACRSFEASWKVFLEINGEGGSDELLDDPDFMSPFIINIIDHITKSYEKFTAQEGNMGDINEINIEKVAALLVSYTKSFK

SEQ ID NO: 9362 - protein, 104 aa, Xenorhabdus bovienii
  Coding DNA sequence: Name=SeqID_3254
MNNQEIKNIKESSTKSFAAMAKNLYIFGLNIYKEQEEYDFLASIMLDKNRTESYILHVKDYLAKRFDEHMEESSKNERLMYVDMDKVIFEMRCIHIKALIFSLT

SEQ ID NO: 9363 - protein, 88 aa, Xenorhabdus bovienii
  Coding DNA sequence: Name=SeqID_3255
  Gene classification: Gene name=AlpA; Function=Predicted transcriptional regulator; Function class=K Transcription
  Homolog annotation: Query=27..84bp; Hit=7..64bp; Blast score=66; Percent Identity=56.0; E value=5e-12; Homolog= Z3946 COG3311
MRNNNTNQQRTEFYEQSFVKNEAASRRFIRLPEVLKRVGLSRARMYGLINAGRFPKQVRIGLRSIAFIESEIEAWMDRVIADSRNESH

SEQ ID NO: 9364 - protein, 31 aa, Xenorhabdus bovienii
  Coding DNA sequence: Name=SeqID_3256
MSLVLHKGTCLGGRLPEIMERAGVTHEILVG

SEQ ID NO: 9365 - protein, 369 aa, Xenorhabdus bovienii
  Coding DNA sequence: Name=SeqID_3257
  Homolog annotation: Query=5..365bp; Hit=11..372bp; Blast score=248; Percent Identity=37.0; E value=2e-64; Homolog= ref|NP_415977.1|
VDVFSDFPDPRCQGKVKHRFIDILVIAVCAVIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDSHGRTVRRRGWVLPLTSETKHLRSWPDIQALLVTETIRQEHYSDTVTSDFRYYLSSCHDSPAFQLGAIRKHWAIENSLHWVLDVTFREDDSRMRERVATRIFAQLRKMALNIVKRDINSKLSLSARRKSAGWDNGYMEALLFNQF

SEQ ID NO: 9366 - protein, 292 aa, Xenorhabdus bovienii
  Coding DNA sequence: Name=SeqID_3258
  Homolog annotation: Query=3..289bp; Hit=5..283bp; Blast score=120; Percent Identity=29.0; E value=2e-26; Homolog= ref|NP_289201.1|
MKSGEVIKAAKQWFRMSNYDVLQDITLNDVNDELSRRAVLFRYDSMNEQSPRYQRYLEEEAKILAGTPLLVSSIEAIPPTSKKKNPLVDATFHVQHMTINDISRYEAELRKLNLLQRSDVSPDAPSTPVSREQGKQRLTDIELLNDDHSLYLWLNIKRLTDDEVIEHIKIMLPQWRKEYGITEPEIGLFRFGLSTIKKVISLRIIPMLDLMLWANHRGVKISNEQMSRLLYPNDSEVIRGGAQIKDTDKPFAEKALTREFARLFNLYLSKDSYMMDVRVADAMKMNEKEEEN

SEQ ID NO: 9367 - protein, 69 aa, Xenorhabdus bovienii
  Coding DNA sequence: Name=SeqID_3259
  Gene classification: Gene name=CspC; Function=Cold shock proteins; Function class=K Transcription
  Homolog annotation: Query=1..69bp; Hit=1..69bp; Blast score=106; Percent Identity=84.0; E value=4e-24; Homolog= cspC COG1278
MAKITGTVKWFNESKGFGFITPADGSKDVFVHFSAIMKDGFKTLSEGQQVEFEIQNGPKGPAAANVTAL

SEQ ID NO: 9368 - protein, 34 aa, Xenorhabdus bovienii
  Coding DNA sequence: Name=SeqID_3260
MCALGSAPEKNGLRLYKEYVIKHMGKRSIGSVNE

SEQ ID NO: 9369 - protein, 38 aa, Xenorhabdus bovienii
  Coding DNA sequence: Name=SeqID_3261
MSQQVIIIIMPLCYYRFFLSNIIDCHFSQLIFPGHTIV

SEQ ID NO: 9370 - protein, 56 aa, Xenorhabdus bovienii
  Coding DNA sequence: Name=SeqID_3262
LNEEVRLSGTHYVAQTLFPASFSLLSMMLAVGSLMNLIIRPAGNRSGRKNTEKIYR

SEQ ID NO: 9371 - protein, 456 aa, Xenorhabdus bovienii
  Coding DNA sequence: Name=SeqID_3263
  Gene classification: Gene name=AnsP; Function=Gamma-aminobutyrate permease and related permeases; Function class=E Amino acid transport and metabolism
  Homolog annotation: Query=3..440bp; Hit=4..450bp; Blast score=564; Percent Identity=69.0; E value=1e-161; Homolog= PA3000 COG1113
MAEQAEQSTLKRGLKNRHIQLIALGGAVGTGLFLGIAQTIKMAGPSVLLGYAIGGFIAFLIMRQLGEMVVEEPVAGSFSHFAYKYWGDFAGFLSGWNYWAMFILVGMAELTAVGMYIHYWWPEIPTWISAAIFFVLINAINLINVRLYGETEFWFSIIKVTAIIGMIIFGAYLLISGTGGPQASVANLWQYGGFMPNGISGLIMAMAVIMFSFGGLEMVGITAAEAEDPEKNIPKATNQVVYRILLFYIGSLSILLSLYPWMNVVEGGSPFVLIFDHLDNFWVSNILNVVVLTAALSVYNSGVYCNSRMLYGLAKQGNAPRILTKVNHRSVPVLSIGLSALATSIGVLVNYIMPGKAFELLMALVVTTLVINWIMICLAHLKFRAAKNAEGIKTKFQAFWYPFGNYLCLIFLAFILVVILMTPEIRISVILMPFWIGMLWGGYLFSKAKRAKARVI

SEQ ID NO: 9372 - protein, 64 aa, Xenorhabdus bovienii
  Coding DNA sequence: Name=SeqID_3264
LNLNRARNFLISPNFYAICRAQTTLTIVAIGLSSDFSATFKPTPLSYLIYHFEPRLCSYESNSF

SEQ ID NO: 9373 - protein, 47 aa, Xenorhabdus bovienii
  Coding DNA sequence: Name=SeqID_3265
MKGLNWGSVQLPDTCLFDIHLNHSLATICANIHSQYSFLGKDVLIFT

SEQ ID NO: 9374 - protein, 128 aa, Xenorhabdus bovienii
  Coding DNA sequence: Name=SeqID_3266
  Gene classification: Gene name=AraC; Function=AraC-type DNA-binding domain-containing proteins; Function class=K Transcription
  Homolog annotation: Query=5..107bp; Hit=2..104bp; Blast score=89; Percent Identity=41.0; E value=6e-19; Homolog= soxS COG2207
MPQDNHLALVCALSKWIENHLGRVIHLEELAAYSGYSLWHMQKIFKEVTEISLGKYIRQRRLAGAVHLLRNSSLSIFDIALDFGFGSQSHFTYMFRKEYGITPYDFRQSTDIELEVKLPLHLTYNCQL

SEQ ID NO: 9375 - protein, 277 aa, Xenorhabdus bovienii
  Coding DNA sequence: Name=SeqID_3267
  Gene classification: Gene name=AmpD; Function=Negative regulator of beta-lactamase expression; Function class=M Cell envelope biogenesis, outer membrane
  Homolog annotation: Query=13..276bp; Hit=13..273bp; Blast score=228; Percent Identity=47.0; E value=8e-60; Homolog= ybjR COG3023
MIRKLILGVCITLLIGCSHQPQREVRNDYIVDHSHSYSTKQGIDSARFLVLHYTALNDQNSLRVLTGGNVGVHYLIPSRPKYENKEPVIFQLASENEKAWHAGRSDWRGYKNLNSNSIGIEIVNCGFKQHFIKKEWCLYHPSQIDALIRLAKDIIQRYQIEAVNVVGHSDIAPLRKKDPGPVFPWQALYQQGIGAWPDLITVNKYLANRVPSMPVPVIGIQKALVLYGYSMPQTGHLDEDTHKIIQAFQMHFRPSDISGVPDAETEAIALALVEKYK

SEQ ID NO: 9376 - protein, 38 aa, Xenorhabdus bovienii
  Coding DNA sequence: Name=SeqID_3268
MPGFYWILISTSASKKHHIYCSLIYYIVMMILFFLHNH

SEQ ID NO: 9377 - protein, 39 aa, Xenorhabdus bovienii
  Coding DNA sequence: Name=SeqID_3269
MYILYLLNCCFIGGFHSPQSYRKLYSWGFASLIYYRAAT

SEQ ID NO: 9378 - protein, 474 aa, Xenorhabdus bovienii
  Coding DNA sequence: Name=SeqID_3270
  Gene classification: Gene name=AlsT (BS); Function=Na+/alanine symporter; Function class=E Amino acid transport and metabolism
  Homolog annotation: Query=1..466bp; Hit=11..475bp; Blast score=599; Percent Identity=70.0; E value=1e-171; Homolog= VC2356 COG1115
MLWDYVLIYLLLGVGLYFTLRTGLIQLRHFGHMFSVLKNSNKSDDSGISSFQALCTSLAARVGTGNLAGVAIAITAGGPGAIFWMWVVAFIGMATSFVESTLAQLYKTKDDQGNYRGGPAYYMEKGLKKRWMGVLFSVFLIIAFGLVFNAVQANSIAEAAAFAFHVKPIYVGIVLVIISGAIIFGGLRSIARVAELVVPLMAGAYLLLAFWVIGHNIERIPEVFALIIKSAFGLQEAIAGTLGYGISQAMIQGVQRGLFSNEAGMGSAPNAAASASPYPPHPASQGYVQMLGVFMDTIVICSATAVIILSSGILNENVTAISGIELTQRALSSAVGHWGTTFIAIAIFFFAFTSIIANYAYAESNMIFLERNHTAGLFILRLAALSMVMFGSLAEVPLVWSMANLSMACMAIVNLIAILLLSGIAIKLAKDYNQQRKAGQLPTFDINMYPELQKEVEEGIWDNKSSQDSQKCSH

SEQ ID NO: 9379 - protein, 43 aa, Xenorhabdus bovienii
  Coding DNA sequence: Name=SeqID_3271
MYYSLFLPPIYCHVPYVVITLFIKNTKIITKFNIEISKIYENI

SEQ ID NO: 9380 - protein, 63 aa, Xenorhabdus bovienii
  Coding DNA sequence: Name=SeqID_3272
MLERKRKNPADNILPKRVYRGKSKYEYHPATGGSISICCLSSPVSVVWKEYNKVVEKIEKNST

SEQ ID NO: 9381 - protein, 172 aa, Xenorhabdus bovienii
  Coding DNA sequence: Name=SeqID_3273
  Homolog annotation: Query=36..162bp; Hit=22..148bp; Blast score=147; Percent Identity=56.0; E value=6e-35; Homolog= ref|NP_407151.1|
MLKRTIANGVLLMYLCKILKIAVIPALIVLSLSTPALAKDGALISLPDKRFAVISVSDLESESIGSYSIAVFKDRDLTEFETGAVFSRDGLVFEDNNKPRVTFADINGDGAKELIVYKLTAGSGNYLEVDALKITDKNVKFLARINTDSKHDPIQLLRTLCKKGQCTGQLHH

SEQ ID NO: 9382 - protein, 123 aa, Xenorhabdus bovienii
  Coding DNA sequence: Name=SeqID_3274
MKRLLLPLFLVPFFSYAAHMNADKTAETYCDLFGKASVEAFKTNASPDAIAQKTFNELNKKGFDLKEIHSNKDELISSIKQTVIEVRKNKQVFPSHKHFDESLDKSVKTCKTQIKNTLSQGTQ

SEQ ID NO: 9383 - protein, 205 aa, Xenorhabdus bovienii
  Coding DNA sequence: Name=SeqID_3275
  Gene classification: Gene name=PrfB; Function=Protein chain release factor B; Function class=J Translation, ribosomal structure and biogenesis
  Homolog annotation: Query=39..201bp; Hit=1..163bp; Blast score=197; Percent Identity=61.0; E value=6e-51; Homolog= prfH COG1186
MILLQISAAQGPDECALAVRKALEQLIHEADELGVMADILEEEAGRRSHTLRSVMVAIQGENEQQLFERWNGTIKWICASPWRKGDGRKNWFIGVAQFKPLQQMMESEIRFETLRASGPGGLHVNKTESAIRAVHIASGISVKIQSERSQHANRRLACLLLEHRLQQQQDMHQAQLKAERRLFHNQIERGNPVRTFAGMQFNPQI

SEQ ID NO: 9384 - protein, 373 aa, Xenorhabdus bovienii
  Coding DNA sequence: Name=SeqID_3276
  Gene classification: Gene name=RtcB; Function=Uncharacterized ACR; Function class=S Function unknown
  Homolog annotation: Query=1..370bp; Hit=1..375bp; Blast score=461; Percent Identity=61.0; E value=1e-130; Homolog= PA5471 COG1690
MGNTLHLAASRVQIIAAENTWLEGKAIQQLETTAQLPDMVSVVGLPDLHPGRGYPVGAAFFSHSRFYPALIGNDIGCGMALWRTDLTLNKWSLDKLEKRPGSIDNPLQAAELPDDIPEHFCYSPGTIGGGNHFAELQQLDEIYQPEMLETWQLNKQQLLLLVHSGSRGLGQVILEQHVREHGHNGLIASSPEAQSYLQLHQQALDYACFNRQLIAERMLKRWRTHGSCLFDVSHNMLMPYTIGGVDGWLHRKGATPSDQGAVIIPGSRGDYSYLVQPLTSDRSLFSLAHGAGRKWMRGECKARLTGRYNAEQLSRTAFGSRVICLDKQLIFQEAPEAYKPIGGVMDAMLQAGLVKLIARLKPVLTYKTRGNKE

SEQ ID NO: 9385 - protein, 63 aa, Xenorhabdus bovienii
  Coding DNA sequence: Name=SeqID_3277
VITIDIVIYENRWLYLFVIIEYALSATITCGQMRLNKTPVMAIRLRVRCSVCKYRYKLNPINN

SEQ ID NO: 9386 - protein, 245 aa, Xenorhabdus bovienii
  Coding DNA sequence: Name=SeqID_3278
MRKIIMLFTLLFTSVNVNAQVLNENNPDKYKKFRLDYVEMVDLANPQRLSYRVFYEEPSTGENSKWFDAIKQGDFETVKKMVESGQDIEAKDTGSLNQTALGWATFIGYEDIVDYLISKKANLWATDTRDVHHTLKSAVLGKNTNIVKKIHNLMKHELDLNDQTIEDDGETPVMIAASNNRIEIVKYLIEQGANLNLFTITDDKSMYSYDQSALTYACERNLEEMQKLLIKHGALNHKTHKPSCN

SEQ ID NO: 9387 - protein, 349 aa, Xenorhabdus bovienii; identical to SEQ ID NO: 8654
  Coding DNA sequence: Name=SeqID_3279
  Gene classification: Function=Predicted transposase; Function class=L DNA replication, recombination and repair
  Homolog annotation: Query=183..336bp; Hit=34..184bp; Blast score=70; Percent Identity=29.0; E value=2e-12; Homolog= BH2520 COG3335

SEQ ID NO: 9388 - protein, 88 aa, Xenorhabdus bovienii
  Coding DNA sequence: Name=SeqID_3280
MHQFEGFFLGICQINFHERDHDLIQMKNQASSMTTDIYHNLTGDKSVLRKSLSGILVNESLISINQRKLSGVQNRKSQSWQQSPFPFP

SEQ ID NO: 9389 - protein, 39 aa, Xenorhabdus bovienii
  Coding DNA sequence: Name=SeqID_3281
MKSHYKCHEYIRVTHHSPLLIIEPVPFAIAPENFTVFTN

SEQ ID NO: 9390 - protein, 84 aa, Xenorhabdus bovienii
  Coding DNA sequence: Name=SeqID_3282
MTFIMGFHEGLYMAEVVKFINSLFCDYVFLFGFFWCISVPIGLIFTAMACVFKKATYRILCSILAIFFLFPPIFAFIISCKHEK

SEQ ID NO: 9391 - protein, 30 aa, Xenorhabdus bovienii
  Coding DNA sequence: Name=SeqID_3283
MKNRDGITECQFPGVVIMKAWGFDYFQKPH

SEQ ID NO: 9392 - protein, 415 aa, Xenorhabdus bovienii
  Coding DNA sequence: Name=SeqID_3284
  Gene classification: Gene name=SdaC; Function=Amino acid permeases; Function class=E Amino acid transport and metabolism
  Homolog annotation: Query=7..412bp; Hit=5..409bp; Blast score=270; Percent Identity=40.0; E value=2e-72; Homolog= yqeG COG0814
LKTEQKWIHEYNIWFYALFGTAVGAGTLFLPIQLGLSGPLAMLVMLLIAFPFTYYPHLGLARYIITSNSPSPTLLSATKQYYGIRIARIINFFYALTFLLIIFVYAISITNSVNILLQQFWQIQFPRTLTAFMVVLGLHLIFLLGKKITLKFMGVLVLPLILYLLTLSVTLIFQWDSANIKHLISNIHIDLDSVRALWLLMPVMVFSFSHTPIMSTFSNHCKRAYKTDAEYHIKQIVKPTYALICIVILFFVFSCVLTLSPQEIQATKDNNITILSAIAQKEGLYWIAITATPVAIIAMTKSFLGTYFGALEGVRGLVGALESKILHHKENKVRDKLIGMAIVFVLTLMITIWNPNTLKVIAGITGPMIALILFVLPSLSTYLVEPLRPYRSFSNLMVLLVGLGSFGIAVFSLFS

SEQ ID NO: 9393 - protein, 87 aa, Xenorhabdus bovienii
  Coding DNA sequence: Name=SeqID_3285
MGARDEITKGMQSSFDKLNETFGKKLPQRLEITEASFDALDKRLKAACDRLENVNSRLQYRFIAWLAVSVAVVGTLFFLKRFIFILV

SEQ ID NO: 9394 - protein, 48 aa, Xenorhabdus bovienii
  Coding DNA sequence: Name=SeqID_3286
MQLRENWQNTCNQHFERAQRPERIAEEIQKATKALIVAGSQTRDEKLR

SEQ ID NO: 9395 - protein, 33 aa, Xenorhabdus bovienii
  Coding DNA sequence: Name=SeqID_3287
MMLFAVTLNSISDVITPKILNTRLSESLFRADH

SEQ ID NO: 9396 - protein, 37 aa, Xenorhabdus bovienii
  Coding DNA sequence: Name=SeqID_3288
MQKARLMGFEALIYSRFHLRRRRGAATLSPDVFCPHQ

SEQ ID NO: 9397 - protein, 49 aa, Xenorhabdus bovienii
  Coding DNA sequence: Name=SeqID_3289
VSNNRNYWGTSFACAAFAYSIIKFACLCGLDLNLGDNYDVYYENNLNSL

SEQ ID NO: 9398 - protein, 53 aa, Xenorhabdus bovienii
  Coding DNA sequence: Name=SeqID_3290
LYTEIPLQNGLKFERYFSAKIIQSLPRSSWYLSGFCCIKVKSGNILSFTLAVS

SEQ ID NO: 9399 - protein, 417 aa, Xenorhabdus bovienii
  Coding DNA sequence: Name=SeqID_3291
  Gene classification: Gene name=Icd; Function=Isocitrate dehydrogenases; Function class=C Energy production and conversion
  Homolog annotation: Query=1..417bp; Hit=1..416bp; Blast score=764; Percent Identity=88.0; E value=0; Homolog= ZicdA COG0538
MESKVVVPAEGKKITIDAKGKLNVPNNPVIPYIEGDGIGIDVTPVMLKVVDAAVQKAYGGERKISWMEIYTGEKSTQVYGKDVWLPEETLDLIRDYRIAIKGPLTTPVGGGIRSLNVALRQQLDLYICLRPVRYYQGTPSPVKQPELTDMVIFRENAEDIYAGIEWKAGSAEADKVIKFLQDEMGVTKIRFPQQCGIGVKPCSEEGTQRLVRAAIEYAIDNDRESVTLVHKGNIMKFTEGAFKDWGYELALTEFGGELLDGGPWVKIKNPKSGKDIIIKDVIADAFLQQILLRPAEYDVIACMNLNGDYISDALAAQVGGIGIAPGANIGDECALFEATHGTAPKYAGQDKVNPGSVILSAEMMLRHMGWFEAADLIIKGTEGAIAAKTVTYDFERLMEGAKLLKCSEFGDALISHM

SEQ ID NO: 9400 - protein, 227 aa, Xenorhabdus bovienii
  Coding DNA sequence: Name=SeqID_3292
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=19..224bp; Hit=1..205bp; Blast score=285; Percent Identity=70.0; E value=2e-77; Homolog= ymfC COG1187
MVTDLRYNTHPHFARWLIMTNISFKKRKLNRFSQRKNKDTIKKLTGPRRVLIFNKPYDVLPQFTDEMGRTTLKDFIPFLDVYAAGRLDRDSEGLLILTNDGKLQAKLTQPHKKTAKVYYVQVEGIPDESALNKLRNGVTLKDGPTLSAGAELVEEPEWLWERIPPIRERKSIPVSWLKITLFEGRNRQVRRMTAHVGFPTLRLIRFSMGSLQLGQLSPGEWREIDFV

SEQ ID NO: 9401 - protein, 150 aa, Xenorhabdus bovienii
  Coding DNA sequence: Name=SeqID_3293
  Gene classification: Gene name=MutT; Function=NTP pyrophosphohydrolases including oxidative damage repair enzymes; Function class=L DNA replication, recombination and repair
  Homolog annotation: Query=1..150bp; Hit=1..150bp; Blast score=209; Percent Identity=66.0; E value=9e-55; Homolog= ymfB COG0494
LFNPHVTVACIVHAKSKFLIVEEFINEIPLWNQPAGHLEAGETLLEAAERELWEETGIRAKPQALLKLHQWNAPDGTPFIRFLFLIEMEQIVDTDPQDKDIHCCHWLNAEEILSSPQLRSPLVAESIRCYLENQAYPLSILDSYGSPFTK

SEQ ID NO: 9402 - protein, 76 aa, Xenorhabdus bovienii
  Coding DNA sequence: Name=SeqID_3294
MQKRSSAAHSYDHRSLLKVSAVIWKIRLTRYQYWIAMGHLSPNELLNKKPNKKAREDVWCTLSTDVLKYCACFFPQ

SEQ ID NO: 9403 - protein, 367 aa, Xenorhabdus bovienii
  Coding DNA sequence: Name=SeqID_3295
  Gene classification: Gene name=TrmU; Function=Predicted tRNA(5 -methylaminomethyl-2-thiouridylate) methyltransferase, contains the PP-loop ATPase domain; Function class=J Translation, ribosomal structure and biogenesis
  Homolog annotation: Query=2..365bp; Hit=16..379bp; Blast score=637; Percent Identity=85.0; E value=0; Homolog= ZycfB COG0482
MLDNSQKKVIVGISGGVDSSVSAYLLQQQGYQVAGLFMKNWEEDDGEEYCSAAADLADAQAVCDKLGIELHTINFAAEYWDNVFEHFLAEYKAGRTPNPDILCNKEIKFKAFLEFAAEDLGADYIATGHYVRRRDVDGISQLLRGLDDNKDQSYFLYTLSHQQIAKSLFPVGELEKPEVRRIAEEIGLVTAKKKDSTGICFIGERKFRDFLGRYLPAQPGSIITVDGQTIGQHTGLMYHTLGQRKGLGIGGTKDGSEEAWYVVDKDVENNTLIVAQGHDHPRLMSVGLIAQQLDWVDRQTLKTEIRCVVKTRYRQHDIPCTVIPLSEDKIEVRFDSPVAAVTPGQSAVFYQGEICLGGGVIEQRIQE

SEQ ID NO: 9404 - protein, 208 aa, Xenorhabdus bovienii
  Coding DNA sequence: Name=SeqID_3296
  Gene classification: Function=Uncharacterized protein involved in purine metabolism; Function class=R General function prediction only
  Homolog annotation: Query=1..207bp; Hit=1..208bp; Blast score=250; Percent Identity=64.0; E value=6e-67; Homolog= ycfC COG2915
VAKNYYDITLALAGICQSGHLVQQLAHEGQCDADTFEVMINSILNMNPASTQDVFGNDACNLRIGLDAMLSMFNNTRSGVSAGLTRYMLSLIVLERRLSKNQAAANELANRINQLERQQTYFEPMSEGILNALAGIYVDVISPLGPRIQVTGSPDVLRNTLVQAKVRAALLAGIRSAVLWQQVGGSRLQIMFSRQRLIRQAKDILDHC

SEQ ID NO: 9405 - protein, 456 aa, Xenorhabdus bovienii
  Coding DNA sequence: Name=SeqID_3297
  Gene classification: Gene name=PurB; Function=Adenylosuccinate lyase; Function class=F Nucleotide transport and metabolism
  Homolog annotation: Query=1..456bp; Hit=1..456bp; Blast score=824; Percent Identity=86.0; E value=0; Homolog= ZpurB COG0015
MELSSLTAVSPIDGRYGDKVSALRAIFSEFGLLKFRVQVEVRWLQKLAATTEIKEVPAFDASANAYLNEIVANFNEQDALRIKEIERTTNHDVKAVEYFLKEKVAHIPALHQVSEFIHFACTSEDINNLSHALMLKTAREEIILPQWRQLIDTIKRMAHDYRDLPLLSRTHGQPATPSTVGKELANVAYRMERQFRQFGQVEILGKINGAVGNYNAHLSAYPQVDWHQFSESFVTSLGIQWNPYTTQIEPHDYIAELFDCVARFNTILLDFDRDTWGYIALNHFKQKTVAGEIGSSTMPHKVNPIDFENSEGNLGLANAVLGHLASKLPVSRWQRDLTDSTVLRNLGVGLGYALIAYQATMKGLNKLEINEQHLLDELDQNWEVLAEPIQTVMRRYSIEKPYEKLKKLTRGKRVDAEGMKTFIDGLELPEEEKSRLKSMTPANYIGYATSLVDELK

SEQ ID NO: 9406 - protein, 51 aa, Xenorhabdus bovienii
  Coding DNA sequence: Name=SeqID_3298
MKVTFKNKGLELVGVDNFAFIYVLCNFSHAFFPLWTGKFPVHRGIYEKILF

SEQ ID NO: 9407 - protein, 227 aa, Xenorhabdus bovienii
  Coding DNA sequence: Name=SeqID_3299
  Gene classification: Gene name=OmpR; Function=Response regulators consisting of a CheY-like receiver domain and a winged-helix DNA -binding domain; Function class=T Signal transduction mechanisms
  Homolog annotation: Query=1..223bp; Hit=1..223bp; Blast score=322; Percent Identity=73.0; E value=2e-88; Homolog= phoP COG0745
MRILIIEDEAILRHHLTVQLQELGHQVDAAENTKEADYYLKENHPDIAIVDLGLPGEDGLSMIRRWRSDQVNLPILILTVHDSWQEKVTVLNAGADDYVTKPFRLEEINARIQALMRRHSGLASQLVELSPFLIDLSRKEFSVNKNSIKLTAFEYTIIETLMRNNGKVVSKESLMRQLYPDAELRESHTIDVLMGRLRKKISNEWSDEVIVTVRGQGYRFDVKQHDI

SEQ ID NO: 9408 - protein, 486 aa, Xenorhabdus bovienii
  Coding DNA sequence: Name=SeqID_3300
  Gene classification: Gene name=BaeS; Function=Signal transduction histidine kinase; Function class=T Signal transduction mechanisms
  Homolog annotation: Query=10..483bp; Hit=11..481bp; Blast score=500; Percent Identity=53.0; E value=1e-141; Homolog= phoQ COG0642
MIFKFSKKHISLRTRFLMATSAIILALTLSYGLVAIIGYLVSFDKTIYSILRSQSNLFSTLAKWDGSKLVIKIPSNLSMTNRSLALIYDNQGRILWRQNHTPELEKKIPEEWLKKDGLHDLSISFKEKEGFLYPKTSTQSDNSTKTDGIDNDESLTYSVAVNSYAKTDKLPAMTIVIIDTIPQDMQSSVKVWAWFGYVLLANLILIIPLIWLAADWSLRPIKSVITQISSLERGEREKLDEEPPNELKGLVRNLNALLSNERRRYTRYRTTLSDLSHGLKTPLAVLQSTLLSLRSGKQMSITQAEPIMLEQINRMSQLVDYYLRRANMHSDHNLLLRQTSSVSILLDRLIIALTKVYQYKGVDITLDVSSEITWLGEKNDFLEVMGNVLENACKYCLEFVEITALMGDNSVTIIVDDDGPGVPPEKRDMIFERGLRADTLRSGQGLGLSIAAEIVVQYDGSISVEDSPLGGTRVNVVFRSQQSCEY

SEQ ID NO: 9409 - protein, 385 aa, Xenorhabdus bovienii
  Coding DNA sequence: Name=SeqID_3301
  Gene classification: Function=Uncharacterized ACR; Function class=S Function unknown
  Homolog annotation: Query=11..383bp; Hit=2..374bp; Blast score=552; Percent Identity=70.0; E value=1e-157; Homolog= ycfD COG2850
MAGNSLVTQDVTMDYQLNLDWQSFLQNHWQKRPLLIKQGFQQFIDPLSPDELAGLAMENEIDSRLVSQKNGRWEVSHGPFEIYDHLGEKDWSLLVQAVNHWHLPSSALMKPFRMLSDWRMDDLMVSFSVPDGGVGPHLDQYDVFIIQGQGRRRWRVGEKIPMKQHCPHPDLLQVDPFEAIIDEEMLPGDILYIPPGFPHEGYAIEDSLNYSIGFRAPNARELFSGFADYILANELGSHRYSDPELALRDNPALIQSNELDTLRIMMRDLLEQPATFQNWFGEFISQSRHELDIAPPEPPYESDEIYELLKQGESLNRLSGLRVLRVGDQCFVNGELIDTPHIHAADALCQHDRVDAGILGDAIDDVRFISLLAALVNSGYWYFND

SEQ ID NO: 9410 - protein, 357 aa, Xenorhabdus bovienii
  Coding DNA sequence: Name=SeqID_3302
  Gene classification: Gene name=PepD; Function=Di- and tripeptidases; Function class=E Amino acid transport and metabolism
  Homolog annotation: Query=1..350bp; Hit=59..408bp; Blast score=563; Percent Identity=75.0; E value=1e-160; Homolog= ZpepT COG2195
MATLPSNVAWSVPVIGFISHLDTSPDFSGKHVNPQILENYRGGDIALGIGNEVLSPVMFPVLHNLLGKTLIMADGKTLLGADDKAGIAEIITAMVRLKQQNIPHGDIRVAFTPDEEIGKGGHSFDVEAFGAEWAYTVDGGGVGELEFENFNAATVTIKIVGNVVHPGSAKGVMVNASSLAMRIHHALPVDETPEHTEGYAGFYHLQSVKGTVERAEMYYLVRDFDRDNFEKRKNTLCAIAEKAGKGLHPDCYIELTIDDRYYNMYSEMMKHPHVIAIAKQAMLDCDIEPIIQPIRGGTDGAQLSYRGLPCPNIFTGGYNYHSRYEFISLEGMEQAVSVIMRIAELTAIRENNSLFDI

SEQ ID NO: 9411 - protein, 52 aa, Xenorhabdus bovienii
  Coding DNA sequence: Name=SeqID_3303
  Gene classification: Gene name=PepD; Function=Di- and tripeptidases; Function class=E Amino acid transport and metabolism
  Homolog annotation: Query=4..49bp; Hit=10..55bp; Blast score=60; Percent Identity=63.0; E value=3e-10; Homolog= HI1348 COG2195
MDRLLERFFEYIAFDTQSKPSAKAVPSSNGQLKLAKALHDELTQLGFSNYTE

SEQ ID NO: 9412 - protein, 276 aa, Xenorhabdus bovienii
  Coding DNA sequence: Name=SeqID_3304
  Gene classification: Gene name=SIR2; Function=NAD-dependent protein deacetylases, SIR2 family; Function class=H Coenzyme metabolism
  Homolog annotation: Query=5..273bp; Hit=7..275bp; Blast score=395; Percent Identity=71.0; E value=1e-110; Homolog= ycfY COG0846
MRVRHRFGKFCKIKRLRCQRLNRKNFYRDIRLANKIKRPHVVVLTGAGISAESGIRTFRSSDGLWEEHRVEDVATPEGFQRDAELVQAFYNARRKQLQQPEIQPNAAHYALVELEQQLGDNFLLVTQNIDNLHERAGSRRVLHMHGELLKARCCQSGQVIEWKTELTTEDRCHCCQFPSPLRPHVVWFGEMPLGMEQIYSALADADLFIAIGTSGHVYPAAGFVHEAKLSGTLTIELNLEPSQVESLFDEKHYGHASKIVTQYVQSLLQQMKADKS

SEQ ID NO: 9413 - protein, 415 aa, Xenorhabdus bovienii
  Coding DNA sequence: Name=SeqID_3305
  Gene classification: Function=ABC-type transport systems, involved in lipoprotein release, permease components; Function class=R General function prediction only
  Homolog annotation: Query=4..415bp; Hit=3..414bp; Blast score=532; Percent Identity=67.0; E value=1e-151; Homolog= ZycfW COG0577
MANLPLALFTALRFSRGRRRAGMVSLISVISTLGIMLGVAVLIIGLSAMNGFERELKNRVLSVVPHGQVYAVEQPFQHWEQALERVKQTAGIVGVSPYIEFTGLMEKGEKLHAVQIRGVEPTTEADVSALPQFVGDDAWKVFHAGKHQVILGQGVANSLHVKQGDWLTVMIPNSDPSLKLLQPKRIRLQVTGIFQLSGMLDHRLALVPLSDAQQYLDYGHAITGIAIKADNVFAAEQRVLDAGKATEKYVYISTWIKDYGYMYNDIQMVRGIMYLAMVLVIGVACFNIVSTLIMAVKDKSSDIAILRTLGAKDGHIRAIFLWYGLLTGMVGSVIGTMAGILTSLNLTTIIKGLEKLLGHQFLSGDIYFIDFLPSELHAMDIFYVLLTALILSLLASWYPARRASKLDPARILSGQ

SEQ ID NO: 9414 - protein, 233 aa, Xenorhabdus bovienii
  Coding DNA sequence: Name=SeqID_3306
  Gene classification: Gene name=PhnL; Function=ABC-type transport systems, involved in lipoprotein release, ATPase components; Function class=R General function prediction only
  Homolog annotation: Query=9..231bp; Hit=3..226bp; Blast score=315; Percent Identity=73.0; E value=3e-86; Homolog= ZycfV COG1136
MSNQPLLLCHHLCKKYQEGQVSTEVLKNVTFSIRQREMMAIVGSSGSGKSTLLHLLGGLDSPTSGEVLFKGRSLNEMSASVRAELRNSEIGFIYQFHHLLPDFSALENVAMPLLIGGKKRQASQKALEMLAAVGLEKRAHHRPAELSGGERQRVAIARALVNEPSLVLADEPTGNLDQRNADSIFEILQELNQRQGTAFLVVTHDLKLAGRLARQVEMRDGFLQDELVLVGER

SEQ ID NO: 9415 - protein, 387 aa, Xenorhabdus bovienii
  Coding DNA sequence: Name=SeqID_3307
  Gene classification: Function=ABC-type transport systems, involved in lipoprotein release, permease components; Function class=R General function prediction only
  Homolog annotation: Query=1..387bp; Hit=14..399bp; Blast score=495; Percent Identity=71.0; E value=1e-140; Homolog= lolC COG0577
MRGRAVDKFGRFVSWLSAIGITLGVAALITVLSVMNGFERSLESSILGFMPQAIITSEKGSINPDEHPMNQLSGLKGVNRITPIVQGDVVLQSARNVGVGIMLGITPNEYTPLAAHIADIDRTQLQPGRYFVILGEKLAIKLGVKRGDQIRVIVPSASQLTPMGRIPSQRLFTVIGTFFANSEVDDTEMLVNQQDAVRLFRYPMDNITGWRLYLNQPLTVDVLSQQTLPEGLVWKDWRERKGEFFQAVRMEKNMMGLLLSLIIAVAAFNIITSLSLLVMEKQGEIAILQTQGLTRRQVMAIFMIQGGSAGIIGALLGTGLGVLLSSQLNSLMPLVGLLTEGIQLPVAIDITQVVLIATSAMLISLLSTLYPSWRAAAIQPAEALRYE

SEQ ID NO: 9416 - protein, 57 aa, Xenorhabdus bovienii
  Coding DNA sequence: Name=SeqID_3308
MSYFISSYVCQYVQNQYLSRQLYLSHSITVSLRFDYRQFQVKNKKTSHYTQPSKILA

SEQ ID NO: 9417 - protein, 75 aa, Xenorhabdus bovienii
  Coding DNA sequence: Name=SeqID_3309
MFIDFGKSIWVVLPEERKSDWMTSEALVNSIFILDYGVFKATHRRSLFCIRPKFSRVEYNGWFFYFSLEIDDNQI

SEQ ID NO: 9418 - protein, 34 aa, Xenorhabdus bovienii
  Coding DNA sequence: Name=SeqID_3310
MEPLVPRFCVFLLSLNLPAYLLQGYLVKNVLGMD

SEQ ID NO: 9419 - protein, 1146 aa, Xenorhabdus bovienii
  Coding DNA sequence: Name=SeqID_3311
  Gene classification: Gene name=Mfd; Function=Transcription-repair coupling factor - superfamily II helicase; Function class=L DNA replication, recombination and repair
  Homolog annotation: Query=1..1146bp; Hit=1..1147bp; Blast score=1764; Percent Identity=76.0; E value=0; Homolog= mfd COG1197
MSAKYRYQLPERRGDIRQLGHLTGAACAVECAEIIERHSGPVLLVTQDMQNALRLRDEILQFTHAPINMLSDWETLPYDSFSPHQEIISNRLSTLYHLPFMTKGALILPVNTLMQRVCPHEYLKGHALVMFKGQHLSRDKLRTELEQSGYRSVEQVLEHGEFATRGALFDMFPMGSEHPYRIDFFDDEIDSLRTFDVDSQRTLAEVETINLLPAHEFPTDQEAIELFRSQWREQFEVRRDAEHIYQQVSKKMLPAGIEYWQPLFFEQPLPAIFDYLPENTLLITQDLVSAAERFWQDTAQRFESRKIDPMRPLLSPERIWLPVDKLFAELKNWPRIQVKNDALPQKAGSTNLAYQALPDLSVATQHKTPLDKVRRFIEQFNGRIVFSVESEGRRETVQELLSRIKISPIKIKQLIDANESGCFLMIGAAEHGFIDEENKLALICESDMLGERVSRRRQDSRRTINTDTLIRNLAELRRGQPVVHLEHGVGRYQGLITLETGGIKAEYLILTYAGEDKLYVPVSSLHLISRYAGGAEDSAPLHKLGGEAWNKARQKAAEKVRDVAAELLDVYAQRAIKPGFAFKQDPEQYQLFCQSFPFDTTPDQEQTINAVLDDMCQPIAMDRLVCGDVGFGKTEVAMRAAFMAITNNKQVAVLVPTTLLAQQHYDNFRDRFANWPVHLEVLSRFRSAKEQQQVIDMAAEGKVDIIIGTHKLLQNDLCWKDIGLLIVDEEHRFGVRHKERIKAIRADVDVLTLTATPIPRTLNMAMSGMRDLSIIATPPARRLAVKTFVREYDSLVVRESILREILRGGQVYYLYNDVENIEKAKNRLEELVPEARIVVGHGQMRERDLERVMADFHHQRFNVLVCTTIIETGIDIPSANTIIIERADHFGLAQLHQLRGRVGRSHHQAYAYLLTPNPKAMTTDAQKRLEAIASLEDLGAGFALATHDLEIRGAGELLGEDQSGQMASVGFTLYMELLESAVDALKNGREPSLEDLTSSQTEIELRMPVLLPGDYIPDVNMRLSFYKRIASAHNDAELAELKVELIDRFGLLPDPSRQLLQSASIRLTAQNLGIKRIEAHEKGGFIEFSDNNKVDPNYLIGLLQTQPNIYRLDGPSKLKFITELTERPARLSFIQQLLEAFIQHQI

SEQ ID NO: 9420 - protein, 184 aa, Xenorhabdus bovienii
  Coding DNA sequence: Name=SeqID_3312
  Gene classification: Function=Uncharacterized membrane protein; Function class=S Function unknown
  Homolog annotation: Query=30..180bp; Hit=1..175bp; Blast score=59; Percent Identity=29.0; E value=2e-09; Homolog= ycfJ COG3134
LNAFLVLLNIQGACFNKNVYKIINISRCYVGKLKIRQYGIGSLIAIAAIGTAATLYFESPQPKVAQVLSSEPIRITVLTPHHYCHETVFAIPIRSEDMKGGLFTGYEYRILTLLDNIKASREYLALNHSALKNCLMVYVKEQRTVGYDVNYTIGDNPGKVRVTYKPEQTIPLNEKGQLILQPYL

SEQ ID NO: 9421 - protein, 434 aa, Xenorhabdus bovienii
  Coding DNA sequence: Name=SeqID_3313
  Gene classification: Gene name=Ndh; Function=NADH dehydrogenase, FAD -containing subunit; Function class=C Energy production and conversion
  Homolog annotation: Query=1..434bp; Hit=1..434bp; Blast score=692; Percent Identity=80.0; E value=0; Homolog= ndh COG1252
MTTPKTRIVIIGGGAGGLELATRLGRKLGRKQKAEITLVDRNNSHLWKPLLHEVATGSLDDGVDALSYLAHASNHHFNFQLGTLTNIDRDGKKITLAEIRDESNDLLVAERELAYDILVMALGSQSNDFGTAGVKENCIFLDNPQQAHRFHNEMLNLFLKYSANQCAGEKVNIAIVGGGATGVELSAELYNAVKQFNSYGFESLNSDALNVTLVEAGERILPALPPRISSAAHQELTKLGVKVLTKTMVTSADKHGLNTKDGELIKASLMVWAAGIKAPDFMKDIGGLETNRISQLVVKPTLQTTLDADVFAIGDCASCPKKEGGFVPPRAQSAHQMASRCYDNILALLNEKPLKEYVYKDHGSLVSLSKFSTVGSLMGNLMRGSMMVEGRIARVVYISLYRMHQVALHGYIKTGLMMLVGGINRVIRPRLKLH

SEQ ID NO: 9422 - protein, 59 aa, Xenorhabdus bovienii
  Coding DNA sequence: Name=SeqID_3314
MTILVFGVVMTTPLKIQLMLCKALKPFLLITFLNNIRFDKFHTANISRVSWLVSWSYQK

SEQ ID NO: 9423 - protein, 31 aa, Xenorhabdus bovienii
  Coding DNA sequence: Name=SeqID_3315
MKFDLIETGSHREIIKRKNREEKQKRDRIAN

SEQ ID NO: 9424 - protein, 339 aa, Xenorhabdus bovienii
  Coding DNA sequence: Name=SeqID_3316
  Gene classification: Gene name=BglX; Function=Beta-glucosidase -related glycosidases; Function class=G Carbohydrate transport and metabolism
  Homolog annotation: Query=1..335bp; Hit=1..334bp; Blast score=484; Percent Identity=71.0; E value=1e-137; Homolog= ycfO COG1472
MGPVMLDVVGYELDNEEREILQHPLVGGLILFTRNFQDTQQLRELIRQIREASHYRLVIAVDQEGGRVQRFHEGFTRLPAAQSFACLNDLLMGAHLAQESGWLMASEMIAMDIDISFAPVLDLGHQCTAIGERSFHGELELAVMMAEKFIKGMHSAGMKSTGKHFPGHGAVVADSHKETPRDNRSMDAISCHDMQIFRDLIQRNLLDAIMPAHVVYSQVDDLPASGSPYWLKSILRQQLEFEGVIFSDDLSMEGAAIMGGYAERGKASLEAGCDMILVCNNRQGAISVLDNLPMVKSDRVARLYHQGSQYSLEELKKSQRWQQANKELNGLCEQWLSYI

SEQ ID NO: 9425 - protein, 286 aa, Xenorhabdus bovienii
  Coding DNA sequence: Name=SeqID_3317
  Gene classification: Gene name=CotS (BS); Function=Predicted choline kinase involved in LPS biosynthesis; Function class=M Cell envelope biogenesis, outer membrane
  Homolog annotation: Query=30..275bp; Hit=30..263bp; Blast score=117; Percent Identity=34.0; E value=1e-26; Homolog= ycfN COG0510
MLTSDNTLLRMLCQQWPDIPVKNWEIRRLNGLTQGSFSITDGVRQMVGRTQTQNSETLGVDRQRENQVLRRLSSTGISPKVIAMNGDWLLLEWFSGTKITHETLNLPLLQQLLAQILATLHNHHRLGYPLQFKKQIASQWQQIDQSRLSPRWLRLQKFFMAARTPTTLKIAPAHMDIHPDNLLMTVEGLKLIDWEYAADVDIGFSLAVLFKGNQWNEMQQQIFLDYYCSYASGYADITLLQQRIKRWEPWVRYMMLMWYEVRWQQTKDPQFLVLAHPLRQGFKLAH

SEQ ID NO: 9426 - protein, 188 aa, Xenorhabdus bovienii
  Coding DNA sequence: Name=SeqID_3318
  Gene classification: Gene name=FlgN; Function=Predicted periplasmic lipoprotein; Function class=N Cell motility and secretion
  Homolog annotation: Query=1..188bp; Hit=4..211bp; Blast score=150; Percent Identity=45.0; E value=1e-36; Homolog= ycfM COG3417
MKRILFVILSAMFLASCNLPIQSPAPVTPVKPEKKTEPQVQPSDKVPQPPKIQSTNWNGIVQPLVAQMVKANGVETGKVLLVDTVKNNTNGSLRALQVTDIITDAVSRKQLFQIVPKKQVHRAQQALGLSSEDSLGLRSKSIGLARYLSADYVLYSVVSGSNDQRNIEIQLMLVKTGEILWSGSGDVN

SEQ ID NO: 9427 - protein, 116 aa, Xenorhabdus bovienii
  Coding DNA sequence: Name=SeqID_3319
MHMDMENFLPGMAITVHDEAITIFCDAFLLCDFRCNREQASQCKLMLWSNIVNRWDQYVWHDQNMGGRLRGNVTECCYQIILINNIRRNFTTNDFAKNSFFCHLTSPFLSLKMTHD

SEQ ID NO: 9428 - protein, 261 aa, Xenorhabdus bovienii
  Coding DNA sequence: Name=SeqID_3320
  Gene classification: Gene name=TatD; Function=Mg-dependent DNase; Function class=L DNA replication, recombination and repair
  Homolog annotation: Query=1..257bp; Hit=1..257bp; Blast score=387; Percent Identity=73.0; E value=1e-108; Homolog= ycfH COG0084
MFLVDSHCHLDCLDYETLHKSMDDVVAKAAERDVKYMLAVATTLPGFQQMKNLIGKRENIAYSCGIHPLNLDEGYDFDELARLAADDDVVAMGETGLDYYYQKENAELQRTSFREHIRIGRKLNKPVIVHTRDAKDDTLLVLREEKVQECGGVLHCFTEDKDTARALLDLGFYISFSGIVTFRNAEQIREAARFVPLDRILVETDSPYLAPIPHRGKQNQPAYVRDVAEYMAVLKGVSLDELAAVTTRNFCDLFHINIPEN

SEQ ID NO: 9429 - protein, 332 aa, Xenorhabdus bovienii
  Coding DNA sequence: Name=SeqID_3321
  Gene classification: Gene name=HolB; Function=ATPase involved in DNA replication; Function class=L DNA replication, recombination and repair
  Homolog annotation: Query=1..327bp; Hit=1..325bp; Blast score=260; Percent Identity=49.0; E value=1e-69; Homolog= holB COG0470
MNWYPWLNHAYRLLIESHQQERGHHALLLHAHDGTGADALLYGLSRWLMCQDKQGMKSCGKCHGCHLMLAETHSDWHVLAPEKGKSTIGVDAVRQLNERLYEYSQQGGAKIIWLPSAESLTDAASNALLKTLEEPPQNTYFLLQCQRPARLLATLRSRCFYYFLPVPEQHVGLYWLQHQLPAISSLDAQTALKLSQGAPLAAEQLLQTEKWQQRNVFCQAIEQALYNCDTLSLLPLLNRDDAQQSLYWLVSLLSDAVKWQQQAQDYCVNQDQQALIHHLASTQSVEKLLSTVDDWVHCRHQLLSVVGINRELLLTGQLLNWEKQLCPTRQLI

SEQ ID NO: 9430 - protein, 213 aa, Xenorhabdus bovienii
  Coding DNA sequence: Name=SeqID_3322
  Gene classification: Gene name=Tmk; Function=Thymidylate kinase; Function class=F Nucleotide transport and metabolism
  Homolog annotation: Query=1..210bp; Hit=1..212bp; Blast score=290; Percent Identity=70.0; E value=6e-79; Homolog= tmk COG0125
MNSKFIVIEGLEGAGKTTAIRTVVETLKQYGISDLIFTREPGGTPLAEKLRQLIKQGVEGESLTNKAEVLMLYAARVQLVENVIKPALEKGTWVVGDRHDLSSQAYQGGGRGIDQKLMTSLRESALGDFYPDLTIYLDLPPEVGLQRARERGELDRIEKESLDFFHRTRERYLELVAQDDTIKKVDATQPLEKVQDAIRQTLLQWLKQQDMQA

SEQ ID NO: 9431 - protein, 341 aa, Xenorhabdus bovienii
  Coding DNA sequence: Name=SeqID_3323
  Gene classification: Function=Predicted periplasmic solute-binding protein; Function class=R General function prediction only
  Homolog annotation: Query=5..339bp; Hit=2..336bp; Blast score=331; Percent Identity=50.0; E value=7e-91; Homolog= yceG COG1559
MKLKKRIFILPSLIIMIVAIMFFSFVKKIENFANQKINLNQEMIFTVPAGTGRAGLGILLVQHNLIKDHQLLSWLFRLKPELAKFKAGTYRLQQGMSLRAILQLFSSGKEVQFSIRFVEGSRLSDWEKILQNAPYLKHEAEGKSPKELTDALDMKAEEPLEGWLYPDTYLYTAGTSDVELLKRAHQKMNMALEQEWKNREKNLPYKSVYEMLIMASIIEKETAIDSERTKVASVFINRLRLKMRLQTDPTVIYGLGDKYTGSIFRSNLTAFTPYNTYMIEGLPPTPIAMPSLASIKAAAHPAVTGYLYFVANGNGGHTFTANLAEHNRAVNLYRQRLKQDK

SEQ ID NO: 9432 - protein, 274 aa, Xenorhabdus bovienii
  Coding DNA sequence: Name=SeqID_3324
  Gene classification: Gene name=IlvE; Function=Branched-chain amino acid aminotransferase/4-amino-4-deoxychorismate lyase; Function class=E Amino acid transport and metabolism
  Homolog annotation: Query=1..273bp; Hit=1..267bp; Blast score=269; Percent Identity=50.0; E value=3e-72; Homolog= ZpabC COG0115
MYLINGKPCNQLPVNDRAVQFGDGCFTTIKVEQGQAALLPLHIKRLQKGVEKLFMPALDWLQLEDHIKQVVTGCESGILKVILSRGVGGRGYGISDAIEPNQVLSLSSYPEQYVIQRKNGISLVLSPIVMGINPHLAGIKHLNRLEQVLIKRFIEQSKADEALVLDSDGLLVECCTANIFWRKGKNVYTPDLNQCGVEGVMRQKIMQLLAESDYNLSCVMRYPEVLAHADEVIICNSLMPVIAVNQIQAHKNQPAWKYQSRELHEYLLPACLRL

SEQ ID NO: 9433 - protein, 427 aa, Xenorhabdus bovienii
  Coding DNA sequence: Name=SeqID_3325
  Gene classification: Gene name=FabB; Function=3-oxoacyl-(acyl-carrier- protein) synthase; Function class=I Lipid metabolism
  Homolog annotation: Query=15..427bp; Hit=1..413bp; Blast score=601; Percent Identity=79.0; E value=1e-172; Homolog= fabF COG0304
MFFVLNFFPPWRITVSKRRVVVTGLGMLSPVGNTVESSWNAVCAGQSGIGLIEHFDTANHATKFAGVVKNFNHEDFNISRKDARKMDLFIQYGIAAGIQAIEDAGIEVTEANASRFGAAIGSGIGGLGLIEENHSTLLSAGPRKVSPFFVPSTIINMVAGHLSILYGLRGPSISIATACTSGVHNIGHAARIIAYNDADIMLAGGTEKASTTFGVAGFGAARALSTRNDDPQGASRPWDKDRDGFVLGDGAGVLVLEEYEHAKKRGAKIYAEIVGFGMSSDAYHMTSPPEDGAGAALAMENALKDADISPDQVGYINAHGTSTQVGDLAEARAVESVFGEGTKVLVSSTKSMTGHLLGAAGAIESIFTILALREQIVPPTINLENQDENCRLDLVPGEARKVEGMEYALCNSFGFGGTNGSLIFRKI

SEQ ID NO: 9434 - protein, 34 aa, Xenorhabdus bovienii
  Coding DNA sequence: Name=SeqID_3326
MALEEEFDIEIPDEEAEKITTVQAAIDYVENAGK

SEQ ID NO: 9435 - protein, 249 aa, Xenorhabdus bovienii
  Coding DNA sequence: Name=SeqID_3327
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=6..249bp; Hit=1..244bp; Blast score=361; Percent Identity=84.0; E value=1e-100; Homolog= fabG COG1028
MTEENMSFDGKIALVTGASRGIGRSIAELLVERGARVIGTATSENGAEAISAYLGDKGKGFVLNVTDSESVEKALSNIRAEFGEIDILVNNAGITRDNLLMRMKDGEWQDIIDTNLSSIFRLSKAVMRSMMKKRYGRIISIGSVVGTMGNAGQANYAAAKAGVIGFSKSLAREVASRGITVNVVAPGFIETDMTRALTDDQRAGILSEIPASRLGDAKEIASAVAFLASDEAAYITGETLHVNGGMYMI

SEQ ID NO: 9436 - protein, 244 aa, Xenorhabdus bovienii
  Coding DNA sequence: Name=SeqID_3328
  Gene classification: Gene name=FabD; Function=(acyl-carrier-protein) S-malonyltransferase; Function class=I Lipid metabolism
  Homolog annotation: Query=1..242bp; Hit=66..307bp; Blast score=325; Percent Identity=77.0; E value=3e-89; Homolog= ZfabD COG0331
MLAASVAIWRIWQQKGGKQPSMMAGHSLGEYSALVCAGVIEFQQAIRLVELRGKLMQEAVSEGQGAMYAIIGLDNESIAKACEESAQGQVVSPVNFNSPGQVVIAGEKEAVERAGAACKAAGAKRALPLAVSVPSHCALMKSAADQLAAALQSIVFNQPQFPVVNNVDVKVEESADAIRDALVRQLYNPVRWTESVEYIAAQGTEQLLEMGPGKVLTGLTKRIVDTLNAVAVNDVSSLTVALNK

SEQ ID NO: 9437 - protein, 52 aa, Xenorhabdus bovienii
  Coding DNA sequence: Name=SeqID_3329
  Gene classification: Gene name=FabD; Function=(acyl-carrier-protein) S-malonyltransferase; Function class=I Lipid metabolism
  Homolog annotation: Query=1..49bp; Hit=6..54bp; Blast score=62; Percent Identity=63.0; E value=8e-11; Homolog= PM1915 COG0331
MGVPRPGSQSPGMLADLAPEFPLVDQILPEASAVLGYDLWALVQQGPAERAE

SEQ ID NO: 9438 - protein, 56 aa, Xenorhabdus bovienii
  Coding DNA sequence: Name=SeqID_3330
MGRIQRGQLVLIEALGGGFTWGSALGRCLINRKINMSDSQWVFPVQVLSHLVCWLI

SEQ ID NO: 9439 - protein, 267 aa, Xenorhabdus bovienii
  Coding DNA sequence: Name=SeqID_3331
  Gene classification: Gene name=FabH; Function=3-oxoacyl-[acyl-carrier- protein] synthase III; Function class=I Lipid metabolism
  Homolog annotation: Query=1..263bp; Hit=1..263bp; Blast score=391; Percent Identity=74.0; E value=1e-109; Homolog= fabH COG0332
MYTKILGTGSYLPPQVRTNADLEKMVDTTDEWIVTRTGIRERRIAAEGETVATMGFKAAEKAIEMAGIDKTQIDLIVVATTTSSHAFPSTACQIQNSLGIRGIAAFDVAAACAGFTYALSIVDKFIKAGEVKHALVIGADIISRVVDPKDRSTVVLFGDAAGAMVVGASEEPGILSTHLHADGRYGDLLSLPNQDRLKWGSPEYVTMAGNEVFKVAVRELTSIVDETLEANNLDHSQLDWLVPHQANLRIISAAAKKLDMTMDKGGL

SEQ ID NO: 9440 - protein, 335 aa, Xenorhabdus bovienii
  Coding DNA sequence: Name=SeqID_3332
  Gene classification: Gene name=PlsX; Function=Fatty acid/phospholipid biosynthesis enzyme; Function class=I Lipid metabolism
  Homolog annotation: Query=1..332bp; Hit=1..331bp; Blast score=447; Percent Identity=69.0; E value=1e-126; Homolog= ZplsX COG0416
MGGDFGPRVTVPAALQALASNPQLKLLLVGDPETISPLLANKNAEQLSRLQIIPAEHVVSNDAKPSQAIRSSHGTSMRIALNLVKTGEAQACVSAGNTGVLMGLAKLMLKSIEGIERPALMTMIPNLKQQKTVILDLGANINCNSRMLVQFAIMGAVMAEDVAGVKNPRVALLNIGEEESKGLDNIREAAMTLQNTSAINYIGYVEGNELLTGKTDVLVCDGFAGNVTLKTMEGAIRVILSLVKSPDGQKKKSSWLRKVFKKWLLKQIVKRFGHLNPDQYNGATLLGLRGIVIKSHGAANERAFKAAIDQAVQTVQNQVPDRIAVRLDAVLPKSE

SEQ ID NO: 9441 - protein, 56 aa, Xenorhabdus bovienii
  Coding DNA sequence: Name=SeqID_3333
  Gene classification: Gene name=RpmF; Function=Ribosomal protein L32; Function class=J Translation, ribosomal structure and biogenesis
  Homolog annotation: Query=1..56bp; Hit=1..57bp; Blast score=72; Percent Identity=89.0; E value=8e-14; Homolog= rpmF COG0333
MAVQQNKPTRSKRGMRRSHDALTATHVSVDKTSGETHLRHHVTADGYYRGRKVINK

SEQ ID NO: 9442 - protein, 174 aa, Xenorhabdus bovienii
  Coding DNA sequence: Name=SeqID_3334
  Gene classification: Function=Predicted metal-binding, possibly nucleic acid-binding protein; Function class=R General function prediction only
  Homolog annotation: Query=1..172bp; Hit=1..172bp; Blast score=249; Percent Identity=72.0; E value=8e-67; Homolog= yceD COG1399
MQKVKLPLTIDALRAAQKSLDYEGSYSAEQASRLAESVVSVDGDINSSLSFQIDNLRLAVVKGHSDVDVTLACQRCGSNFSHHVHTTYCFSPVINDERAEALPEEYEPININEFGEIDLLAMIEDEIILSLPVVPVHDSEHCEVSDAEMVFGVLPPEAEKPNPFAALASLKKST

SEQ ID NO: 9443 - protein, 201 aa, Xenorhabdus bovienii
  Coding DNA sequence: Name=SeqID_3335
  Gene classification: Gene name=Maf (BS); Function=Nucleotide-binding protein implicated in inhibition of septum formation; Function class= D Cell division and chromosome partitioning
  Homolog annotation: Query=1..196bp; Hit=10..205bp; Blast score=248; Percent Identity=62.0; E value=3e-66; Homolog= yceF COG0424
MEKMMLPIVLSSTSIYRHLLLEKMGLPFVCAAPNIDESPQENESPTQLVMRLSQAKATALQPSYSSHLIIGSDQVCVLNGKITGKPHNFENAFAQLKKASGQCVTFYTGITLFNSKTGNTDTRCELFHVHFRDLTEPEIISYLNKEQPFNCAGSFKSEGLGITLFKKLDGRDPNTLIGLPLITLTEMLIRQGINPLTVRYQ

SEQ ID NO: 9444 - protein, 318 aa, Xenorhabdus bovienii
  Coding DNA sequence: Name=SeqID_3336
  Gene classification: Gene name=RluA; Function=Pseudouridylate synthases, 23S RNA-specific; Function class=J Translation, ribosomal structure and biogenesis
  Homolog annotation: Query=1..314bp; Hit=1..316bp; Blast score=486; Percent Identity=81.0; E value=1e-137; Homolog= ZyceC COG0564
MKTNNPIVQFVTIDDDEAGQRIDNFLLARLKGVPKSMIYRILRKGEVRVNKGRIKPEYKLAAADVVRIPPVRVAEKQQPPVSAKLGKVAVLAECILYEDDYILVINKPSGTAVHGGSGLSFGVIEGLRALRPEARFLELVHRLDRDTSGVLLIAKKRSALRALHEQLRLKQMQKDYFALVRGQWQSHCKVVQAPLLKNILQSGERVVKVSGDGKPSETRFKVEERYEFATLVLASPVTGRTHQIRVHTLHAGHPIAFDDRYGDRAFDAQLTETGLNRLFLHASSLKFTHPSTGETLRFEAQMDDELRQCLTTLRQNNY

SEQ ID NO: 9445 - protein, 42 aa, Xenorhabdus bovienii
  Coding DNA sequence: Name=SeqID_3337
LGYCNKLVQISPNPVSCNSQPINCLIKHYVLRHCCVFVRSDR

SEQ ID NO: 9446 - protein, 45 aa, Xenorhabdus bovienii
  Coding DNA sequence: Name=SeqID_3338
MKFRLADKYRRLYTNDSREAGGFVKDTRPSVTSSASLFARSSIPM

SEQ ID NO: 9447 - protein, 1058 aa, Xenorhabdus bovienii
  Coding DNA sequence: Name=SeqID_3339
  Gene classification: Gene name=CafA; Function=Ribonucleases G and E; Function class=J Translation, ribosomal structure and biogenesis
  Homolog annotation: Query=1..1058bp; Hit=1..1061bp; Blast score=983; Percent Identity=60.0; E value=0; Homolog= rne COG1530
MKRMLINATQQEELRVALVDGQRLYDLDIESPGHEQKKANIYKGKITRIEPSLEAAFVDYGAERHGFLPIKEIAREYFPSNYHAHGRPNIKDILKEGQEVIVQVDKEERGNKGAALTTFISLAGSYLVLMPNNPRAGGISRRIEGDDRIELKEALSSLELPEGMGLIVRTAGVGKSAEALQGDLNFRLKHWEAIKKAADNHPAPFLIHQESNVIVRAFRDYLRPDIGEILIDNPKILDLARQHITALGRPDFASKIKLYSGEVPLFSHYQIESQIESAFQREVRLPSGGSVVIDTTEALTAIDINSSRATRGGDIEETAFNTNLEAADEIARQLRLRDLGGLIVIDFIDMTPVRHQREVENRLRDAVRQDRARIQIGRISRFGLLEMSRQRLSPSLGESSHHVCPRCSGTGTIRDNESLSLSILRLIEEEALKENTHQVHAIVPVQIASYLLNEKRKAVSAIEHRQGDVGVVIVPNDQMQTPHFSVLRVRKGEEISTLSYLLPQIHEAEMTNAQDDGQHERKRPEQPAISTFDLPAETTTPVAAKTKEKKVAVSNNQQTEQPGLFSRFLCALKKMFSGESGEEEKQAQEKSNKSSSNDNRRSPERRNSRRQNQRRERNENDTRNNRERGDEQRKGRNVQQKNNAPDNIAVNVDIDNEAREAQQQQRREQRAERQRHRQEEKRQQQLETKAQQTSRPEITEEEVEEHQPVMPRRQRRQLEQKIRITDNVKEEAVVVSLPIVTKVVIPAITEEEKKVSVPAIIDTNVEAANQPSIPQGSITQNNEQQDNIMPRRSRRSPRHLRVSGQRRRRYRDERNLTQSPVPLAMAVASPELASGKVWVRYPVTPVTKPAEPEVSAVEETASEQQESVMPIPAVAGSVSVSTVADTQVTEQIAATHDDVKLATNGYPLVASVEPVLEKPEVSAPENLEPVVNHETKHQPEALNDTEETRHIAEPIIVTSIVEQEQHEEQPTVATEICSKAEEVKAEETKIAESPIIVEKNHHASSPMTKAPAPDLVVQTVIVSEWQRPAYPFRGKGGAGGHSATNVAISAMSKPQSFE

SEQ ID NO: 9448 - protein, 169 aa, Xenorhabdus bovienii; identical to SEQ ID NO: 7827
  Coding DNA sequence: Name=SeqID_3340
  Gene classification: Function=Predicted transposase; Function class=L DNA replication, recombination and repair
  Homolog annotation: Query=25..156bp; Hit=1..131bp; Blast score=177; Percent Identity=63.0; E value=3e-45; Homolog= VC0870 COG1943

SEQ ID NO: 9449 - protein, 214 aa, Xenorhabdus bovienii
  Coding DNA sequence: Name=SeqID_3341
  Gene classification: Function=Predicted nucleoside-diphosphate-sugar epimerases; Function class=M Cell envelope biogenesis, outer membrane
  Homolog annotation: Query=7..211bp; Hit=1..206bp; Blast score=191; Percent Identity=47.0; E value=5e-49; Homolog= ZchuY COG0702
MENIPTMKSWLIFGAGRGVGRHLATMALQQNHPVTALVRNVQQAVELSTMGANVIHGDACDKKSIEKAIAQAGENPIVFSTIGGGNADHHGNMAIIDTLEQAEVSRMLLVTSIGCGDSWKTLSPRAKSLFGQSVRHKSLAESYLQTSKLDFTIIRPGGLTDKSGTGHCQRYQGEVHGMVSREDVAQQLALMAEDEETYYQIYALVDPELKPHWG

SEQ ID NO: 9450 - protein, 106 aa, Xenorhabdus bovienii
  Coding DNA sequence: Name=SeqID_3342
  Gene classification: Function=Uncharacterized BCR; Function class=S Function unknown
  Homolog annotation: Query=6..101bp; Hit=27..122bp; Blast score=139; Percent Identity=84.0; E value=7e-34; Homolog= yeeX COG2926
MDNANKPTFHNVLEFVRIFRRKNKLQREIVDNEKKVRDNQKRVLLLDNLSDYIKPGMSVEDIQGIIAHMRSDYEERVDEYIIKNAELSKERRELSKKLKAMDGGVK

SEQ ID NO: 9451 - protein, 35 aa, Xenorhabdus bovienii
  Coding DNA sequence: Name=SeqID_3343
MFLMRRKVSFRIGTETSHGSGNSWSSDARTMKMID

SEQ ID NO: 9452 - protein, 54 aa, Xenorhabdus bovienii
  Coding DNA sequence: Name=SeqID_3344
MTKSFRCHERFQYLSEKRLFSALETCEMIINDFHPISLESSDCPKYGLPYLFAS

SEQ ID NO: 9453 - protein, 51 aa, Xenorhabdus bovienii
  Coding DNA sequence: Name=SeqID_3345
MCYLIFCVLIMLIKVLLHGLVYDKLCTKSLVSTMQKDMVNHILDNLNSLMI

SEQ ID NO: 9454 - protein, 475 aa, Xenorhabdus bovienii
  Coding DNA sequence: Name=SeqID_3346
  Gene classification: Gene name=SbcB; Function=Exonuclease I; Function class=L DNA replication, recombination and repair
  Homolog annotation: Query=8..473bp; Hit=10..474bp; Blast score=666; Percent Identity=68.0; E value=0; Homolog= sbcB COG2925
LSNDKNPTFYFHDYETFGKHPALDRPAQFAGIRTDSDFNIIEEPLVVYCSPTDDYLPDPEAVMITGITPQLALKKGVNEAEFTRQIHEAFSKPNTCIIGYNNIRFDDEVSRNIFYRNFYDPYAYSWQKGNSRWDLLDVLRACYALRPEGIIWPENEDGLPSFKLENLTKANGVEHTQAHDAMSDVYATIAMAKRVKKAQPRLFDYFFQLRNKQKVSNQIDIPQMKPLVHVSGMFGTLRSNISLIAPLAWHPTNRNAVIMCDLAGDISPLLELSADELRERLYTRRNELQPGQAPVPIKLMHINKCPIIAPENTLRTEDAERVGLNRDQCAKNLVILRSNPQIREKVVELFSQPEEFPESDNVDAKLYSGFFSDADKTAMEIIRETAPKNLPALDLTFQDPRIKTLLFRYRARNYPATLDYDEQQRWLYYRREILTQESISQYLATIEQLFVEYQSDEEKCRQLKALVDYAVQLAG

SEQ ID NO: 9455 - protein, 39 aa, Xenorhabdus bovienii
  Coding DNA sequence: Name=SeqID_3347
MQFSWLANGPASYWLILEKEKDKMLYFVFFSHHSSIIIV

SEQ ID NO: 9456 - protein, 576 aa, Xenorhabdus bovienii
  Coding DNA sequence: Name=SeqID_3348
  Gene classification: Gene name=GlcD; Function=FAD/FMN-containing dehydrogenases; Function class=C Energy production and conversion
  Homolog annotation: Query=1..567bp; Hit=1..567bp; Blast score=890; Percent Identity=72.0; E value=0; Homolog= dld COG0277
MNDAKSPQNQQLITILTNIVGSSHILTEPRKTERYRKGFRSGQGNALAVVFPASLLEQWKVFKACILADKIILMQAANTGLTEGSTPNGDDYDRDIVIISTLRMDKIQVLKSVNQVIAFPGSTLWHLEKVLKPLGREPHSVIGSSCIGASVVGGICNNSGGSLVQRGPAYTEMALYGRVNEKGQAELINHLGISLGNTPEDILTCLEEQRYRAEDIQLDDRVASDHEYEQRVRDINADTPSRFNADERRLFEASGCAGKLVIFAVRLDTFPAQSSSQVFYIGTNQPEVLTELRRHILANFQHLPIAGEYMHRDIFDIAEGYGKDTFIMIDKLGTDKMPMFFSLKGRIDAMFSKIPFLPSHLTDRVIQGLSHLLPSHLPARLKEYRNRFEHHLMLKMSGEGIKEASEWLESYFKQAEGEFFACTPEEGAKAFLHRFAAAGAAIRYQAVHSNEVEDILALDIALRRNDHEWFEHLPPEIDEALVHRLYYGHFMCYVFHQDYIVKKGTDVHTLKVKMLEILNQRGAEYPAEHNVGHLYQAKQQLKQFYQMTDPTNTLNPGIGKTSKLKNWGREDGKCDC

SEQ ID NO: 9457 - protein, 460 aa, Xenorhabdus bovienii
  Coding DNA sequence: Name=SeqID_3349
  Gene classification: Gene name=PotE; Function=Amino acid transporters; Function class=E Amino acid transport and metabolism
  Homolog annotation: Query=7..458bp; Hit=1..452bp; Blast score=567; Percent Identity=70.0; E value=1e-161; Homolog= yeeF COG0531
MSHNTTLTLDTNQTSASNRVQLRRTLTLFQVVMMGLAYMQPMTIFDTFGIVSGLTSGHVATSYALALIAILFTALSYGKLVKRFPSAGSAYTYVQKSINPHLGFMVGWSSLLDYLLMPMINILLAKIYLQALFPGIDPWIFVVTLTILMTIFNLSGINVVANLNGVIVIVQVVVMLVLVGFLVHGVYNGEGVGTLLSIQPFTSDEAKLIPMITGATILCFSFLGFDGISSLSEETPNAGKVIPKAIFMTALIGGAIFITVSYFLQLYFPDISRFKDPDASQPEIMLYVAGALFQYIILMFSCVTVVASGMAAHAGVSRLLYVMGRDGVLPEKVFAYIHPKWRTPSINVILVGIVALSAGWLDLVTATALINFGALVAFTFVNLSVISQFYIREKRNSTLKDTIHFLLLPVLGAATVGVLWMNLESSSMKLGLIWGGIGIIYMFFLTRSFRQPMPQFTESV

SEQ ID NO: 9458 - protein, 71 aa, Xenorhabdus bovienii
  Coding DNA sequence: Name=SeqID_3350
MEQLFTFALVPIGACCCNDDYGAWSSVSSLSSNNSSFFSVYRQMRSLPTNYRLSSCISTQIEVMGGFAHVA

SEQ ID NO: 9459 - protein, 81 aa, Xenorhabdus bovienii
  Coding DNA sequence: Name=SeqID_3351
MFAFLSTAARSYNGRLWSVSIRNKIRPLGVVKNNSKQKNNWCIFTHQLFFSARILHFTLRNSKSYHTKNSLFFTIPESLME

SEQ ID NO: 9460 - protein, 657 aa, Xenorhabdus bovienii
  Coding DNA sequence: Name=SeqID_3352
  Gene classification: Gene name=CirA; Function=Outer membrane receptor proteins, mostly Fe transport; Function class=P Inorganic ion transport and metabolism
  Homolog annotation: Query=5..657bp; Hit=9..652bp; Blast score=544; Percent Identity=44.0; E value=1e-154; Homolog= VC0475 COG1629
MAVFVKRKIVLGIIAAISSGTVLAANNGEDKIVVTTAAGFQQKIEDAPASISVVSREQLETKSYRDVTDALKDVPGVVVTGGGSSSDISIRGMASKYTMILIDGKRVDTRSTRPNSDGSGIEQGWLPPLASIERIEVVRGSMSSLYGSDAMGGVINIITRKVQKEWHTSLRADTTLTERKNSGNSYQTSAYAAGPLIDGLLGLKVNGLFSHRNEDKFIGGFREQEMRNGAATFSLTPDEQNTFEFEAGRYEQDRDSTIGKTRDCQPKSCKDDISRYKRNNYSISHNGVYDFGTMTSYVQRDESHNPEREMKYNDTLFNNQTTFILDDHTLSVGGQYRYEDLRDTGNKLNSAKDVNKLTRWSWALFAEDEWQMTNDFALTGGARLNKDENFGAHWTPRLYGVWHADEQWTIKGGVSTGYRSPELRQVAPNWGQTTGGSNLKGMIIGNSDIKPEKSVSEEISVIWNNQDNFNVGVTVFNTDFKDKITEVGECDKDTENPCKPTGDITYDFINKRTNLDKANIRGIEATLNWDIVENLSLAASYTYTESEQKSGKYKGQALNKMPKHMANATLNWQALPEMDTWTRINFRSKSTNYVYRSGVKNGTPSYTFVDLGMTYNLTKNLRVLGGIYNVFDKRVTEKTHDAVLDGRRYNIGINYDF

SEQ ID NO: 9461 - protein, 262 aa, Xenorhabdus bovienii
  Coding DNA sequence: Name=SeqID_3353
  Gene classification: Gene name=FepC; Function=ABC-type cobalamin/Fe3+- siderophores transport systems, ATPase components; Function class=P Inorganic ion transport and metabolism
  Homolog annotation: Query=5..237bp; Hit=21..256bp; Blast score=148; Percent Identity=38.0; E value=5e-36; Homolog= VC0779 COG1120
MNQGLKINRLTAGYPKHPVIENLNVKSLPSGQITVLLGPNGSGKSTLLRSLAGLNKARGELLLNGQDLMQMNFAQRAQGVVYLPQSLPEGVHLHVLESVIVAQRASGGVSSKQCENEVMELLRQLGIEHLALSYLDQLSGGQKQLVGLAQSLIRQPTLLLLDEPLSALDLNYQYHVMDLVARETRRRNIITVVVVHDINIALRHGDHVLMLKKGELIAEGTPEQVITPDSLAQVYGVKGRIERCSQGVPQVLIDGLVTELAN

SEQ ID NO: 9462 - protein, 361 aa, Xenorhabdus bovienii
  Coding DNA sequence: Name=SeqID_3354
  Gene classification: Gene name=BtuC; Function=ABC-type cobalamin/Fe3+- siderophores transport systems, permease components; Function class=P Inorganic ion transport and metabolism
  Homolog annotation: Query=24..355bp; Hit=4..339bp; Blast score=187; Percent Identity=35.0; E value=1e-47; Homolog= TM0190 COG0609
MSITTEPMPMVKQQLSECDVKARYRHILHRRTALILFIIFVIAASLVLDFTMGPSGLSLQALWQTLVSPESVDAGTRVIVWDIRLPYALMAVVIGLSLGLAGAEMQTILNNPLASPFTLGVSNAASFGAALAIVLGIGIPGIPDQWLISANAFIFALLAALMLDGITRWTRVATSGVVLFGIAMVFTFEALVSMMQFIATEDTLQGLVFWTMGSLARATWEKLGIMLLVFLMIMPISMMNSWKLTALRLGEDRAASFGINISRLRLGTLLRISILTALAVAFVGPIAFIGLIAPHIARMMFGEDHRFYLPASALIGALVLSMASIASKNLIPGIIIPVGIVTSLIGVPFFLSIILRHKGSI

SEQ ID NO: 9463 - protein, 383 aa, Xenorhabdus bovienii
  Coding DNA sequence: Name=SeqID_3355
  Gene classification: Gene name=FecB; Function=ABC-type cobalamin/Fe3+- siderophores transport systems, periplasmic components; Function class=P Inorganic ion transport and metabolism
  Homolog annotation: Query=18..370bp; Hit=1..328bp; Blast score=95; Percent Identity=27.0; E value=8e-20; Homolog= TM0189 COG0614
MKRLTKVKFVFRAVVKGMNISLLASSAMMASFASWAETVTDVAGRTVEVPEKVNRILLGEGRLFHSLALLEGDKPLARIVGWQGDFRKLDPQTYSIYKAKFPEIDNIPLIGNTSADSVSSEKVLTLNPDVAIFGLSGHGPGKNSELVKQLEKAGIPVVFVDFRNDPLKNTLPSIRMLGKMLHREEQANAYADFYEKNQKLVTDITDRIAEAQKPSVFIELRAGSSEDCCGTAGNGNMGNFIDLAGGKNIAKDVLPSPLGMMNLEKVIVADPYIYIASGAQDPGDKDGGVQMGAQTSADIACAGLKTVTARQGINTLTAVKEGRSYGIWHHYYNSPYNVVVTQVFAKWFYPEKFADLDPQQTLKELHNKFLAVEPAGTYWVSEK

SEQ ID NO: 9464 - protein, 495 aa, Xenorhabdus bovienii
  Coding DNA sequence: Name=SeqID_3356
  Gene classification: Gene name=LysP; Function=Amino acid transporters; Function class=E Amino acid transport and metabolism
  Homolog annotation: Query=16..487bp; Hit=13..484bp; Blast score=759; Percent Identity=85.0; E value=0; Homolog= lysP COG0833
MSQEQSTPRDQPPRTLRRELKARHMAMIAIGGSIGTGLFVASGATISRAGPGGTLLSYALIGLMVYFLMTSLGELAAYMPVSGSFSTYGSKYVDEGFGFALGWNYWYNWAVTIAVDLVAAQLVMGYWFNDVPGWVWSALFLGIIFLLNFISVKGFGEAEYWFSLIKVSTIIVFIIVGILMIIGIMKGAESAGWQNWQVADAPFAGGFAAMIGVAMIVGFSFQGTELIGITAGESKDPAKNIPRAVRKVFWRILLFYVFAILIISLIIPYTDPNLLRNGVKDISVSPFTLVFENAGLLSAAAMMNAVILTAVLSAGNSGMYASTRMLFTLAREGKAPKIFGHLSKGGVPRNALYATTVVAGLCFFSSMFGNQTVYLWLLNTSGMTGFIAWLGIAISHYRFRKGYIAQGRDLNELPYRSGFFPVGPIFAFVLCLMITLGQNYQAFLQDNIDWYGVTATYIGIPLFLIIWFSYKLKKKTRFVKCSEMEFPSLKLTGNE

SEQ ID NO: 9465 - protein, 287 aa, Xenorhabdus bovienii
  Coding DNA sequence: Name=SeqID_3357
  Gene classification: Gene name=LysR; Function=Transcriptional regulator; Function class=K Transcription
  Homolog annotation: Query=1..286bp; Hit=1..286bp; Blast score=399; Percent Identity=66.0; E value=1e-111; Homolog= yeiE COG0583
MRITLRQLEIFAEVLKSGSTTQASQHLALSQSAVSASLTDLEGQLGVKLFDRVGKRLVTNEHGRLLYPKALALLEQAGEVEQLFKLELGALRLAASSTIGNYMLPEMLSKYRQDYPDTPLELNISNTEDVIKAVVEFRVDLGLIEGLCHNPELITQPWMEDELMIFCSPKNSLSQRDFTVEDLIKEPWILREKGSGTREVLDHLLFSQMPRFNIAMELGNSEAIKHAVQYGMGISCLSRRVVQEQLKNGTLVELVIPELNLYRTLYLIYHRQKHMSNALQKLLSYCK

SEQ ID NO: 9466 - protein, 360 aa, Xenorhabdus bovienii
  Coding DNA sequence: Name=SeqID_3358
  Gene classification: Function=Uncharacterized membrane protein; Function class=S Function unknown
  Homolog annotation: Query=13..359bp; Hit=9..348bp; Blast score=328; Percent Identity=59.0; E value=4e-90; Homolog= yeiH COG2855
MSESQFGKIDRPQHNPILILIPGFTLIAVLTAIAIHVGGMPWFINMGLGALTLAILLGIIVGNTLYPLLKPTCDKGVHFAKHYLLRAGIILYGFRLTFQQITDIGATGLLIDAIMLSSTFFIALWLGRTFLGLDSQTAVLIGAGSSICGAAAIMATEPVVKASASKVAVAVSTVVIFGTLAIFIYPWFYQLNAHYQWLPFSQETFGIFSGSTIHEVAQVVAVGHTLGNNAENAAVISKMIRVMMLAPFLLLLSGFISRIEAKNFGNDQKKSPISIPWFAIFFIATAGLNSFHLLPGSLIKHIITADTIMLAMAMVALGLTTHVSAIRQAGIKPILLAFFLFIWLMAGGLIVNQGIQRLLG

SEQ ID NO: 9467 - protein, 280 aa, Xenorhabdus bovienii
  Coding DNA sequence: Name=SeqID_3359
  Gene classification: Gene name=Nfo; Function=Endonuclease IV; Function class=L DNA replication, recombination and repair
  Homolog annotation: Query=1..279bp; Hit=1..279bp; Blast score=455; Percent Identity=76.0; E value=1e-128; Homolog= Znfo COG0648
MKFVGAHVSAAGGVDQAVIRAHELQATAFALFTKNQRQWHAPPLSADVIDKFRANCERYGYGSQQILPHDSYLINLGHPEAEALEKSRAAFLDEMQRCEQLGIDLLNFHPGSHLKKIDIDKCLARIAESINIVLDKTQGVTAVIENTAGQGTNLGFKFEQLSAIIEGVEDKNRVGVCIDTCHAFAAGYDLRTEKDCEATFEAFDKIVGFKYLRAMHLNDAKSEFSSRVDRHHSLGEGNIGNTPFSYIMKDDRFNGIPLVLETINPGIWDQEIAWLKSQQN

SEQ ID NO: 9468 - protein, 312 aa, Xenorhabdus bovienii
  Coding DNA sequence: Name=SeqID_3360
  Gene classification: Gene name=FruK; Function=Fructose-1-phosphate kinase and related fructose-6-phosphate kinase (PfkB); Function class=G Carbohydrate transport and metabolism
  Homolog annotation: Query=1..311bp; Hit=1..311bp; Blast score=466; Percent Identity=73.0; E value=1e-131; Homolog= fruK COG1105
MSRRVATITLNPAYDLVGLCPDITKGTVNRVQTAGLHAAGKGNNVAKVLRDLGIDVTVSGFLGRENQEGFQQFFSENNMVNRFHLVSGRTRINVKLTEKYGEVTDFNFSGFHVTAEEWNYFVSDSLDWLGQCDMVVVSGSLPEGILPESFADWMLQLKQRCPCIIFDSSREAFVAGLEASPWLVKPNRDELEIWAGKPLPDLDSVINAAHELRNRGIAHVVISLGEQGALWVNASGAWLAKPPHCEIVSTVGAGDSMVGGLVYGLLMRETSEHTLRLATAVSALTVSQPNVGIRSRTELASMMSKIELTSFR

SEQ ID NO: 9469 - protein, 47 aa, Xenorhabdus bovienii
  Coding DNA sequence: Name=SeqID_3361
MKIDFKLSVVVLFSSSDKKSSLGIFLLLDRDNTTINQVVILTETIQF

SEQ ID NO: 9470 - protein, 174 aa, Xenorhabdus bovienii
  Coding DNA sequence: Name=SeqID_3362
  Gene classification: Function=ADP-ribose pyrophosphatase; Function class=F Nucleotide transport and metabolism
  Homolog annotation: Query=40..155bp; Hit=6..118bp; Blast score=85; Percent Identity=43.0; E value=3e-17; Homolog= PA2769 COG1051
MPREDFLSDDENKTTTDNLKSIFIIMDKFQPEEYTVSVVVGVGVIIINDKGEVLLGKRTSKHAPYWSIFGGHVDPGETFEECAIREIQEETGLTIQDPKVYGVCNNLETYHEEGKHTVSVCLLAHHPGGEPQLMEPEKCEQLIWCDPNQLPEPHFEASRNAIKLWQMEKFYLIA

SEQ ID NO: 9471 - protein, 79 aa, Xenorhabdus bovienii
  Coding DNA sequence: Name=SeqID_3363
VILISYQNPTLKPAAMPSSYGKWKNSILSLKTTHLLKCFSGGLFHITCSHICMKNTTKGIYLSSINICLHISFINVSSS

SEQ ID NO: 9472 - protein, 414 aa, Xenorhabdus bovienii
  Coding DNA sequence: Name=SeqID_3364
  Gene classification: Gene name=SdaC; Function=Amino acid permeases; Function class=E Amino acid transport and metabolism
  Homolog annotation: Query=10..413bp; Hit=11..416bp; Blast score=422; Percent Identity=57.0; E value=1e-118; Homolog= PA5434 COG0814
MTIEVTQNLKRPSILGGAMIIAGTAVGAGMFSIPIATSGVWFTGSIILLVYTWACMYFSGLMILEANLNYPSGSSFHTVTKDLLGKGWSTLNGLSIAFVLYILTYAYVSAGSSILFHNITHLLPLPQSGTGLLFALIVAFIVWMSTKAVDRLSTILIGGMVITFIMSVGSMFTEVKSTVLFDQANTETSYLPYTFMALPYLLASFGYHGNIPGLVKYYHKDSRAVAHSLFYGTLIALVIYILWQYVIQGNIPREAFKQIIADGGNIANLLQQMDNTSNNTTVAQLLNAFSYMALASSFLGVSLGLFDYLADFFGFDDSGEGRFKTALVTFIPPTVLALIFPNGFLYAIGFAGLAATIWAVIVPALMAHASRVRYPNASYQAPGGNFLIAFIILFGLINATAHILSLFDVLPTYH

SEQ ID NO: 9473 - protein, 48 aa, Xenorhabdus bovienii
  Coding DNA sequence: Name=SeqID_3365
LPNVLTASNFVVTSIFIPLFPCFYGRYLWLKPMKLSAELQSVTMENYY

SEQ ID NO: 9474 - protein, 190 aa, Xenorhabdus bovienii
  Coding DNA sequence: Name=SeqID_3366
  Gene classification: Gene name=Efp; Function=Translation elongation factor P/translation initiation factor eIF-5A; Function class=J Translation, ribosomal structure and biogenesis
  Homolog annotation: Query=1..190bp; Hit=86..275bp; Blast score=304; Percent Identity=77.0; E value=3e-83; Homolog= yeiP COG0231
MAKANEIKRGTAISYNGKLLLVKDIDIQTPSARGASTLYKMRFTDVRTGQKVEERFKGDDILETITLTRRSVSFSYIDGDEYIFMDDEDFTPYHFKKNQIEEELLFIPEEGLPGVQVLTMDGQLLALELPQTVDMIIEETTPSIKGASASARTKPAKMSTGLTIQVPEYLSSGEKIRIHIAERRYMGRCD

SEQ ID NO: 9475 - protein, 103 aa, Xenorhabdus bovienii
  Coding DNA sequence: Name=SeqID_3367
MQNYLKLLISCLLVSWMSYGYAQSTGGQIQFSGSIVDPGCQVVVSNTQANISCYRLGKSLTVKQIISTQKTIGEVMLPGNIGVSSVKWTDSQKRVAIINVDYF

SEQ ID NO: 9476 - protein, 43 aa, Xenorhabdus bovienii
  Coding DNA sequence: Name=SeqID_3368
LHGHLTFVFPLTKTQLPLFLHLHHNYFTGKNTTLTHFIDSYQK

SEQ ID NO: 9477 - protein, 103 aa, Xenorhabdus bovienii
  Coding DNA sequence: Name=SeqID_3369
  Homolog annotation: Query=1..103bp; Hit=1..103bp; Blast score=76; Percent Identity=34.0; E value=8e-14; Homolog= ref|NP_930096.1|
MLRKMTTFLFIPLLYPVMAHDPLSSSFGSLQFHGAIVEPPCQFNWGEERTEVACWHNGEQINQDKNLEYQKDSDYPLSKHIGIEEIRWMEENKKSGIVTITYH

SEQ ID NO: 9478 - protein, 55 aa, Xenorhabdus bovienii
  Coding DNA sequence: Name=SeqID_3370
MRYLFKTKVNFGGSQINWGSTIAKFMAKSNRSGMLLLRHGDISIFIPFMDWRNYH

SEQ ID NO: 9479 - protein, 234 aa, Xenorhabdus bovienii
  Coding DNA sequence: Name=SeqID_3371
  Gene classification: Gene name=PgpB; Function=Membrane-associated phospholipid phosphatase; Function class=I Lipid metabolism
  Homolog annotation: Query=9..228bp; Hit=20..240bp; Blast score=237; Percent Identity=58.0; E value=9e-63; Homolog= yeiU COG0671
MTRSNPLSIFILNMLGIALFFSWYLPENHGFWFNIDAAIFHFFNEKLLPNSRFALFVAIVNIRAFDVISLLCMGLLYYSAFRKQDYAGKRRLFMIGLVMLVTAVIINQIGHKIPVSRPSPTLTFENINRVDDMISWHTKDASKDSFPGDHGLMLLIFSCFILRYVSHGAFFIALLIMITFTLPRIMAGAHWFTDIAIGSLSLTLIGMSWVLLTPLSDIMATWLDKKLPYIRRTN

SEQ ID NO: 9480 - protein, 194 aa, Xenorhabdus bovienii
  Coding DNA sequence: Name=SeqID_3372
  Gene classification: Gene name=Spr; Function=Cell wall-associated hydrolases (invasion-associated proteins); Function class=M Cell envelope biogenesis, outer membrane
  Homolog annotation: Query=1..187bp; Hit=1..185bp; Blast score=245; Percent Identity=66.0; E value=2e-65; Homolog= spr COG0791
MVKSQPILRYILRLIPAILAAVVLTACSSPDSQMRSKKTDTHAVNSQKHFLLQASQDEFETLVKNLDTKSKILNQYADWKGVAYRLGGNTKRGIDCSAFVQRTFHDQFDIDLPRSTSEQQKIGQTVSRSKLRAGDLVLFKTGIYMRHVGIYIGNNQFVHASTSNGVIVSKLTDTYWTKRYYGARRVLRDVNKVS

SEQ ID NO: 9481 - protein, 114 aa, Xenorhabdus bovienii
  Coding DNA sequence: Name=SeqID_3373
  Homolog annotation: Query=1..113bp; Hit=1..113bp; Blast score=157; Percent Identity=70.0; E value=2e-38; Homolog= ref|NP_930099.1|
VDNIQLSVVHRLPQSYRWSSGFVGTKVEILPTEETDIGNSLMGLKLLSHEGENARVILHSLNQSIADMQILSAVIEWEGEPCLFFAKEDESAVICRLKTLGAAIAENITALYPL

SEQ ID NO: 9482 - protein, 50 aa, Xenorhabdus bovienii
  Coding DNA sequence: Name=SeqID_3374
MYYRKLDIIHVLFLSETTLIHLTTSCRLSVRQNRITPQQKANKKVNKKLK

SEQ ID NO: 9483 - protein, 30 aa, Xenorhabdus bovienii
  Coding DNA sequence: Name=SeqID_3375
MASFAISRFLGIISKCSHYQDRIKNIGKTL

SEQ ID NO: 9484 - protein, 376 aa, Xenorhabdus bovienii
  Coding DNA sequence: Name=SeqID_3376
  Gene classification: Gene name=ProP; Function=77 Permeases of the major facilitator superfamily; Function class=G Carbohydrate transport and metabolism
  Homolog annotation: Query=1..376bp; Hit=20..395bp; Blast score=382; Percent Identity=59.0; E value=1e-106; Homolog= Zbcr COG0477
MLMPLAIDMYLPSMPTIATNFGVDAGRVQMTLSSYILGFAIGQMVYGPMSDSLGRKPVIVGGVIVFAIASAACALSQNIDTFISMRFLHGFSAAAASVVINALMRDMFTKDEFSRSMSFVTLVMIIAPLLAPMLGGLMMVWFNWHAIFWSISIAGVITAFLVAFFIRETLPKERRQRFNLKTIFNQFAMLFRQRQVLFYILASGFSFAGMFSFLSAGAFVYIDLNGVSAQHFGYYFGLNIIFLFIMTMINSQCVRKYGASKMLHFGVFVQFVMGLWLLFSTVLDLGFISLVLGVAIYISGISMITSNAMAVVLDDYPHMAGTVASLAGTIRFSIAALVGTILSSVSAKSAWPMVGSMALCVILAMLLIIYANKAKK

SEQ ID NO: 9485 - protein, 235 aa, Xenorhabdus bovienii
  Coding DNA sequence: Name=SeqID_3377
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=1..230bp; Hit=1..230bp; Blast score=353; Percent Identity=73.0; E value=7e-98; Homolog= rsuA COG1187
MRLDKFLSQQLGISRNDIGRELRTSRVTVDGEVIKSGAYKLKPDQQVAYEGSVLEQLDGSRYFMLNKPQGYVCSTDDPTNPTILYFIDEPVAHKLHSAGRLDIDTTGLVLLTDDGQWSHRITSPKHHCEKTYLVTLEYPISDDIEMKFLAGVQLNGEKTLTKPAKLEIIEPHRVRLSISEGRYHQVKRMFAAVGNHVVELHRERIGQICLDSALEPGEYRALTKNEINSIQVPTP

SEQ ID NO: 9486 - protein, 40 aa, Xenorhabdus bovienii
  Coding DNA sequence: Name=SeqID_3378
MNTPLILQALQGSLLEYKIKQIIFRVIVTSIIITIINYML

SEQ ID NO: 9487 - protein, 585 aa, Xenorhabdus bovienii
  Coding DNA sequence: Name=SeqID_3379
  Gene classification: Gene name=SSL2; Function=DNA or RNA helicases of superfamily II; Function class=L DNA replication, recombination and repair
  Homolog annotation: Query=1..358bp; Hit=1..358bp; Blast score=567; Percent Identity=75.0; E value=1e-161; Homolog= yejH_1 COG1061
MAFTLRPYQQEAVDATIHHFRQHKDPAVIVLPTGAGKSLIIAELAKLAHGRVLILAHVKELVAQNHSKYCAYDLQADIFSAGLHQKQSERKVVFGSIQSVARNLDCFDHHFSLLIIDECHRISDDENSQYQQIIQQLKKNNPQIRILGLTATPYRLGSGWIYQYHYHGMIRGDEHCFFRDCIYELPLRYMIKHHFLVPPERLDMPVMQYDFSQVRTSQQGIFNEADLNREIKRQKRITPHIIKQIIEYAQDRKGVMIFAATVEHAKEIFQLLSAEQAALVSANTPATERDLLITAFKAQQLQYMVNVAVLTTGFDAPHVDLIAILRPTESVSLYQQIIGRGLRLSPDKKECLILDYAGNPHDIYSPEVGSSKPNSQNQPIQVFCPICQFANTFWGKCTAEGEIIEHFGRRCQGWEEDESGKRHQCDFRFRFKSCPHCGAENDIAARRCHRCQEVLVDPDDMLKAALKLKNALVLRCGGMQLTSGHDSKGEWLQITYYDEDGADVSERFRLATPAQRKVFELHFLRQHQRAPGIPLQWKTAEDIAQQLPLLRHPDFVVARKKGQFWQIREKVFDYQGRFRRADDLY

SEQ ID NO: 9488 - protein, 93 aa, Xenorhabdus bovienii
  Coding DNA sequence: Name=SeqID_3380
  Gene classification: Gene name=RplY; Function=Ribosomal protein L25 (general stress protein Ctc); Function class=J Translation, ribosomal structure and biogenesis
  Homolog annotation: Query=1..93bp; Hit=1..94bp; Blast score=136; Percent Identity=75.0; E value=5e-33; Homolog= rplY COG1825
MLTINAEVRKEQGKGASRRLRRANKFPAIIYGGNQEPVSIELDHDAVINHESKPEFYEVLNLVVDGKETTVKVQAVQRHPFKPKLTHIDFLRA

SEQ ID NO: 9489 - protein, 68 aa, Xenorhabdus bovienii
  Coding DNA sequence: Name=SeqID_3381
  Gene classification: Function=Nucleoid-associated protein; Function class=R General function prediction only
  Homolog annotation: Query=1..68bp; Hit=268..335bp; Blast score=133; Percent Identity=92.0; E value=3e-32; Homolog= yejK COG3081
LEESFPADRGTLRQLTKFAGSGGGLTINFDAMLLGERIFWDPVTDTLTIKGTPPNLRDQLQRRGSGNH

SEQ ID NO: 9490 - protein, 281 aa, Xenorhabdus bovienii
  Coding DNA sequence: Name=SeqID_3382
  Gene classification: Function=Nucleoid-associated protein; Function class=R General function prediction only
  Homolog annotation: Query=1..260bp; Hit=1..260bp; Blast score=377; Percent Identity=73.0; E value=1e-105; Homolog= yejK COG3081
MSLEITQIALHRLIKRDEQTLEVILRDSLLTTNQVVEDMMAELHRVYSAKSKAYGLFNDESELAESLRHQRKGDEDFLGFSRAATVRLKDELTKYPFAEGGTVLFCQYRYLAVEYLLISVLNSCNSMSVNDELDVNTTQYLDIPHADIVARIDLTEWETNPESSRYLTFLKGRVGRKVSDFFMDFLSASEGMNAKVQNKGLLQAVDDYCESAQIDKNERQAYRQQVYSYCNEQLQAGEEIKLQELSQELPPLGEQNSSNFRRNRDTNWKRVSQQIAVHYVN

SEQ ID NO: 9491 - protein, 37 aa, Xenorhabdus bovienii
  Coding DNA sequence: Name=SeqID_3383
MFNFFIAVARRLWHKSKILDIQSPIYYRIEGQFSAFL

SEQ ID NO: 9492 - protein, 75 aa, Xenorhabdus bovienii
  Coding DNA sequence: Name=SeqID_3384
  Gene classification: Function=Uncharacterized BCR; Function class=S Function unknown
  Homolog annotation: Query=1..75bp; Hit=1..75bp; Blast score=110; Percent Identity=84.0; E value=3e-25; Homolog= yejL COG3082
MPQSSRYSDEKVEHLLAELVNVFEKNHTPTDLSLMILGNMVTNLINTSIAPAQRRHIADSFARALQSSINEDKAH

SEQ ID NO: 9493 - protein, 243 aa, Xenorhabdus bovienii
  Coding DNA sequence: Name=SeqID_3385
  Gene classification: Function=Predicted hydrolase of alkaline phosphatase superfamily; Function class=R General function prediction only
  Homolog annotation: Query=1..207bp; Hit=1..208bp; Blast score=279; Percent Identity=67.0; E value=2e-75; Homolog= yejM COG3083
MVTSRQHYREKVSQMISWGHWFALFNIVFSLVLGSRYLFASDWPGSLFGRIYALLSWLGHFSFIVFAIYLLILFPLTFVVMSQRLLRFLSAALATAGLTLLILDSSIYIRFHLHLTPLVWDLVTNPEQGELTREWQLMFICIPAIFLVQMLFGTWSWQKLRSLNRQRSVSHWRRYSLPAFIASHLMYIWADANFYRLIYMQRSNLPLVLFNDRTQIPWKTPNYWINRNPAPYEPTRKPGCPNR

SEQ ID NO: 9494 - protein, 389 aa, Xenorhabdus bovienii
  Coding DNA sequence: Name=SeqID_3386
  Gene classification: Function=Predicted hydrolase of alkaline phosphatase superfamily; Function class=R General function prediction only
  Homolog annotation: Query=19..389bp; Hit=210..586bp; Blast score=324; Percent Identity=45.0; E value=1e-88; Homolog= yejM COG3083
MLTSTASFTCSVQIYHWFYSMTGRKFPGKHRITGSTGIQRRMNQQGNPAALTVEYPLNGLSYQDNRQGYNLLLLVVDDLDNKDITNAMPSLERFTQNNIQFTQHFSTGIQNDTALFGLFYGISSGYLDGILNSRKSSALLDALTHQRYQFGLFSSDGFQTPLYRQALLTDYSFPTPTKKDDSLTVTKWRQWLDLNHGTTPWFSFLGINGFTHSTGQFDKKALDTEINNVLETLTNKGMLDKTIVVITAKHSELSTGHSPKWLTGDKFNREQIHVPLIIHWPGTPAQVINKLTSHQDVMTTLMQRLLHVSNSPGDYSQGEDLFTVRRDNPWLITGDDGSLIVTTATNTIYLSKNGEYYLYDLDGNEIQGAKPNLAQLLQILTEVKRFLAN

SEQ ID NO: 9495 - protein, 33 aa, Xenorhabdus bovienii
  Coding DNA sequence: Name=SeqID_3387
MEILGRDFTPILHQANLRHKKTNHNRLVFLGKF

SEQ ID NO: 9496 - protein, 33 aa, Xenorhabdus bovienii
  Coding DNA sequence: Name=SeqID_3388
MGVKSRPNISILTLPYLIFTCTFFVNATEPFCA

SEQ ID NO: 9497 - protein, 215 aa, Xenorhabdus bovienii
  Coding DNA sequence: Name=SeqID_3389
  Homolog annotation: Query=5..215bp; Hit=9..226bp; Blast score=126; Percent Identity=33.0; E value=2e-28; Homolog= ref|ZP_00123030.1|
MDRVIYSAKFGDKTVRFVVIKMELYVSRTDIVESFRECATDYVKLEVNGLVDDWLKGMGDVQDRKSAMLGESSIGPVVHFYTISHLLHIMSDFNESRNDELIALGRRVNALFRWFSDASYQAHEHFGITIFEMLNSVSKRLDRLNDFFVVNVIHDGDVWVSECDELGLVTEAKTYDELTEQVWEIASELYELVGDSEYIRIKFVQEQSSDSRIAL

SEQ ID NO: 9498 - protein, 56 aa, Xenorhabdus bovienii
  Coding DNA sequence: Name=SeqID_3390
VPVPRSEFSTRKRSHKEQSWINELNFSAMSTILAVFSFHQGNNSVSRSGNADVMVT

SEQ ID NO: 9499 - protein, 62 aa, Xenorhabdus bovienii
  Coding DNA sequence: Name=SeqID_3391
  Homolog annotation: Query=1..54bp; Hit=40..93bp; Blast score=65; Percent Identity=61.0; E value=2e-10; Homolog= ref|NP_927686.1|
MSISEIMTILIFFPMSNHRNFKIFYLGLTWQYHYNDFPALLSYTCFIGVVSSVLPLLLAVRL

SEQ ID NO: 9500 - protein, 36 aa, Xenorhabdus bovienii
  Coding DNA sequence: Name=SeqID_3392
MLNTPLNVKRKLSDGCHLLVGQLAETQQPPTLVGGC

SEQ ID NO: 9501 - protein, 91 aa, Xenorhabdus bovienii
  Coding DNA sequence: Name=SeqID_3393
  Homolog annotation: Query=1..89bp; Hit=1..89bp; Blast score=69; Percent Identity=50.0; E value=1e-11; Homolog= ref|ZP_00134929.1|
MLSLYTAYDVQHELRDFIKRQRKQQKITVEVLSKRSGVPYSTIRKFERTGNISLRQFLMLLEAIGELNPLHQLTKERKQEPITIAEVLKNA

SEQ ID NO: 9502 - protein, 54 aa, Xenorhabdus bovienii
  Coding DNA sequence: Name=SeqID_3394
MVNSSNVSSQCAHHYISKKSSNDYGMLTKKQLTHSTIILLLWNLIIIFTMLLLL

SEQ ID NO: 9503 - protein, 54 aa, Xenorhabdus bovienii
  Coding DNA sequence: Name=SeqID_3395
MSCQQVYKIIREARLKANLAICVNPHILWHACDYTKQQGHLLKRMAWVNIFVQW

SEQ ID NO: 9504 - protein, 51 aa, Xenorhabdus bovienii
  Coding DNA sequence: Name=SeqID_3396
LILQSKNNQQNSYKLLIFIFLNHLNLLLVELERHVHACHVSRCIKSSVRLV

SEQ ID NO: 9505 - protein, 371 aa, Xenorhabdus bovienii
  Coding DNA sequence: Name=SeqID_3397
  Homolog annotation: Query=1..369bp; Hit=3..372bp; Blast score=249; Percent Identity=37.0; E value=4e-65; Homolog= ref|NP_286289.1|
MKELVDVFSDFPDPRCQGKVKHRVIDILVIAVCAVIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDSHGRTVRRRGWVLPLTSETKHLRSWPDIQALLVTETIRQEHYSDTVTSDFRYYLSSCHDSPAFQLGAIRKHWAIENSLHWVLDVTFREDDSRMRERVATRIFAQLRKMALNIVKRDINSKLSLSARRKSAGWDNGYMEALFHA

SEQ ID NO: 9506 - protein, 52 aa, Xenorhabdus bovienii
  Coding DNA sequence: Name=SeqID_3398
MFVGETITLVPIFIKVFFLYINLTKWYSLKSSQLPPFYYRIVKFPGVTHENI

SEQ ID NO: 9507 - protein, 37 aa, Xenorhabdus bovienii
  Coding DNA sequence: Name=SeqID_3399
MDLFLVNFADMAAKGLSENKTIGLDRLDKLLLHGYSH

SEQ ID NO: 9508 - protein, 107 aa, Xenorhabdus bovienii
  Coding DNA sequence: Name=SeqID_3400
  Homolog annotation: Query=1..105bp; Hit=410..514bp; Blast score=148; Percent Identity=67.0; E value=2e-35; Homolog= ref|NP_455941.1|
VNFSEKPVKVTRWTAINLAARDFRYVCGIRYTSSSLEISTGESVKIPLSYKAPGWEATYIEATFHDGYVATTQVYITPDDKYPVVAPPSNGIACQTLPGRGLGENKP

SEQ ID NO: 9509 - protein, 48 aa, Xenorhabdus bovienii; identical to SEQ ID NO: 6457
  Coding DNA sequence: Name=SeqID_3401

SEQ ID NO: 9510 - protein, 111 aa, Xenorhabdus bovienii
  Coding DNA sequence: Name=SeqID_3402
  Homolog annotation: Query=1..103bp; Hit=201..303bp; Blast score=165; Percent Identity=69.0; E value=2e-40; Homolog= ref|NP_460504.1|
MDGPEQRKLIPLHIPMAVTVSQAMRVAKQELKEWNINKFIVTGASKRGWTAWLSSISDPDVDAIVPFVMDLLSTDLALENMYRTYGGNWPITFSPYYQQGIDKLLNYHLLK

SEQ ID NO: 9511 - protein, 105 aa, Xenorhabdus bovienii
  Coding DNA sequence: Name=SeqID_3403
  Homolog annotation: Query=3..105bp; Hit=58..160bp; Blast score=110; Percent Identity=46.0; E value=6e-24; Homolog= ref|NP_455941.1|
MVDFSHVIPCYRAKLAALPVKYSLQGKKSLPSIELLKYEMTSQRWSPGNLVSPDSWQHDVDMYIPDNPKSQHALVVVNNGTNYDDDIKKTSQPTNFSEKSLAEIA

SEQ ID NO: 9512 - protein, 32 aa, Xenorhabdus bovienii
  Coding DNA sequence: Name=SeqID_3404
MRKINHILLLAYGIFRIYQSGTFSRKEKKSDK

SEQ ID NO: 9513 - protein, 485 aa, Xenorhabdus bovienii
  Coding DNA sequence: Name=SeqID_3405
  Gene classification: Gene name=NuoN; Function=NADH; Function class=C Energy production and conversion
  Homolog annotation: Query=61..485bp; Hit=1..425bp; Blast score=553; Percent Identity=75.0; E value=1e-157; Homolog= nuoN COG1007
MTITSEQLIALLPLLIVGLTVVVVMLSIAWRRDHLINFTLTVIGLNLALLSLYFVGQQEPMDVTPLIHVDRFAMFYTGLVLIASLATTTFAYSWLENYPDNKEEFYLLVLIAAVGGILLSSANHMASLFIGIELITLPLFGLIGYAYRQKRSLEASIKYMLLSAAASSFLLFGIALLYAESGDLSFASLGRSLSDSQLHEPLILAGLGMMLVGLGFKLSLVPFQLWTPDVYQGAPAPVSTFLATASKVAIFAVIMRLFLEAPVAESETLRIVLTVMAIASILFGNLLALTQSNIKRLLGYSSIAHLGYLLVVLVAIRSHTLAEETAGIYLAGYLFASIGAFGVVSLMSSPYQGPDADSLYSYRGLFWHKPILSAVMTIIMLSLAGIPLTFGFIGKFYVIATAVEAELWWLTGAVVLGSAIGLYYYLRVMVSLYLPAPKTLNRDTPSNWALTSGGIVVLISGLLVLILGIWPQPVIDIVQQAKSAM

SEQ ID NO: 9514 - protein, 506 aa, Xenorhabdus bovienii
  Coding DNA sequence: Name=SeqID_3406
  Gene classification: Gene name=NuoM; Function=NADH; Function class=C Energy production and conversion
  Homolog annotation: Query=1..506bp; Hit=1..509bp; Blast score=709; Percent Identity=80.0; E value=0; Homolog= nuoM COG1008
MLLPWLILLPFIGGLLCWQTERFGTRMPRWIALLAMGLTLLLSLQLWLQGGYTLTNPQGIPQWQSEFLIPWIPRFGISIHLALDGLSLLMVVLTALLGLMAILCSWNENQPYQGFFHLNLLWILGGVMGVFLAIDLFLFFFFWEMMLVPMYFLIALWGHRGSGGKTRITAATKFFIYTQASGLVMLISILALAFVYYDATGEWSFSYEKLLNTPMSDTVQYLLMLGFFIAFAVKMPVVPLHGWLPDAHSQAPTAGSVDLAGILLKTAAYGLLRFSLPLFPQASAEFAPIAMWLGVIGIFYGAWMAFSQTDIKRLIAYTSVSHMGFVLIAIYTGSQLAYQGAVIQMIAHGLSAAGLFIVCGQLYERLHTRDMRNMGGLWGRIQLLPAISLFFAVATLGMPGTGNFVGEFMILFGSFSKFTLITTVSVFGLVFASVYALYLMQKAYYGTPTTDKPLQRMDVREISILLLLVVLLVIVGVYPQPVLDTSAAAMSNIQNWYSASLLTTRP

SEQ ID NO: 9515 - protein, 616 aa, Xenorhabdus bovienii
  Coding DNA sequence: Name=SeqID_3407
  Gene classification: Gene name=NuoL; Function=NADH; Function class=C Energy production and conversion
  Homolog annotation: Query=1..605bp; Hit=1..601bp; Blast score=818; Percent Identity=78.0; E value=0; Homolog= nuoL COG1009
MNLLYLTILLPLLGFLLLAFSRGRWSENLSATIGSASVGLAALATLWAGVDFHAQNGAEGLVYSQTLWNWMEADNFSIPVNLVLDGLSLTMLSVVTGVGFLIHIYASWYMRGEEGYSRFFAYTNLFIASMVVLVLADNMLLMYLGWEGVGLCSYLLIGFYYKTPANGAAAMKAFIVTRVGDVFLAIGMFILYDQFGTLSFRELAVLAPQHIEAGSTAITWATLMILGGAVGKSAQLPLQTWLADAMAGPTPVSALIHAATMVTAGVYLIARSHALFLMAPDILHLVGTIGAITLLLAGFAALVQTDIKRVLAYSTMSQIGYMFLALGVQAWDAAIFHLMTHAFFKALLFLASGSVILACHHEQNIFKMGGLSKRIPFVYLCFIVGGSALSALPLLTAGFYSKDEILWGALANGHMNLMLAGLVGALMTSLYTFRMIFIVFHGEENTKAHPVKGITHTLPLSVLLVLSTFVGALIVPPLAGVLPESSTTAGHDDKLTLEIVSGVVAVLGILLAAALYLGKRAVVKATANSVPGRFFSTWWFHAWGFDALYDWVFVKPFKGITQLLQNDPLNSLMNIPAILSRWGNKGLGLSENGQVRWYATSLGLGAVLVLALLLLI

SEQ ID NO: 9516 - protein, 100 aa, Xenorhabdus bovienii
  Coding DNA sequence: Name=SeqID_3408
  Gene classification: Gene name=NuoK; Function=NADH; Function class=C Energy production and conversion
  Homolog annotation: Query=1..100bp; Hit=1..100bp; Blast score=125; Percent Identity=88.0; E value=6e-30; Homolog= nuoK COG0713
MIPLEHGLILAAILFVLGFVCLIVRRNLLFMLIGLEIMINASALAFVVAGSYWLQPDGQVMYILAITLAAAEASIGLALLLQLYRRRQSLNIDIVSEMRG

SEQ ID NO: 9517 - protein, 175 aa, Xenorhabdus bovienii
  Coding DNA sequence: Name=SeqID_3409
  Gene classification: Gene name=NuoJ; Function=NADH; Function class=C Energy production and conversion
  Homolog annotation: Query=1..174bp; Hit=1..174bp; Blast score=214; Percent Identity=75.0; E value=3e-56; Homolog= nuoJ COG0839
MEFTFYVAGLVAILATLRVITHTNPVHALLYLITSLLALSVVFFSLGAYFAGALEIIVYAGAIMVLFVFVVMMLNLGKSVVEQERAWLQLRVWIGPAILATVLLIVLIFAISSLPTAEISGEVVSAKEVGISLFGPYVLAVELASLLLLAGLVVAYHIGRENRQGEVISNRTEDQ

SEQ ID NO: 9518 - protein, 180 aa, Xenorhabdus bovienii
  Coding DNA sequence: Name=SeqID_3410
  Gene classification: Gene name=NuoI; Function=Formate hydrogenlyase subunit 6/NADH; Function class=C Energy production and conversion
  Homolog annotation: Query=1..180bp; Hit=1..180bp; Blast score=347; Percent Identity=92.0; E value=5e-96; Homolog= nuoI COG1143
MTLKELVVGFATQVRSIWMIGLHAFHKRETKMYPEEPVYLPPRYRGRIVLTRDPDGEERCVACNLCAAVCPVGCISLQKAEHKDGRWYPEFFRINFSRCIFCGLCEEACPTTAIQLTPDFELGEFKRQDLVYEKEDLLISGPGKYPDYNFYHKTGMAIDGKDKGEADNEAKPIDVKSLLP

SEQ ID NO: 9519 - protein, 325 aa, Xenorhabdus bovienii
  Coding DNA sequence: Name=SeqID_3411
  Gene classification: Gene name=NuoH; Function=NADH; Function class=C Energy production and conversion
  Homolog annotation: Query=1..325bp; Hit=1..325bp; Blast score=529; Percent Identity=89.0; E value=1e-150; Homolog= nuoH COG1005
MSWFTPDVIEVLITILKAVVILLVVVVCGAFMSFGERRLLGLFQNRYGPNRVGWGGSLQLVADMLKMFFKEDWVPRFSDRAIFTLAPIIAFCSLLLAFAIVPVSPTWMVADLNIGILFFMMMAGLSVYAVLFAGWSSNNKYSLLGAMRASAQTLSYEVFLGLALMGVVAQAGSFNMVDIVNSQQHMWNVIPQFFGFLTFAIAGVAVCHRHPFDQPEAEQELADGYHVEYSGMKFGLFFVGEYIGIVTVSALIVTLFFGGWHGPLLPSFIWFALKTAFFMVMFILIRAALPRPRYDQVMSFGWKVCLPLTLLNLLATAAVILYNAQ

SEQ ID NO: 9520 - protein, 911 aa, Xenorhabdus bovienii
  Coding DNA sequence: Name=SeqID_3412
  Gene classification: Gene name=NuoG; Function=NADH dehydrogenase/NADH; Function class=C Energy production and conversion
  Homolog annotation: Query=2..911bp; Hit=1..910bp; Blast score=1455; Percent Identity=73.0; E value=0; Homolog= nuoG COG1034
MLTMATIHVDGKEYDVNGADNLLQACLSLGLDIPYFCWHPALGSVGACRQCAVKQYQNAEDTRGRLVMSCMTPATEGTFISIDDEEAKQFRASVVEWLMTNHPHDCPVCEEGGNCHLQDMTVMTGHSFRKYRFTKRTHQNQELGPFVAHEMNRCIACYRCVRYYKDYADGTDFGVYGAHDNVYFGRTESGTLESEFSGNLVEICPTGVFTDKTHSERYNRKWDMQFAPSICQQCSIGCNTSPGERHGEVRRIENRYNGTVNHYFMCDRGRFGYGYVNRDDRPRQPQQLRGDQWISLNAEQVMQGGADILRQAKNAIGIGSPRASIESNFALRELVGAENFYSGISVEEQNRLDMMLEILQQGGVYTPSLREIEGYDAVLILGEDLTQTGARMALSVRQAVKGKAREMAAAQKVADWQIAAVMNIGQHTKYPLFLTSVDDTRLDDIAAWNYRAPTDDQARFGFAVAHALNSIAPAVNDLPDELKTKVEIVAQALRDAKKPLIISGSNAGSDALIQAAANIAWALKDKGANVGLSFVAAYANSLGLAMMEAQPLDVALQRIAKGDSDTAIVVENDLYRHAAADKIDSALGSLKNLIVVDHQRTAIMDKAHLILSAASFAESDGTLVNQEGRAQRYFQVYEPSFYDKSIVMLESWRWMHSLYTTYAQCQTDWAQLDHVIEACVKAMPQFKGIVNAAPDSTFRIRGQKLARSPHRYSGRTAMLANVSVHEQRQPQDIDTAFAFSMEGNNSPFAERQQIPFAWAPGWNSPQAWNKFQAEVGGKLRFGDPGMRLIETTDGGLNYFDSIPAAFAAQKNQWYVAPYFHLFGSEELSQRAEVIQERMPEPYVMMNHQDAEHLNVKEGSMMEFDCAGQQLRLAVRLSGNLVQGQIGLPLGMPGIPPVLAGKSANNLRGIAQ

SEQ ID NO: 9521 - protein, 454 aa, Xenorhabdus bovienii
  Coding DNA sequence: Name=SeqID_3413
  Gene classification: Gene name=NuoF; Function=NADH; Function class=C Energy production and conversion
  Homolog annotation: Query=7..454bp; Hit=1..445bp; Blast score=823; Percent Identity=88.0; E value=0; Homolog= ZnuoF COG1894
MTTHSGVKEIIRVAETHPLTWRLRDDQQPVWLDEYRSKSGYKGAEKALKGMVPDEITTLVKDAGLKGRGGAGFSTGLKWSLMPKDESMNIRYLLCNADEMEPGTYKDRLLMEQLPHLLVEGMLISAFALKAYRGYIFLRGEYVEAAVHLRRAIEEAKAAGLLGKNILGSGFDFELFVHTGAGRYICGEETALINSLEGRRANPRSKPPFPATSGVWGKPTCVNNVETLCNVPAILEHGKEWYIGLSEGKSKDAGTKLMGFSGRVKNPGVWELPFGTTAREILEDYAGGMRDGLKFKAWQPGGAGTDFLTVDHLDLPMDFENIAKAGSRLGTALAMAVDHEINIVSLTRNLEEFFARESCGWCTPCRDGLPWSVKILRAIEDGKGQPGDIETLEQLCRFLGPGKTFCAHAPGAMEPLQSAIKYFRDEFEAGIVTKDYGNTNLIAGIQPNLLKQRW

SEQ ID NO: 9522 - protein, 181 aa, Xenorhabdus bovienii
  Coding DNA sequence: Name=SeqID_3414
  Gene classification: Gene name=NuoE; Function=NADH; Function class=C Energy production and conversion
  Homolog annotation: Query=26..180bp; Hit=11..165bp; Blast score=275; Percent Identity=83.0; E value=2e-74; Homolog= nuoE COG1905
MQSEFNANKQVRLDVINVTDAQTQGAFVLSTAERDAIEQEKHHYEDPRAASIEALKIVQKQRGWVPDGAIYAVAEVLGIPASDVEGVATFYSQIYRQPVGRHIIRYCDSVVCHITGYQGVQAAIETHLNIRPGQTTADGRFTLLPTCCLGNCDKGPTMMIDEDTHSYVKPEEIEKLLEQYP

SEQ ID NO: 9523 - protein, 599 aa, Xenorhabdus bovienii
  Coding DNA sequence: Name=SeqID_3415
  Gene classification: Gene name=NuoD; Function=NADH; Function class=C Energy production and conversion
  Homolog annotation: Query=202..599bp; Hit=1..399bp; Blast score=761; Percent Identity=89.0; E value=0; Homolog= nuoC_2 COG0649
MMTDQIAQESARPAWETRDHLDDPVVSELNRQFGPDAFSVQPTRTGMPVVWVRREQLLAVITFLKKLPKPYVMLFDLHGVDERQRSHRQGLPAADFSVFYHLISIERNRDIMLKVALNEKDLNVPTVTSIYSNANWYERETWEMFGITFNGHPNLRRILMPDTWEGHPLRKEYPARATEFDPFMLTKQKEDLEMEALTFKPEEWGMKRGTENEDFMFLNLGPNHPSAHGAFRIVLQLDGEEIIDCVPDIGYHHRGAEKMGERQSWHSYIPYTDRVEYLGGCVNEMPYVLAVEKLAGIDVPDRVKTIRVMLSELFRINSHLLYISTFIQDVGAMSPVFFAFTDRQKVYDVVEAITGFRMHPAWFRIGGVAHDLPRGWDKLLRDLLDWLPKRLNSYVKAALKNSVLKGRSVGVASYNSKQALDWGVTGAGLRATGIGFDVRKWRPYSGYENFDFEVPTGYNGDCYDRVMLKVEEIRQSMRILEQCLKNMPEGPFKADHPLTTPPPRERTLQHIETMINHFLQVSWGPVMPANESFQMIEATKGINSYYLTSDGNTMSYRTRIRTPSFAHLQQIPSVIRGSLVSDLIVYLGSIDFVMSDVDR

SEQ ID NO: 9524 - protein, 224 aa, Xenorhabdus bovienii
  Coding DNA sequence: Name=SeqID_3416
  Gene classification: Gene name=NuoB; Function=NADH; Function class=C Energy production and conversion
  Homolog annotation: Query=1..224bp; Hit=1..220bp; Blast score=428; Percent Identity=91.0; E value=1e-120; Homolog= nuoB COG0377
MDYTLTRIDPNGENDRYPLQKQELVNDPLEQHVHRSVYMGKLEHALHDMVNWGRKNSLWPYNFGLSCCYVEMVTSFTAVHDVARFGAEVLRASPRQADFMVISGTCFVKMAPVIQRLYDQLLEPKWVISMGACANSGGMYDIYSVVQGVDKFIPVDVYIPGCPPRPEAYMQALLLLQESIGKERRPLSWVVGDQGVYRANMQSERERKRGERIAVKNLRTPDEI

SEQ ID NO: 9525 - protein, 147 aa, Xenorhabdus bovienii
  Coding DNA sequence: Name=SeqID_3417
  Gene classification: Gene name=NuoA; Function=NADH; Function class=C Energy production and conversion
  Homolog annotation: Query=1..142bp; Hit=3..144bp; Blast score=199; Percent Identity=73.0; E value=7e-52; Homolog= nuoA COG0838
MSTSTGVFAHHWAFAVFLLGAFGLCALMLLGAYFLGGRSKGRAKHIPYESGIDSVGSARLRLSAKFYLVAMFFVIFDVEALYLYAWSVSIKESGWLGFAEASIFILVLLAGLVYLARIGALNWTPARSQRQVSKPSADIHTNNSHMQ

SEQ ID NO: 9526 - protein, 101 aa, Xenorhabdus bovienii
  Coding DNA sequence: Name=SeqID_3418
VDVDILVAYSSKVVSRCLLFLPAVLHHIDSWEGITTKYETVLINIINSLNRLGFYSSKQYFACMAKATTYLFTNKKPLINRLCLYIAKTCQSSKKPPTRHN

SEQ ID NO: 9527 - protein, 318 aa, Xenorhabdus bovienii
  Coding DNA sequence: Name=SeqID_3419
  Gene classification: Gene name=LysR; Function=Transcriptional regulator; Function class=K Transcription
  Homolog annotation: Query=1..303bp; Hit=1..303bp; Blast score=345; Percent Identity=57.0; E value=5e-95; Homolog= ZlrhA COG0583
MINANRQIINLDLDLLRTFVAVADLNTFAAAAAAVCRTQSAVSQQMQRLEHLVGRELFARHGRNKLLTEHGLQLLGYARQILRANDDATASLTYNDADGELRIGASDDTVDTLLPFLLNRIASVYPRMAVDVRIKRTQFIESMLDNHEIDLALTTAKINHHPKTVLRSSPVLWHCAPDFQLQTNEAIPLVVMDETNPFRQIALDTLDTAGISWRIAYEAASLSAVRAAVNAEVGITARPLEMQNADLRILGESEGLPRLPEIQFFLYRNSNEQNESVLTVFDAIENKKTPYTVTTVESGETDEIDESVEISTVENIDE

SEQ ID NO: 9528 - protein, 404 aa, Xenorhabdus bovienii
  Coding DNA sequence: Name=SeqID_3420
  Gene classification: Gene name=AvtA; Function=PLP-dependent aminotransferases; Function class=E Amino acid transport and metabolism
  Homolog annotation: Query=1..404bp; Hit=1..404bp; Blast score=751; Percent Identity=87.0; E value=0; Homolog= yfbQ COG0436
MFSINKSSKLDNVCYDIRGNTLKEAKRLEEEGNKILKLNIGNPAPFGFEAPDEILVDVIRNLSTAQGYSDSKGLYSARKAIMQHYQARNMLDITVEDIFIGNGVSELIVQSMQALLNTGDEMLVPAPDYPLWTAAVSLSSGKAVHYLCDEQQGWFPDLDDIRSKITPRTRGIVIINPNNPTGAVYSKELLLEIVEIARQHNLTIFADEIYDKILYDDAQHHSIAALAPDLFTVTFNGLSKTYRVAGFRQGWMVLNGPKKQAKGYIEGLEMLASMRLCANVPMQHAIQTALGGYQSISEFIFPGGRLYEQRNHAWELINQIPGVSCVKPMGALYMFPKIDTKRFNIHDDQKMVLDLLLQEKVLLVQGTAFNWPEPDHFRIVTLPHTTDLQIAIEKLARFIGNYRQ

SEQ ID NO: 9529 - protein, 239 aa, Xenorhabdus bovienii
  Coding DNA sequence: Name=SeqID_3421
  Gene classification: Function=Predicted hydrolases of HD superfamily; Function class=R General function prediction only
  Homolog annotation: Query=48..238bp; Hit=4..194bp; Blast score=286; Percent Identity=76.0; E value=2e-77; Homolog= Z3552 COG1896
MPHISPTFSFSTDSNCLSQLILAPNGFTSTLAPSTINHIVPQQEKIMSHFFAQLSRLKLINRWPLMRNVRTENVSEHSLQVAFVAHALAVIKNRKFNGSINAERIALLAMYHDASEVITGDLPTPIKYYNPQIAHEYKKIEKIAQHKLLAMLPSELQDDFRSILDDKLHTDEETAIVKQADALCAYLKCLEELSAGNAEFNQAKSRLEKTLAERHSEEMDYFLTVFVPSFSLSLDEISL

SEQ ID NO: 9530 - protein, 609 aa, Xenorhabdus bovienii
  Coding DNA sequence: Name=SeqID_3422
  Gene classification: Gene name=CitT; Function=Di- and tricarboxylate transporters; Function class=P Inorganic ion transport and metabolism
  Homolog annotation: Query=1..609bp; Hit=1..610bp; Blast score=783; Percent Identity=72.0; E value=0; Homolog= ZyfbS COG0471
LNSELLWVLTLLLVAIVLFTTNKVRMDVVALLVIIAFVLSGTLSLNEATIGFSDPNVLLIAALFVIGEGLVRTGVAYQMGDWLVRVAGRSETKMLALLMLSVAGLGAFMSSTGVVAIFIPVVLSVAARMKTSPGRLMMPLGFAGLISGMMTLVATPPNMVVNSELVREGLRGFDFFSITPIGILVLLAGIVYMLVTRRWLGGKTPQKLDERYHRTFRDLIRDYKLAGRARRLAVREDSPLIGRALDELNLRAHYGANVIGIERWRKFRRVMVAATGETELHQQDVLLVDMSDSDVDLREFCSEQRLEPMILRGEYFSEQSRDVGMAEVSVIPESELLGKSLRDMKFRTRYGLNVVGIRRSGKAIVDKLVDEPVHLGDTLLVIGDWKLIRALKTKTPDFIVLNLPVEVESAAPAASQAPHALFCLALMVAMMLTNEIPNFVAALIACLLMGKFRCIDMESAYRAIHWPSIILIVGMMPFALALQKTGGIDLIVKGLMDIAGNMGPRVMLLCLFVLCALIGLFISNTATAVLMAPIAIAAAKQMSVSSLPFAMIIGVAASAAFMTPVSSPVNTLILGPGGYRFADFLKLGVPFTLIVMGISVAMIPILFPF

SEQ ID NO: 9531 - protein, 224 aa, Xenorhabdus bovienii
  Coding DNA sequence: Name=SeqID_3423
  Gene classification: Function=Predicted phosphatase/phosphohexomutase; Function class=R General function prediction only
  Homolog annotation: Query=3..209bp; Hit=1..207bp; Blast score=223; Percent Identity=56.0; E value=1e-58; Homolog= ZyfbT COG0637
VVLKCRGFLFDLDGTLIDSLPVVERAWCQFADKMSIDRDEVLSFVHGTPAMISLRHFMPDASEEEINRTFKWIEKIESEDTEGVTALPGAVALIDKLNALDIPWAIVTSCTVPLASVRHKVAELPEPAHWVTAESVKNGKPNPEPYLLGASMLGLPPEECVVFEDAAAGIHAGLDAGCQVVVVHNSPGIPRRDELHLVLNNLEDIEISKSGGYVTIYASNEENC

SEQ ID NO: 9532 - protein, 164 aa, Xenorhabdus bovienii
  Coding DNA sequence: Name=SeqID_3424
  Gene classification: Function=Uncharacterized ACR; Function class=S Function unknown
  Homolog annotation: Query=1..164bp; Hit=7..170bp; Blast score=256; Percent Identity=76.0; E value=5e-69; Homolog= yfbU COG3013
MEMTHTQRLILSNQYKIMSMLEPEHTERYRRYQTVIERGFGLQLRELDRDFGELSEETCRLIVNIMEMYHALHVSWSNLKDKQELDERRMVFLGFDAATEPHYLAYVRFMVNTEGRYTHFDSGSHGFNSQTPMWDKYQRMLALWLSCPRQYHLSTVEICQIINA

SEQ ID NO: 9533 - protein, 152 aa, Xenorhabdus bovienii
  Coding DNA sequence: Name=SeqID_3425
  Gene classification: Function=Uncharacterized BCR; Function class=S Function unknown
  Homolog annotation: Query=2..152bp; Hit=1..151bp; Blast score=184; Percent Identity=62.0; E value=2e-47; Homolog= yfbV COG3092
MMNTTPPVNQGWFKRVQLGQQYLKTWPLEKQLAPVFPENRIIRATRFGIRFMPPLAIFILTWQIALGGQLEPSVATALFACSLPLQGLWWLGKRAATPLPEGLLKWFYEIREKFAEAGIAMMPVESTPTYFSLAELLKRAFKQLDNAFLDDI

SEQ ID NO: 9534 - protein, 400 aa, Xenorhabdus bovienii
  Coding DNA sequence: Name=SeqID_3426
  Gene classification: Gene name=ackA; Function=Acetate kinase; Function class=C Energy production and conversion
  Homolog annotation: Query=1..400bp; Hit=1..400bp; Blast score=699; Percent Identity=84.0; E value=0; Homolog= ackA COG0282
MSSKLVLVLNCGSSSLKFAIINPANGEEYLSGLAECFTLPEARIKWKMDGAKNEAALGAGAAHSEALNFIVNTILSEKPELSAQISAIGHRIVHGGEKFTSSVVITDEVIQGIEAAIPFAPLHNPAHLIGIAEAKKGFPHLVEKNIAVFDTAFHQTMPEEAYLYALPYNLYKEHGIRRYGAHGTSHFYVTREAAKMLNKPVEELNVITCHLGNGGSVSAIVNGQCVDTSMGLTPLEGLVMGTRSGDIDPAIVFHLHDAMGMSVDQINTLLTKESGFLGLTEVTSDCRYVEDNYETKTDAKRAMDVYCHRLAKYIGAYSALMEGRLDAIIFTGGIGENSSLVRELAVKKVALLGFEYDHERNIAARFGKSGVITTDNSRPALVIPTNEELVIAQDAARLTA

SEQ ID NO: 9535 - protein, 42 aa, Xenorhabdus bovienii
  Coding DNA sequence: Name=SeqID_3427
MISRTASNAGGSLFMNALINISLISIALTHFSSIHIALSHVD

SEQ ID NO: 9536 - protein, 709 aa, Xenorhabdus bovienii
  Coding DNA sequence: Name=SeqID_3428
  Gene classification: Gene name=Pta; Function=BioD-like N-terminal domain of phosphotransacetylase; Function class=R General function prediction only
  Homolog annotation: Query=1..384bp; Hit=6..391bp; Blast score=589; Percent Identity=77.0; E value=1e-168; Homolog= Zpta_1 COG0857
MLIPTGTSVGLTSVSLGVIRSMERKGVRLSVFKPIAQPRHSGSQDQTTSIIRSHSSMHAAEPLDMAHVESLLTTNQKDVLMEEIVARYHANTKDAEVVLIEGLVPTRKHPFAQSLNYEIAKTLNAEIVFVTALGTHSPEQLKEQIELSRAEYGGIKNQNIIGVIVNKLNAPVDDQGRTRPDLSEIFDEASKATVAYIDPKTVFKNSPLPILGCIPWSFDLIATRAIDMAKHLKADIINEGAIQSRRIKSVTFCARSIPNMLEYFRPGSLLVTSADRPDVLITACLAAMNGVDVGAVLLTGGYAIDDSIRELCERAFSTGLPVFTVKTNTWQTSLNLQSFSLEVPADDHERIEKLQDYVAQHISSEWIDSLAATSERPNRLSPPAFRYQLTELARQAGKRIVLPEGDEPRTVKAAAICAERGIAECILLGDPEEIRRVAAAQGVELGAGVELVNPAAVRERYVPRLVELRKSKGMTEVVAREQLEDNVVLGTLMLEQGEVDGLVSGAVHTTANTIRPPLQLIKTAPNSSLVSSVFFMLLPEQVLVYGDCAINPDPTAEQLSEIAIQSADSAKAFGIDPRVAMISYSTGNSGAGSDVEKVREATRLAQEKRPDLIIDGPLQYDAAIMADVAKSKAPNSPVAGQATVFIFPDLNTGNTTYKAVQRSADLVSIGPMLQGMRKPVNDLSRGALVDDIVYTVALTAIQAAQQENA

SEQ ID NO: 9537 - protein, 55 aa, Xenorhabdus bovienii
  Coding DNA sequence: Name=SeqID_3429
MVFIKRLIEYLIDYYYKKITPAKKNGVILPVSVISSCFSQPDKTTQEIENYAFSC

SEQ ID NO: 9538 - protein, 474 aa, Xenorhabdus bovienii
  Coding DNA sequence: Name=SeqID_3430
  Gene classification: Gene name=AnsP; Function=Gamma-aminobutyrate permease and related permeases; Function class=E Amino acid transport and metabolism
  Homolog annotation: Query=10..457bp; Hit=11..457bp; Blast score=456; Percent Identity=56.0; E value=1e-128; Homolog= cycA COG1113
MTRTAKTPVEQSAGAQKLHRGLGKRHVQLIAIGGAIGTGLFMGTGKTIAVSGTSIILTYLMIGFFAFMVMRAMGELLLTKLDYRTFADFVADYLGEKASYFLGWTYWMSWVVSCIADVVVCGGYIQYWFPDVSLWFTALSLLGLICLCNFCSVRLFGETEFWFAMIKVVAIVALIIVGVGMVFVGWTSPNGVTASVRHLTDPEVFLPNGMFGFLAGFQIAIFSFTGIELVGTVTAETKEPEKVLPKAINTIPIRIIIFYVLSIMCIIAVTSWQNISPEVSPFVTLFALAGLPAAAAVINFVALTSAMSSANSGLYACTRMLYGLSTEKLAHGKFAQLSVSSAVPIFSLIFSVICMASGVFLLFIVPNVMKLFTIVSTVAAIMVIYSWAMILIAYLAYRKKRPDLHKISIYKMPMGIPMTWCTLIFFAFTVVIMVFDYDTRVALYGTPIWFVILEVLWRMRKSRKQHATEERVVN

SEQ ID NO: 9539 - protein, 324 aa, Xenorhabdus bovienii
  Coding DNA sequence: Name=SeqID_3431
  Gene classification: Function=Succinylglutamate desuccinylase; Function class=E Amino acid transport and metabolism
  Homolog annotation: Query=26..324bp; Hit=28..322bp; Blast score=257; Percent Identity=44.0; E value=1e-68; Homolog= ZydjS COG2988
MDLLNLLFEKKLEDALHFPPTLKASWLAEGVLQLLPQESKADTLILSVGIHGNETAPVEILIQLVSQLAQGNLPLQHNLLLIFGNVPAMRENKRYIDNDLNRMFGGRHQNFPLGNESKRAMELEAVVHQFFREPAVRASTRRWHLDLHTAIRGSCHEQFALLPFQAREYASDFLQWLEGSDIDALVFHNAAGGTFSHFTSEHFNVESCTMEVGKARPFGQNDLSRFNNITLALRDVVAGSFLIKREKPTMKRYRVIDAIIKQEDSFRLHIPEDTKNFTALPDGFEIASQPNQFWKIASPANFILFPNAHVAIGQRAGLLLVQLT

SEQ ID NO: 9540 - protein, 447 aa, Xenorhabdus bovienii
  Coding DNA sequence: Name=SeqID_3432
  Gene classification: Function=Succinylarginine dihydrolase; Function class=E Amino acid transport and metabolism
  Homolog annotation: Query=1..446bp; Hit=1..446bp; Blast score=537; Percent Identity=60.0; E value=1e-153; Homolog= PA0899 COG3724
MSGIEANFDGLVGMTHHYAGLSMGNEASMTHRGQQSNPRKAALQGLMKMKSLSDMGLVQGVLPPQQRPNLPALRQLGFTGSDEQVLSKVARYSPLLLSNLSSASSMWTANAATVSPSADSADQRVHFTVANLNNKLHRSLESTVTARVLEAVFPDQACFVHHDPLPQHGDWGDEGAANHNRFCGEYGEAGVQLFVYGRSVLQEGAAPKRYPVRQTLEASQAVARLHQLEAAQTVFAQQNPVAIDRGVFHNDVIAVSNRNVFFHHQQALVNQQSVLAELEEKMARLGQKLIAVEVPSSQVTLQDAVESYLFNSQLLSQPNGDMMLILPEECRQNANVWAYLQALVAGADSPIKKLHFFDLRESMRNGGGPACLRLRVVLKEQELAAVNQAVLMTPELYQRLTSWVERYYRDSLYTADLVDPQLLNEVYFALDELTQILKLGSIYEFQR

SEQ ID NO: 9541 - protein, 492 aa, Xenorhabdus bovienii
  Coding DNA sequence: Name=SeqID_3433
  Gene classification: Gene name=PutA; Function=NAD-dependent aldehyde dehydrogenases; Function class=C Energy production and conversion
  Homolog annotation: Query=7..489bp; Hit=4..486bp; Blast score=597; Percent Identity=59.0; E value=1e-170; Homolog= astD COG1012
MNHQANYIGSGWVAGQGEPVIKYSPLDQRILWQANSASASQVNDACQSARRAFPEWAKLTAEKRIAIIQAFADLLTQEKEAIARVISEETSKPLWETRTEVQSMIGKVAISIEAWQQRTGYSETPMPDGKAILQHRPHGVMAVFGPYNFPGHLPNGHIVPALIAGNTLVFKPSELTPMTAEKTVQLWIKAGLPAGVLNLVQGGRETGGALLDSREIDGVLFTGSAVTGFHFHRVLAGQPEKMLALEMGGNNALIVDDYDDLEAAVYTIIQSAFISAGQRCTCARRLLVKRGEKGNALIQRLLDTAGQIIPSRWDADPQPFIGGVISLPAVENLLDAQSRLQALGGVSLLTMTQPDPDSTFMTPGIIDLTDAKEVPDEEYFGPLLTLKRYDTFEEAISITNDTRFGLATGLISPDAALFEHLLQEARAGIVNWNKPLTGASSAAPFGGIGASGNHRPSAYYAADYCAWPMASLTADKLVLPDAPAPGLDFFRS

SEQ ID NO: 9542 - protein, 348 aa, Xenorhabdus bovienii
  Coding DNA sequence: Name=SeqID_3434
  Gene classification: Gene name=AstA; Function=Arginine/ornithine N -succinyltransferase beta subunit; Function class=E Amino acid transport and metabolism
  Homolog annotation: Query=1..344bp; Hit=1..340bp; Blast score=333; Percent Identity=48.0; E value=2e-91; Homolog= astA COG3138
MMLFRSVQHQDLGDILDLSSRAGVGLTSLPHNQEYLTARISRSIDSFNDVNGRAQQGFLFTLEDTEKHRVVGVSALEVAVGLEEAFYNFRLQRSVRASRELGVYNTFETLMVGQDYTGCSELCTLFLDPDYQGGGNGVFLSRSRFLFISAFRHLFPKSIFAEMRGVVDLQGESPFWNALGQHFFNIPFAQADYLTGIGIRTFIAELMPFHPIYVPLLPEDAQKAIGQVHENTVPARAILEKEGFFYNDGVDIFDAGAILQAEIDNVRSIKASRLAYVKKSEKVSRQSDGVPCIVSNVHFQDFKALLLNIPDPFSHDELQLTPAEMEVLHVDEGDAVRFISLFSEGSSQ

SEQ ID NO: 9543 - protein, 403 aa, Xenorhabdus bovienii
  Coding DNA sequence: Name=SeqID_3435
  Gene classification: Gene name=ArgD; Function=PLP-dependent aminotransferases; Function class=E Amino acid transport and metabolism
  Homolog annotation: Query=1..401bp; Hit=1..401bp; Blast score=535; Percent Identity=62.0; E value=1e-152; Homolog= cstC COG0160
MSNTIQRSWFDQYMVPCFSPAQFIPVRAKGSRVWDQEGKEYVDFAGGIAVNSLGHANDELKKVLTSQIESMWHVGNGYTNEPVLKLAKILVENTFADKVFFCNSGAEANEAALKIARKYALDKYGSHKNEIISFENSFHGRTLFTVTVGGQPKYSQDFAPLPQQISHLPYNDIDAIKAHISENTCAVIVEPIIGEGGVIPADPAFLKALRELCDQHQALLIFDEIQTGVGRTGYFYAYEETGVEPDILTSAKGLGGGFPIGAMLVKQPIAEVFQPGSHGTTFGGNPLAAAVANQVVALVNQPEFLAGVQERHHEFIKRMSDLNQRYHVFSELRGKGLLLGAELEKKYQGKAKTLSNIAAEEGLIALIAGPNVLRFAPALNIEEQDINDGFARLENALKRFVQE

SEQ ID NO: 9544 - protein, 53 aa, Xenorhabdus bovienii
  Coding DNA sequence: Name=SeqID_3436
MNIFFHPLRLQAGCIISLRFNKVNTMRLQIIYFMMFFTIYKSGFIYNLCIVYA

SEQ ID NO: 9545 - protein, 90 aa, Xenorhabdus bovienii
  Coding DNA sequence: Name=SeqID_3437
MEDRIYNLLEITLILKSIRYKSHPIRAILLGILNFGCVQIKAIAFERTSMRFERRYAANPTHVLILDYLRVRSDFCGQSVYNITFTGIDS

SEQ ID NO: 9546 - protein, 36 aa, Xenorhabdus bovienii
  Coding DNA sequence: Name=SeqID_3438
MFSLVDILTSKDIHSLFEIFIVFIFSKIYFTLLYLF

SEQ ID NO: 9547 - protein, 48 aa, Xenorhabdus bovienii
  Coding DNA sequence: Name=SeqID_3439
VIVPIRQCPSRLNKLKYVNLAQYRDVRCKKTSKTLCRALTGNWQPEHC

SEQ ID NO: 9548 - protein, 63 aa, Xenorhabdus bovienii
  Coding DNA sequence: Name=SeqID_3440
LPFLLSQLRQVLVVYFNYRCYNLPIHLPTEKKRRLIMMLSDVIEYSHFFGNRQHSGLSTNALR

SEQ ID NO: 9549 - protein, 583 aa, Xenorhabdus bovienii
  Coding DNA sequence: Name=SeqID_3441
  Gene classification: Gene name=Uup; Function=ATPase components of ABC transporters with duplicated ATPase domains; Function class=R General function prediction only
  Homolog annotation: Query=4..496bp; Hit=77..595bp; Blast score=226; Percent Identity=33.0; E value=5e-59; Homolog= DR1635 COG0488
MSTLLSTQNLSFHHGHTPLLADISIAINKGEKIGLIGYNGCGKSTLLKLLSAQLSPNEGTVTLANHCILAYIEQHLPATLHSMTLIEAVLDKLPAEQRIEDNWRAEILLSEMGFQPEQHNLAISALSGGQHTRLLLARALIINPDLLLLDEPSNHLDLPTILWLEQFLTQWCGSFILVSHDNTLLDHLTNCTWILRDGNVSLYRLPCSQAREAQTAQDLSDEHRHNAQQKEIDRIAHSAKRLAIWGKVYDNEALSRKAKQMEKHVDRLQGCQVELAVSSQWRLKLTGDALRADRLCAFNQLTVSPAPSCPPLYVTDNLSVKSGDRIAIMGANGTGKSSLLRMILAQSQSQALTLPDSPLVLHPRVNLGYYDQKLAQLSDSDTLSDALKPFAALIDKQRKMALISAGFPYLRHQQTVASLSGGERARLLFIGLSLAKYSLLMLDEPTNHLDMDGKNTLRDEIRLFAGGLLLVSHDRELIEQSCNRYWYIDGQRLTEYHDLDAVYQKIRHANSNTQTDSASVSTFSLVPSSEMFSDDDEMKLAELISLEEKLATDLQRKAAHQKPILQQQWREKIAQLRQQLSLD

SEQ ID NO: 9550 - protein, 365 aa, Xenorhabdus bovienii
  Coding DNA sequence: Name=SeqID_3442
  Gene classification: Function=ABC-type multidrug transport system, permease component; Function class=R General function prediction only
  Homolog annotation: Query=168..362bp; Hit=185..379bp; Blast score=71; Percent Identity=25.0; E value=2e-12; Homolog= MTH1486 COG0842
MNSALINLMNTQFRQYIREPEILFWSFGFPLLLVWLLGVSFSSQDIPERKIGIVLPVEAVQQQQMKQWGEQLTAQEHMISGIINKEEIKRERLVKVRYNITYYPDHEAVVRGLKRGDIQMFIEQDKEKKRVHYLDPQSSDALLTYYLLNQQEGIESEKNLFILETPGLRYVDFLVPGLLAMAIMETCLIAVGWALAEKRITRVTRQMCITPMRKSTFLLAHILSCLLISITEILIIYLFADLYFDVEIQGSFYAFLLLMLTGNICFSGVAVLVASRARKAQTANGLLEVSILIQILLSGIFFSYKNFPQWMANIIEYLPLTILADNMRKVFIEGGDLLQVVPAAIILSLIGIVTFVLGMKIFRWY

SEQ ID NO: 9551 - protein, 314 aa, Xenorhabdus bovienii
  Coding DNA sequence: Name=SeqID_3443
  Gene classification: Gene name=CcmA; Function=ABC-type multidrug transport system, ATPase component; Function class=Q Secondary metabolites biosynthesis, transport and catabolism
  Homolog annotation: Query=8..314bp; Hit=13..301bp; Blast score=197; Percent Identity=39.0; E value=2e-50; Homolog= TM0389 COG1131
MGIQHNEKVIEFEQVKKHYKDYQALKGISLDVYRGEFLGLLGPNGAGKTTLVEILEGLKTPDSGSVRVLGKTWQQDAPYLRQHLSGVLQQTLFIDKLSVEETLNLFGSFYGCSRKRAQEVMELVELEEKRKTYVEGLSGGQRQRLALGVAIINEPEILILDEPTTGLDPRIRHDTWDILRKLNREKHSTMILTTHYMEEAEYLCDRICIMNKGEIITQGSIDELLKKHCDGDLIEFRTHFPDRLQALSQHAQVLNYEYDERKDKICMLIEDSTSFVAHLFEFAKQVEADIIELMVRKKTLDDLFMTLAGRRLHE

SEQ ID NO: 9552 - protein, 249 aa, Xenorhabdus bovienii
  Coding DNA sequence: Name=SeqID_3444
  Gene classification: Gene name=EntF; Function=Non-ribosomal peptide synthetase modules and related proteins; Function class=Q Secondary metabolites biosynthesis, transport and catabolism
  Homolog annotation: Query=23..243bp; Hit=495..697bp; Blast score=97; Percent Identity=33.0; E value=2e-20; Homolog= PA2399_1 COG1020
MKFAGGRMHMQKHTFQPKAPLEQKQLRLTQTLHQAFEQKVQRYPQAIVLNTENGLGLTYEQLNQRANQLAHYILQIKQQMGETDAFSPVIGICLEHDEEMLVSILAILKAGLAYLPINSTHGAERIGFYIEDAGIELVIGVLQYQSLFDESKVDYLCIDSEKAFIQTMPLHNPDVSIHSDPLACIVYISKTAGVSKGVEISHTSAMRLSAMRLLRAEKYHLDLTKNNSTENDIWTLLDASTFEVHTMGK

SEQ ID NO: 9553 - protein, 73 aa, Xenorhabdus bovienii
  Coding DNA sequence: Name=SeqID_3445
MQCLSQSQLFLLQGGFGLKCMFLHMHTTSGKFHCYTFHLSSCGFVGCNLKSIRYGVSLIQHQDDVPKQYDHDG

SEQ ID NO: 9554 - protein, 307 aa, Xenorhabdus bovienii
  Coding DNA sequence: Name=SeqID_3446
  Gene classification: Function=Predicted amidohydrolase; Function class=R General function prediction only
  Homolog annotation: Query=46..298bp; Hit=4..255bp; Blast score=238; Percent Identity=47.0; E value=9e-63; Homolog= ZyafV COG0388
MRIYDAVWLHLDPDLFQGLFIKQSNNRQVMTEIWVKSELSMIEQNLKVTLVQTDLVWENAEQNREHIERHIAQITGSDLIILPEMFTTGFSMKPQAIAETMTGPSIQWMKAMAAKKDCAIVGSMIITENQRFYNRLLWVNPDGSVAHYDKKHLFTFAQEDHEYTAGNAPLVVNFKGWKIAAFICYDLRFPVWSRNVNGHYDAAIYIASWPARRSAHWCSLLQARAIENQSYVIGVNRVGQDGNQLDYDGHTMLIDPLGEVLLHEMNHEVVKTVQLSLSHVQGVRERFPFLKDADPFVLNNDVLGSDA

SEQ ID NO: 9555 - protein, 410 aa, Xenorhabdus bovienii
  Coding DNA sequence: Name=SeqID_3447
  Gene classification: Function=Putative dehydrogenase domain of multifunctional non-ribosomal peptide synthetases and related enzymes synthetases; Function class=Q Secondary metabolites biosynthesis, transport and catabolism
  Homolog annotation: Query=12..370bp; Hit=11..371bp; Blast score=114; Percent Identity=30.0; E value=2e-25; Homolog= PA4078_2 COG3320
MFDHNKKDVSSILLTGATGVMGGRILLEILTTTDIEVYCLIRAENNQQAIERLKGILFAYDQEKQSENTHHRIIPVLGDVSKKRLGLTQELYCELADKVDRVIHCAANVSLVASYKKIAPVNVQGTQHVIDFCLQGNVAMLYASSFSMAGDCLYKDGFVLHETDLDVGQRFDDMDYERSKFESEKIIHSAGKKGLKWVIVRPGNIWGESTNGRYPLAHTKVKGIYYEMVKALVETGLTFNAQDDFDITPVDYVAEASLYAIFNIEKFNGKTLNLTNPNPITFNDIVSFLRDFGYRIDTINMNDYMEALAQNRLYRYGQPYRSVFTDLLGLFYSGMELTEKAKYATQLTTELLSGSGIQCPLSDRTLLFHYFNYLIECEFIAPPQQQGERAEIREASVRGSYLEQLFDADL

SEQ ID NO: 9556 - protein, 255 aa, Xenorhabdus bovienii
  Coding DNA sequence: Name=SeqID_3448
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=4..250bp; Hit=6..244bp; Blast score=159; Percent Identity=39.0; E value=2e-39; Homolog= TM1724 COG1028
MSRQIAVVTGAAGGFGTAISKVLLDIGYLVAATDVSSQKLALLKERLGHPESLATFEMDVTDLASVERAAQQIVETFGDTITVLVNNAGIINRAFCLSGQGFSETTKVINVNLIGAFNSTSIFVRYMARLKYGRIINIASVAGIWGAAGSSAYGASKAGLISATESWGRELGPLNISVTAVAPGVCKTDMLEQFVESGPMESAGEDKVVRSIVPVGRWGTPDDVAEVVGFLASCKTNYLNSAVIPLDGGMRVGTL

SEQ ID NO: 9557 - protein, 1026 aa, Xenorhabdus bovienii
  Coding DNA sequence: Name=SeqID_3449
  Gene classification: Gene name=HemL; Function=Glutamate-1 -semialdehyde aminotransferase; Function class=H Coenzyme metabolism
  Homolog annotation: Query=581..938bp; Hit=22..375bp; Blast score=210; Percent Identity=34.0; E value=6e-54; Homolog= MJ0603 COG0001
MSQRLSVNKSSHQLTALPLTIGISHLQALATELRVVKVGESISLLLPDDTIAEQTTLLGRLPAVTAGSLGDAGFMADYGVNYAYYAGAMANGIHSEEMVIALGKQRILGIFGSGGLRIPRIAEAISRIRQTLPEGPFGVNLLHNPGNPEWEMACVRLCMENQVRVIEASAYINLSSALVYYRVSGLVQQPDGTILRHHRLIAKVSRREVAQNFLRPAPEKILQKLLVEELITPEQAELARQIPMADDITVEGDSGGHTDQGVLACIFRSVVQLRDEIADETQHDYQVRIGAAGGLGTPHAILSAFALGAAYVVTGSINQACVEAGTSRAVKKMLGQAQINDVATAPSADMFELGAKVQVLKQGSMYAVRAQKLYNLYKQHDSLDTLPVQEIALLEKQIFHKPLTEIWQETIAYFQSINQLDIITKAEKQPKTKMALVFQWYLGQSSRWAITGDPVRNLDYQIWCGAAMGAMNEWLQGTPFEAVENRHVSEIAQLLMKGAAYLTRITLLELFNIAVPEQIKRHLPLHFYTGGENSPPNEFSHEQSNDDLADHSQVDDRHLNLMSIQKSQVRSKEPMDASTKLVLDNSKDFYKKCWELMPGGTHYNFGDPERPLVIPFNRGRNSRVWDLDGNEHLDLFCKFGALLVGHHNEAYNQSLIEYMGKVTSVDTCDLEVGVCETLVKHIPCAEMVRFCLSGTEAVQNALRLARAFTGKNRFIRFHGHYHGNADNIMGWRKKQDLTYPVPEQFNGDLLDTLGRDPKIMVDQTFMLPWNDIDVLTATIERYHNEIGAVLMEPLCINGGGIFPEEGYLEKTKALCEKHNIVLIFDEIITGVRLGLGGAQKLLGVTPHLATFGKALGGGSMPISAIVGRSDIMNLYTRGKVIHAGTFNGYPLGLAAIQTTFDLIERDPGCYDRMGNIMRQISDVFVKAAKAVDLPLVVQGMPTALVYHSQSTPVSSTEGYSDKVKFCDIIIREISKRYGIQFSPLSRMYSNLLMSQDDVRFFEERIFDAMVNARKVIDIAFKEGIDA

SEQ ID NO: 9558 - protein, 1454 aa, Xenorhabdus bovienii
  Coding DNA sequence: Name=SeqID_3450
  Gene classification: Function=Polyketide synthase modules and related proteins; Function class=Q Secondary metabolites biosynthesis, transport and catabolism
  Homolog annotation: Query=2..450bp; Hit=35..468bp; Blast score=177; Percent Identity=29.0; E value=7e-44; Homolog= ML2355 COG3321
MENIAIIGMGCLFPGADTLEKYWDNLLREKDCTTPLSALELGVDLDCYYSPVAGKPDTINYVKNGHVRDFHFDGKGYHLPEEELNSLDNLFKWTIYSAEQALNDSGYRQNKKVLEKTGLILGNIGMPTHSTKRLMSPFYQKILQPYIQKLIGRPDFHFDSVWPPANYSGQNLITGGHNATIAALALGLSGPRYCLDAACASALYAIKLGIDYLFSHKVDMMLVGAICHTDHIYIDHGFNMLQVFPAKGESIPFDRSSKGVKAGEGSGIVAIKRYSDAIRDNDKIYGVIESIGLSNDAGAKHLLVPDIQGQRIALERAYRDNPQHVDYVECHATGTTIGDQVELSTIESFFGERGTIPLIGANKAINGHMLTASGMGGLLKVLLAMQHNMIPATPRVEQLVLTQKGLLNIDHVVREAKPWPVSNRPKRAGINAFGFGGVNAHMVIGEDTPERRAACTQVKLENRQKIERLSIVGIGVHMAKTEDGKTLDQTLQQGIQHFYPLPKTRWIGMEKRHDVLAMQGISQPPLGSYIETFEFDCKHFKLPPNVVGAHLSCHMFLLPIAERAFIDAGYTLDGSKRNIAVIVAGGVDYSSLRYQARNEISWQLSQSLASRGIHLSEEDTVALQEIVKDGLFPKPYPEGITGGIGNIVASRLAAHLKLNGPAFTLYGEENSPFKALELAQFMLSRQHVDAVMIASSSFGGSLENVLWDHQSNHGNQIVGDAGGVIILKREQDAIRDNTPAYAVLDGLSITYMPDHSIDFRGNEDAILAAARSGLEAAGCTADQIDYIELYAGGKPGEIAAEMSALGRVYASQNRQLTATIGTVKANYGHLFMTTGLLGIIKSALQLTQRYLPALPDYPQHQELAHYAEGKFQLPAHTQSWPAPAKGPRRAAISHLGIDRAYSHVILSEPQSGKRARPTSRPESNQAGLKVLSYTAREKTVEELILNEQTLARFASLAAAAHVNMAVTPADAETKVVSPEVSTLNMSLPMELNHFIRNAHTQLHYLQLEQTYYQLLKQHLAELPLIQSKTTESALVAPTKKRVTTSPAVFDEQQVLELTDGSVEKVLGADYAEVDSYQIRTRMPSPPFMFVSRITALSAVKGKLEPCYIEWEYDVPEDAWYAVNGRVPSFVALESSHAMIVAFTVIGCDLMFKGQRCYRAVDCNTTIYSEMPKTGDVLRGRVNITSVVRVGGLTLVAYEYLCYVEERLVFRLVANSGFFGRKEIENAGNFDTSAYFAKGKNSIPAKPFTPLLHCDRTTFNERDITNVMNGDLAACFGSQYQYNREGKLCVPDTRMLSRILSVDTVGGAFGLGQIVAELDIDPAHWAFKAHFKNDPVMPGTLLVEGSEQLMKFYLFYLGLNSQPDLEAHTLTEHTSGAKFRGEVKCERDVVQFRLTCKSVDAIYSDDKLESITLFFIAETLYRGNVVGVSDNMGVRYVRRKPHQIIAAELKQEALK

SEQ ID NO: 9559 - protein, 41 aa, Xenorhabdus bovienii
  Coding DNA sequence: Name=SeqID_3451
LIIYLSEYFRSGELCHIQESLLDGKYCDYWDGVLISRCRYP

SEQ ID NO: 9560 - protein, 2291 aa, Xenorhabdus bovienii
  Coding DNA sequence: Name=SeqID_3452
  Gene classification: Function=Polyketide synthase modules and related proteins; Function class=Q Secondary metabolites biosynthesis, transport and catabolism
  Homolog annotation: Query=22..938bp; Hit=36..881bp; Blast score=328; Percent Identity=28.0; E value=4e-89; Homolog= ML0135 COG3321
MLITGVFYSIHEECMSETYFLHDRKVRGDIAIVGMASHFPDAPNLYKFWENIIGKKDSLTDISTMLGDEYWQKEDFYDPNPAVADKTYGHSAGFVPPIDFDPVEFKIPPAIIDSISTAQLFALYVAKQAMLDAGLVGQENSRVDRDRIGVILGGAGNGNTSFSLASRQQSPYLRKIMVKSGLSEKVANDIIERMHGMYLEWTEDSFPGFLGNVACGRIASYFDLGGTSYMVDAACASSLAAIKAAIGELHSGSCDAVLTGGVNLENSIFSFLCFSKTPALSKSNLSRPFDQSADGMMLGDGVGMLVLKRLEDAELDGDRIYAVIKSIEASSDGRAKSIFAPRLEGQAKALRRAYASAGLSPNDIQLVEAHGTGTASGDDTELKSLHTVFGEYQVPAKSVAIGSIKSQIGHTRCAAGAASMMKVALALHHKVLPPTINVGKPTNLLKAENSPFYVNSEARPWLRSFSSAPRRAALSAFGFGGTNFHVILEEYEKHTHGRYRLNESPWIMLFKGHNPAELLAQCEETLIHFSGNLPDIAIRQHLEQQDIDSLQPQQARVLFVSQSAEQTVALLSIAIKQLQQNSAHGWEHPRGIYYQPQGKMLDGKIVALFPGQGSQYVNMARDVANDYPEMRQSLETLDDVSINELGHELSPVIYPVPTFSDDERQVQQQRLMDTANAQPALGAISAGYFNILKGMGFAPDFVAGHSYGEVTALWAAGVLSDKDFHRVSLARGWAAASASDHRGADTDAGVMLAASLNPAQRAQILERYTGIIIANDNSQQQVVFGGATSLIHQLHDELKKRDVHCRILPVSAAFHTAFIQPAYQPYRERLAGINFQSPQCRLFSSATAEPYGNSPQAIRELLAEQLIKPVQFRQTIEAIYQQGGRLFVEVGPKGVLGKLVADILKDKEHEVISVNPNDKGEDRLQFARAQAKLLAEGVKLREINQHIRPQPIAEDKSKRLTFRMSGGFYLSQKNKARRQRALRDGDSAIVEQFIAESAPVPMAPVMPLHSQKEVNIKEEHSGKEVKPTQEVHPTKEVVVEKVENKVEKIAENKTISAQFIQQNMLTIIQRRESTMEQNNQLSENVDVNMLNGLLQAQQVMSQLHQQFQANQKDYIQLLGMLLDKQYTLLETCKDHQNLPSMLSSLSQSVQLLDKNLELYHSNHEHYFMAQQSLFQSGQVAPMIAPTHRTSSPVVDYSALAKVTASATIEPAPVSTPAPIPTPIPTTAPAVKVDTAPVKGSKPVDTIKEIEPVRSMVPEMPVMPSVVEEPVKPIVNETPVSQPTPVVIETKAKILDPEVEKQFQLLSQITEEKIVNQLISIVSDRTGYPQDMITPEMDLEADLGIDSIKRLEIFGAMFDAFSANVGLYNEASRNKDLENFEVDSLSNISKMGVFFKQMLDDVMNGLLGNGGDEVVAEQSLPSVETREHANTKSNVVPDSGGATGKLQSLGFFTSTVTSPEVDSVKKPLAEPQLIVPSVVQPALKNEIVLNEEESFAGSPVSRFAVVKQPLPMPDRLQGVFSSPKRWLVVDEGTTTVDDVVNALRQQGQQVAVLMLEKNQAVMRDEAALDMALADIEQQHGTIEGVIYLQTPKQSVKALADVFNEQDYRSVETTFLLAKRLQGSLNHDEQKTGYFMVIMRGDGELLTSGREHLSIVSAGLTGLTKSLNIEWKNVFCRTVDIDARVKDSDAAKMVVEELQDSRTDMGEVGRGVNGERMTLALTEENVLSATSVNQVNASDVLVVTGGARGITAQCVIELAKQSQATFILLGRTDMTEPLPKWAEGKITQDERKTAAMAYLKAQGVQLTPVKINGMLSRLTHIDEINGTLQAIRQAGGRVMYLHCDITDPKQVKIVLTKAQQQLGQITGLIHGAGNLADKRIEKKTLADLHSVFNAKVKGLENLCRELDFTSLHHIMLFSSVSGFFGNAGQADYSLANETLNKFIYLPFKGKNSQIIRSVNWGPWDGGMVSDVLKRAYDAQNMAIIPLEEGTQRFVREFRDPGSLQITIGGANYKAEKTVKVLGIGEQVDRQLSLDKNPFLYHHVIEGKSVLPMTAAIAWMARICEDRFPGYQLETITHFKVLKGIVFDNALAESYCVAWVPSTFDESGDGRLALNVVITSKRMKHYQATLILSLQSREAKHEAVGIDLNAEVPQTLPFYGGVGGEGMLFHGESFHGVQKVVHVDDDHITLKCCVMPVQLEMQGQFSTRLFNLFINDIAFQLPAMWLLQRNEMCLPNAIEKIEQYAELKFGQEFYASIEIKNQISTEIITDIIFYDEQGYIYSRFHNAKFTVFVE

SEQ ID NO: 9561 - protein, 40 aa, Xenorhabdus bovienii
  Coding DNA sequence: Name=SeqID_3453
MIEPYISQSRLPKYSCKNITYIFLGYFFILFFLSTVFELL

SEQ ID NO: 9562 - protein, 174 aa, Xenorhabdus bovienii
  Coding DNA sequence: Name=SeqID_3454
MIVFNLKRGLTMINYANTIWHIIINTAIVGGIYFFLINIWRVTPSIGDYLILFLFVFCIRVFVEIIYDNIKAFSSKHLNQTLLNNVIALIEFKGSYRGFYQVWGLITLCVLAFHILLILPFYSLLSKIRFLSWFVSGFLFCLLSHNFFILVLNYYLVDFCYNLFSNVIISLIVF

SEQ ID NO: 9563 - protein, 70 aa, Xenorhabdus bovienii
  Coding DNA sequence: Name=SeqID_3455
MVRPLLRLNTIIKLFPCYNLNNGDHLICVIYHVTKLIMNIIWNIKFWRFSLTLYWYTFNLFFFQFFKKTT

SEQ ID NO: 9564 - protein, 176 aa, Xenorhabdus bovienii
  Coding DNA sequence: Name=SeqID_3456
  Gene classification: Gene name=MutT; Function=NTP pyrophosphohydrolases including oxidative damage repair enzymes; Function class=L DNA replication, recombination and repair
  Homolog annotation: Query=1..175bp; Hit=1..175bp; Blast score=258; Percent Identity=77.0; E value=3e-69; Homolog= yfcD COG0494
MVQEKSVGIEWIDIVNEGNEVIAQATRQQMRSQNLRHRATYIVVHDGMGKILVQHRTETKDFYPGRLDATAGGVVMVGENMLDSARREAEEELGIAGVPFAEHGIFYYEEKSCRTWGGLFSCVSHGPFALQEEEVSAVYWLSPEEITARCDEFTPDSLKALSLWLARNRQTELPEN

SEQ ID NO: 9565 - protein, 233 aa, Xenorhabdus bovienii
  Coding DNA sequence: Name=SeqID_3457
  Gene classification: Gene name=Gst; Function=Glutathione-S -transferases; Function class=O Posttranslational modification, protein turnover, chaperones
  Homolog annotation: Query=28..229bp; Hit=1..202bp; Blast score=278; Percent Identity=64.0; E value=4e-75; Homolog= ZyfcG COG0625
MAFYRQLKPVVMYWNYIYPSVIITRGYMIDLYYAPTPNGYKISLFLEEVGLPYTVHSINISTGEQFKPEFLAISPNNKIPAIVDHQPADGGEPISIFESGAILLYLANKTGQLLSKDVRERNQQLQWLFWQVAGFGPMLGQNHHFNHYASEVVPYAINRYMEESRRLVNVLNTQLEKTPYLGGNEYNIADIATYPWARCHEHQKINLNDYPAVEKWLEKIEQRPATQAAYNNG

SEQ ID NO: 9566 - protein, 304 aa, Xenorhabdus bovienii
  Coding DNA sequence: Name=SeqID_3458
  Gene classification: Function=Predicted nucleoside-diphosphate sugar epimerases (SulA family); Function class=R General function prediction only
  Homolog annotation: Query=1..298bp; Hit=1..297bp; Blast score=395; Percent Identity=61.0; E value=1e-110; Homolog= yfcH COG1090
MRILITGGTGLIGYRLTCQLLSLSHSITILSRSPQKVYSLFSEQVECWATLKNKNNLNDFDAVINLAGEPIADKRWTSAQKTKLCQSRWQLTEKLSHLINASEFPPSVFISGSSVGYYGNQGQAVVSENDLPHDEFAHQLCKQWETLALQAESEKTRVCLLRTGIVLANKGGALKKMLPLFRLGLGGKMGDGKQYMPWIHIDDMVNGIYYLLVSPELSGPFNMTAPYPVHNDLFSAALANVLHRPAFIRMPAFVLKIIMGEAAMLVLGGQQAIPKRLEEGGFGFRYFELEEAFKDLLKAEANSP

SEQ ID NO: 9567 - protein, 194 aa, Xenorhabdus bovienii
  Coding DNA sequence: Name=SeqID_3459
  Gene classification: Gene name=UbiX; Function=3-polyprenyl-4 -hydroxybenzoate decarboxylase; Function class=H Coenzyme metabolism
  Homolog annotation: Query=1..189bp; Hit=1..189bp; Blast score=304; Percent Identity=84.0; E value=3e-83; Homolog= ubiX COG0163
MKRLIVGLTGASGAIYGVRLLQVLQSVEGIETHLVISQSARQTLALETDYTLRDVQALADVVHDNRDIAASISSGSFKTLGMVILPCSIKTLSGIVHSYTDGLITRAADVVLKEGRKLVLSVRETPLHLGHLRLMTQAAEIGAVIMPPVPAFYHRPDHIQDIIDQTVNRVLDQFDIELPQDLFNRWQGAKQIEV

SEQ ID NO: 9568 - protein, 510 aa, Xenorhabdus bovienii
  Coding DNA sequence: Name=SeqID_3460
  Gene classification: Gene name=PurF; Function=Glutamine phosphoribosylpyrophosphate amidotransferase; Function class=F Nucleotide transport and metabolism
  Homolog annotation: Query=6..510bp; Hit=1..505bp; Blast score=851; Percent Identity=81.0; E value=0; Homolog= purF COG0034
MRKNYMCGIVGIVGFTPVNQSIYDALTVLQHRGQDAAGIATIDGNNEFRLRKANGLVKDVFETRHMLRLQGTTGIGHVRYPTAGSSSASEAQPFYVNSPFGITLAHNGNLTNAHKLKKMLFEHARRHVNTTSDSEILLNIFADELTQFPDFPLEPDDIFAAVAAMHKKIRGAYACVALIIGHGLVAFRDPNGIRPLVLGKRTLEDGRNEYMVASESVALDTLGFEFLRDVASGEAIYITEKGQLFTRQCAENPALTPCLFEFVYFARPDSFIDKISVYNARLRMGRKLGEKIAREWEDLHIDVVIPVPETSCDTALEIAHILDKPYRQGFVKNRYVGRTFIMPGQQERRKSVRRKLNANRAEFRGKNVLLVDDSIVRGTTSEQIVELAREAGAKKVYFASAAPEVRFPNVYGIDMSNANELIAHGREVDEIRQLIGADALIYQDLSDLINAVREENPDIEKFECSVFDGIYVTKDIDQIYLDYLENLRKDDAMKLRGQSEIEDLEIYNEG

SEQ ID NO: 9569 - protein, 168 aa, Xenorhabdus bovienii
  Coding DNA sequence: Name=SeqID_3461
  Gene classification: Gene name=CvpA; Function=Uncharacterized membrane protein, required for colicin V production; Function class =R General function prediction only
  Homolog annotation: Query=1..160bp; Hit=1..160bp; Blast score=233; Percent Identity=83.0; E value=7e-62; Homolog= ZcvpA COG1286
MVWIDYTIIAIIGFSALVSLIRGFVREALSLVTWGCAFFVASHFYTYLAVYFTRLEDELVRNGVAIAILFIATLIVGAVVNYVIGSLVQRTGLSGTDRVLGICFGALRGVLIVSAILFIADSFTPLPKSEDWQQSQLIPQFSQIIRWFFDYLQNSSSFLPEKLPSPLG

SEQ ID NO: 9570 - protein, 70 aa, Xenorhabdus bovienii
  Coding DNA sequence: Name=SeqID_3462
LRSRFLTLLKIIRSRFKNDNRRKGLTCNYHDGKQNTSRKTPIRSGTVVFDLPLQTRQFFQFRQIGFKGLP

SEQ ID NO: 9571 - protein, 233 aa, Xenorhabdus bovienii
  Coding DNA sequence: Name=SeqID_3463
  Gene classification: Gene name=DedD; Function=Uncharacterized BCR; Function class=S Function unknown
  Homolog annotation: Query=1..233bp; Hit=1..219bp; Blast score=156; Percent Identity=49.0; E value=1e-38; Homolog= ZdedD COG3147
VASKFQNRLVGTIVLVALGIIVLPVLFDGDKKHNESQFASIPLALKPGDEEDIDLIAPLTQDMPSTPPEGAAEAMAKQAQELQPDMLSSSLLSEPAPMAPPPVEITQAPKATVKSEPNPQPKVEVKRETRAETKPETNPEAKSESKSTPVKAPQGVAYVVQLGALKNAGKVDEIVAKLRLSGHQVYIIPSSPVQGALTRIYVGPNASRQALESNLPELKELTGLQGQIKNYSP

SEQ ID NO: 9572 - protein, 432 aa, Xenorhabdus bovienii
  Coding DNA sequence: Name=SeqID_3464
  Gene classification: Gene name=FolC; Function=Folylpolyglutamate synthase; Function class=H Coenzyme metabolism
  Homolog annotation: Query=4..432bp; Hit=3..422bp; Blast score=500; Percent Identity=59.0; E value=1e-141; Homolog= folC COG0285
MSDILQIPQATSSLMTWLSYLGNLHAKAIDMGLERVGALADQLDLLHPAPKVITVSGTNGKGTTCHTLESILLAAGLKVGVYSSPHLVRYTERVRIQGKEPTEQDFCRVFADIEAQRGDITLTYFEYGTLAALQLFKEADLDVVILEVGLGGRLDATNIVDSDVAAITSIALDHIDWLGADREHIGREKAGIFRQGRFAVVGEPDMPHTIAEVADELGSKLFRRGVDWDFSQDADSWYWRTGDQQFSELPVPNLPLANAATAMGVIYCLLQQDDNVSQAINERAIREGLSKAQLPGRFQIVRENPRVILDVAHNPHAAGYLVEKLAELPRAPDSKIRGVVGMLEDKDIVGTLACLAQQIDEWYCASLHEPRGAEATMLAEYLGDARTFVDVEQAWHQAMAEASAQDIIVVCGSFHTVAHVMEALAEVKEGGK

SEQ ID NO: 9573 - protein, 315 aa, Xenorhabdus bovienii
  Coding DNA sequence: Name=SeqID_3465
  Gene classification: Gene name=AccD; Function=Acetyl-CoA carboxylase beta subunit; Function class=I Lipid metabolism
  Homolog annotation: Query=1..285bp; Hit=1..283bp; Blast score=474; Percent Identity=82.0; E value=1e-134; Homolog= accD COG0777
MSWIEKILNKSKIMQTRKASIPEGVWTKCDSCGQVLYRAELERNLEVCPKCDHHMRISARERLHTFLDEGTGIELGSELEPKDLLKFRDTKKYKDRLVAAQKQTQEKDALIVMKGSLYKMPIVAGAFEFTFMGGSMGSVVGARFVRAVEQSLEDNCPFVCFTSSGGARMQEALMSLMQMAKTSAALAKMQDRGLPYICVLTNPTMGGVTASLGMLGDINIAEPKALIGFAGPRVIEQTVREKLPAGFQRSEFLLEKGAIDMIVRRPEMREKIANLLSMLTRQPHPAAKVETVAEMVAEPADVETDININTNKEDV

SEQ ID NO: 9574 - protein, 229 aa, Xenorhabdus bovienii
  Coding DNA sequence: Name=SeqID_3466
  Gene classification: Gene name=DedA; Function=Uncharacterized membrane-associated protein; Function class=S Function unknown
  Homolog annotation: Query=8..217bp; Hit=1..210bp; Blast score=313; Percent Identity=80.0; E value=7e-86; Homolog= dedA COG0586
MEFLTHFVDFTKFIVDFILHIDAHLKELVSDYGNWVYGILFLIIFCETGLVVTPFLPGDSLLFVAGALSALGSNDLNVHIMVALMITAAIIGDAVNYTIGRIFGEKLFTNPNSKIFRRSYLDKTHEFYEKHGGKAIILARFVPIVRTFAPFVAGMGKMSYRHFAAYNVIGAFIWVLLFTYAGYLFGDMPIIQQNLKLLIVVIIFISILPGIIEIWRHRRAASKKAVDGK

SEQ ID NO: 9575 - protein, 279 aa, Xenorhabdus bovienii
  Coding DNA sequence: Name=SeqID_3467
  Gene classification: Gene name=TruA; Function=Pseudouridylate synthase (tRNA psi55); Function class=J Translation, ribosomal structure and biogenesis
  Homolog annotation: Query=17..276bp; Hit=11..270bp; Blast score=435; Percent Identity=80.0; E value=1e-122; Homolog= truA COG0101
MSDAELSQSVPEAKKVKIALGIEYDGSRYYGWQRQQEVKSVQECLEKALSKVADEPISVFCAGRTDAGVHATGQVVHFKTSAQRKDAAWTMGVSSHLPPDIAVRWVKTVDDEFHARFSATARRYRYIIFNHRYRPAVLAQGVTHFHYPLDERKMHEAAQSLLGENDFTSFRAVQCQSNSPWRNMMHINVSRHGHYVVVDIKANAFVHHMVRNIVGSLLEIGCSNQDIGWMAELLALKNRTKAAATAKAEGLYLVAVDYPEHFGLPEPIMGPLFLANDLI

SEQ ID NO: 9576 - protein, 336 aa, Xenorhabdus bovienii
  Coding DNA sequence: Name=SeqID_3468
  Gene classification: Gene name=Asd; Function=Aspartate-semialdehyde dehydrogenase; Function class=E Amino acid transport and metabolism
  Homolog annotation: Query=1..336bp; Hit=1..337bp; Blast score=443; Percent Identity=67.0; E value=1e-124; Homolog= usg COG0136
MSEGWNIALLGATGAVGEAILALLQEREFPVGELHLLASEQNAGKIQRFSGKSITVYDAAEFDWSQVQLAFFAATMEATAQYVEKATEAGCLVIDSSGLFAAEPDVPLVVPGVNPYALAEYRNRNIIAVADSSTSQVLTAIKPLIDVAGVARINLTNILPVSVHGKAAINELAGQSARLLSGIPPDESLFNKQLAFNLLPLLPDAEGSVREERRIVDQIRRILQDEGLPISVSCVQSSVFYGIAQMVSVETLRPVGVGEARGELERFAEIQVSEEGDYPTQVTDASGNDRLSIGCLRNDYGMPEMLQFWSVADNIRFGGALMAVEIAEKLMQEQFY

SEQ ID NO: 9577 - protein, 378 aa, Xenorhabdus bovienii
  Coding DNA sequence: Name=SeqID_3469
  Gene classification: Gene name=SerA; Function=Phosphoglycerate dehydrogenase and related dehydrogenases; Function class=E Amino acid transport and metabolism
  Homolog annotation: Query=4..375bp; Hit=1..372bp; Blast score=503; Percent Identity=70.0; E value=1e-142; Homolog= pdxB COG0111
MRKVKILVDENMPYAEQLFQQLGEVQAIPGRPVPAGVLEQADAFMVRSVTKVNESLLKGSSVKFVGTATAGMDHVDQQWLSQAGIGFSAAPGCNAIAVVEYVFSALMLLAERDQFQLKDKTVGIVGVGNVGGRLADRLAALGVKTLLCDPPRADRGDEGEFWPLEKLVQEADILTFHTPLNRSGRYQTYHLADAELLSALPDNRILINASRGEVVDNQALLSVLQSGKKLRVVLDVWEPEPNLSLPLLALVDIGTPHIAGYTLEGKARGTTQVFEAYCEFLGQPRRAELSDLLPEPDFSHITVHGEVTQSILKRLIHLVYDVRRDDAPLRQVAEQDGAFDRLRKNYPERREWSSLTVHCDSEKSAQLLSEIGFNAKVI

SEQ ID NO: 9578 - protein, 61 aa, Xenorhabdus bovienii
  Coding DNA sequence: Name=SeqID_3470
LPVLRPIAEKVVQRKAYFHQPEFSLFSSNDLNGRDPLFCHLIDIKPIIRNGRIIWIATSVV

SEQ ID NO: 9579 - protein, 295 aa, Xenorhabdus bovienii
  Coding DNA sequence: Name=SeqID_3471
  Gene classification: Gene name=RhaT; Function=7 Permeases of the drug/metabolite transporter (DMT) superfamily; Function class=G Carbohydrate transport and metabolism
  Homolog annotation: Query=2..283bp; Hit=1..282bp; Blast score=192; Percent Identity=43.0; E value=3e-49; Homolog= PA4287 COG0697
MINFLFPFIAVLIWSINAVVSKVAATSIEPAAIAFYRWFIAFLALTPFILWPVLKQRKMVIQYWWKLLILGTLGMVLNQSMAYYAAHTVSATLIGIFTSLIPLLTVIISIFALRVAPTVGITLGTVFSLFGLVWLVSKGEPASLLEHGLGIGEVMLFIASASYALYGVLTKRWAIPLPNWQSLYIQIGFSLLLLLPNFMMTEDVRLTSDNISLVLFAGIPASILAPYLWIQGVTRLGANMTSIFMNLAPVFTAIIAIVFLHEKMQSYHLIGGGIVLAGVILAQRLRTPLTRRKSE

SEQ ID NO: 9580 - protein, 492 aa, Xenorhabdus bovienii
  Coding DNA sequence: Name=SeqID_3472
  Gene classification: Gene name=BaeS; Function=Signal transduction histidine kinase; Function class=T Signal transduction mechanisms
  Homolog annotation: Query=24..483bp; Hit=6..457bp; Blast score=260; Percent Identity=37.0; E value=2e-69; Homolog= PA0757 COG0642
MYIAWIGISIGVAEIMKLFKVPRSLFHQLLLFFGAPLLLLGGASVYTHYFSAENAATLAYDRTLLASARTVAERLTVKNKQLNVDVPYIVLDSFERNTNDRLYYQVISPEGKTISGYDNLPPIPQYTQRSQLYTALVYFYNAEYQGYPIRVAALYQPINEGGLMGMALILVAETVGSRQYLARQLLISSLISQGTVVVLTLILAYFLLKQLLKPLRRLSGMMVLRSANDLTPLPDILPWSELSPLLRAFNRYIERLKLMVGRQARFSADASHQLRTPLSVLKTQIAVALNDKDPHPSGKIIKAINKTVDNMISLTDRLLYLSQLKVHEKEAIQNYQPVNIVELLQQACFSRLQQAESKNVDLGYEGENAFWIKGEPVLLTEMCANLLDNAIKYTPAAGMVTARVSMTADKKYCCLEVDDSGPGIAQENITQSLMAFNRLDNAAGLEGAGLGLTIVKDISLYHGATLQLLPSATLGGLLVRILFRLPASERGT

SEQ ID NO: 9581 - protein, 221 aa, Xenorhabdus bovienii
  Coding DNA sequence: Name=SeqID_3473
  Gene classification: Gene name=OmpR; Function=Response regulators consisting of a CheY-like receiver domain and a winged-helix DNA -binding domain; Function class=T Signal transduction mechanisms
  Homolog annotation: Query=1..220bp; Hit=1..221bp; Blast score=221; Percent Identity=56.0; E value=5e-58; Homolog= PA0756 COG0745
MRLLLVEDHPDLSHWLQKALRSSGFTVDIAEDGIAADQLLLTENYTLLILDVALPRLDGISLLSRLRKRGQNLPVLLLTAKADVADRVKGLNSGADDYLTKPFDFEELEARIRALLRRGVGSPLGMQQFGSLAYEDAGYFLLDNQPLALTPREFSVLTTLFHRRGRPVSKQQLFEQVFSLSDEANPQSIELYVHRLRKKLLNSDIGICTLRGLGYRLELQK

SEQ ID NO: 9582 - protein, 35 aa, Xenorhabdus bovienii
  Coding DNA sequence: Name=SeqID_3474
MQFIKLEAALLKDSRCIPLFNQTTLAFQMNRKLSD

SEQ ID NO: 9583 - protein, 47 aa, Xenorhabdus bovienii
  Coding DNA sequence: Name=SeqID_3475
MANNPDFIFYNQDYLSQIFFNILVTIIKSITIMRELPPPCNVKHYEN

SEQ ID NO: 9584 - protein, 319 aa, Xenorhabdus bovienii
  Coding DNA sequence: Name=SeqID_3476
  Gene classification: Function=Uncharacterized BCR; Function class=S Function unknown
  Homolog annotation: Query=16..317bp; Hit=23..325bp; Blast score=386; Percent Identity=61.0; E value=1e-107; Homolog= PA0754 COG3181
MLLATTCLLFCANTLATNAPNRTECIAPAKPGGGFDLTCKLVQVSLLDSKAINTPMRVTFMPGGVGAVAYNAIVAQRSAEPGTIVAFSGGSLLNLSQGKFGRYNVNDVRWLASVGTDYGMIAVRSDSPYKNLQDLMEAFKKNPTSIVFGAGASIGSQDWMKTALLAKEVGIDPRKMRYVAFEGGGEPITALLGNHIQVVSGDLSETLPYLSGDKIRVLAVYADKRLSGNLARIPTAKEQGYNLVWPIIRGFYIGPKVTDEHYQWWVETFNKLQQTKEFKKQRELRGLFEFNMTGKELNDYVKKQVAQYHELAKSFGLAK

SEQ ID NO: 9585 - protein, 143 aa, Xenorhabdus bovienii
  Coding DNA sequence: Name=SeqID_3477
  Homolog annotation: Query=1..142bp; Hit=1..142bp; Blast score=179; Percent Identity=80.0; E value=9e-45; Homolog= ref|NP_930411.1|
MSDRIFATVWLVLCGIGLTIGWGIHSEYSYEPLGPRPFPIAIISLMALCSLLLLFKKPEPTQWPTAQVLRRLLLLITSLVVYAWTFEWLGFPLATTLLTISVALLFNAKLPAAIISGVFLGVSLFFAFDRLLDVTLPLGNWLK

SEQ ID NO: 9586 - protein, 503 aa, Xenorhabdus bovienii
  Coding DNA sequence: Name=SeqID_3478
  Gene classification: Function=Uncharacterized BCR; Function class=S Function unknown
  Homolog annotation: Query=2..473bp; Hit=1..472bp; Blast score=545; Percent Identity=68.0; E value=1e-155; Homolog= PA0752 COG3333
MMDTWIYLSQGFEVALMPKNLVIALIGCFIGTVVGMLPGLGPINGVAILLPLAFALKLPAESALILLATVYIGCEYGGRISSILLNLPGDAAAIMTALDGHPMAKQGKAGVALSISAVSSFCGSLLAIIGIILFAPILAKWSLAFGPAEYFALMVFAIACLGSMMSQNPIKSLLAALIGLSLATVGVDANTGVYRFTFDSVHLSDGIQFIVVVIGLFSVSEILLMLESTSAGQKVISKTGRLLFNKKEAAVCTGPILRSSVIGFFVGILPGAGATIASAITYMTEKRISGNSDSFGKGDIRGVAAPEAANNASACGSFIPMLTLGVPGSGTTAVMIGALTLYNITPGPAMFTEQPDIVWGLIAALLIANVLLLIMNIPMIGLFTRMLNIPLWFLVPAIAIVSAVGVYAVHSTTFDLMLMVGLGVFGYILRKMNFPMSPLILGFVLGEMLEQNLRRALSISNGNFEILWSSTIAQTLLVLGALVIIIPPVLRIMNKRRNKNTAA

SEQ ID NO: 9587 - protein, 404 aa, Xenorhabdus bovienii
  Coding DNA sequence: Name=SeqID_3479
  Gene classification: Gene name=FabB; Function=3-oxoacyl-(acyl-carrier- protein) synthase; Function class=I Lipid metabolism
  Homolog annotation: Query=1..401bp; Hit=1..403bp; Blast score=622; Percent Identity=79.0; E value=1e-178; Homolog= fabB COG0304
MKRAVITGLGIVSSIGNNQKEVLESLREGRSGITFSEEFKEMGLRSHVWGNIKLDISGLIDRKTQRFMSDSSIYAYLAMDEAIKDSGLSDEQVSNLRTGLVVGSGGGSPRNQVNGSDGMRAKGLRGVGPYMVTRAMASGVSACLATPFKIKGVNYSISSACSTSAHCIGHAVELIQLGKQDVIFAGGGEELSWEMACEFDAMGALSTKYNETPELASRTYDQGRDGFVIAGGGGIVVVEELEHALARGAHIYAEIIGYGANSDGADMVAPSGEGAVRCMKLALDGIEGGVDYINTHGTSTPIGDLKELGAIREVFGDNTPAISATKAMTGHSLGAAGAHEAIYSLLMLEHGIIAPSINIDNLDENASGMNIITEPTKRELRTVMSNSFGFGGTNASLVMRKYSN

SEQ ID NO: 9588 - protein, 34 aa, Xenorhabdus bovienii
  Coding DNA sequence: Name=SeqID_3480
VITARFIHYLIIFTCGISAPHFSVHLYAEQVRSG

SEQ ID NO: 9589 - protein, 683 aa, Xenorhabdus bovienii
  Coding DNA sequence: Name=SeqID_3481
  Gene classification: Gene name=DadA; Function=Glycine/D-amino acid oxidases (deaminating); Function class=E Amino acid transport and metabolism
  Homolog annotation: Query=259..681bp; Hit=1..413bp; Blast score=447; Percent Identity=53.0; E value=1e-125; Homolog= yfcK_2 COG0665
VKNSAISSATLNWNEQGTPVSEQFDDVYFSNQDGLEETLYVFLKGNHFPQRFNTHSRPDCIIAETGFGTGLNFLTLCRAFSIFRQQHPDASLKRLHYISFEKYPLTTADLKTAHQRWPELQIFSEELCQQWPLPLGGCHRLMLNNGAVTLDLWFGDVNDLLPRINSNLTGKIDAWFLDGFAPSKNPQMWSEQLFTAMARFSRPEGTFATFTSAGVVRRGLQGAGFDVKKIKGFGHKREMLTGVLAPSAHSPLSSSGTPWFARQAATDTDDIAIIGGGIASVLTALALLRRGAKVTLYCQDNQPAQNASGNQQGAIYPLLNGRDDLLERFFISAFTFARRQYDQLIDENVSFDYQWCGVSQLAYDEKSDKKIAKMLQTSWLEEIAIGMDRQQLSQASGLDVNYHGIHYPQGGWLSPAQLTQEAINLAEQRGMLTYFNHKITQLVQDEYGWQLHIEHQGQSLHKNHKVVIIANGHCLPQFTQTEKLPVTAARGQVSHIPTSTRLSQLNNVLCYDGYLTPVNPHNQHHCIGASYQRGKVDTQYSSAEQQENRDRLLKSLPDVDWVKQVNISEAKSRQGIRCVTRDHMPMVGNVPIFSEIMAKYAGLSQRINTDETIEESPCYPDLFVIGALGSRGLCSAPLSAELLAGQIFGEALPLDDETLATLHPNRFWVRKLLRGKEVKAGKP

SEQ ID NO: 9590 - protein, 177 aa, Xenorhabdus bovienii
  Coding DNA sequence: Name=SeqID_3482
  Gene classification: Gene name=WecD; Function=Histone acetyltransferase HPA2 and related acetyltransferases; Function class=K Transcription
  Homolog annotation: Query=4..167bp; Hit=5..168bp; Blast score=131; Percent Identity=44.0; E value=4e-31; Homolog= PA2271 COG0454
MFFIRPTQILDAGVLPAIERSAGQLFLSTPELAWIANGNVHTEQQHLDYISQQNSWIALNGDNQPVGFILAKPLDDGLHIMELSVHGDWQKKGIGKALIDTVIQVAEQRGFQAVTLTTLRHINWNAPFYQRLGFFILEPRQITGALCQILQREIEYGFAENQRCAMKRLVVTTDYHD

SEQ ID NO: 9591 - protein, 183 aa, Xenorhabdus bovienii
  Coding DNA sequence: Name=SeqID_3483
MKQATHSVNIGKGYAVGKAAFLLSKPVNFSQSTEIERRDMGEQIEKRVENLESDVAQLKTDVSVIKSNYATKADIESVKVLVHNDISSVKSIIHNEISSVKNIIHQEITTVNKEMSLMRKEISSIHKDISSIHKEIASGHKNTAAIHKEISLIYKKMADQTKWMVTMMFGFSGIVIAAMKFMI

SEQ ID NO: 9592 - protein, 97 aa, Xenorhabdus bovienii
  Coding DNA sequence: Name=SeqID_3484
MDVRFSKFEKRVENLESDVAQLKTDVAVIKSNYATKADIESVKALVHNEISSVRKEMSSIHKEVSKIYKTIADQTKWMMTMMVGFSGIIIAAMKYML

SEQ ID NO: 9593 - protein, 91 aa, Xenorhabdus bovienii
  Coding DNA sequence: Name=SeqID_3485
  Homolog annotation: Query=1..90bp; Hit=1..90bp; Blast score=131; Percent Identity=85.0; E value=2e-30; Homolog= ref|NP_930415.1|
MLAEFETRILAHIDDRVEDASDDELFAGGYLRGHLTLAVAELELEGANTIEQLHQSVEESIHRAIKAGELAPPDQVLVLSTWQRLLDSAKD

SEQ ID NO: 9594 - protein, 183 aa, Xenorhabdus bovienii
  Coding DNA sequence: Name=SeqID_3486
  Gene classification: Function=Uncharacterized BCR; Function class=S Function unknown
  Homolog annotation: Query=2..178bp; Hit=3..179bp; Blast score=289; Percent Identity=76.0; E value=1e-78; Homolog= Z3589 COG3101
MTVHHYQQLIEIFDNCFSDDCNTRLIKGDDEPIYLPVDDQVGYNRIVFAHGFYASGLHEISHWCIAGKERRKRVDFGYWYCPDGRDAQTQSEFEQVEIKPQALEWLFCMAAGFPFNVSCDNLEGDCEPDRFAFQCKVHAQVITYLENGIPTRAARFIQGLHSFYNTPPLTAEHFPCPEDPFAN

SEQ ID NO: 9595 - protein, 266 aa, Xenorhabdus bovienii
  Coding DNA sequence: Name=SeqID_3487
  Gene classification: Function=Predicted permeases; Function class=R General function prediction only
  Homolog annotation: Query=5..262bp; Hit=9..266bp; Blast score=267; Percent Identity=63.0; E value=8e-72; Homolog= yfcA COG0730
MEWSLLSPEIYGFLFLVAIVAGFIDSIAGGGGLLTIPALLSVGVSPVQALATNKLQAVGGSFSASLYFIRRGAVDWRSQRFAIAMTLFGAMLGALLVQFVSPDFLLYLLPVLVIIIGLYFLLVPNIGAEDRPRRLAPLAFGCLAGGGIGFYDGVFGPGTGSFLALSYVMLCGYNLAKATAHAKVLNFASNMGSLGFFILGGQVLWLLGLVMLMGQVIGARLGAGLVLSRGQKLIRPMLVTISFLMSIKLLHDHHGDTIRSWLAFYF

SEQ ID NO: 9596 - protein, 39 aa, Xenorhabdus bovienii
  Coding DNA sequence: Name=SeqID_3488
MIYFTRKLLINNPDACISDVLLPIYQRGSGEMTSAHCAR

SEQ ID NO: 9597 - protein, 361 aa, Xenorhabdus bovienii
  Coding DNA sequence: Name=SeqID_3489
  Gene classification: Gene name=AroC; Function=Chorismate synthase; Function class=E Amino acid transport and metabolism
  Homolog annotation: Query=1..361bp; Hit=1..361bp; Blast score=604; Percent Identity=85.0; E value=1e-173; Homolog= ZaroC COG0082
MAGNSIGQFFRVTTFGESHGIALGCIVDGVPPGIAITEADLQIDLDRRRPGTSRYTTQRREPDQVRILSGVFEGVTTGTSIGLMIENTDQRSQDYSAIKDVFRPGHADYTYEQKYGLRDYRGGGRSSARETAMRVAAGAIAKKYLLEKHGIRIRACLTQMGDIHCELKDWDLVEQNPFFCPDESKLTQLDELLRTLKKEGDSIGAKVTLVAENVPVGLGEPIFDRLDADIAHALMSINAVKGVEIGDGFGVVNLRGSENRDEITSQGFTSNHAGGILGGISSSQPIIAHIALKPTSSIMVSGKTINRQGEEVDMVTRGRHDPCVGIRAVPIAEAMMAIVLMDHLLRQRAQCADVISPLPRW

SEQ ID NO: 9598 - protein, 325 aa, Xenorhabdus bovienii
  Coding DNA sequence: Name=SeqID_3490
  Gene classification: Gene name=HemK; Function=Predicted rRNA or tRNA methylase; Function class=J Translation, ribosomal structure and biogenesis
  Homolog annotation: Query=12..325bp; Hit=108..421bp; Blast score=514; Percent Identity=76.0; E value=1e-146; Homolog= yfcB COG2890
MAKYALIHFCGLEMLVDKIFVDEAVAELHTILDMLRWSASRFNAANIYYGHGTDNSWDEALQLVLPTLHLPLDVPESMMAARLTSTERHRIVERVLRRINERIPVAYLTNRAWFCGHEFYVDERVLVPRSPIGELVNNQFAGLLPQEPSTILDLCTGSGCIAIACAHEFPEAEVDAVDVSGDALAVTEQNIENHGLLNRVIPILSDLFRDMPPMKYDLIVTNPPYVDEEDMNDLPDEFLREPELGLAAGVDGLTLARRILANAPDFLTEEGVLICEVGNSMVHLIDQYLGVPFTWLEFENGGDGVFMLTREQLIEHHEYFRLFKD

SEQ ID NO: 9599 - protein, 62 aa, Xenorhabdus bovienii
  Coding DNA sequence: Name=SeqID_3491
MLQPVCTQRVRKKVNRMAYWESLIKCNFFLERVREPPCIHRVVCLGVISFFSPTTFSPTRNN

SEQ ID NO: 9600 - protein, 457 aa, Xenorhabdus bovienii
  Coding DNA sequence: Name=SeqID_3492
  Gene classification: Gene name=AnsP; Function=Gamma-aminobutyrate permease and related permeases; Function class=E Amino acid transport and metabolism
  Homolog annotation: Query=1..449bp; Hit=1..451bp; Blast score=560; Percent Identity=70.0; E value=1e-159; Homolog= PA5097 COG1113
MQNTSQLKRGLSVRHIRFMALGSAIGTGLFYGSAEAIKAAGPAVLLAYAIGGAAVFMVMRALGEMAVHHPVAGSFSHYASHYLGPLAGFLTGWTYVFEMLVVCLADITAFGLYMKLWFPHVDQWIWVLSIVFFIGAINLCNVKVFGEMEFWLSIIKVTAIVAMIVGGFVIMMYGFGQEAGHVTGLSNLWEHGGFMPNGIAGVIASFTVVMFAFGGIEVIGITASEAKNPEKSIPQAINAVPFRILLFYVLTLFVLMCIYPWNQIGQNGSPFVQIFSSLGIDSAANILNVVVITAAISAINSDIFGSGRMMYGMAQEKQAPSAFTKLTKNGVPWVTVLVMSCVLLIGVVLNYLLPEKVFGIIASIATFATVWVWLMILLSQYIMRRKMPAEEVKKLKFPVPLWPTAPILTISFMAFIIVVLGYFPSTRIALYVGIAWIALLTLSYFLWVKKLWVKKTR

SEQ ID NO: 9601 - protein, 510 aa, Xenorhabdus bovienii
  Coding DNA sequence: Name=SeqID_3493
  Gene classification: Gene name=HutH (BS); Function=Histidine ammonia -lyase; Function class=E Amino acid transport and metabolism
  Homolog annotation: Query=6..503bp; Hit=5..502bp; Blast score=683; Percent Identity=74.0; E value=0; Homolog= PA5098 COG2986
MKHITIHPGKMTFEELRHIYQHPVQITLDEQCFPAIERSVDCVNRIINENRTAYGINTGFGLLASTRIAERDLEELQRSLVLSHAAGVGEPLPDEIVRLMMVLKINSLARGYSGIRLDVIQTLITLVNAEVYPCIPSKGSVGASGDLAPLAHMSLLLLGESKARYRGEWLPAKEALEKANLKPIRLAAKEGLALLNGTQTSTAFALKGLFAAEDLLASAVVCGAMSVEAALGSRKPFDARIHEARGQQGQIDVAALYRLVLEEQSGLSESHKNCPKVQDPYSLRCQPQVMGACLTQIRHAADVIITEANAVSDNPLVFTDQDEVISGGNFHAEPVAMASDNLAIALAEMGALSERRISLLMDSNMSQLPPFLVNNSGVNSGFMIAQVTAAALASENKALAHPSSVDSLPTSANQEDHVSMAPAAGRRLWEMADNVRGILAIEWLTACQGMDFRDGLKSSPILEKARHILRDKVAYYDKDRFFAPDIDAAIQLLIAQQLSALLPTGKILRN

SEQ ID NO: 9602 - protein, 613 aa, Xenorhabdus bovienii
  Coding DNA sequence: Name=SeqID_3494
  Gene classification: Gene name=HutU (BS); Function=Urocanate hydratase; Function class=E Amino acid transport and metabolism
  Homolog annotation: Query=50..600bp; Hit=5..555bp; Blast score=1033; Percent Identity=88.0; E value=0; Homolog= PA5100 COG2987
LIFSIKDTTLQIIDFICVTFFPIESTCIYNYTINKLYKDEKEKTVTMQNNKFSNEVIRAPRGTQLTAKSWLTEAPLRMLMNNLDPDVAENPHELVVYGGIGRAARNWECYEKIVETLKNLENDETLLVQSGKPVGVFKTHENAPRVLIANSNLVPHWATWEHFNELDAKGLAMYGQMTAGSWIYIGSQGIVQGTYETFVEAGRQHFNGNLTGRWVLTAGLGGMGGAQPLAATLAGVSSLTIECQQSRIDFRLRTQYVDEQAADLDDALARIKRYTQEGKAVSVALCGNAAEIVPELVRRGVRPDMVTDQTSAHDPLHGYLPAGWTWEEYCRRAETEPEVVIQAAKASMAVHVEAMLAFQKQGVPTFDYGNNIRQMAKEMGVEHAFDFPGFVPAYIRPLFCRGIGPFRWAALSGDPEDIYKTDAKVKELLPDDANLHRWLNMARERISFQGLPARICWVGLGDRAKLGLAFNEMVRSGELSAPLVIGRDHLDSGSVASPNRETESMKDGSDAVSDWPLLNALLNTASGATWVSLHHGGGVGMGFSQHSGMVIVCDGTDEAAERIARVLHNDPATGVMRHADAGYEQAIQCAKEKNLNLPMLDTKSSDTKTVETK

SEQ ID NO: 9603 - protein, 31 aa, Xenorhabdus bovienii
  Coding DNA sequence: Name=SeqID_3495
MGFTLWSQLFVKKSPYTKNKGRFFYVTMGKS

SEQ ID NO: 9604 - protein, 243 aa, Xenorhabdus bovienii
  Coding DNA sequence: Name=SeqID_3496
  Gene classification: Gene name=PhnF; Function=Transcriptional regulators; Function class=K Transcription
  Homolog annotation: Query=12..243bp; Hit=19..250bp; Blast score=290; Percent Identity=60.0; E value=9e-79; Homolog= PA5105 COG2188
VTVDLSDTFVKPVPLYAKVKQAIIEKIYTGEWKPHDRVPSESELVKQFSCSRMTANRALRELMAEGFLFRLQGVGSFVSEPKGQSALFEIHSIAGEIAARSNQHSCKVLKLAEVNANITQAAELGIVAGTAIYHSIIVHYENDVPVQIENRYVNAQAVPAYLQQDFNQQTTHDYLSMVAPLTEGEHIVEAVAGDVRSCRLLQIEADTPCLLISRRTWSKEHIVSSAKLLFPGHRYKLKGHFSS

SEQ ID NO: 9605 - protein, 356 aa, Xenorhabdus bovienii
  Coding DNA sequence: Name=SeqID_3497
  Gene classification: Gene name=SpeB; Function =Arginase/agmatinase/formimionoglutamate hydrolase, arginase family; Function class=E Amino acid transport and metabolism
  Homolog annotation: Query=44..352bp; Hit=6..324bp; Blast score=209; Percent Identity=40.0; E value=3e-54; Homolog= VC1204 COG0010
MPKIRWISYMNLDVIHWFIVSIVVKLHIIFNNGERNNMKLWHPTSENIWQGRNDLAEADNALRVFQTIKQPANFSPEEFPHHIALLGFECDEGVKLNHGRPGAKLGPEYLRQSLANMASYDGHEQLVDLGNIRADTEKLAEAQNALSDAVYECQHQNMRTLIFGGGHETAFAHGMGIYRAFPTQRVGIINFDAHLDLRNSPQPTSGTPFRQLADYCQQHQRPFNYTCIGASLASNTQALLDEANHLDVTIIWDTQCIESMLDKVQEQIQDVINQVDIIYMTIDLDVLPIWQMPSVSAPAALGVPLERLLPLIQLICQSKKLQAVDLVELNPLYDIQGMGGKAAARLAWQLVHWWNG

SEQ ID NO: 9606 - protein, 417 aa, Xenorhabdus bovienii
  Coding DNA sequence: Name=SeqID_3498
  Gene classification: Gene name=HutI (BS); Function =Imidazolonepropionase and related amidohydrolases; Function class=Q Secondary metabolites biosynthesis, transport and catabolism
  Homolog annotation: Query=15..414bp; Hit=8..400bp; Blast score=409; Percent Identity=52.0; E value=1e-114; Homolog= VC1205 COG1228
MSIELKDTDVIWRNARLATMNPTINNIDGKHHYGMLEQHDLIVRGEKILAIVPTDSVPTHHCHIIDVEQRLITPGLIDCHTHLIFGGNRASEWEQRLNGASYEEISAKGGGINSTVNATRNNSAQQLEVAAQKRLNALIAEGITTIEMKSGYGLDLVNEEKQLNVVQALAQKNAIEISPTLLSAHAVPPEYKHNPDAYIDLICDSILPTLWQKQLFESVDVFCETVGFSLDQTKCVFDAAQRLNIPVKGHVEQLSNMGGSELVADYQGWSVDHIEYLDEKGIEAISRSGSVAVLLPGAFYFLKEKKLPPISLLRQYRVPMAISTDFNPGTSPFASLRLIMNMACVQFGFTPEEAWQGVTLHAARALGRAESHGQLAEGYMADFIVWDAENPVDILYELGRNPLVHRIYRGEITHNFQ

SEQ ID NO: 9607 - protein, 87 aa, Xenorhabdus bovienii
  Coding DNA sequence: Name=SeqID_3499
MFAINVVDCRVHCGKSGITPNNVSIFQLNRHCIVLLFFLLVSTFMLYIHLFYNQPRLSNHFMDTDEYHEFSRDYPSRCEYIAIYTIT

SEQ ID NO: 9608 - protein, 46 aa, Xenorhabdus bovienii
  Coding DNA sequence: Name=SeqID_3500
MNFLETIRHDANILQFTQSPKYTYQFYAIASKQNHKKSGTITKICQ

SEQ ID NO: 9609 - protein, 174 aa, Xenorhabdus bovienii
  Coding DNA sequence: Name=SeqID_3501
  Gene classification: Function=Uncharacterized BCR; Function class=S Function unknown
  Homolog annotation: Query=1..170bp; Hit=7..176bp; Blast score=261; Percent Identity=73.0; E value=2e-70; Homolog= Z3594 COG2840
MSEEDISLFRTSVTGARRIVQDTVLHSPQRKKISYVAPARMMQEQVDASYYFSDEFQPNLDMEGPTRYIREGANHYELKKLRRGDYSPELFLDLHGLTQLQAKQEIGALIAACRREHIYCACVMHGHGKHILKQQAPLWLAQHPDIIAFHQAPKEWGGNAALLILIEMNELMQR

SEQ ID NO: 9610 - protein, 160 aa, Xenorhabdus bovienii
  Coding DNA sequence: Name=SeqID_3502
  Gene classification: Gene name=SixA; Function=Phosphohistidine phosphatase SixA; Function class=T Signal transduction mechanisms
  Homolog annotation: Query=1..156bp; Hit=1..155bp; Blast score=165; Percent Identity=56.0; E value=2e-41; Homolog= Z3603 COG2062
MYVFIMRHGDAALHSISDATRELTPRGQQESQEMACWLTQQEPDVDCILVSPYIRAKQTLKVVRENLALPGNEEELAELKPSGDVALVASYLQVLATQEYNAVLVVSHLPLVGYLVSELCPEQTPPMFATSSIACVELDPQTEKGRLLWQTSPAQLAAKD

SEQ ID NO: 9611 - protein, 725 aa, Xenorhabdus bovienii
  Coding DNA sequence: Name=SeqID_3503
  Gene classification: Gene name=FadB; Function=3-Hydroxyacyl-CoA dehydrogenase; Function class=I Lipid metabolism
  Homolog annotation: Query=324..725bp; Hit=4..400bp; Blast score=503; Percent Identity=65.0; E value=1e-142; Homolog= yfcX_2 COG1250
MAQGEKETMMSETQPKQSVFSFSVRDDKVGVITIDVPGEKVNTLKAEFVEQFLTVFEKAQQASGLKGLVIVSGKPDTFIAGADITMIAGCQTEEDAMELAEKGQRLFAQIANYRLPVVAAIHGACLGGGLELALACHARVCSLDDKTRLGLPEVQLGLLPGSGGTQRLPRLIGVSAALDIILTGRQLKAKQAQRLGVVDDAVPLDILLDVAVQYVKKGISKRKPLAWSQRILASTLGRPLLFHMVHQKTRAKTHGHYPAPERIINVVRTGLEKGLKKGFQAEAKAFGELAMSPESEALRSLFFASTSLKNETGSSEQPAEIKYVGVLGGGLMGGGIANVTMTRGNLPVRIKDINQKGINQALKYIWDILSRRVKQRRLKSSERSRQMALISGTTDYSGFRQADIVVEAVFEDLALKRKMVAEVEEHSKPETIFASNTSSLPICQIAEIASRPEQVIGLHYFSPVDKMPLVEVIPHAGTSEKTIATAVALAKKQGKTAIVVGDKAGFYVNRILSPYINEAGYCLAEGEPIDHIDKALVDFGFPIGPINLLDEVGIDVGTKIIPILVAQLGSRFTAPGFLDAVLKDNRKGKKNGCGFYSYGAKKSKFWPFGNKTKEVDASIYSLLKIKPHAKMQPSDIAQRCMMLMLNEAVRCLDEGIIRSPRDGDIGAVFGIGFPPFLGGPFRYIDRLGSDKVVAILRRLEQQHGERFTPCEYLVQMAEQKKKFYK

SEQ ID NO: 9612 - protein, 436 aa, Xenorhabdus bovienii
  Coding DNA sequence: Name=SeqID_3504
  Gene classification: Gene name=PaaJ; Function=Acetyl-CoA acetyltransferases; Function class=I Lipid metabolism
  Homolog annotation: Query=1..436bp; Hit=1..436bp; Blast score=624; Percent Identity=76.0; E value=1e-179; Homolog= yfcY COG0183
MGRSSTKVAQQKERVAIVSGLRLPFAKQATSYHGIPAVDLGKAVVSELVIRSGLSPEKIDQLVFGQVVQMPEAPNIAREIVLGAGLSVSTDAYSVSRACATSFQAIANVAESIMAGTVNVGIAGGADSSSVLPIGVTKSLARTLVDMNKAKSLSQRLKLISRLKLRDLLPVSPAVAEYSTGLRMGDTAEQMAKTYHISREEQDELAHRSHILAAKAWQQGCLNEEVVAAHFPPYRDTLTEDNNIRKNSVLTSYSKLRPAFDRKYGTVTAANSTPLTDGAAAVMLMRESVAKELGMTPLGYLRSYAFSAIDVWQDMLLGPSYATPIALERAGITLNELSLIDMHEAFAAQTLANLKMFASEKFAREKLGRSQAMGDVDMDKFNVLGGSIAYGHPFAATGARMVTQTLNELRRRGGGFGLATACAAGGLGVAMVLEVE

SEQ ID NO: 9613 - protein, 98 aa, Xenorhabdus bovienii
  Coding DNA sequence: Name=SeqID_3505
  Gene classification: Function=Uncharacterized BCR; Function class=S Function unknown
  Homolog annotation: Query=4..98bp; Hit=8..102bp; Blast score=110; Percent Identity=63.0; E value=2e-25; Homolog= Z3606 COG3691
MPDTIKRCNVEETATCCCVDVGTVIDNEDCTASYQRVFANGQEAEMMLNTLTVKAKSVESEPCVISHKIEAVDDGAQLTIDFTFSCQAEALIFQLGLR

SEQ ID NO: 9614 - protein, 440 aa, Xenorhabdus bovienii
  Coding DNA sequence: Name=SeqID_3506
  Gene classification: Gene name=FadL; Function=Long-chain fatty acid transport protein; Function class=I Lipid metabolism
  Homolog annotation: Query=1..440bp; Hit=3..448bp; Blast score=507; Percent Identity=58.0; E value=1e-143; Homolog= ZfadL COG2067
MSQKNLFTRSALAVAVAVISSNASAAGFQLNEYSTSGLGRAFSGAGVVADNASEGSRNPAAMTLFDRPSFSSGLVYVKPNVDITGRSPVPQLGTGVKNSTDAKNIAPHAWIPNLHFITPINDQWFLGASATSNFGLATEFSNNYAAGLVGGKTSLKTVNLNLSGAYKFNDQFSFGLGVNAVYADATIVRHMGEVGPYNPRAPIPATYEASRLEGKDWGYGWNAGILYQYDENNRYSLTYRSKVKVKFKDGDFSNDLPEFLPNGTGGNTIKGTLDLNLPDMWEVSGYNRVAPQWAIHYSFLYTGWSEFKELRGKNKGNGNTLFHKDENFRNAYRVSLGTTYYYDDNWTFRTGIAFDQSPVPAQNRSISIPDQDRFWLSLGSTYTFNKDASVDVGVSYMRGKKVRVSEKLPEDVQRGPFSQPYEFDSKGTAWLYGVNFNYTF

SEQ ID NO: 9615 - protein, 260 aa, Xenorhabdus bovienii
  Coding DNA sequence: Name=SeqID_3507
  Gene classification: Gene name=VacJ; Function=Surface lipoprotein; Function class=M Cell envelope biogenesis, outer membrane
  Homolog annotation: Query=11..260bp; Hit=1..249bp; Blast score=370; Percent Identity=71.0; E value=1e-103; Homolog= ZvacJ COG2853
MSKSDYVENNMKYRLSGVALTAVLLVGCASSSNSVEQGRSDPLEGFNRAMFNFNYDVLDPYLLRPVAVAWRDYVPMPARNGIGNFVSNLEEPASMVNSILRGDIHDGAKHFNRFFLNTLLGMGGLIDVASMANPKLAKEDPMRFGSTLGYYNVGYGPYVVLPGYGNFTLRDEGGNVADMTYPVLSYLTPWMSVGKWVFEGIETRARLLDSDGLLKNSSDPYLMMREAYFQRHDFMVNGGKLSPEQNPNATVIQDELDSID

SEQ ID NO: 9616 - protein, 61 aa, Xenorhabdus bovienii
  Coding DNA sequence: Name=SeqID_3508
MRYRPLRLPEREAGDCGEVGRKAVVTLIELRLTKQCQPNLPNTVISSTSFLRWRIQKKSKG

SEQ ID NO: 9617 - protein, 80 aa, Xenorhabdus bovienii
  Coding DNA sequence: Name=SeqID_3509
MRCFHRFWCCCTSFVITVSIITQDHKSFILQCCIGVIAALGMFFNRFFYIITTGYHEKITVTRAWCIRIIILNTHIYSLI

SEQ ID NO: 9618 - protein, 117 aa, Xenorhabdus bovienii; identical to SEQ ID NO: 7232
  Coding DNA sequence: Name=SeqID_3510
  Gene classification: Function=Predicted transposase; Function class=L DNA replication, recombination and repair
  Homolog annotation: Query=1..115bp; Hit=133..248bp; Blast score=81; Percent Identity=39.0; E value=1e-16; Homolog= mll8100 COG3293

SEQ ID NO: 9619 - protein, 158 aa, Xenorhabdus bovienii; identical to SEQ ID NO: 7173
  Coding DNA sequence: Name=SeqID_3511
  Gene classification: Function=Predicted transposase; Function class=L DNA replication, recombination and repair
  Homolog annotation: Query=11..115bp; Hit=6..110bp; Blast score=103; Percent Identity=45.0; E value=6e-23; Homolog= CC0928 COG3293

SEQ ID NO: 9620 - protein, 117 aa, Xenorhabdus bovienii; identical to SEQ ID NO: 7849
  Coding DNA sequence: Name=SeqID_3512
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 9621 - protein, 163 aa, Xenorhabdus bovienii; identical to SEQ ID NO: 7546
  Coding DNA sequence: Name=SeqID_3513
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 9622 - protein, 163 aa, Xenorhabdus bovienii
  Coding DNA sequence: Name=SeqID_3514
  Homolog annotation: Query=6..161bp; Hit=9..164bp; Blast score=225; Percent Identity=73.0; E value=2e-58; Homolog= ref|NP_930547.1|
VSNSTLPVGVPVPWPAETPPEGWLICNGDSFDKATYPKLALAYPSGNLPDLRGEFIRGWDNGRGADVGRSLLSNQVADIAPHSHRIGRMWSSSNGGVEGLGTGNRIFNSVHQDINYGIDPRGLGIAIGMGSGGVGYMDNAVAASTGTETRPRNIAFNYIVKAD

SEQ ID NO: 9623 - protein, 59 aa, Xenorhabdus bovienii
  Coding DNA sequence: Name=SeqID_3515
LGGLGGGCWGRCEAGDGRRMKPVLTRGKLRVKDYSSDHSIAGIRIFSRYSAVFLACGIN

SEQ ID NO: 9624 - protein, 981 aa, Xenorhabdus bovienii
  Coding DNA sequence: Name=SeqID_3516
  Homolog annotation: Query=2..543bp; Hit=467..996bp; Blast score=570; Percent Identity=55.0; E value=1e-161; Homolog= ref|NP_405679.1|
MVSFTVGLDGKIPLPGYIIGVADEMFSGRVLGGRISAVDGRNITLDRVSSAKVGERLILNLPSGKAEGRTIQAVNGQIVTVTTEYSEIPATENVWAIDATDLAVQQFRVTGIKEGEDGVSFDITAVEHNPDKYDHIDTGTRIDERPISVIPPGVQLPPKNVGISSYSVVNQGIAVTTLRVTWNAAESAIAYEAEWRRDNGNWISAPRTSTQGFEIPNIYAGRYQARVRAINAAEIPSLWANAPETHLKGKEGNPPAPLGFKATPIIFGIQLDWGFAPQTDDTLKTEIQYSKTNDSEGLMLLADIPYPQRTHTMQGLAAGVAFYFRARLVDKSGNQSPWTAFIRGESSSDTNWIIDAAGKEFLSNKAGQRLQEQMDFNSEAIMENAAVEGAIVQRQLKVNGDLKADILHVQTTQVTDREAFAEDMKKVQADVGENAAAVQTKATAVFDIKGDGAALYDVGVGLKYKDQFHKAGMVMGSEVKNGQVTIVRGTGTKWKSNINGITAGQIISIQSGNTVIQNVIQSVNSDTELVLAFAPSVSLNNAKYVISTTVPDTVSDGVRHMCAINAAIILFLQNMDRWMSENGKVDVEMPNGQKVTLDSIRALQAAVEGKLDKFQNAADIQNKSEFVKNLGLSGVMKIGDYGFGGGGRIIQKDSTQLLSWLRDEYVSEIYRNDSACAYTYRFGSNLKIRAYDTWGNISIDYSGSGVRFAGGNGYQDHLYDVVTGKDSNVVHPDPGVGKRGKSLNNLPNNQIYFVYSDGVDGSSGVAGTMVQFAMDHVNSYPFQIMTAYWDGQLRYRAKNGDNGNWMNWRVAWDNRNAVFDGNGFLKKTSSIIQLHPDGTFTTNDESEGATVTKLGLGHYRISGILGYNADGAWGVHGGISVPRDVNGNELVYVEDKVLPDGAIEIKVTHRQNAHMPARLQNRRIKSQDEQTHYTVDEPCDLPAGTRLDARVQMPEDSIWNQKQALASDPQQEHDITSAVNK

SEQ ID NO: 9625 - protein, 235 aa, Xenorhabdus bovienii
  Coding DNA sequence: Name=SeqID_3517
  Gene classification: Function=Uncharacterized ACR, PAD1/JAB1-related; Function class=S Function unknown
  Homolog annotation: Query=4..127bp; Hit=3..126bp; Blast score=122; Percent Identity=45.0; E value=3e-28; Homolog= PA0639_1 COG1310
METLRKHIIDTIIDHAKAEYPNECCGLVIQNSRKQQYIRCRNTAPLPTEQFSMHPVDYAEAEDVGTIVAIVHSHPDATTQPSQLDIAQCDLSQIPWVIVSWPESDIRTIMPTEGIKPLLGRPFVHGIWDCYAIVRDWYRLERDIDIPDFERSDGWWERGENLYMKNYADAGFTECSSELQMGDVIIMQVTAWCRLRWDWMERSPYPVTLSVWRMKCFPVVYWVDVSVRWMGVTLH

SEQ ID NO: 9626 - protein, 246 aa, Xenorhabdus bovienii
  Coding DNA sequence: Name=SeqID_3518
  Homolog annotation: Query=1..246bp; Hit=1..250bp; Blast score=328; Percent Identity=63.0; E value=4e-89; Homolog= ref|NP_405670.1|
MTINADLQRLEVGHKILLFSVDGSAFGGPELYFHNHTIPYTEAELENPDDLPIKSIWWQGVEYKPWPVRIEGLEVNSDGRTVSPTLSVANLDGTISAMCLAYQNMAQARVTLRMTFAHYLDARNFPEGNPEADPTQEKIDVYYIDSKTHEDNTEIHFALSSPADLQGIQIPTRQIHSLCTWCMRGLYRKSPCNYTGDRYFDEDGNPTDDPSKDACSGLLSTGCELCFGKGNQLPFGGFPGSALLRR

SEQ ID NO: 9627 - protein, 101 aa, Xenorhabdus bovienii
  Coding DNA sequence: Name=SeqID_3519
  Homolog annotation: Query=6..100bp; Hit=18..112bp; Blast score=113; Percent Identity=54.0; E value=8e-25; Homolog= ref|NP_405668.1|
MAIEEFKHRVKSIEFGDGYKQVVADGINSETQSWPYSYLGAKEEVVPIFQFIRNHTAKSFIWRPPFGEKGLYRVKSDSITMTPMAGGIMKVSATFEQAFSA

SEQ ID NO: 9628 - protein, 37 aa, Xenorhabdus bovienii
  Coding DNA sequence: Name=SeqID_3520
LRSLFHICRLVRFFTSKSKPLNCGFSFYRYLYGYRRI

SEQ ID NO: 9629 - protein, 68 aa, Xenorhabdus bovienii
  Coding DNA sequence: Name=SeqID_3521
MNQYIVTYSALGSDNSALVNSQIALDFDWSTGGVSDFLIAVENEALTQATGFNSSVARISIVRIYTLQ

SEQ ID NO: 9630 - protein, 83 aa, Xenorhabdus bovienii
  Coding DNA sequence: Name=SeqID_3522
MRSRNNYVGSFMKVRNRAVRRHHMYRLKAKRSKYHNAGGQPDKTSAGICYRTPCLCSCWICANHRAVFGMGIKEIRDRAKYTD

SEQ ID NO: 9631 - protein, 35 aa, Xenorhabdus bovienii
  Coding DNA sequence: Name=SeqID_3523
MNPRNCCATAWLCSRLIVSSERIVFLIVNINGCDY

SEQ ID NO: 9632 - protein, 136 aa, Xenorhabdus bovienii
  Coding DNA sequence: Name=SeqID_3524
  Gene classification: Gene name=Doc; Function=Prophage maintenance system killer protein; Function class=N Cell motility and secretion
  Homolog annotation: Query=23..119bp; Hit=23..119bp; Blast score=70; Percent Identity=42.0; E value=5e-13; Homolog= NMB0917 COG3654
MDIQFLSTEEVIEIQRKTLPNSGEPDVNKLEGALFRVQTLRDYEGCEDVFKFAAMYLIAIAKSHAFNDANKRTAFQATSIFLILNGFELNASFELVKLTILAAIGEADCDNTAFALKILSNYRNDLLEETVTGYGI

SEQ ID NO: 9633 - protein, 57 aa, Xenorhabdus bovienii
  Coding DNA sequence: Name=SeqID_3525
MEKVNDIQKITRQADNSKREPTDATNSIDDARSEAFRKALLHTQTKYADIIKALEDK

SEQ ID NO: 9634 - protein, 42 aa, Xenorhabdus bovienii
  Coding DNA sequence: Name=SeqID_3526
MSLTFSICTSFSVCVQISSTNKTVNVYNARLVTSHPWLGVMR

SEQ ID NO: 9635 - protein, 31 aa, Xenorhabdus bovienii
  Coding DNA sequence: Name=SeqID_3527
MEIAQRAGYLLIHKEDMQPMMKALESYKFNA

SEQ ID NO: 9636 - protein, 269 aa, Xenorhabdus bovienii
  Coding DNA sequence: Name=SeqID_3528
  Gene classification: Function=Prophage antirepressor; Function class =K Transcription
  Homolog annotation: Query=49..230bp; Hit=16..192bp; Blast score=100; Percent Identity=31.0; E value=2e-21; Homolog= Z1818 COG3617
VSLYHCKTVKPPTGGTVRASYTTSNIISRKIDMLSIPVNEPSKTINVPFHGSDLYVVNYNGEPYVPMKPIVDGMGLAWQSQLEKIKQRFKSTVTEIVIVAADGKKREMICIALRKLAGWLATISPNKVKASIRDKVIRYQDECDDVLYEYWTTGEVKAKTKTTVQQRNPLKNAVNLLVSKKGIMYPEAYSLVHQRFNVEHIDELTADQLPQAIEYVHKMAMEGEYLGKEELPVLHGYSGFSGKLLMELENGEVVLFLSTDTKSPCSDHK

SEQ ID NO: 9637 - protein, 33 aa, Xenorhabdus bovienii
  Coding DNA sequence: Name=SeqID_3529
VIVTFCKDNLCEFGKCFVNQIYSELIDCINNVM

SEQ ID NO: 9638 - protein, 252 aa, Xenorhabdus bovienii
  Coding DNA sequence: Name=SeqID_3530
  Gene classification: Function=Uncharacterized phage-encoded protein; Function class=S Function unknown
  Homolog annotation: Query=119..251bp; Hit=101..228bp; Blast score=67; Percent Identity=32.0; E value=1e-11; Homolog= Z1797 COG3645
VNIANNNLPVIAGVEITTDSEGRFNLNALHKASGGENAKRPSLWLNNKQVQELIDELSKNSCLGQEVIKSVRGGTTPGTFAHELLAVSYAGWISPSFQLQVNQTFIDYRSGKLVDQVQVQIPQSLPEALRLAADLAEQKAELEHKVEEMKPDVAALERIAKSDGSMCVTDAAKQLQVKPKSLFDLMSHNKWIYRRMGTPWVGYQEKIQQRLIEHKVTVVIKPDGEEKTVSQVRITPKGISKLAKILSVDKAA

SEQ ID NO: 9639 - protein, 43 aa, Xenorhabdus bovienii
  Coding DNA sequence: Name=SeqID_3531
MREQEVWLNKDETSKAATNEASKSSNREKQLKITSTLTKRVTK

SEQ ID NO: 9640 - protein, 58 aa, Xenorhabdus bovienii
  Coding DNA sequence: Name=SeqID_3532
  Homolog annotation: Query=4..58bp; Hit=3..57bp; Blast score=61; Percent Identity=58.0; E value=3e-09; Homolog= ref|NP_930118.1|
MNANVDAKKKSEVMQLRTTKFLKDQVCSLSERDGISKNSVMNQAIAWYVNERARSVAQ

SEQ ID NO: 9641 - protein, 38 aa, Xenorhabdus bovienii
  Coding DNA sequence: Name=SeqID_3533
LAFITFFSPQMMSICYYHLFRDKLEGDKNDEKARGGSR

SEQ ID NO: 9642 - protein, 101 aa, Xenorhabdus bovienii
  Coding DNA sequence: Name=SeqID_3534
  Homolog annotation: Query=1..48bp; Hit=3..50bp; Blast score=66; Percent Identity=81.0; E value=9e-11; Homolog= ref|NP_930119.1|
MTKKLVAAQDKFMLRLPDGMREAVAKRADENGRSMNSEIVQILQDALDVSVSPIDSSMSPEDAAATFQSEVEEFKRLLSKKEEDIMKVAKVFAQWAAQKEK

SEQ ID NO: 9643 - protein, 53 aa, Xenorhabdus bovienii
  Coding DNA sequence: Name=SeqID_3535
MLMYIPGAILILFLNLRPIITPHYIVLFRIFLILIVQSNEMFNDQDFDHQGQT

SEQ ID NO: 9644 - protein, 91 aa, Xenorhabdus bovienii
  Coding DNA sequence: Name=SeqID_3536
  Homolog annotation: Query=1..66bp; Hit=1..66bp; Blast score=73; Percent Identity=46.0; E value=8e-13; Homolog= ref|NP_286700.1|
MGLKFRKRIKIAPGIYINISKSGVSTSIGGKGATINIGKKGTKATLGIPGTGLSYSTKMTDGKRKQKTKTQKFFSFVLYVILFFFFYNLIK

SEQ ID NO: 9645 - protein, 135 aa, Xenorhabdus bovienii
  Coding DNA sequence: Name=SeqID_3537
MKRILIACAALTLIGCGDNYSEYNGIYTCKVGRLMNYVAVDRGSEYSFPLGTVKARMIFNNGVMIINGMKSGDYVGHEMALTALPVAQDGRKLMFKYDDGELSEDFSPHDGIATITIGNPRNDGIMLRLINCKKE

SEQ ID NO: 9646 - protein, 96 aa, Xenorhabdus bovienii
  Coding DNA sequence: Name=SeqID_3538
  Homolog annotation: Query=1..96bp; Hit=1..96bp; Blast score=165; Percent Identity=95.0; E value=2e-40; Homolog= ref|NP_929772.1|
MDSKLFSRLTESMTQMNEIMNGERAASRETTIEAVKVKNIRQATGLSQTGFAKLISVNVGTLRNWEQGRREPTGPAKALLKAIEKDPVHVLKALSM

SEQ ID NO: 9647 - protein, 103 aa, Xenorhabdus bovienii
  Coding DNA sequence: Name=SeqID_3539
  Homolog annotation: Query=1..103bp; Hit=1..103bp; Blast score=187; Percent Identity=93.0; E value=2e-47; Homolog= ref|NP_929773.1|
MIFIETHIFTEDCKELLSDDEYREFQQYLADNPATGDVIQHTGGLRKVRWASRGKGKRGGVRVIYYHKVDVSHIRLLLIYKKGIKDGLSESEKKVLRALNEGW

SEQ ID NO: 9648 - protein, 54 aa, Xenorhabdus bovienii
  Coding DNA sequence: Name=SeqID_3540
MSLNEYHVSVRHWCMHRVIIALLLYKSIAYDGRVWIVKSPVGAVLYTLKSHVSL

SEQ ID NO: 9649 - protein, 143 aa, Xenorhabdus bovienii
  Coding DNA sequence: Name=SeqID_3541
  Homolog annotation: Query=1..139bp; Hit=1..137bp; Blast score=173; Percent Identity=60.0; E value=5e-43; Homolog= ref|NP_930173.1|
MQFTPWNPNPKAAQRVNDPLPVPTQCRHCRSHVKIAHHTEVFGKTRHDDKWPWFYVCWSCDARVGMHPETDIPLGYLADEPTRRARRSGKQEFEEMRKRGNFERTEAYRWLAWRLGISINKCHFGWFNAEMCEKATNICRGFK

SEQ ID NO: 9650 - protein, 187 aa, Xenorhabdus bovienii
  Coding DNA sequence: Name=SeqID_3542
MTDFTSLADGGELSRETWADFVKRLEYQHKGEGVDRHGTAHPSFTVREKVRLTGSEDDEVGIYYDWGAYYSLENALAHLDDEQKQKIFNYATEEFLDDLDNLDDIDKAKCIVSVLEDSYIFYWKYDYKTINTHLTREAAERFIARKQHDYGELSVYVESFYWCWEMRTLIEGVLTRKIKYTGDGNDK

SEQ ID NO: 9651 - protein, 56 aa, Xenorhabdus bovienii
  Coding DNA sequence: Name=SeqID_3543
MTNKRRFNLWQWIWLQVWNLSEWSGIGLGRFASWVFHQMIGCNYPVKKIKSGDNND

SEQ ID NO: 9652 - protein, 64 aa, Xenorhabdus bovienii
  Coding DNA sequence: Name=SeqID_3544
MTDSDLCREAFEKFMVDGFNYPIDSLGKYDDGTYWNMPAQNYWEIFQAAWNASRENIIKQESQK

SEQ ID NO: 9653 - protein, 97 aa, Xenorhabdus bovienii
  Coding DNA sequence: Name=SeqID_3545
MSKDVIEKINTTLESAEEFKSEGASTIILDLDVYITILKRLAKYENMEPVARGRITGMFRIMDTTTLPVIVSEWIGFNESHPDIADDIFPLYRHPNK

SEQ ID NO: 9654 - protein, 38 aa, Xenorhabdus bovienii
  Coding DNA sequence: Name=SeqID_3546
MLVNGGFRFWSAWDTVNSTASLAVSIISMMVLYLLGWR

SEQ ID NO: 9655 - protein, 238 aa, Xenorhabdus bovienii
  Coding DNA sequence: Name=SeqID_3547
  Gene classification: Gene name=XerC; Function=Integrase; Function class=L DNA replication, recombination and repair
  Homolog annotation: Query=3..179bp; Hit=15..198bp; Blast score=86; Percent Identity=30.0; E value=2e-17; Homolog= Z1835 COG0582
MALSDTKLRGIHDKPYKGTPELTDGDGLSVRITPNGTITFQHRYRWNGKPVRLTVGRYPEMSLKDARIAVGEMRSLYAKGLDPKMYFSHSEGEATLKDCLDYWWDKYASTLKPNTQILYKSVVYNTMYTQFLCTPVASIPVSSWVKFFDKQEKENPKKARVLLTQMRSVVNWCIGRQFSDCWLLRCWLSYYMPWRISQYQAVFLFHLSAYPAHNPLRTPDYRMHRVLLAQSHTIGTFR

SEQ ID NO: 9656 - protein, 392 aa, Xenorhabdus bovienii
  Coding DNA sequence: Name=SeqID_3548
  Gene classification: Gene name=XerC; Function=Integrase; Function class=L DNA replication, recombination and repair
  Homolog annotation: Query=1..385bp; Hit=1..382bp; Blast score=507; Percent Identity=63.0; E value=1e-143; Homolog= intC COG0582
MLTIKQIESAKSQDKAYRLVDGGGLFLFVSKTGSKIWRFRYRKNGKEQTHVIGTYPEISLVTARLKHAEAKSILANGGDLIPVVPKQKDIETPDTFAAIYNEWYQFKRAVWSERYAKELQSMFQADILPSIGHMTIKEIEPMVLLKVIRQFEERGAMERASKARHRCGEVFKYAIVTGRAKYNPAPDLAGAMTGYKKKHFPFLTADQIPSFNLALSSYSGSIISKVATQVLQYTALRTNELRSMKWSDVDFDNKLITINADIMKNRKVHVVPMSNQVIALLKTLYPITSSISNFVFAGRNDKKKPICENAVLQVIRQIGYDGIASGHGFRHQFSTILNEHGFSHDLIERQLAHVDRNSIRGIYNHAQYLDKRRKMMQWFADYIDEISTATTT

SEQ ID NO: 9657 - protein, 44 aa, Xenorhabdus bovienii
  Coding DNA sequence: Name=SeqID_3549
MRYRPLRLPEREAGDCRTVRREATVTIGQKPALKMGYHTLRQPW

SEQ ID NO: 9658 - protein, 54 aa, Xenorhabdus bovienii
  Coding DNA sequence: Name=SeqID_3550
LTTRDISSVNSSLFQLLGKSQWLLYVLDKRNKCIVFQCVNCAQGVGQADAKSVV

SEQ ID NO: 9659 - protein, 54 aa, Xenorhabdus bovienii
  Coding DNA sequence: Name=SeqID_3551
LAQFQSDKFLADRANWDLKAHLSENAHFDDNSLIFNQTTDLASACPTPCAQLTH

SEQ ID NO: 9660 - protein, 68 aa, Xenorhabdus bovienii
  Coding DNA sequence: Name=SeqID_3552
MKLSRLADSSGIPSILQNVPLGRSILIPPHWKSGFTVSPHLVTVNARRELMSTAYPKVSVPPPRTTPV

SEQ ID NO: 9661 - protein, 49 aa, Xenorhabdus bovienii
  Coding DNA sequence: Name=SeqID_3553
MLRPSGTFWRIEGIPDESASLLNFIDRNNDGSNRSVQTLPNPPTSVGGS

SEQ ID NO: 9662 - protein, 127 aa, Xenorhabdus bovienii
  Coding DNA sequence: Name=SeqID_3554
  Homolog annotation: Query=1..125bp; Hit=189..313bp; Blast score=147; Percent Identity=60.0; E value=2e-35; Homolog= gb|AAO17169.1|
LALIACKIAEHYPTAKFIISALPNDIHLAENLTLRISKNSQIVISNSLNEFLILLNNMTLIVVGDGGICHLAAALQKKIVALYGITKPENWAPLATEEICITLYDPEDVNNINLDKVNNAIFSLLEK

SEQ ID NO: 9663 - protein, 61 aa, Xenorhabdus bovienii
  Coding DNA sequence: Name=SeqID_3555
MIQVQHCYERSKQFSIPWNNSLAAFDFLTFLPNIGSLIDFYQWRYSPNAMIPEFITCLNKK

SEQ ID NO: 9664 - protein, 88 aa, Xenorhabdus bovienii
  Coding DNA sequence: Name=SeqID_3556
MGKFYQVGDIPKYIICCKIFYKEINSDESLKKFNYTLPICVIGYFLGIKVQECKELVNKIIDFIQCIVLNSDKQRITESIIASEYLYV

SEQ ID NO: 9665 - protein, 30 aa, Xenorhabdus bovienii
  Coding DNA sequence: Name=SeqID_3557
MILPENRLNYSIDNFTTSLLCRTKYSFRYG

SEQ ID NO: 9666 - protein, 300 aa, Xenorhabdus bovienii
  Coding DNA sequence: Name=SeqID_3558
  Gene classification: Gene name=PrpB; Function=PEP phosphonomutase and related enzymes; Function class=G Carbohydrate transport and metabolism
  Homolog annotation: Query=39..282bp; Hit=12..254bp; Blast score=115; Percent Identity=30.0; E value=5e-26; Homolog= CC1903 COG2513
MNINILITSIAVEKYSTKNKSPRETNMQTVILNEKIQIFRQLHEEGRLILANSWDVMSSRLAEQSGAKAIATTSSGISWSLGYPDNQFADRKLVMKALGLITGCTNLPVSADIEDGLLGIDENMDHLVQDLYSVECVGINIEDAQNGKSMSIEDGAERIAAVRTSANKLNYNLFINARIDSWLRGENTEPAHLISRANAYLAAGADCIFIPGLTDLAICQTISTHINGPLNVMAHSGAPSAEEFFAAGVKRISGGSFFAEQAYGITLSSMENFVRNGMLQPNDKAKLNYMALNALLAQKE

SEQ ID NO: 9667 - protein, 52 aa, Xenorhabdus bovienii
  Coding DNA sequence: Name=SeqID_3559
MLYWLRKNNQYVAGNMAFYPATLNNNLKHLEYSFLYYNLSMKLKYQFYSINN

SEQ ID NO: 9668 - protein, 125 aa, Xenorhabdus bovienii
  Coding DNA sequence: Name=SeqID_3560
  Gene classification: Function=Predicted Fe-S-cluster oxidoreductase; Function class=R General function prediction only
  Homolog annotation: Query=13..122bp; Hit=2..109bp; Blast score=127; Percent Identity=59.0; E value=2e-30; Homolog= ykgJ COG0727
MASGMSQTLTSQSNLQDNPCISCGACCAYFRVSFYWAEAEDGGGTVPVSMTEKLNAFMSCMKGTNEPNPRCINLRGEIGQSVSCAIYDKRPSPCREFTQAWETDDYNEACDRARAAHGLPPLPKS

SEQ ID NO: 9669 - protein, 43 aa, Xenorhabdus bovienii
  Coding DNA sequence: Name=SeqID_3561
LPEILILNFCWISKAFLITEKTTDSLILLWINITMRKYYDEKS

SEQ ID NO: 9670 - protein, 109 aa, Xenorhabdus bovienii
  Coding DNA sequence: Name=SeqID_3562
  Gene classification: Gene name=AnsB; Function=L-asparaginase/archaeal Glu-tRNAGln amidotransferase subunit D; Function class=E Amino acid transport and metabolism
  Homolog annotation: Query=2..108bp; Hit=232..338bp; Blast score=155; Percent Identity=71.0; E value=9e-39; Homolog= ZansA COG0252
MQPVKALILRSYGVGNAPQHADLLKILREATERGIIVVNLTQCISGRVNMEGYATGHALATSGVISGYDMTFEATLTKLHYLLSQSYESEEIRHLMQQNLRGELSYSDE

SEQ ID NO: 9671 - protein, 93 aa, Xenorhabdus bovienii
  Coding DNA sequence: Name=SeqID_3563
  Homolog annotation: Query=13..93bp; Hit=66..146bp; Blast score=136; Percent Identity=79.0; E value=7e-32; Homolog= ref|NP_931589.1|
MKTALLLIDLQNDYRDSSEIEDKPDRVWRGANYHHAPANPLSKEVDANLEKLGQELLEQFDAQAFMLRLYELLPINNPAYKQLANLLMQPEKG

SEQ ID NO: 9672 - protein, 163 aa, Xenorhabdus bovienii; identical to SEQ ID NO: 7546
  Coding DNA sequence: Name=SeqID_3564
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 9673 - protein, 48 aa, Xenorhabdus bovienii
  Coding DNA sequence: Name=SeqID_3565
MEEANLLVGQRIQAKRKELSMTATSLAKKIGISQQQLSRYKQEKIGLI

SEQ ID NO: 9674 - protein, 66 aa, Xenorhabdus bovienii
  Coding DNA sequence: Name=SeqID_3566
VPLPSKGVFFYDTNCILCFGVTLHLSTSSPVTGLNSIFILLTRGITNLLPNFFLMVIYVILNLLRY

SEQ ID NO: 9675 - protein, 81 aa, Xenorhabdus bovienii
  Coding DNA sequence: Name=SeqID_3567
MAGWRDIFFGGGVGRNRSWKWNYSLHLSNGGFIGGFHSPQSHRYLCNWGFTHLPLRCILLNVACWSAISTSSSLSRVVTHV

SEQ ID NO: 9676 - protein, 307 aa, Xenorhabdus bovienii
  Coding DNA sequence: Name=SeqID_3568
  Homolog annotation: Query=1..305bp; Hit=1..305bp; Blast score=520; Percent Identity=83.0; E value=1e-146; Homolog= ref|NP_931361.1|
MNINPVMPLIRLFREEDSTGVSALFRVVYGEDYVYPEVYLPTMLSRYNAARHWYSAVAIQDGQVLGHATLWRNGRCPSSAELALIAVHPQARGQGIATALGRYLCDQAKEMGLGILTIKQVSSHNHSQRLAQNLGFHTTGLLPDYVTSPFDQARPESIVLGCLPLQRWPFPELHWPVNWQTWLTSVTQIFGQEPLKPAVPIDTGISIASHGGRLEVWIETQTTERVKEVTELPAHKLIYVKLPVGEETLHAVQILQQAGFACTGFVPGHHHRWEVLLVRGHSRKELALSCQFAHNLHQQSLFACAER

SEQ ID NO: 9677 - protein, 423 aa, Xenorhabdus bovienii
  Coding DNA sequence: Name=SeqID_3569
  Gene classification: Gene name=PaaK; Function=Coenzyme F390 synthetase; Function class=H Coenzyme metabolism
  Homolog annotation: Query=2..417bp; Hit=20..440bp; Blast score=77; Percent Identity=24.0; E value=2e-14; Homolog= BH0195 COG1541
MTLSLHDLVEYARHHAPFFRDLYNDLPQSGWALTDLPLIDPAAYWQQSQPLENWPVLTGPINSGHIFKTGGSTSEGRLSVFSRSEWQAFVRSFGQGLAQQLQSGDRVANLFFAGDLYTSLLFIHGALSHSPVPVVEYPFTCSVDDQALADAIVSLGINVLAGVPVQLLRFASTLQRSGQFMPNIDRLLYGGESLFPEQLALLNIVFPNARIGSIGCASVDAGLIGAASPDCHHGEHRVFDEDSIVEIIDESNGQPITESGRNGMLVVTNLQRRLMPVIRYPTGDLACWCEEPGRLNRKFALQGRAGSAHRIRVSTLSLFPDQIARLLQQQKGILAWQLLLSRQDGIDKIKLLLASDSPQMPSTASIHQALVTAQPAMAELCSQGVLQVEVASCALENMVTHPRSGKLIRVVDHRCYNAEEKTA

SEQ ID NO: 9678 - protein, 801 aa, Xenorhabdus bovienii
  Coding DNA sequence: Name=SeqID_3570
  Gene classification: Gene name=PaaK; Function=Coenzyme F390 synthetase; Function class=H Coenzyme metabolism
  Homolog annotation: Query=438..775bp; Hit=56..392bp; Blast score=92; Percent Identity=24.0; E value=3e-18; Homolog= AF1671 COG1541
MYLVNGEVISNLEPAAALADLKNRLADALACPPTVQEVLDCAERFASSLKTMATDFALDATTISTLHHFCRRDALEEKLRHELGEQPFSLRRFDYTQPRFETWQPLGLVVHITPANAPLLPFMAVLESLLVGNINWLRPSSSDNGLNARILAEFLRHDLSGKLASYVSVLPLPSDQLSELLACADAVSAWGSNAALTAIRSQLRPGCRWIDWGHRISFAYLDPMVASNADYDALADDVCRFDQQACSSPQCLLVDSTDENVLREVADAVASALERRAPVWPALQPDIQEAAEISSQMAFLRLDHTFADVAGSVTEGTGWRVAWTQRQELAASPLYRTLQIRPVPRAQLINVLLPWRPYLQSCGLIAGEHELPALSRQLLAAGVSRICQAGAMHEGYEGEPHDGVYALTRLARRVSVSVKAEQLPNHVTLDKLSIRPPDLAGLPIMGKEQFQQSGTTPKAQVFFRSGGSTGAPKLAGFSHRDYHIQMQAAADGLFSAGLDPAQDRVINLLYGGNLYGGLLSFFTVLDKLSVPHYPMGGPIDDDFSQILQVIVTQGVNTLVGMPSTIYQLFEREEAALRAYGGVRKIFAGGEHVSEERHQFLSSFGVQVIRSAIYGSVDAGPLGHACTCCNEGEFHLLSDIQWLEILDLDSEQPVQSGETGRLVFTPLAREGQVVQRYEVGDLGHWLSEPCTCGLSTPRFRLEGRHGGLIRVGSIFVNPTALSADLAFPVQWLVGNLDKGGEYIHVLADGDVNQVRQHLLQHEMLNQVVSGELLQLEITSTPAGQFRRHSQSGKTPLVLDYRV

SEQ ID NO: 9679 - protein, 346 aa, Xenorhabdus bovienii
  Coding DNA sequence: Name=SeqID_3571
  Homolog annotation: Query=1..346bp; Hit=31..376bp; Blast score=654; Percent Identity=89.0; E value=0; Homolog= ref|NP_931364.1|
MRELTRYHCENSPGYHQWLKVNGLDDKKLEKLHDWSRLPPIFANYFKHQLLLSHTGIDALELTSSGTTGQKSRMRYDTRSIQAAQRMVERIFEYYGWNTPQQPCNYILLSYEPAGAITLGTAYTDQYLCQYAPVSQACYALRHNGKSNEFDPFGVIRALQEFAAQGLPVRFLGFPAFLWFTLERMREMNLPPLQLHPESLVFLGGGWKTHADKAIPRSLLYQRLNEQLGIPDERCRDGYGSVEHPVPYVECQNHHFHVPSYARAYVRDTANMAVQSYGKPGFLHLTSPYITSSPAHSIVVSDLAVLHPAAECGCGLATDWFELLGRAGTSKSRSCAIAASELIKES

SEQ ID NO: 9680 - protein, 57 aa, Xenorhabdus bovienii
  Coding DNA sequence: Name=SeqID_3572
LACHRLIPYRVFRDDKVIATLLYILAIHSMMKISIAPASHNERYGYNVQYRPRWATD

SEQ ID NO: 9681 - protein, 77 aa, Xenorhabdus bovienii
  Coding DNA sequence: Name=SeqID_3573
MQSWRFCGYRRKKTPVGRVPLSVAELRKLLSKLMEKAGKTIEQILHWSDWRRRHQYRAQQCHCRRRGNHRLTEQLRL

SEQ ID NO: 9682 - protein, 170 aa, Xenorhabdus bovienii
  Coding DNA sequence: Name=SeqID_3574
  Homolog annotation: Query=32..164bp; Hit=254..385bp; Blast score=103; Percent Identity=45.0; E value=2e-21; Homolog= ref|NP_821294.1|
VLAIPCNTPLWWRGPEYIRVDRIADTLTAADWKTRSAGTGTKGEREYDWAVVPLWRLQLSEEDRHYGHYLLVRRSRDSRQERAYYVVYALREQVDLNTLVQVAGCRWEIESGFEETKGECGLDHYEVRRWQSWHRHITLSLLAHAVLAVLRVQEKKNTGRPGSAQCSGTP

SEQ ID NO: 9683 - protein, 216 aa, Xenorhabdus bovienii
  Coding DNA sequence: Name=SeqID_3575
  Homolog annotation: Query=8..215bp; Hit=12..219bp; Blast score=220; Percent Identity=54.0; E value=1e-56; Homolog= ref|NP_821845.1|
MPSPAKIWEQALQALHTRLAPLFHSTGSRQRSLAYLRGLLSDVERKNSWQLAEWMGENTPDGIQYLLERADWDVDMARDILRDYVTEHLGDEQGVLIIDETGFIKKGTHSAGVQRQYSGTAGRVENSQIGVFLCYAGNGGHAFVDRALYLPRQWTDARSRCEAAGIPASVTFATKPPLARQMLERTWDAGVPCRWVTADEVYGRDRRLRVWLESRY

SEQ ID NO: 9684 - protein, 150 aa, Xenorhabdus bovienii
  Coding DNA sequence: Name=SeqID_3576
  Gene classification: Function=Predicted transposase; Function class=L DNA replication, recombination and repair
  Homolog annotation: Query=1..126bp; Hit=1..117bp; Blast score=99; Percent Identity=44.0; E value=8e-22; Homolog= mll8100 COG3293
MARYDIPDDAWIVVEPCLPPVHSERAGRPHVEHRRVMNGMFWVLCSGAPWRDLPERYDPWKTVYNRFNRGSKSGIINKIFNRLLSILDEKGLIDWAEICLDGSNIRASKDAAGAKKNIPISPTIMRWVAHAVVMAPKSTWQPTERVFPST

SEQ ID NO: 9685 - protein, 129 aa, Xenorhabdus bovienii
  Coding DNA sequence: Name=SeqID_3577
  Gene classification: Function=Predicted transposase; Function class=L DNA replication, recombination and repair
  Homolog annotation: Query=2..125bp; Hit=139..248bp; Blast score=74; Percent Identity=40.0; E value=3e-14; Homolog= mll8100 COG3293
MLTAGQAHESQSAIPLLDGIGIQRKNGFMKRRGKAVLADKGYSGGKLRGYLRKLRIKSIIPYKINEKGSTDGRTQFDEQAYRDRNVVERCFGFLKGNRRIATRYEKTARNFLSRVKLGCIRLFYRRLSN

SEQ ID NO: 9686 - protein, 321 aa, Xenorhabdus bovienii
  Coding DNA sequence: Name=SeqID_3578
  Gene classification: Gene name=Tra5; Function=Putative transposase; Function class=L DNA replication, recombination and repair
  Homolog annotation: Query=38..302bp; Hit=64..327bp; Blast score=184; Percent Identity=40.0; E value=8e-47; Homolog= Rv3430c COG2801
LTVALKEIPLSLRTWRRWQKSPEDRRPLAVRPKSANRLTPEEEQQILAVCHQPEYASLPPSQIVPRLADNGVYLACESTFYRVLRRQGEVHHRGRKRTAHKRGKPTTWEATAPNQLWAWDITWLPSTVKGRWFYLYMIMDIFSRKIVGYEVHEAESGELAATLVQRTVWKEKCWREPLILHADNGAAMKSQTLQVKLQELAITPSHSRPRVSNDNAYAESLFRTLKYVPTWPEGGFRDLTQARVWGNNFTNWYNEEHRHSGINYVTPGQRHRGEDKMILKQRDAVYRQAKLIHPERWSRSTRNWQWVETVTLNPEREKRVA

SEQ ID NO: 9687 - protein, 160 aa, Xenorhabdus bovienii
  Coding DNA sequence: Name=SeqID_3579
  Homolog annotation: Query=13..160bp; Hit=1..148bp; Blast score=204; Percent Identity=80.0; E value=3e-52; Homolog= ref|NP_405438.1|
MTRISPERKSAALAKLLPPYNMTVAAVAQMEGISEATLYNWRNQAKAEGKPVPGADKTPKQWPAEARLAVIIETATFSATELAEYCRKKGLYPEQIQQWKQAFLQVPARDDKAALKQSQKENKQLKRELARKEKALAEAAAILVLRKMLQAHFGTDNEED

SEQ ID NO: 9688 - protein, 173 aa, Xenorhabdus bovienii
  Coding DNA sequence: Name=SeqID_3580
MPSICATAATVMLYGGNNLASAADLRSGEIRVIFFSISVVNGDDNYADRKGPSEDSNEVKEVIISLICVIITLLSIPSRGIFACSFTSPNNPRINVISSRVRQLSSTSCLIGTVRSLKVRISNLSIFAINLPKSAQSVKKEYTPPDLIDSDGELEVLNPDMACTRMDHSKPVN

SEQ ID NO: 9689 - protein, 146 aa, Xenorhabdus bovienii; identical to SEQ ID NO: 8316
  Coding DNA sequence: Name=SeqID_3581

SEQ ID NO: 9690 - protein, 178 aa, Xenorhabdus bovienii; identical to SEQ ID NO: 8288
  Coding DNA sequence: Name=SeqID_3582
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 9691 - protein, 125 aa, Xenorhabdus bovienii
  Coding DNA sequence: Name=SeqID_3583
MSVWSQSSFLKKFEGLYTFKEANSIQGKPTLITASLKDCPVIIKYWPHEYHEPSDILEDIWLYEIRQLRRLKGYPGLGDYIANLIDTGKDEYGFYLVLDAGNRLPLSYFLQKPIQQRTLSIHWLK

SEQ ID NO: 9692 - protein, 43 aa, Xenorhabdus bovienii
  Coding DNA sequence: Name=SeqID_3584
MFILAISASKSAQMYHNSCTPFQATGVFLVARKRFLSDLWKHW

SEQ ID NO: 9693 - protein, 47 aa, Xenorhabdus bovienii
  Coding DNA sequence: Name=SeqID_3585
MKCSVRFTALLSRHEPVIVMLSFCCGVTFSGKSAKSDALSPANSQQK

SEQ ID NO: 9694 - protein, 51 aa, Xenorhabdus bovienii
  Coding DNA sequence: Name=SeqID_3586
MQAAVQRTQPIPRNTSTRVYSGAQISVKDKAGVSCFVSIVARQRLHVVRYK

SEQ ID NO: 9695 - protein, 293 aa, Xenorhabdus bovienii
  Coding DNA sequence: Name=SeqID_3587
  Homolog annotation: Query=1..289bp; Hit=4..292bp; Blast score=355; Percent Identity=64.0; E value=7e-97; Homolog= ref|NP_404706.1|
MSRLIKELKFFARQGGGSHKTCHDRTRIAGRLGALLLSLNIQVKSLSHLKAKHVEHYVDARLSQGIAKRTVQNEMSALRNIFRMAGREKLETSPRLSNQALGLSGTSRAGTKQTIPDATFQVVYQKALEHDAGFAVTLKLARLMGLRSQEAVQCSASLKSWRKQLEQPEPKLHVVFGTKGGRPRQTRVLNVAAVKEAVEQAIAIAEQRGGRLIDKPDLRQAMNYWRTHTTRIGLTGRHSPHSLRYAWAQDALAFYQQNGFSRQEARALVSMDLGHGDGRGRYVERVYSQGGLE

SEQ ID NO: 9696 - protein, 62 aa, Xenorhabdus bovienii
  Coding DNA sequence: Name=SeqID_3588
METLTFIRLDYVMQKTGLEKSQIDHLIRQGNFLKPRKLGIRSMLWIAEEVDEWAANKVRKTT

SEQ ID NO: 9697 - protein, 62 aa, Xenorhabdus bovienii
  Coding DNA sequence: Name=SeqID_3589
MVAIQTGFAIPGAIVRRGRSLPYLNRHRKGERRHTGRNILPVDSSTGLQIPDHWILPMERLL

SEQ ID NO: 9698 - protein, 122 aa, Xenorhabdus bovienii
  Coding DNA sequence: Name=SeqID_3590
  Gene classification: Gene name=Nlp; Function=Predicted transcriptional regulator; Function class=K Transcription
  Homolog annotation: Query=42..106bp; Hit=7..71bp; Blast score=93; Percent Identity=72.0; E value=3e-20; Homolog= sfsB COG3423
MAVQVGEASASPDDSSRYCKPCLNRHHQSMEEVAGMINIQNDWHSADIIGALRKRGTTLAAVSREAGLSSSTLANVLSRPWPKGEWIIADYLGIHPSEIWPSRYFDRNGQLIERKARKQLVL

SEQ ID NO: 9699 - protein, 44 aa, Xenorhabdus bovienii
  Coding DNA sequence: Name=SeqID_3591
MRKQNERKLENKEKAMRTKTVSLLSQSLKFQIVTFFLIKNFLQN

SEQ ID NO: 9700 - protein, 98 aa, Xenorhabdus bovienii
  Coding DNA sequence: Name=SeqID_3592
  Gene classification: Gene name=Fis; Function=Factor for inversion stimulation Fis, transcriptional activator; Function class=K Transcription
  Homolog annotation: Query=1..98bp; Hit=1..98bp; Blast score=162; Percent Identity=98.0; E value=8e-41; Homolog= fis COG2901
MFEQRVNSDVLTVATVNSQDQVTQKPLRDSVKQALKNYFAQLNGQDVNDLYELVLAEVEQPLLDMVMQYTRGNQTRAALMMGINRGTLRKKLKKYGMN

SEQ ID NO: 9701 - protein, 327 aa, Xenorhabdus bovienii
  Coding DNA sequence: Name=SeqID_3593
  Gene classification: Function=Predicted TIM-barrel enzymes, possibly dehydrogenases, nifR3 family; Function class=R General function prediction only
  Homolog annotation: Query=1..320bp; Hit=1..320bp; Blast score=573; Percent Identity=85.0; E value=1e-164; Homolog= yhdG COG0042
MRIGQYQLKNCLIAAPMAGITDRPFRSLCYDMGAGMTVSEMLSSNPQVWKTDKSRLRMVHRDESGVRSVQIAGSDPDEMAAAARINVANGAQIIDINMGCPAKKVNRKLAGSALLRYPELVQAILSAVVNAVDVPVTLKIRTGWSPEERNCVEIAQLAERCGIQALTIHGRTRSCLFNGEAEYDNIRTVKQTVAIPIIANGDITDPLKARAVLEYTGADALMIGRAAQGRPWIFREIQHYLETGELLPPMPLGEVQHLMSEHVRELHDFYGQGKGVRIARKHVSWYLKEHAPDDQFRRTFNAIEDASEQLEALEAYFENFCVNKEKS

SEQ ID NO: 9702 - protein, 293 aa, Xenorhabdus bovienii
  Coding DNA sequence: Name=SeqID_3594
  Gene classification: Gene name=PrmA; Function=Ribosomal protein L11 methylase; Function class=J Translation, ribosomal structure and biogenesis
  Homolog annotation: Query=1..292bp; Hit=1..292bp; Blast score=446; Percent Identity=80.0; E value=1e-125; Homolog= prmA COG2264
MPWIQLRLNTTGQQAEALGDELMESGAVSVTFQDSHDTPIFEPLPGETRLWGDTDVIGLYDAEMDMKAVVSQLEQVPQLGKGFLHKIEQLEDKDWEREWMDNFHPMCFGNRLWICPSWREVPEPDAVNVMLDPGLAFGTGTHPTTSLCLQWLDGLDLTDKTVIDFGCGSGILAIAALKLGAKHAIGIDIDPQAIQASRDNAERNGVSAQLTLYLSKDQPADLKCDIVIANILAGPLRELAPIIGSLPKSGGLLGLSGVLASQAEGVAQAYSNEFIIDPIAEQEEWCRITGIKK

SEQ ID NO: 9703 - protein, 483 aa, Xenorhabdus bovienii
  Coding DNA sequence: Name=SeqID_3595
  Gene classification: Gene name=PutP; Function=1 Na+/proline, Na+/panthothenate symporters and related permeases; Function class=E Amino acid transport and metabolism
  Homolog annotation: Query=1..479bp; Hit=1..479bp; Blast score=639; Percent Identity=79.0; E value=0; Homolog= panF COG0591
MIMQTEVILPLVGYLALVFLLSIYAYRRRQTGEFLNEYFLGNRSMGGFVLAMTITATYISASSFIGGPGAAYKYGIGWVLLSLIQLPAIWLSLGVLGKKFAILARRYNAVTLNDMLYARYQSRFLVWFASLSLLVAFIGAMTVQFVGGARLLETAAGIPYDTGLLIFGISIALYTAFGGFRASVLNDALQGLVMLLGTVILLAGIIYKAGGLSKAVDTLRAIDPNLVSPYGADNILTGPFMASFWVLVCFGVIGLPHTAVRCISYRDSKAVHRGIIIGTIVMALLMFGMHLAGALGRAIIPDLTIPDQVIPTLMITVLPPVAAGIFLAAPMAAIMSTINAQLLQSSATIVKDLYLNLFPQQISQEKKLSRISSYSTLFLGMLLLLAAWRPPEMLIWLNLLAFGGLQAVFLWPLVLGLYWEKANAYGAIGSMIIGATSYTLLASFNIQIFGFHPIVPSLLFSLLAFGIGNMIGSRKCQQTAASQ

SEQ ID NO: 9704 - protein, 89 aa, Xenorhabdus bovienii
  Coding DNA sequence: Name=SeqID_3596
LSDCRENTHSKIRLFGGGGKHRLTAGKPTPDILPEVRSLQFALSSSNGTSLNINATINQQRMINRAGSSRQANSNQYGNPVKPVASLGK

SEQ ID NO: 9705 - protein, 61 aa, Xenorhabdus bovienii
  Coding DNA sequence: Name=SeqID_3597
MWRELYGNLRIYSGENVPEKLANRIVESNSGFICILKIIILLLYYDGGFSIFFVLLALRLI

SEQ ID NO: 9706 - protein, 449 aa, Xenorhabdus bovienii
  Coding DNA sequence: Name=SeqID_3598
  Gene classification: Gene name=AccC; Function=Biotin carboxylase; Function class=I Lipid metabolism
  Homolog annotation: Query=1..449bp; Hit=1..449bp; Blast score=789; Percent Identity=88.0; E value=0; Homolog= accC COG0439
MLEKIVIANRGEIALRILRACKELGIKTVAVHSTADRDLKHVLLADETVCIGPAASAKSYLNIPAIISAAEITCAQAIHPGYGFLSENADFAEQVERSGFIFIGPKAETIRLMGDKVSAINAMKTAGVPCVPGSDGSLGDDTEKNKAIAKRIGYPVIIKASGGGGGRGMRVVRSDKDLEQSIAMTRAEAKAAFNNDMVYMEKFLENPRHVEIQILADGQGHALYLAERDCSMQRRHQKVVEEAPAPGISAELRRTIGERCANACIEIGYRGAGTFEFLYENGEFYFIEMNTRIQVEHPVTEMITGVDLIKEQLRIASGLPLSIKQEDIVIEGHAIECRINAEDPKSFLPSPGKITHFHSPGGFGVRWESHIYAGYTVPPYYDSMIGKLITYGETREIAIARMKNALAELIIDGIKTNIDLQVAIMNDENFQKGGTNIHYLEKKLGLQEK

SEQ ID NO: 9707 - protein, 151 aa, Xenorhabdus bovienii
  Coding DNA sequence: Name=SeqID_3599
  Gene classification: Gene name=AccB; Function=Biotin carboxyl carrier protein; Function class=I Lipid metabolism
  Homolog annotation: Query=1..151bp; Hit=1..156bp; Blast score=184; Percent Identity=76.0; E value=4e-47; Homolog= accB COG0511
MDIRKIKKLIELVEESGISELEISEGEESVRISRIAAAQHMPMTQQYISAPVQQPVQTAAPAIPAAAEKPAEIIGHTVCSPMVGTFYRSPSPDAKAFIEIGQRVNQGDTLCIVEAMKMMNQIEADKTGVVRAILAQDGQPVEFDEPLVVIE

SEQ ID NO: 9708 - protein, 153 aa, Xenorhabdus bovienii
  Coding DNA sequence: Name=SeqID_3600
  Gene classification: Gene name=AroQ; Function=3-dehydroquinate dehydratase II; Function class=E Amino acid transport and metabolism
  Homolog annotation: Query=1..146bp; Hit=1..146bp; Blast score=201; Percent Identity=71.0; E value=2e-52; Homolog= VC0297 COG0757
MADKFRILLLNGPNLNLLGTREPETYGKLTLDNIVSKLSKEAHQSGVKLSHLQSNAESELIERIHTARGNTDFILINPAAFTHTSVALRDALLAVDIPFIEIHLSNVHAREPFRHHSYLSDIAVGVICGLGADGYSFALQAAVNRLSTFNSFT

SEQ ID NO: 9709 - protein, 329 aa, Xenorhabdus bovienii
  Coding DNA sequence: Name=SeqID_3601
  Gene classification: Gene name=Qor; Function=NADPH; Function class=C Energy production and conversion
  Homolog annotation: Query=1..323bp; Hit=1..323bp; Blast score=432; Percent Identity=66.0; E value=1e-121; Homolog= ZyhdH COG0604
MKALLLEQHETLSASIQNIDTSQLPSGDVVVDVHWSTLNYKDALAITGKGKIIRQFPMVPGVDFSGVVHHSEDPRFHIGQHVLLTGWGVGENHWGGLAEQARVSGEWLTPLPQGLSARQAMIIGTAGFTAMLCIMALEQGGVTPESGEIAVTGASGGVGSTAITLLSQLGYSVVAISSKTENQDYLLSLGAKTILPATDFNQPSRSLEKQRWAGVIDTIGGTVLATLLAQVHYNGTVAACGMASDSQLPTTVMPFILRNVRLQGIASVTVPAIKRPDIWKRLQKLLPDAFYQQATTEISLDQVVEYANKLINNQMTGRTLVKVADKTSI

SEQ ID NO: 9710 - protein, 34 aa, Xenorhabdus bovienii
  Coding DNA sequence: Name=SeqID_3602
MSRVAQVIRLSSLFSLDGFFISDTITILTSPQYR

SEQ ID NO: 9711 - protein, 46 aa, Xenorhabdus bovienii
  Coding DNA sequence: Name=SeqID_3603
MKQRQGASLTTFTTSIKVATLLFISDTQYSTLLFSNGAEKNCIKTG

SEQ ID NO: 9712 - protein, 340 aa, Xenorhabdus bovienii
  Coding DNA sequence: Name=SeqID_3604
  Gene classification: Gene name=MreB; Function=HSP70 class molecular chaperones involved in cell morphogenesis; Function class=D Cell division and chromosome partitioning
  Homolog annotation: Query=1..340bp; Hit=28..367bp; Blast score=615; Percent Identity=96.0; E value=1e-176; Homolog= mreB COG1077
MFSNDLSIDLGTANTLIYVKGQGIVLDEPSVVAIRQDRAGSPKSVAAVGSAAKQMLGRTPGNIAAIRPMKDGVIADFYVTEKMLQHFIKQVHNNSFMRPSPRVLVCVPVGATQVERRAIRESAQSAGAREVFLIEEPMAAAIGAGLPVSEATGSMVVDIGGGTTEVAVISLNGVVYSSSVRIGGDRFDEAIINYVRRNYGSLIGEATAERIKHGIGSAYPTDEVHEIEVRGRNLAEGVPRGFTLNSNEILEALQEPLTGIVSAVMVALEQCPPELASDISERGMVLTGGGALLRNLDRLLMEETGIPVIVAEDPLTCVARGGGKALEMIDMHGGDLFSED

SEQ ID NO: 9713 - protein, 32 aa, Xenorhabdus bovienii
  Coding DNA sequence: Name=SeqID_3605
MVAICSAKTERNSASWGAIMCYQSLLAVCSGV

SEQ ID NO: 9714 - protein, 344 aa, Xenorhabdus bovienii
  Coding DNA sequence: Name=SeqID_3606
  Gene classification: Gene name=MreC; Function=Rod shape-determining protein; Function class=M Cell envelope biogenesis, outer membrane
  Homolog annotation: Query=1..317bp; Hit=1..317bp; Blast score=387; Percent Identity=66.0; E value=1e-108; Homolog= ZmreC COG1792
MKPIFSSGSSLQLRLFLAVIIAIILVVVDSRFGFFNKVRSYMDTAVSPFYFLANGPRQFLDGISESLATRKHLEMENNTLRNELRLQNSKLLLLGQLKHENSRLRELLGSPVRRDEHMMVSQVISGGMDPYRDQIVIDRGAKDGVYEGQAVISDRGVAGQVISVSHLSSRVLLICDPTHGLPVQVMRNDLRVIAAGAGCTEDLHLEPMASDTDIRVGDVLVTSGLGGRFPEGYPVAVVSSVKIDNQRAHVVIRARPLAELRRLRYLLLLWGSGNDPSEPLPPSAVHRAANERLMQMLPEVLPNPLEEKPQLPTQDSGEGKEGNKEGNKVPSVTKPSSSATGNRQ

SEQ ID NO: 9715 - protein, 162 aa, Xenorhabdus bovienii
  Coding DNA sequence: Name=SeqID_3607
  Gene classification: Gene name=MreD; Function=Rod shape-determining protein; Function class=M Cell envelope biogenesis, outer membrane
  Homolog annotation: Query=1..162bp; Hit=1..162bp; Blast score=156; Percent Identity=61.0; E value=9e-39; Homolog= mreD COG2891
MNQYRSRGRWVIWLSFLIAIVLQIMPWPEQFYMFRPTLLVLCLIYWLLAIPHRVSVGTGFVLGIITDLLQGSVLGAHALAFSIISFLVVFKFQLIRNMALWQQALVVVALSTLMNLCVFLAHALIPKTLFHPEVFWNGLVNGILWPWLFLLMRKIRRQFSVR

SEQ ID NO: 9716 - protein, 195 aa, Xenorhabdus bovienii
  Coding DNA sequence: Name=SeqID_3608
  Gene classification: Gene name=Maf (BS); Function=Nucleotide-binding protein implicated in inhibition of septum formation; Function class= D Cell division and chromosome partitioning
  Homolog annotation: Query=1..190bp; Hit=1..190bp; Blast score=249; Percent Identity=65.0; E value=9e-67; Homolog= yhdE COG0424
MKTLYLASGSPRRRELVGMLDFNFEILTPQVEEKWQEGESPQQYVSRLAREKAQAGVAIAPNDFPVLGADTIVVLNNRILEKPRNPQHAAEILRALSGQSHQVMTAVALSNSQHTLSEIVITDVIFRQLSQQEIQEYIVTGEPMDKAGAYGIQGKGGCFVRKINGSYHAVVGLPLVETYELITRFLALADGKHYS

SEQ ID NO: 9717 - protein, 489 aa, Xenorhabdus bovienii
  Coding DNA sequence: Name=SeqID_3609
  Gene classification: Gene name=CafA; Function=Ribonucleases G and E; Function class=J Translation, ribosomal structure and biogenesis
  Homolog annotation: Query=1..489bp; Hit=7..495bp; Blast score=783; Percent Identity=84.0; E value=0; Homolog= cafA COG1530
MTAELLVNITPSETRVAYIDGGILQEIHVEREARRGIAGNIYKGRVSRVLPGMQAAFVDIGLEKAAFLHASDIVPHTECIAGEEKKNFHVRDIAELVHQGQDLIVQVVKDPLGTKGARLTTDITLPSRYLVFMPGASHVGVSQRIESEEERDRLKSIVMDYCNEHGGFIIRTAAEGIGAEELVQDAAFLQRLWGKVIERKKRNITKNKIYGELALAQRVLRDFAGAPLNRIRVDSRQTFLQLQEFIDEYIPEMNAKLEHYQGNQPIFDLYDVENEIQRALERKVELKSGGYLIIDQTEAMTTIDINTGAFVGHRNLEETIFNTNIEATQSIARQLRLRNLGGIIIIDFIDMGNEEHRRRVLASLEQALSKDRVKTTINGFSQLGLVEMTRKRTRESIEHILCDNCPTCQGRGTVKSVETVCYEILREIVRVHRLIDADRFLVYASPAVSEVLKGDESHALAEVEIFVGKQVKVQTEQLYSQEQFDVVMM

SEQ ID NO: 9718 - protein, 1278 aa, Xenorhabdus bovienii
  Coding DNA sequence: Name=SeqID_3610
  Gene classification: Function=Uncharacterized membrane protein; Function class=S Function unknown
  Homolog annotation: Query=1..1276bp; Hit=1..1264bp; Blast score=1097; Percent Identity=43.0; E value=0; Homolog= yhdR+P COG3164
VRRLPGILLATAAIVVIIVALLVSGLRFFLPHINDYRQQVAEKIAAVTDIPVHMGYINGHWESFGPSLEIRDISAKTKDASFQAKKVTLSLNVWRSLLQWRWHFRDLSFYQLEVNYDKPLFSGKDENLLSEPDSLSSFVLEQLNHFDLHDSRLTFQTPSGEKAQLILPQLTWLNKDDRHRAQGSVNLSSINGQEGVVQVKFDLKDINGVLDNGVIYLQADDIDMRLWLSRWLRDNTGLESSRFSLASWITLKGGRIDSGRLQLKQGEANWYVGSEKHQLAVSDLILQMCRQGEGWLFNIPNLANLKTNGQQWPVGRIAALYVMQADKYQGKDHWRLRAENIQLERLNGILPLLSSVTPNVVKDWQHRQPKGMLNHFALDITPELPDSSMGIAIKWQDVSWLRWQDLPSVNHFSGTLSGNKQWGSLKFELKNSTVDYRSLFQAPFDITSSEGQFAWRNDHHGLKVWGRDLDLQAKSLWFNGAFNYLLPKNEPPVLEMLAGIRVDDAGEAWRYFPKPLMGASLTDYLTHSLIKGKIENATLLFQGNPHDFPFKQNNGQFQVWVPLRHATFQYQPDWPALFDFDIDLNFQNNGLWMQVPKAKLGKVDATRLTAVIPDYGKQKLLIDGELSGNGKNIHDYFKHSPLAGSIGSALDELQLDGRVDGKLHLDIPLEDGKVNASGEVVLQDTALFIKPLDSKMEHVSGKFRFDDGKLQSDTLSAQWLGHPLSLRFTTQDLPKHYQVDVDLNAHWAAGKLPEVPAEIRRQLSGTLDWQGKVNIAIPAQSTSSHTKPQQNGVKYRVSINADLSHINSKLAALDTELLREWQGIDVLAEGDMNQIQIKGSLGKQYAFNTQWQLGKTHARLQRGIMNSEGNGTPILPEKSLLALNLPEIDGEKWLPLIAPLMSGSSEDDGLLWPEMFEIYMPSLKIGGQRWNQLVFNIVQQADGMKVSAVGEKLKGNLLIYRHEPWQASIDYLYYDPQFPEDSSAGSDTLTSDTTEAKKYGLRHWPSLNVKCAECWVAGLKLGKVSGTVMPEGDSLVLTNGQLENRAGKLTLSGRWGENDIGNYTQAKGQLSGQRFDEMAAYLGFIVPIVDAPFKFDFDLGWRGTPWNPDIKTLNGTLTGETKKGAIAKLGGGRAGQLLRLISFDALLRKLQLDFSDTFSNDFNFDSMRGDTTIKNGVMYTENFRIDGLAADIDAEGQTDLVRRQINMELVITPEISTTVGVATAFAVNPVAGAAVFAATKVLGPLWSKISVIRYRLTGSLEQPKIDEVLRQLKENKGS

SEQ ID NO: 9719 - protein, 282 aa, Xenorhabdus bovienii
  Coding DNA sequence: Name=SeqID_3611
  Gene classification: Function=Predicted amidohydrolase; Function class=R General function prediction only
  Homolog annotation: Query=6..273bp; Hit=4..270bp; Blast score=243; Percent Identity=46.0; E value=1e-64; Homolog= VC0421 COG0388
MKNVNVALLQLCSGANVKHNLAQVEQQIKQLPDTVKLVLTPENALLFADADTYRKYAEEQGSGPLQQAVSEIAQRYGVWLLIGSMPMISREEPTRITSSSLLFDDQGEIRARYDKIHMFDVNINDEHGAYNESTVYQRGEHITVVDTPVGRLGMAICYDLRFPGLFQALREQGAELISVPAAFTRLTGKAHWEPLLRARAIENQCIILAPAQVGVHGTRRTWGHSMAVSGWGEVIKKNPLTVSALQLNIRRDSLTHMREQIKVVKHNRFRPQLTSLIKKNTN

SEQ ID NO: 9720 - protein, 481 aa, Xenorhabdus bovienii
  Coding DNA sequence: Name=SeqID_3612
  Gene classification: Gene name=TldD; Function=Predicted Zn-dependent proteases and their inactivated homologs; Function class=R General function prediction only
  Homolog annotation: Query=1..481bp; Hit=1..481bp; Blast score=772; Percent Identity=83.0; E value=0; Homolog= tldD COG0312
MSLTFVSDYLLAANNLNHQDLFSVLGQLAERRLDYADLYFQSSYHEAWILEDRIIKDGSYNIDQGVGVRAISGEKTGFAYADQITLNALQQSAQAARSIVREAGNGTVHTLGAVTHKGLYPAIDPLQSMSREEKIALLHRVDQIARAEDPRVQEVNASLTGVYEQMLVAATDGTLAADIRPLVRLSVSVLVEEDGKREHGSSGGGARYGYEYFLQTADGQVLAEQFVREAVRMALVNLSAVAAPAGTMPVVLGAGWPGVLLHEAVGHGLEGDFNRRGTSVFSGQIGQQVASELCTVVDDGTIEGRRGSLSVDDEGVPGQYNVLIENGILKGYMQDKLNARLMGVAPTGNGRRESYAHLPMPRMTNTYMLAGKSTPEEIIASVDRGLYAPNFGGGQVDITSGKFVFSTSEAYLIENGKITKPVKGATLIGSGIEAMQQISMVGNDLALDKGVGVCGKEGQSVPVGVGQPTLKLDNLTVGGTA

SEQ ID NO: 9721 - protein, 158 aa, Xenorhabdus bovienii
  Coding DNA sequence: Name=SeqID_3613
  Homolog annotation: Query=1..158bp; Hit=1..154bp; Blast score=178; Percent Identity=56.0; E value=2e-44; Homolog= ref|NP_931255.1|
MKKSILAGILLILAFVSITFAQGSESVGAEKSQQNTEVLESASSEPIGVLTKPKRVAQYLRQHNNSRLPDYYLTKAQARNLGWDARKGNLCQVSPNTAIGGDRFSNRENKLPKKRDRQWFEADVNYSCGHRGSDRLLYSNDGLIYLTVDHYNTFKKLE

SEQ ID NO: 9722 - protein, 89 aa, Xenorhabdus bovienii
  Coding DNA sequence: Name=SeqID_3614
  Gene classification: Function=Barstar, RNAse (barnase) inhibitor; Function class=K Transcription
  Homolog annotation: Query=6..87bp; Hit=6..88bp; Blast score=70; Percent Identity=46.0; E value=4e-13; Homolog= yhcO COG2732
MKKVEFDFDRIPDLETFYCEFKESFDIGDHFGANLDALWDAVTGGIELPVEISFIHFSSQKRVYFAALVLLFEEAEEELEGELQFNIVE

SEQ ID NO: 9723 - protein, 69 aa, Xenorhabdus bovienii
  Coding DNA sequence: Name=SeqID_3615
MVLNIHHENRLYDFLCSIRSRTEHLMNTSGAHGHITESPNSRTRKENSLYYVKLQFPFQFFFGFFKQQN

SEQ ID NO: 9724 - protein, 179 aa, Xenorhabdus bovienii
  Coding DNA sequence: Name=SeqID_3616
  Gene classification: Function=Uncharacterized BCR; Function class=S Function unknown
  Homolog annotation: Query=1..178bp; Hit=1..181bp; Blast score=210; Percent Identity=74.0; E value=6e-55; Homolog= yjgA COG3028
MVKQPEDWLDNYPAEEEDEEIIWVSKSEIKRDSEALKKLGMELVELSKNALERIPLDDDLLAAIELAQRIKREGRRRQLQLIGKMLRSRDPEPITIALDKLNNRHNQQIVLFHKLEELRDKLLEDADGALTEVVTLYPHVDRQQLRTLVRNAKKEKETNKPPKSYRQIFQYLKELSESA

SEQ ID NO: 9725 - protein, 447 aa, Xenorhabdus bovienii
  Coding DNA sequence: Name=SeqID_3617
  Gene classification: Gene name=TldD; Function=Predicted Zn-dependent proteases and their inactivated homologs; Function class=R General function prediction only
  Homolog annotation: Query=8..447bp; Hit=11..450bp; Blast score=737; Percent Identity=82.0; E value=0; Homolog= pmbA COG0312
MIVTNQYIAEQRKQLEDAVSHALELAKTGSDAAEVSVNKTTGISVSTRFSEVENVEFNSDGALGITVYHQQRKGSASSTDLSPEAIARTVQAAIDIARYTSPDPYAGPADKDLLAFAAPDLDLFHPADLDTDTAIELAARAEQASLQADQRITNTEGGSFNSHYGIRIFGNSHGMLQSYCSSRHSLSSCVIAEQDGNMERDYAYTVSRRFDELQSPEWVGQECARRTLSRLGARKLPTMKAPVIFSAEVATGLFGHLVGAISGSSIYRKSSFLLDSLGKQILPSWLTIEEQPHLLRGLASTPFDSEGVRTAPRDIIKEGVLQTWLLTSYSARKLGMVNTGHAGGIHNWRIAGQGLDFAALLREMGTGLIVTDLMGQGVSAVTGDYSRGASGFWVENGEIQYPVSEITIAGNLKDMWANMVTVGDDIETRSNIQCGSVLLPEMSIAGQ

SEQ ID NO: 9726 - protein, 136 aa, Xenorhabdus bovienii
  Coding DNA sequence: Name=SeqID_3618
  Gene classification: Gene name=GreA; Function=Transcription elongation factor; Function class=K Transcription
  Homolog annotation: Query=1..134bp; Hit=1..134bp; Blast score=166; Percent Identity=64.0; E value=6e-42; Homolog= rnk COG0782
MKKPKIIINELDAERLDSLLEQPAFANTSIAEALNAELDRAEIVPPVEIPPDVVTMNSEIRFIDLGSNEERVRTLVYPASLQDSTKHLSVMAPLGAALLGLRVNDEITWQLPNSEKTRIKVLEIIYQPEAAGEYHR

SEQ ID NO: 9727 - protein, 69 aa, Xenorhabdus bovienii
  Coding DNA sequence: Name=SeqID_3619
MLVLAKAGCSNSESKRSASSSLIIIFGFFIPRSKLGSIQNNTPHHKEGGVIFKVIKLILGCSDVKIKRS

SEQ ID NO: 9728 - protein, 410 aa, Xenorhabdus bovienii
  Coding DNA sequence: Name=SeqID_3620
  Gene classification: Gene name=Alr; Function=Alanine racemase; Function class=M Cell envelope biogenesis, outer membrane
  Homolog annotation: Query=1..407bp; Hit=22..427bp; Blast score=376; Percent Identity=46.0; E value=1e-104; Homolog= VC1312 COG0787
MRFNKITLAILLGLTLCQGTAQAAPALSLDNIQAEHVAATNNAWVEINTTTFENNIHTLQSKLTKDTKVCVVLKGDAYGHGIDLLMPSVIKTGIPCVGITSNEEARIVRESGFKGQLMRIRAAAATEIESTLGYDMEEMVGDLEHAKTIDALAKKHGKAIRVHLVLNTGRMSRNGLEMKTEQGKQEALKIAQLPNLKLVGMMSHYALKDLDAIREGVNDFKEQTAWLIKTANLKRNEITLHASSSYASISVPEAQFDMVRVGSALYGVLTPEYPEFKPLIQVKTRVASVKPYPKGNGVSYDNTYILKRDSKLANLPVGFSDGFSSSLSNKAFVLINGHRAPVVGLVSMNTVMVDVTDLPDVKSGDEVVIFGKQGKEEITQSDIQKWGGMHIVEFSSIWGETNPRIAITGA

SEQ ID NO: 9729 - protein, 90 aa, Xenorhabdus bovienii
  Coding DNA sequence: Name=SeqID_3621
  Gene classification: Gene name=FruB; Function=Phosphotransferase system, HPr-related proteins; Function class=G Carbohydrate transport and metabolism
  Homolog annotation: Query=1..90bp; Hit=1..90bp; Blast score=105; Percent Identity=64.0; E value=8e-24; Homolog= ptsO COG1925
MTVKKQLEIKNRLGMHARPAMKLHDLVQQFQSQVILRNSSNIQAEAHSVIAMLMLDSEQGSYIEVEATGSDEQQALAAIIELFNAGFDEE

SEQ ID NO: 9730 - protein, 283 aa, Xenorhabdus bovienii
  Coding DNA sequence: Name=SeqID_3622
  Gene classification: Function=Predicted P-loop-containing kinase; Function class=R General function prediction only
  Homolog annotation: Query=1..283bp; Hit=1..283bp; Blast score=530; Percent Identity=95.0; E value=1e-151; Homolog= yhbJ COG1660
MVLMIVSGRSGSGKSVALRALEDMGFYCVDNLPVVLLPELAGTLAERSISAAVSIDVRNMPESPEIFEEALTKLPDTFSPQLLFLDADRNTLIRRYSDTRRLHPLSNKNLSLESAIDQESDLLEPLRSRADLIIDTSEMSVHELAEMLRTRLLGKRERELTMVFESFGFKHGIPIDADYVFDVRFLPNPHWDPKLRPMTGLDRPVAAFLDRHTEVHNFIYQTRSYLELWLPMLETNNRSYLTVAIGCTGGKHRSVYVAEQLADYFRSRGKNVQSRHRTLEKRK

SEQ ID NO: 9731 - protein, 155 aa, Xenorhabdus bovienii
  Coding DNA sequence: Name=SeqID_3623
  Gene classification: Gene name=PtsN; Function=Phosphotransferase system mannitol/fructose-specific IIA domain (Ntr-type); Function class=G Carbohydrate transport and metabolism
  Homolog annotation: Query=2..155bp; Hit=3..155bp; Blast score=228; Percent Identity=75.0; E value=2e-60; Homolog= ZptsN COG1762
MNNETDLPLSSVLSPECTRNNVPCSSKKRALEIISELASKQLGLPENTVFEAILSREKVGTTGIGNGIAIPHGKLDKECSHNAVGVFLNLEQPIAFDAIDNQPVDLLFALLVPSDQCQTHLHSLSLIAKRLADKNLCRRLRSAQSDEELYKIITE

SEQ ID NO: 9732 - protein, 95 aa, Xenorhabdus bovienii
  Coding DNA sequence: Name=SeqID_3624
  Gene classification: Function=Ribosome-associated protein Y (PSrp-1); Function class=J Translation, ribosomal structure and biogenesis
  Homolog annotation: Query=1..95bp; Hit=1..95bp; Blast score=119; Percent Identity=66.0; E value=8e-28; Homolog= yhbH COG1544
MQLNVTGHNIEITDALRNIVNTKCGKLDQYFDKINLIQVILRVEKVQKIAEATVYVNGGELHASSEHEDMYAAIDALADKLARQLTKHKSKLRQH

SEQ ID NO: 9733 - protein, 479 aa, Xenorhabdus bovienii
  Coding DNA sequence: Name=SeqID_3625
  Gene classification: Gene name=RpoN; Function=DNA-directed RNA polymerase specialized sigma subunits, sigma54 homologs; Function class=K Transcription
  Homolog annotation: Query=1..479bp; Hit=1..477bp; Blast score=675; Percent Identity=74.0; E value=0; Homolog= ZrpoN COG1508
MKQSLQLRLSQQLAMTPQLQQAIRLLQLSTLELQQEIQQALEANPLLEQDDPHEEIDSQESPDAATEVMDTREALEQKDIPEELPLDASWDEIYTAGTSSGTNSDYSAEDFPVYQGETTQTLQDYLMWQAGLTPFTETDSAIATSIIDAIDDSGYLTVSIEEILASIGDDELMLEEVEIVLKRIQHFDPIGIAARDLRECLLIQLSMLSTETPYLNEAKLVVSKYLELLGNRDFRNLLRQSKLKENALKEAIDIIQSLEPKPGLVVNTGESEYVIPDVLAHKENESWQVKLNTDSIPRLRINQHYAALGQQSHSESDSLFIRNNLQEAKWLIKSLESRNDTLLKVASCIVERQQDFFEYGAEHMKPLVLADIAYQVEMHESTISRVTTQKYLYSPRGIFELKYFFSSHVNTDSGGEASSTAIRALVKKLVAAENPAKPLSDSKLTSILAEQGIQVARRTVAKYRESLSIPPSNQRKKLV

SEQ ID NO: 9734 - protein, 241 aa, Xenorhabdus bovienii
  Coding DNA sequence: Name=SeqID_3626
  Gene classification: Function=ABC-type (unclassified) transport system, ATPase component; Function class=R General function prediction only
  Homolog annotation: Query=1..241bp; Hit=1..241bp; Blast score=387; Percent Identity=85.0; E value=1e-108; Homolog= yhbG COG1137
MAILNAENLAKAYKGRRVVEDVSLTVKSGEIVGLLGPNGAGKTTTFYMVVGIVPRDTGTITIDGEDISLLPLHERARRGIGYLPQEPSIFRRLSVFDNLMAVLEIRKDITQEQRKERAEELMEEFHIAHLRDNLGQSLSGGERRRVEIARALAANPKFILLDEPFAGVDPISVLDIKKIIQHLRDYGLGVLITDHNVRETLDVCERAYIVSQGQLIAHGSPEDILNNEQVKRVYLGEGFRL

SEQ ID NO: 9735 - protein, 177 aa, Xenorhabdus bovienii
  Coding DNA sequence: Name=SeqID_3627
  Gene classification: Function=Uncharacterized BCR; Function class=S Function unknown
  Homolog annotation: Query=2..177bp; Hit=6..177bp; Blast score=214; Percent Identity=64.0; E value=4e-56; Homolog= yhbN COG1934
MNNLIRNTVIASTLFAVSLPVLALKEDTKQPITLNSDRQSLDLTGNVATFTDNVSVKQGSIDIHADKVVVTRPEGDAKKTVIEAYGNPATFYQLQDDGKPIKGHASKMRYEMDKELMTLTGNAYLEQLDSNIKGDKITYLVPTQQMEAFSDKGKRVTTVLLPSQLQEKGTSVNNKSK

SEQ ID NO: 9736 - protein, 209 aa, Xenorhabdus bovienii
  Coding DNA sequence: Name=SeqID_3628
  Gene classification: Function=Uncharacterized BCR; Function class=S Function unknown
  Homolog annotation: Query=15..209bp; Hit=1..191bp; Blast score=193; Percent Identity=50.0; E value=1e-49; Homolog= yrbK COG3117
MPKGYQYKTKIEKRMSRIQSWLIGTLALIALALIGWNLSNLNENASSPIVDDGHPTYQTQEATSFVYDPEGKLAYKLVADDVQNYTETKLTWFTKPILTTFAPNSTSETPTWTVRANKAKLTNDKMLYLYGDVQLDSLTDASQLQRITTENATVNLVSQDILSDDQVTLIGVGLKSVGMKMRGNLRNKTAELIEKVTTHYEIPNEQPNP

SEQ ID NO: 9737 - protein, 187 aa, Xenorhabdus bovienii
  Coding DNA sequence: Name=SeqID_3629
  Gene classification: Function=Uncharacterized proteins of HAD superfamily, CMP-Neu5Ac homologs; Function class=R General function prediction only
  Homolog annotation: Query=7..187bp; Hit=8..188bp; Blast score=281; Percent Identity=76.0; E value=2e-76; Homolog= yrbI COG1778
MSQKTYLDTCYGPVNEEIIEKASKIRLLICDVDGVMSDGLIYMGNQGEELKAFNVRDGYGIRCLITSGIEVAIITGRNAKLLEDRAETLGITHLYQGQSDKVLAYKELLDKLTLQPEQVAYIGDDLIDWPVMAQVGLSAAVSDAHPLLLPRADYVTRIAGGRGAVRELCDLVLFAQNKLEDAKGLSI

SEQ ID NO: 9738 - protein, 328 aa, Xenorhabdus bovienii
  Coding DNA sequence: Name=SeqID_3630
  Gene classification: Gene name=GutQ; Function=Predicted sugar phosphate isomerase involved in capsule formation; Function class=M Cell envelope biogenesis, outer membrane
  Homolog annotation: Query=11..212bp; Hit=11..212bp; Blast score=322; Percent Identity=77.0; E value=5e-88; Homolog= yrbH_1 COG0794
MTWEVKMSKIDFQQAGKKVLQVELDGLAELEQYINEDFSRACELMFSCEGKVIVMGMGKSGHIGRKIAATFASTGTPSFFVHPGEASHGDLGMVTSKDIVLTISNSGESNEILALIPVLKRQKVPLICMTNNPNSSMGKAADIHLCIKTPQEACPLGLAPTTSTTATLVMGDALAVALLQARGFTAEDFALSHPGGTLGRKLLLLTSDLMTTGDDIPRVPYTATLREALVEITRKKLGMTVICDDDMQIKGIFTDGDLRRVFDMGTDLNHANISDVMTAGGVRIKPHTLAVDALNLMQSRHITSLLVTDGEKLLGVLHMHDLLQAGVV

SEQ ID NO: 9739 - protein, 325 aa, Xenorhabdus bovienii
  Coding DNA sequence: Name=SeqID_3631
  Gene classification: Gene name=CM27; Function=Ca2+/Na+ antiporter; Function class=P Inorganic ion transport and metabolism
  Homolog annotation: Query=5..319bp; Hit=18..331bp; Blast score=261; Percent Identity=48.0; E value=6e-70; Homolog= VC2522 COG0530
MFLTIALLITGLILLVYGSDRLVYGAAVFARSLKIPPYIVGLTIMGIGTSLPELMVSITAAQDGLPNMAIGNAIGSNITNLLLITGAASLIRPITVKSDILRRELPLMLLITAFVGYILADSYLNRLDGIVLLLTGLFFIALMIKMTTVSQDDDLDSYTQERDAELPIEGNKGIALLWVVLGLIILPISTRMVIDNAAVVARIYGISELVIGLTILAVGTSLPELATSIAAAIKGENDMAMGNIIGSNVFNITLVLGIPGILSPSVISPQAFSRDFWVMMAASVLFTIFCLGKKHRLNRLNGVLLLGCFIAYFVVLFVSNYYGTD

SEQ ID NO: 9740 - protein, 267 aa, Xenorhabdus bovienii
  Coding DNA sequence: Name=SeqID_3632
  Gene classification: Function=ABC-type exporter of toluene and related compounds, ATPase component; Function class=N Cell motility and secretion
  Homolog annotation: Query=1..266bp; Hit=1..266bp; Blast score=392; Percent Identity=78.0; E value=1e-109; Homolog= yrbF COG1127
MSQQTANLIEICGMYFTRGQRPIFSDINLTVPKGKVTAIMGPSGIGKTTLLRLIGGQIRPERGEIWFDGDNIPALSRQRLYAARKKMSMLFQSGALFTDLNVFDNVAFPLREHTQLPEALIHTTVMMKLEAVGLRGAAHLMPSELSGGMARRAALARAIALDPDLIMFDEPFVGQDPITMGILVKLIDELNHALGVTCVVVSHDVPEVLSIADYAYIVAEKTVIAEGTPEQLRMNQDHRVRQFLDGIADGPVPFRFPAGDYKTELLG

SEQ ID NO: 9741 - protein, 260 aa, Xenorhabdus bovienii
  Coding DNA sequence: Name=SeqID_3633
  Gene classification: Function=ABC-type toluene export system, permease component; Function class=R General function prediction only
  Homolog annotation: Query=1..260bp; Hit=1..260bp; Blast score=349; Percent Identity=78.0; E value=2e-96; Homolog= yrbE COG0767
MLTRALAALGKRAIEVAASFGRAGFMLFSAIIGKPEPAKQWKLLCQQLYSVGVQSLLIIVVSGLFIGMVLSLQGYLVLTTFSAEGSLGMMVALSLLRELGPVVTALLFAGRAGSALTAEIGLMKATEQISSLEMMAIDPLRRVIAPRFWAGFISMPLLSLIFVAVGIIGGAIVGVDWKGIDAGFFWSSMQSAVDWQKDLLNCFLKSVAFAITVTWIALFNGYDAIPTSEGISRATTRTVVHASLAVLGLDFVLTALMFGN

SEQ ID NO: 9742 - protein, 170 aa, Xenorhabdus bovienii
  Coding DNA sequence: Name=SeqID_3634
  Gene classification: Function=Permease component of an ABC -transporter; Function class=R General function prediction only
  Homolog annotation: Query=1..169bp; Hit=1..169bp; Blast score=206; Percent Identity=64.0; E value=8e-54; Homolog= yrbD COG1463
MQNKKNEIWVGCFVLIALVAIVFLCLKVADVRSFGSQTTYRVSAAFDNIGGLKVRSPVKIGGVVIGRVGRIWLDRKTYTPQVELDLFTQYDNIPSTSSLSIRTSGLLGEQYVAMNVGFYDPDMGVSMLKGGDRIEDTKSAMVLEDLIGQFLYKSGDGGQAKSDSAPAPAH

SEQ ID NO: 9743 - protein, 209 aa, Xenorhabdus bovienii
  Coding DNA sequence: Name=SeqID_3635
  Gene classification: Function=ABC-type exporter of toluene and related compounds, periplasmic component; Function class=N Cell motility and secretion
  Homolog annotation: Query=1..209bp; Hit=1..211bp; Blast score=299; Percent Identity=76.0; E value=1e-81; Homolog= yrbC COG2854
MFKRLLMVALLVVAPLASAVDQTNPYALMKDAAEKTFTRLKNDQPQVQANPEVLRQIVREELLPYVQVKYAGALVLGTYYGQATPEQREAYFKAFESYLEQAYGQALAMYHGQNYQIAPEQPLEGKTIAAIRVTITDENGQPPVRLDFQWRKNSKTGYWQAYDMIAEGVSMITTKQNEWADILRQKGIDALTEQLKISAKTPITLEKKK

SEQ ID NO: 9744 - protein, 111 aa, Xenorhabdus bovienii
  Coding DNA sequence: Name=SeqID_3636
  Gene classification: Function=STAS domain protein; Function class=R General function prediction only
  Homolog annotation: Query=15..100bp; Hit=37..122bp; Blast score=67; Percent Identity=43.0; E value=2e-12; Homolog= yrbB COG3113
MENREISQTSDDGKISWEQTGSTLFLHGTLDRDSLLPLWQQKDSVLAEIKNIDVSRLEHVDSTGLALFVRLKGDMQQRGKLLTFSGISERLETLIALYGLKSLFGANTPDM

SEQ ID NO: 9745 - protein, 84 aa, Xenorhabdus bovienii
  Coding DNA sequence: Name=SeqID_3637
  Gene classification: Gene name=BolA; Function=Stress-induced morphogen (activity unknown); Function class=T Signal transduction mechanisms
  Homolog annotation: Query=1..84bp; Hit=6..89bp; Blast score=137; Percent Identity=79.0; E value=1e-33; Homolog= yrbA COG0271
MDTDEIKEVLMKALVLDDVIVSGDGSHFQVIAVGELFDGLSRVKQQQTVYAPLMEYIADNRIHAVSIKTYTPAKWQRDRKLQGF

SEQ ID NO: 9746 - protein, 420 aa, Xenorhabdus bovienii
  Coding DNA sequence: Name=SeqID_3638
  Gene classification: Gene name=MurA; Function=UDP-N-acetylglucosamine enolpyruvyl transferase; Function class=M Cell envelope biogenesis, outer membrane
  Homolog annotation: Query=1..417bp; Hit=1..417bp; Blast score=718; Percent Identity=87.0; E value=0; Homolog= ZmurA COG0766
MDKFRVKGPTCLSGEVTISGAKNAALPILFAALLAEEPVELQNVPKLKDIDTTIKLLNRLGTKVKRNGSVFVDASNVNEYCAPYELVKTMRASIWALGPLVARFGQGQVSLPGGCAIGARPVDLHISGLEQLGAKIVLNEGYVKASVDGRLKGASIVMDKVSVGATVTIMTAATLAEGTTIIENAAREPEIEDTADFLNTLGAKITGAGTDRIVIEGVERLGGGVYRVLPDRIETGTFLVAGAISRGKVICRNTKPNTLDAVLSKLREAGADIQVGDDWISLDMHGKRPKAVTFRTAPHPGFPTDMQAQFSLLNMVAEGVGMITETIFENRFMHIPELIRMGARAEIESNTVVCHGVENLSGAQVMATDLRASASLVLAGCIAEGTTVVDRIYHIDRGYEHIEDKLRGLGANIERIKSTD

SEQ ID NO: 9747 - protein, 49 aa, Xenorhabdus bovienii
  Coding DNA sequence: Name=SeqID_3639
VRISSVLSRLIKLNSYYPSPELGEGLNKRKAAELSAILFILQAATGVKC

SEQ ID NO: 9748 - protein, 352 aa, Xenorhabdus bovienii
  Coding DNA sequence: Name=SeqID_3640
  Gene classification: Gene name=DegQ; Function=Trypsin-like serine proteases, typically periplasmic, contain C-terminal PDZ domain; Function class=O Posttranslational modification, protein turnover, chaperones
  Homolog annotation: Query=1..350bp; Hit=1..351bp; Blast score=406; Percent Identity=62.0; E value=1e-113; Homolog= degS COG0265
MLIKLLRSISIGLLIAAILLVTIPSLRPNGLKHLLSDNSRNGKPYSFNQGVRRAAPAVVNIYSSNLGSFSHEGRELRPLGSGVIMNDQGYILTNKHVINKADSIIVALQDGRFYEALLAGSDAPTDLAVLKVNGKNLPVIPINHNRVAHVGDIVLAIGNPYNLGQTITQGIISATGRVSLSPTRRQNFLQTDASINQGSSGGALVNTLGELVGINTLTFDKSEFGVTPEGLGFAIPTELATKIMHKLIRDGRVIRGYIGITVQDLPRIRSSDSNINQMSGLRVFEVAPRSPAQKVGIKVGDIITNFNHQPAISPAETMDQVTDIRPGSMVPITMLRDGQSLTFKVMVEEFDG

SEQ ID NO: 9749 - protein, 485 aa, Xenorhabdus bovienii
  Coding DNA sequence: Name=SeqID_3641
  Gene classification: Gene name=DegQ; Function=Trypsin-like serine proteases, typically periplasmic, contain C-terminal PDZ domain; Function class=O Posttranslational modification, protein turnover, chaperones
  Homolog annotation: Query=26..484bp; Hit=1..455bp; Blast score=529; Percent Identity=63.0; E value=1e-150; Homolog= degQ COG0265
MKFPDRIGLLSTISLSGLGIKRTYSMKRKNTLLSALAISIGLSLASVPVVGNAALPAAVASQELPSLAPMLEKVLPSVVTVHVSGTEVQNQQQLQLPEDFQFFFGPGFPPQEQRSRPFKGLGSGVIINANKGYVLTNSHVIEKANKIRVQLNDGREYSAKLIGRDLQTDIALLQLQDAKNLTAIKFADSDQLRVGDYSVAIGNPFGLGQTVTSGIISALGRSGLNLEGLENFIQTDASINRGNSGGALINLKGELIGINTAILAPGGGNIGIGFAIPSNMASNLADQLIAHGEVKRGLLGIKGTEMTADVAKALNVDAQQGAFVSEVIPKSAAAKADIKPGDVLVSVDGKKITSFAELRAKVGTTAPGKAIKIGLLRKGRPMEVTVTLENNVTQETKAENLSVALQGAILSNSTVKNTQGVKVDKITQNSPAAMSGLQNDDLIIGANNERIRNISELRKLLETKPPVIALNILRGDDNIYLLLRN

SEQ ID NO: 9750 - protein, 43 aa, Xenorhabdus bovienii
  Coding DNA sequence: Name=SeqID_3642
LGITLIGIGFKHNCFDAVMTLNYSAKFTNNVVLPCFFTGIYVN

SEQ ID NO: 9751 - protein, 154 aa, Xenorhabdus bovienii
  Coding DNA sequence: Name=SeqID_3643
  Gene classification: Function=Uncharacterized BCR; Function class=S Function unknown
  Homolog annotation: Query=21..147bp; Hit=3..128bp; Blast score=159; Percent Identity=70.0; E value=8e-40; Homolog= yhcB COG3105
MVLRHCGTLLPNTEVNKGVAMTWEYALIGLVIGFIVGALAVRFGSSKLRQQNAAQAELEKNRAELEEYRKELVSHFAHSAELLDNMARDYRQLYQHMAKSSNELMPNMPIQDNPFNYRLTESEADKSKVTANMPPRDYSEGASGLFRPIQDKKQ

SEQ ID NO: 9752 - protein, 39 aa, Xenorhabdus bovienii
  Coding DNA sequence: Name=SeqID_3644
MIRRELLAKLREDMEKSMKNWNKYNELKQKRLARFLPVQ

SEQ ID NO: 9753 - protein, 375 aa, Xenorhabdus bovienii
  Coding DNA sequence: Name=SeqID_3645
  Gene classification: Function=Predicted ATPase; Function class=R General function prediction only
  Homolog annotation: Query=1..374bp; Hit=1..373bp; Blast score=496; Percent Identity=65.0; E value=1e-140; Homolog= yhcM COG1485
MLPITPSSLYQSALSEGQYQPDEVQRNTVARLDIMHHDLSNRSPEHVLPSSGLKSILGRLFGGLSTEQQRPVQGLYMWGGVGRGKTWLMDMFFQSLPTDRKLRLHFHRFMLRVHEELTVLQGHENPLDVIADGFKAQTDVLCFDEFFVSDITDAMILGTLLEALFKRGIALVATSNIPPDELYRNGLQRARFLPAIEQIKKYCDVMNVDAGIDYRLRTLTQAHLYLTPLSEDNRQEMHRMFQRLAGRKGEPNPVLEINHRSMPAISSVDGVLAINFKTLCDDPRSPLDYIALSKLYHSVLLHDTPAMTALDESAARRFLALVDEFYERHVKLIINAEAPMERIYQGELLTFEYRRCLSRLQEMQSEEYLKLPHLP

SEQ ID NO: 9754 - protein, 57 aa, Xenorhabdus bovienii
  Coding DNA sequence: Name=SeqID_3646
LPSASTTYQSRFTVSGLAVKVFIKAYPIISYTLVNTRCSETVFEVHTTFVQQTYPFE

SEQ ID NO: 9755 - protein, 142 aa, Xenorhabdus bovienii
  Coding DNA sequence: Name=SeqID_3647
  Gene classification: Gene name=RplM; Function=Ribosomal protein L13; Function class=J Translation, ribosomal structure and biogenesis
  Homolog annotation: Query=1..142bp; Hit=1..142bp; Blast score=258; Percent Identity=92.0; E value=2e-69; Homolog= rplM COG0102
MKTFTAKPETVKRDWYVVDADGKTLGRLATEIASRLRGKHKAEYTPHVDTGDYIIIVNAEKVAVTGNKRADKIYYHHTGHIGGIKQATFEEMIARRPERVIEIAVKGMLPKGPLGRAMYRKLKVYAGSEHNHAAQQPQVLDI

SEQ ID NO: 9756 - protein, 130 aa, Xenorhabdus bovienii
  Coding DNA sequence: Name=SeqID_3648
  Gene classification: Gene name=RpsI; Function=Ribosomal protein S9; Function class=J Translation, ribosomal structure and biogenesis
  Homolog annotation: Query=1..130bp; Hit=1..130bp; Blast score=199; Percent Identity=92.0; E value=6e-52; Homolog= rpsI COG0103
MAENQYYGTGRRKSSSARVFIKPGSGNIVINQRSLEVYFGRETARMVVRQPLELVDMLGKLDLYITVKGGGISGQAGAIRHGITRALMAYDETLRSDLRKAGFVTRDAREVERKKVGLRKARRRPQFSKR

SEQ ID NO: 9757 - protein, 86 aa, Xenorhabdus bovienii
  Coding DNA sequence: Name=SeqID_3649
MTRLCVLIFAKLASLLAMLVKLNVKKWVCAKHVVVHSSPNVNLLPRLWRWVKVETRHLYGGFFYHLIFLPLVNSLFSQKLAYYRNK

SEQ ID NO: 9758 - protein, 92 aa, Xenorhabdus bovienii
  Coding DNA sequence: Name=SeqID_3650
MAKNVGRAGKQSHYRTFVGSDSHENLQVYLNKGTNSPSVKNGYSRSYSHPVSHLLSEGILKPLPNQAHSWIRQKIITSLPDFAHFVGKYIEN

SEQ ID NO: 9759 - protein, 213 aa, Xenorhabdus bovienii
  Coding DNA sequence: Name=SeqID_3651
  Gene classification: Gene name=Gst; Function=Glutathione-S -transferases; Function class=O Posttranslational modification, protein turnover, chaperones
  Homolog annotation: Query=1..209bp; Hit=1..209bp; Blast score=327; Percent Identity=79.0; E value=6e-90; Homolog= sspA COG0625
MAVAANKRSVMTLFSGSTDIFSHQVRIVLAEKGVSVEIEHVEAGNLPQDLIDLNPYQTVPTLVDRELTLYDSRIIMEYLDERFPHPPLMPVYPVARGSSRLMMYRIEKNWYSLMYKIQGGNTQETNAARKQLAEELLAMAPIFRDMPFFMSEEFSLVDCYLSPLLWRLPVLGVELSGPGAKDIQVYMQRVFERDAFLASLTEAEREMRLPSRG

SEQ ID NO: 9760 - protein, 160 aa, Xenorhabdus bovienii
  Coding DNA sequence: Name=SeqID_3652
  Gene classification: Gene name=SspB; Function=Stringent starvation protein B; Function class=R General function prediction only
  Homolog annotation: Query=1..131bp; Hit=1..131bp; Blast score=184; Percent Identity=70.0; E value=2e-47; Homolog= sspB COG2969
MEMIQMSPRRPYLLRAHYEWLLDNEMTPHLVVDVTLYGVNVPMEYANDGQIILNISPRAVGNLELTNDEVRFNARFGGVGRQVSVPMAAVIAVYGRENGAGMMFEPESAYKVGFEPEDSDAPIADNLVLISDAKIARDNGSSDDEPPQPPKGRPTLRVVK

SEQ ID NO: 9761 - protein, 168 aa, Xenorhabdus bovienii
  Coding DNA sequence: Name=SeqID_3653
  Homolog annotation: Query=1..167bp; Hit=1..166bp; Blast score=104; Percent Identity=36.0; E value=6e-22; Homolog= ref|NP_931211.1|
MRLLTQILLFSFISLMSSPSIAHLSTQAEILQQVRERGVNAVVAELGESRKRDEIAYNITTGESQWLRVAFTLSPNMHSEFSKQLLCSLSFALINNPVEVLSLSKKYNSFSSDQICDIPPTLKGLDERTSFIEKLSNSLNAARKSNSGKNNENIENCLWRLWRLAQTL

SEQ ID NO: 9762 - protein, 521 aa, Xenorhabdus bovienii
  Coding DNA sequence: Name=SeqID_3654
  Gene classification: Gene name=GltD; Function=NADPH-dependent glutamate synthase beta chain and related oxidoreductases; Function class=E Amino acid transport and metabolism
  Homolog annotation: Query=50..521bp; Hit=1..472bp; Blast score=805; Percent Identity=79.0; E value=0; Homolog= gltD COG0493
MAKAYWKTGHNGSINSRWLNLNPVMSVHCWGTAAVLPQNYGFRRSKESKMSQNVYQFIDLQRVDPPKKPLKIRKIEFVEIYEPFSEMQVEAQADRCLSCGNPYCEWKCPVHNYIPNWLKLANEGRIIEAAELSHRTNSLPEVCGRVCPQDRLCEGACTLNDDFGAVTIGNIERYINDTAIAMGWKPDMSDVIPTGKRVAVIGAGPAGLACADVLTRNGVQAVVYDRHPEIGGLLTFGIPAFKLEKEVMIRRREIFSEMGIEFRLNTGIGKDITLAELTEQFDAVFLGVGTYQSIHGGLENEDADGVYDALPFLIANTRHLMGYPALPKQPYVDMKGQRVLVLGGGDTAMDCVRTSVRQGATHVICAYRRDEGNMPGSRREVKNAKEEGVDFQFNLQPLSIEISSAGQVCGVKVAKTQLGEMDEKGRRRAEIIQGSEFLIETDAVITAFGFKPHNMHWLNAHQINLDQQGRIVAPEASDLPFQTSNPKIFAGGDAVRGSDLVVTAIAEGRKAASGILDYLEV

SEQ ID NO: 9763 - protein, 1485 aa, Xenorhabdus bovienii
  Coding DNA sequence: Name=SeqID_3655
  Gene classification: Gene name=GltB; Function=Glutamate synthase domain 2; Function class=E Amino acid transport and metabolism
  Homolog annotation: Query=378..1169bp; Hit=1..792bp; Blast score =1356; Percent Identity=83.0; E value=0; Homolog= ZgltB_2 COG0069
MLYDKLQEKDNCGFGLIAHIEGEQSHKVVRTAIHALARMQHRGAILADGKTGDGCGLLMQKPDRFFQMIASDQSWRLAKNYAVGMLFLSQDAKIAQSCRDIVEQELQNETLSIVGWREVPINRDILGEIALSSLPRIEQIFVNAPAGWRAQDLERRLFVARRRIEKRITDDDFYVCSLSNLVTIYKGLCMAADLPRFYLDLADLRMESSICLFHQRFSTNTVPRWPLAQPFRYLAHNGEINTITGNREWARARAYKFRTPLIPDLQTAAPFVNETGSDSSSLDNMLELFLNGGMDLIRAMRLLVPPAWQNNPDMDDDLRAFFDFNSMHMEPWDGPAGIVISDGRYAACNLDRNGLRPARYVITKDKLITCASEVGIWDYQPDEVVEKGRVGPGELMVIDTYEGRILHSAETDNDLKIRHPYKEWLEKNVKQLIPFEKLPEDQIGQRDLDDRMLAIYHKQFAYSNEELDQIIRALGENGQEATGSMGDDTPFAVLSSRPRVIYDYFRQQFAQVTNPPIDPLREAHVMSLATRIGREMNVFCEAEGQAHRLSFESPVLLYSDFVQLTTQQESYYHAETLDLTFNPQETNLKSAVATLCRQAEELIRNGAVLLVLSDRNISPEKLPIPAPMAVGAIQHCLVEKSLRCDANLIVETASARDPHHFAVLLGFGATAVYPYLAYESLGKMVDDGTINAPYVRVMLNYRNGINKGLYKIMSKMGISTISSYRCSKLFEAVGLHSDVTDLCFNGVVSRIEGADFNDFEQDLRNLSKRAWLHRHTIDQGGLLKYVHDGEYHAYNPDVVNTLQAAVHSGKYSDYQKYSQLVNGRPATTLRDLLAISSKEEPIAIEEVEPDESLFKRFDTAAMSIGALSPEAHEALAEAMNTLGGFSNSGEGGEDPARYGTKKVSRIKQVASGRFGVTPAYLSSADVIQIKVAQGAKPGEGGQLPGDKVTPYIAKLRYSVPGVTLISPPPHHDIYSIEDLAQLIFDLKQVNPKALISVKLVSEPGVGTIATGVAKAYADLITIAGYDGGTGASPLSSVKYAGCPWELGLVETQQALVANGLRHKIRLQVDGGLKTGVDIIKAAILGAESFGFGTGPMVALGCKYLRICHLNNCATGVATQDEKLRKSHYHGLPERVINYFRFIAQETRELMAQLGIRELTDLIGRTDLLQILEGISAKQSKLNLEPLLKTAQPHEGKDLHCTEDNPSFDQGILNKDIIKQAMPYVKNSQSKKLYFDIQNTDRSVGASLSGEIAELHGDQGLAADPIKLYFTGTAGQSFGVWNAGGVELTLTGDANDYVGKGMAGGQIVIRPPVGSAFRSNEATIIGNTCLYGATGGKLFAAGNAGERFAVRNSGAITVIEGIGDNGCEYMTGGIVCVLGSTGVNFGAGMTGGFAYVLDEFDDFRKRVNPELVEVLSIDTLAIHKEHLRGLITEHVRLTGSQHGESILENWSQWVNKFALVKPKSSDVSALLGHRSRSSAELRVQAQ

SEQ ID NO: 9764 - protein, 38 aa, Xenorhabdus bovienii
  Coding DNA sequence: Name=SeqID_3656
MLCHCIRTLHKYESENYPTSDFQWIPNLARKIEQVKSC

SEQ ID NO: 9765 - protein, 778 aa, Xenorhabdus bovienii
  Coding DNA sequence: Name=SeqID_3657
  Gene classification: Gene name=BaeS; Function=Signal transduction histidine kinase; Function class=T Signal transduction mechanisms
  Homolog annotation: Query=1..561bp; Hit=1..562bp; Blast score=803; Percent Identity=75.0; E value=0; Homolog= ZarcB_1 COG0642
MKRIRRFAQYYVDLMMKLGLVRFSLLLASVLIILAMVIQIAITLHWRGEVQRTDLIGSIFFGLLITPWAVYFLSIVVEQLEESRQRLSSLVAKLEEMRQRDAKLNLQLKENIAQLNHEINDREKAEKTHLVLLDKLKSEMEQREKTQSALEQQSILLRSFLDASPDLVYYRNEDNEFSGCNRAMELLTGKSEKQLIGLTPTEVYDKEVASKVMETDEKVFRHNVSLTYEQWLVYPDARKACFELRKVPFYDRVGKRHGLMGFGRDITERKRYQDALENASRDKTTFISTISHELRTPLNGIVGLSRILMDTDLTPEQCKYLKTIHVSAITLGNIFNDIIELDKIERRKVQLDNQQIDFTGFMADLENLSGLLAQPKGIRFVLEPELPLPAKILTDGTRLRQILWNLIGNAVKFTQKGEIRVRIWREGGERLLFEVTDSGIGIPSSELEKIFAMYYQVTDSAGGRPATGTGIGLAVSKRLAQSMGGDIVVESTVDQGSCFTLSIVAPAVDEKSEGQEESELPLPALNILLVEDIELNVIVARSVLEKLGNSVDVAMNGHDALMMFDPDEYDLVLLDIQLPDMTGLDIARQLHQRYPSQSLPPLVALTANVLKDKREYLDVGMDDVLSKPLSVKELTAVMEKFWGKAPKPEQTLQETKVVKKNEDLLDTEMLNQYIDLVGPKMIADNLKMFETMMPSYLALLDSNMTARDQKGITEEAHKIKGAAGSVGLRHLQQLAQQIQSPDLPAWWDNVQEWVDELKLEWRSDTETLRNWLTDATKK

SEQ ID NO: 9766 - protein, 221 aa, Xenorhabdus bovienii
  Coding DNA sequence: Name=SeqID_3658
  Gene classification: Gene name=ElbB; Function=Uncharacterized sigma cross-reacting protein 27A (ES1 or KNP-I alpha protein); Function class=S Function unknown
  Homolog annotation: Query=3..221bp; Hit=2..220bp; Blast score=269; Percent Identity=59.0; E value=2e-72; Homolog= yhbL COG3155
MEINMKCVAVILSGCGVYDGSEIHESVLTMLSLSRLGAKVSFFSPDELQHHVINHLNGKEEKETRHIMQESARITRGNIQPLSQVDINTLDALIIPGGFGVAKNLCNFAFKGSECEINKNLLSIVRSMHQQGKPMGFMCIAPVMVAKILGRPIKVTIGNDPETAAQIEAMGGIHIECPVDDIVIDFKNKIVTTPAYMLAESLSQAEQGIDKLVRKILEMIE

SEQ ID NO: 9767 - protein, 238 aa, Xenorhabdus bovienii
  Coding DNA sequence: Name=SeqID_3659
  Gene classification: Gene name=MrcA; Function=Membrane carboxypeptidase (penicillin-binding protein); Function class=M Cell envelope biogenesis, outer membrane
  Homolog annotation: Query=5..237bp; Hit=9..241bp; Blast score=285; Percent Identity=62.0; E value=3e-77; Homolog= mtgA COG0744
MKNPFSILWPWLKKIVLTITILWFVAVILFSFLPVPFSMVMAERQISALMSINLSYVSRSSWMDQNQISPYMTLAVIAAEDQKFPKHWGLDFEAIETAMAHNKKFQKRIRGASTITQQTAKNLFLWEGRSWVRKGLEAGMAVVLELLWSKKRILTVYLNIAEFGHGIFGVEEAARHYFGKSANRLTASEAALLAAVLPNPHRYKVDAPSAYLLQRQQWILRQMRLLGGESYLKQNKLR

SEQ ID NO: 9768 - protein, 191 aa, Xenorhabdus bovienii
  Coding DNA sequence: Name=SeqID_3660
  Gene classification: Gene name=OsmY; Function=Predicted periplasmic or secreted lipoprotein; Function class=R General function prediction only
  Homolog annotation: Query=1..190bp; Hit=1..190bp; Blast score=207; Percent Identity=65.0; E value=4e-54; Homolog= yraP COG2823
MRLFSLLIVFCSAMLLQGCIGAAVVGSAAIATKAGSDPRSIGQQVDDGTLEARVSNAISKDPQIKAQARIIVTVYQGRVLLTGQSPDLQLGDRAKQLASKVEGTEAVYNEVRQGNPVDLGTASVDTWLTTKVRSKILASDSVKSSNIKVVTENGEVFLFGIVTRQEGTDAAKIASETSGVKRVTTAFTYLN

SEQ ID NO: 9769 - protein, 219 aa, Xenorhabdus bovienii
  Coding DNA sequence: Name=SeqID_3661
  Gene classification: Gene name=GmhA; Function=Phosphoheptose isomerase; Function class=G Carbohydrate transport and metabolism
  Homolog annotation: Query=26..219bp; Hit=3..196bp; Blast score=337; Percent Identity=88.0; E value=5e-93; Homolog= yraO COG0279
LKDEGYIGYHSLHKIDYQYIGHNVLDRIKVCFTESIQTQIAAAEALPDAISRAAMMMVQSLLNGNKILCCGNGGSAATAQRFAASMINRFETERPSLPALSLNADNVVITSIANSKQPDEIYAKQVRALGHAGDVLLAISTHGNSRDIIKAVEAAVTRDMTIVALTGYDGGELAGLLGPQDVEIRIPSHHSIRIQEVHMLTINCLCDLIDNTLFPHQDD

SEQ ID NO: 9770 - protein, 120 aa, Xenorhabdus bovienii
  Coding DNA sequence: Name=SeqID_3662
  Gene classification: Function=Predicted endonuclease distantly related to archaeal Holliday junction resolvase; Function class=L DNA replication, recombination and repair
  Homolog annotation: Query=12..119bp; Hit=20..127bp; Blast score=114; Percent Identity=50.0; E value=1e-26; Homolog= yraN COG0792
MKKPSINRYAQGRYYEQQVKQFLQQQGLVFVAENVKIRGGEIDLIMRDKQTWVFVEVRFRQNATYGDAIATITQSKRRKILYTASVWLYQRNECLETASCRFDICAITGQKFEWLKNAFT

SEQ ID NO: 9771 - protein, 618 aa, Xenorhabdus bovienii
  Coding DNA sequence: Name=SeqID_3663
  Gene classification: Gene name=LppC; Function=Putative lipoprotein; Function class=R General function prediction only
  Homolog annotation: Query=68..586bp; Hit=139..674bp; Blast score=450; Percent Identity=47.0; E value=1e-126; Homolog= yraM COG3107
MTDLKLSIFEKNITGYSMLPSIFVRFKTGLVCTALLSTMIIAGCTTPEQQGQPPSKPQDKISAEINRYQSIIDATHNQPSLDVIRAYIALETHTADDAAHQKNIDDTWQALTHLSPQQLGELVINANEYTLQGWLDLLNAYLVNKQDLDKLRTAINDWRTRYPDNPAMRSLPTSLQQMLLKPKDSHAIIGLFLPLSGQAKVFGEAIRQGFLDAQKGLPQPTLPVNATVSAPEAGIAANTTETAEAALSSSPASATSTTIAAAPVNDQPVKVYDTNSQPLANLLAQAEQDGVTLVVGPLLKPNVEQLVQINTPLNILALNELDVSQSRSNICYFSLSPEDEAKNAALHLWQQQKRNPLVLVPRTELGNRVTKAFAEEWQKLGGNVALQQTFGTLGEMKQSINRGMGIRLSGTPIPVSAYLPGAGASQLKTNGAVIATSAPTNSAGGAVDAVYIAATTDELTLIKPMIDMAISSRKKPALYANSRSNKAGVGPDFRLEMDGMQFSDIPLLTGVNLPLMQQAASKFANDYSLIRLYAMGIDAWSLANQFTQLQQGTGFHMKGASGELSVTNNCIILRQLAWMQFNNGRITIENNAANNIDATVDNTVNKSTDSSNSVQLMP

SEQ ID NO: 9772 - protein, 290 aa, Xenorhabdus bovienii
  Coding DNA sequence: Name=SeqID_3664
  Gene classification: Function=Predicted methyltransferases; Function class=R General function prediction only
  Homolog annotation: Query=1..285bp; Hit=1..284bp; Blast score=431; Percent Identity=80.0; E value=1e-121; Homolog= yraL COG0313
MNQTNRAVVTTSTLYVVPTPIGNLGDITQRALEVLKHVDLIAAEDTRHTGLLLQHFAINARMFALHDHNEQQKADQILAKLEQGLSIALVSDAGTPLINDPGYHVVRRCREAGINVVPLPGPCAAITALSAAGLPSDRFCYEGFLPAKSKGRRDTLRDLAQEPRTLIFYESTHRLLDSLEDMVEVWGADRYVVLARELTKTWESIKGMPVGELLAWIREDETRRRGEMVLIVEGYRKPAEDCLPPEALQTLALLQKELPLKKAAALAAEIHGVKKNALYRHALEQIEEGV

SEQ ID NO: 9773 - protein, 49 aa, Xenorhabdus bovienii
  Coding DNA sequence: Name=SeqID_3665
LLSVALVVGFHPPDVIWHPALWSPDFPPLYISRRRAVKQRLSSQLRRGL

SEQ ID NO: 9774 - protein, 87 aa, Xenorhabdus bovienii
  Coding DNA sequence: Name=SeqID_3666
  Homolog annotation: Query=1..86bp; Hit=3..88bp; Blast score=109; Percent Identity=73.0; E value=8e-24; Homolog= ref|NP_667459.1|
LTDKPGSVVDNHSSRPELARWLKQPTRVQYGPYHVNLYLVLLRVEFTVPRTVASRAVRSYRTLSPLPDPTLIFANKSGPSAVCSLLH

SEQ ID NO: 9775 - protein, 233 aa, Xenorhabdus bovienii
  Coding DNA sequence: Name=SeqID_3667
  Gene classification: Function=Pirin-related protein; Function class=R General function prediction only
  Homolog annotation: Query=1..231bp; Hit=1..231bp; Blast score=266; Percent Identity=54.0; E value=1e-71; Homolog= yhaK COG1741
MIITRTANQCGKADYGWLKSRYTFSFGHYFDPKFLNYGALRVLNQEVLAPKAEFQPKAYPHVDILNIILQGEAQYRDSEGTHIHARQGDCLLFSARQGILYSEHNISDEIPLTRLQLWLNACPEQEPQPLQRTVLPNRPLTLLASPSSENKSMYLRQQVWVSYLVIKASDTQTLPLRGKNAYLQSIRGNAKISGSNHASVEIKCGDGVFIQEELLLKLRADTPFQGLLIDLGG

SEQ ID NO: 9776 - protein, 298 aa, Xenorhabdus bovienii
  Coding DNA sequence: Name=SeqID_3668
  Gene classification: Gene name=LysR; Function=Transcriptional regulator; Function class=K Transcription
  Homolog annotation: Query=1..295bp; Hit=1..295bp; Blast score=478; Percent Identity=84.0; E value=1e-135; Homolog= yhaJ COG0583
MGKERALTLESLRVMDAIDRRGSFAAAADELGRVPSALSYTMQKLEDELDVVLFDRSGHRTKFTNVGRMLLERGRLLLEAADKLTADAEALARGWETHLTIVCEALFPVVSLFPLVDKLAKKSNTQFSLMTEVLAGAWERLETGYADIVIAPDIHFRPSAEINSRTLYSINNVYVASVDHPIHHEPEPLSDATRVKYRGIAVADTARERPVLTVKLLDKQARLTVSTLEDKRRALLAGLGVATMPYPMVEQDIAEKRLRVIGSEYSHETNIIMAWRRDSMGEAKSWCLREIPKLFMKQ

SEQ ID NO: 9777 - protein, 163 aa, Xenorhabdus bovienii
  Coding DNA sequence: Name=SeqID_3669
  Gene classification: Function=Predicted membrane protein; Function class=S Function unknown
  Homolog annotation: Query=29..163bp; Hit=27..160bp; Blast score=154; Percent Identity=63.0; E value=5e-38; Homolog= yqjF COG2259
MINKLCFLAHLLVIENINRHFIIIAFCILETFMKKFEDSGLLTARILISVLFIIAGYGKLGEAYAGTQQFMEAMKIPGILLPLTILLELGGGLAVLFGLLTRTTAVFTFIFCILTAFLFHNDFSDGMNQTMFLKNMAIGAGYLLLAMMGPGKFSIDRVLNKNW

SEQ ID NO: 9778 - protein, 45 aa, Xenorhabdus bovienii
  Coding DNA sequence: Name=SeqID_3670
LYKPVTEATTIVSVGVGIMRLVTRQGAAVGLNGGFVHTGVTWENG

SEQ ID NO: 9779 - protein, 45 aa, Xenorhabdus bovienii
  Coding DNA sequence: Name=SeqID_3671
MNLFMTTPSNASLKILIISYSRHVSCTSLLPRLLPSCLSGLGSCG

SEQ ID NO: 9780 - protein, 163 aa, Xenorhabdus bovienii; identical to SEQ ID NO: 7546
  Coding DNA sequence: Name=SeqID_3672
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 9781 - protein, 117 aa, Xenorhabdus bovienii; identical to SEQ ID NO: 7849
  Coding DNA sequence: Name=SeqID_3673
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 9782 - protein, 45 aa, Xenorhabdus bovienii
  Coding DNA sequence: Name=SeqID_3674
MVFFKTKDYNLTKRILICQTHRQILPIISNGYRFQRITKWCVYFL

SEQ ID NO: 9783 - protein, 31 aa, Xenorhabdus bovienii
  Coding DNA sequence: Name=SeqID_3675
MLSNILYKLGIPIYYMRKFLLLHGSMKWIYN

SEQ ID NO: 9784 - protein, 110 aa, Xenorhabdus bovienii
  Coding DNA sequence: Name=SeqID_3676
  Homolog annotation: Query=6..110bp; Hit=18..126bp; Blast score=67; Percent Identity=39.0; E value=4e-11; Homolog= ref|NP_928518.1|
MSTVTFFIFEDIVKIFNIDEIFTFSWRTFAIFSSYPFLLYFCIIPVYYGFSLRMPKNIKYLLLISVFGLILSIPISWYLDYKFKSLGYSVCYKLSWNAPSKYVKDTKLCN

SEQ ID NO: 9785 - protein, 45 aa, Xenorhabdus bovienii
  Coding DNA sequence: Name=SeqID_3677
MQLIRHGHNFSSLSIERLNRPVFTGGLFVYELCDHIKFGGYIKFV

SEQ ID NO: 9786 - protein, 379 aa, Xenorhabdus bovienii
  Coding DNA sequence: Name=SeqID_3678
  Gene classification: Gene name=AdhC; Function=Zn-dependent alcohol dehydrogenases, class III; Function class=C Energy production and conversion
  Homolog annotation: Query=10..374bp; Hit=3..366bp; Blast score=370; Percent Identity=51.0; E value=1e-102; Homolog= CC2396 COG1062
MTVTNQLHDITVAVTRSKGEDFTIEPARIRGPRYNEILVRMVATGLCHTDLIVRDQYYPVPLPAVLGHEGAGIVEEVGPQVKTLKVGDHVVLTYGACGHCHHCFEGHGAYCDDFFGLNFGGSDLSGQTAIEDMHGQPLHDHFFAQSSFATYTIAKENNAIKVPKTAPLAMLGPLGCGIQTGAGAVMNSLKVTPGSSFVSFGAGAVGLSAVMAARVVGATKIIAVDVVTSRLELAKKLGATHTVNSKEQDVVAAIIEITGSGTDFALESTGRTDVLGQAIETLASLGIIGVVGAPKLGTKAEFDVNNLLLKGRSIRGIVEGDSIPQIFVPQLIELYQQGRFPFDELIKFYPLDKINEAAKDSEMGKTLKPVLLISEIDTL

SEQ ID NO: 9787 - protein, 31 aa, Xenorhabdus bovienii
  Coding DNA sequence: Name=SeqID_3679
MFAKIKDWKRIATRYDRCAHTFMSATRNLLA

SEQ ID NO: 9788 - protein, 47 aa, Xenorhabdus bovienii
  Coding DNA sequence: Name=SeqID_3680
LVLKPLLERNYPNTTSAYNLVVAGSCVSCSHLCLLPPNKSQEANHTA

SEQ ID NO: 9789 - protein, 92 aa, Xenorhabdus bovienii
  Coding DNA sequence: Name=SeqID_3681
  Homolog annotation: Query=8..87bp; Hit=4..83bp; Blast score=64; Percent Identity=42.0; E value=5e-10; Homolog= ref|NP_931196.1|
MTIMNKSQRQQREWRKQQLLLEIQQQRQSLSECTQHWLDIIQAYDRGWQTLLAFKPYVAIGSGIALIYGICHPMKFYRWSRRMVSLLGFIRG

SEQ ID NO: 9790 - protein, 133 aa, Xenorhabdus bovienii
  Coding DNA sequence: Name=SeqID_3682
  Homolog annotation: Query=1..133bp; Hit=1..133bp; Blast score=138; Percent Identity=56.0; E value=2e-32; Homolog= ref|NP_931195.1|
MTQPPRSQGPGKGIFDTLQRVAAIVVGMVETRIRLIAVELEENTATLVQLLLLIGFTLLFATFGLMCLLILIFWVIDPVYRATAMAITAGILLILAVFSAIWTIRKTRKLTFFNSTREQLKIDRKMLEDDHHE

SEQ ID NO: 9791 - protein, 101 aa, Xenorhabdus bovienii
  Coding DNA sequence: Name=SeqID_3683
  Homolog annotation: Query=1..101bp; Hit=1..101bp; Blast score=124; Percent Identity=71.0; E value=3e-28; Homolog= ref|NP_404212.1|
MPQKKNSEDLRTELQSLADTLEEVLNSSSDKSKAELEKLRSKAEKTLKDARVTLSDVSDKLVDQTKEIAGRTDNYVRDNPWTSIGIGAAVGAVLGILLAKR

SEQ ID NO: 9792 - protein, 43 aa, Xenorhabdus bovienii
  Coding DNA sequence: Name=SeqID_3684
MFWLDTTGKSQPLYWQEKNFHDRILLRGMVSAFLTPDDRQAAN

SEQ ID NO: 9793 - protein, 222 aa, Xenorhabdus bovienii
  Coding DNA sequence: Name=SeqID_3685
  Gene classification: Gene name=DedA; Function=Uncharacterized membrane-associated protein; Function class=S Function unknown
  Homolog annotation: Query=1..218bp; Hit=1..218bp; Blast score=268; Percent Identity=70.0; E value=2e-72; Homolog= yqjA COG0586
MEIVTDLIYALWHQDYETLANPSFVWAIYILLFTILFLENGILPAAFLPGDSLLILVGVLIAKDAMSFPATIFILTAGASLGCWVGYLQGRWLGNTKLVQGWLSHLPTHYYQRAHNLFHRHGLSALLIGRFLAFVRTLLPTLAGIAGLKNGRFQIFNWLSGFLWVIILTTLGYALGKSPLFRQYEEYVMNFLVLLPLGLLLIGLIGSLTVIWRKKRANHPPQ

SEQ ID NO: 9794 - protein, 55 aa, Xenorhabdus bovienii
  Coding DNA sequence: Name=SeqID_3686
VFHNLGAKVHKSGLLQFPSNVPKTRIKDYILLLWCISGAFLLGTLKIQNIKYRLS

SEQ ID NO: 9795 - protein, 36 aa, Xenorhabdus bovienii
  Coding DNA sequence: Name=SeqID_3687
MNVQLVTKISCFATADFVRVSLLVLMPSCKKLKGIL

SEQ ID NO: 9796 - protein, 46 aa, Xenorhabdus bovienii
  Coding DNA sequence: Name=SeqID_3688
MTKSNPLIILETVQILIVVVKMMIQYNLLNKKSNYCFFIMLHTTPL

SEQ ID NO: 9797 - protein, 45 aa, Xenorhabdus bovienii
  Coding DNA sequence: Name=SeqID_3689
LPFRSHKCKQFVIKHCVVCIFQLIIRFSFFHFPIPGKQTQKQQAH

SEQ ID NO: 9798 - protein, 415 aa, Xenorhabdus bovienii
  Coding DNA sequence: Name=SeqID_3690
  Gene classification: Gene name=SstT; Function=Na+/serine symporter; Function class=E Amino acid transport and metabolism
  Homolog annotation: Query=3..406bp; Hit=4..407bp; Blast score=488; Percent Identity=71.0; E value=1e-138; Homolog= ZygjU COG3633
MEKQQKGFVQYIVQGSLVTQIIIGLIAGILLAWLLPSAAQSADLLGSLFVSALKAVAPVLVWILVMSSIANHKKGQKTSIRPILLLYLIGTFGAAVVAVIGSTLFPSTLILVTNDAKISPPDNIVEVMRGILLNVVVNPIDAILKGNYVGILAWSIGLGIALRHAKESTKSLMQDLAEAVTQIVRVVIRLAPIGIFGLVASTIATTGFEALLGYARLLAVLLGCMIIVALVVNPLIVYWTIRRNPYPLVFACLRESGVTAFFTRSSAANIPVNMAMCRRMNLNEDTYSVSIPLGATINMAGAAVTITVLTLAAVNTLDMTVGLPTAILLSVVAVIGACGSSGVAGGSLLLIPLACSIFGISNEIAMQVVAVGFIIGVLQDSAETGLNSSTDVLFTAAACQAEDARLNADQLSQRR

SEQ ID NO: 9799 - protein, 673 aa, Xenorhabdus bovienii
  Coding DNA sequence: Name=SeqID_3691
  Gene classification: Gene name=NemA; Function=NADH; Function class=C Energy production and conversion
  Homolog annotation: Query=3..355bp; Hit=2..354bp; Blast score=538; Percent Identity=73.0; E value=1e-153; Homolog= fadH_1 COG1902
MSNYPHLLAPLDLGFTTLKNRVLMGSMHTGLEEHPDGARRLAQFYAERAAGGVALIVTGGIAPNEQGVVTAGASILNNEDTLPHHQVITDAVHQAGGKIALQILHTGRYSYQKNLVAPSAIQAPINPFKPREMSEEDIQQTIRDFARCAQLAQQAGYDGVEIMGSEGYLINQFLVARTNHRQDKWGGNFENRMRFAVEIVKAARAITGEHFIIIYRLSMLDLVEEGSDWQEIEQLAKEIEKAGASIINTGIGWHEARIPTIATMVPRAGFSWVTQKLMGKVSIPLITTNRINDPHVAEQTLSEGCADMVSMARPFLADAEFVLKAEQNRADEINTCIGCNQACLDRIFVGKLTSCLVNPRACHETEFIAEPVKAPKTIAVIGAGPAGLSFAVTAASQGHHVTLFERDNKIGGQFNIAKQIPGKEEFYETLRYFDRQLALNGVEVKLNHTATASQLASFDEIIIATGIIPRTPDIDGINHEKVLTYLDVLKHKRNVGPRVAIIGAGGIGFDTAEYLSHNGQSSSLSSHAFSQEWGIDQTLSHRGGLQPEGAQMERSPRKIYLLQRKDSKVGEGLGKTTGWVHRASLLMRGITMLNSVQYLKIDDQGLHISRNGEQQCLEVDNVIICAGQEPLKDLYQPLQTMGKNVHVIGGADVAVELDARRAIDQGARLAFKI

SEQ ID NO: 9800 - protein, 86 aa, Xenorhabdus bovienii
  Coding DNA sequence: Name=SeqID_3692
  Gene classification: Gene name=RimL; Function=Acetyltransferases, including N-acetylases of ribosomal proteins; Function class=J Translation, ribosomal structure and biogenesis
  Homolog annotation: Query=9..71bp; Hit=116..178bp; Blast score=73; Percent Identity=55.0; E value=2e-14; Homolog= NMA0331 COG1670
MPMIFESFMEYAFEQLSGVAVEFRTHFLNHQSRRAIERLGAKRDGILRSHLRARDGSIRDTCVYSMLASEWPAIKIHLLWLMAKPR

SEQ ID NO: 9801 - protein, 311 aa, Xenorhabdus bovienii
  Coding DNA sequence: Name=SeqID_3693
  Gene classification: Gene name=VirK; Function=Uncharacterized BCR; Function class=S Function unknown
  Homolog annotation: Query=10..301bp; Hit=30..320bp; Blast score=247; Percent Identity=45.0; E value=1e-65; Homolog= ybjX COG2990
MNYLQQPASSGMKLFADLVGKRVTPGEYWHSSSYRTKFALRSIFTPISTLKLLNKIAKTPLYNDILKKQPSLPCKLHRPYLSINFKRKQIVCALNEHYQILFEQLEPAIINKIFDTHAYLLATVQGKNESFMIYIDSLDNLNKEGELSLYITTAENVVLAKCAFTLLTIKGKQTLFIGVLQGPAKMDNSLDIIRHATKECYGLFPKRLLIEAICRFASHANCEQILAVSNETHIYRSIRYWHKKKDKMVADYNAFWESLNGIRKENNDFHLPSAIERKSLEEIASKKRAEYRRRYQLLDELDNHIKVALTD

SEQ ID NO: 9802 - protein, 144 aa, Xenorhabdus bovienii
  Coding DNA sequence: Name=SeqID_3694
  Gene classification: Gene name=WecD; Function=Histone acetyltransferase HPA2 and related acetyltransferases; Function class=K Transcription
  Homolog annotation: Query=1..143bp; Hit=1..143bp; Blast score=121; Percent Identity=46.0; E value=2e-28; Homolog= PA1428 COG0454
MYIKQATETDFAILIQIWEASVRATHDFLPETIIEELRPLILNDYLPNLIIYKAVNDQHIIEGFVAVDQQRVEMLFISPQARGKGIGKMLLAFAMTELQINELDVNEQNEQGVGFYKHMGFQVFARSEVDGQGNPFPLLHMKLA

SEQ ID NO: 9803 - protein, 60 aa, Xenorhabdus bovienii
  Coding DNA sequence: Name=SeqID_3695
MGSTHRGFPNLDKNREIRFGGLLYIHQLSPHISQLFDVRLCVFTAILELKMIQYNRFNRK

SEQ ID NO: 9804 - protein, 128 aa, Xenorhabdus bovienii
  Coding DNA sequence: Name=SeqID_3696
  Gene classification: Function=Predicted transposase; Function class=L DNA replication, recombination and repair
  Homolog annotation: Query=1..124bp; Hit=139..248bp; Blast score=71; Percent Identity=38.0; E value=3e-13; Homolog= mll8100 COG3293
LTAGQAHESRSAIPLLDGIGIQRKNGFMKRRGKAVLADKGYSGGKLRGYLRKLRIKSIIPYKINEKGSTDGRTQFDEQAYRDRNVVERCFGFLKGNRRIATRYEKTARNYLSRVKLGCIRLFYRRLSN

SEQ ID NO: 9805 - protein, 152 aa, Xenorhabdus bovienii; identical to SEQ ID NO: 9077
  Coding DNA sequence: Name=SeqID_3697
  Gene classification: Function=Predicted transposase; Function class=L DNA replication, recombination and repair
  Homolog annotation: Query=1..126bp; Hit=1..117bp; Blast score=105; Percent Identity=46.0; E value=2e-23; Homolog= mll8100 COG3293

SEQ ID NO: 9806 - protein, 383 aa, Xenorhabdus bovienii
  Coding DNA sequence: Name=SeqID_3698
  Gene classification: Gene name=ProP; Function=77 Permeases of the major facilitator superfamily; Function class=G Carbohydrate transport and metabolism
  Homolog annotation: Query=12..377bp; Hit=13..377bp; Blast score=308; Percent Identity=50.0; E value=9e-84; Homolog= VCA0753 COG0477
VKLLRNNDSAFVPVAGLTVFAIASGYLMSLIPLSMASFSIDTSYASWLASAYYVGLLIGSIMIEPVIAKIGHRFSFISFLLLLAATVVVLPFFPNKESWLVIRCVAGIAVAGIFVVVESWLLMGDSPKERAKRLSFYMTSLYGGTTLGQLAIGFIGTQGIVPFMVVLALLLLATLPPLLISQGQPPALHHQSLSLKKIVQFSKPAIVGCITSGVVMGTIYGLMPLSLSQSHFDGEQVGVLMAATILGGMVIQPIVSKLSVIMSKTLLLAMVSLLGVFAMGMTYLSENYIVMIVALGLLGMSSFALYPIAITLACDKLDSSCIVATTQVMLLSYSIGSAIGPLSAGNFMLQHNGLMNFFFIVLLAAAIYMLLASLRRKDHILAN

SEQ ID NO: 9807 - protein, 34 aa, Xenorhabdus bovienii
  Coding DNA sequence: Name=SeqID_3699
MHCHCCAAVSLLSSPHKKISWICAASHQDFAEWR

SEQ ID NO: 9808 - protein, 74 aa, Xenorhabdus bovienii
  Coding DNA sequence: Name=SeqID_3700
MFINGFSCRLKPLNIRLYSRLKNSYSLSPTLIGDFLHSFMNLFIHEYQFFSLYLSGVKGYSPQRSRSLSDLPTA

SEQ ID NO: 9809 - protein, 409 aa, Xenorhabdus bovienii
  Coding DNA sequence: Name=SeqID_3701
  Gene classification: Gene name=FabB; Function=3-oxoacyl-(acyl-carrier- protein) synthase; Function class=I Lipid metabolism
  Homolog annotation: Query=1..409bp; Hit=1..409bp; Blast score=685; Percent Identity=82.0; E value=0; Homolog= Z4866 COG0304
MTRRVVITGMGGITALGHNWQSVSSGLKAGKNAVQHMSAWSEYDGLNTLLGAPVTDFSLPDHYTRKRIRSMGRVSLMSTRATESALERAGLLDNPILTHGETGIAYGSSTGSTKPVSEFATMLTEKHTHNITGTTYVQMMPHTTAVNTGLFFGLRGRVIPTSSACTSGSQAIGYAWEAIRHGYQTVMVAGGAEELCPSEAAVFDTLFATSQKNDAPKTTPSPFDTHRDGLVIGEGAGTLILEELEHAKARGAKIYGEIIGFATNCDASHITQPKSETMQLCMEMALKSAGRQSSDIGYISAHGTATDRGDVAESQATANVFGRNTPISSLKSYFGHTLGACGALEAWLSLEMMNEGWFAPTINLNEIDPACGELDYIMHQSREIQTEFIQSNNFAFGGINTSIVFRRWP

SEQ ID NO: 9810 - protein, 242 aa, Xenorhabdus bovienii
  Coding DNA sequence: Name=SeqID_3702
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=2..242bp; Hit=3..243bp; Blast score=371; Percent Identity=79.0; E value=1e-103; Homolog= Z4865 COG1028
MRSVLVTGASKGIGRAIACKLASDGFTVVVHYHRDAAGAAKTLEQIQANGGNGRTLGFDISDRTTSRELLEQDIEMHGAYYGIICNAGIAKDGAFPALEGSDWDSVIHTNLDGFYNVIHPCVMPMIGLRQGGRIITLSSVSGLMGNRGQVNYSAAKAGIIGATKALAIELAKRKITVNCIAPGLIDTDMIQMEEPALKEAMNIIPMKRMGHVDEVAGLASYLMSDIASYVTRQVISVNGGML

SEQ ID NO: 9811 - protein, 158 aa, Xenorhabdus bovienii
  Coding DNA sequence: Name=SeqID_3703
  Homolog annotation: Query=1..154bp; Hit=1..151bp; Blast score=183; Percent Identity=57.0; E value=8e-46; Homolog= ref|NP_290038.1|
MSDYLSVDRYIPHEAPMILLENVISVSSDSVHCQVTVSKNSVLSPFLNAEGHLPGWFAIEIMAQTIGVWSGWHRHAKKEEDSALGMLLGGRAIRCLTPFFANGQVLDIHMNLLLQDEKFGSFEGDISGNGEILATGRLNTYQPDQTELKKLFQQDGVA

SEQ ID NO: 9812 - protein, 389 aa, Xenorhabdus bovienii
  Coding DNA sequence: Name=SeqID_3704
  Gene classification: Gene name=FabB; Function=3-oxoacyl-(acyl-carrier- protein) synthase; Function class=I Lipid metabolism
  Homolog annotation: Query=1..387bp; Hit=1..386bp; Blast score=517; Percent Identity=66.0; E value=1e-147; Homolog= Z4863 COG0304
MIYIAAVGMLNALGNNADDIAQNLVLGKSPGMYARSDWLQPDESCFLGGIEEVELPIIPEPLFMHNSRNNQLLLAALMQIKPQVETAIAFHGRDRIAVIMGTSTSGLDEGDKHVSRGIKQLPDANYHYYQQELGDPSRFLASYLNIEGPAFTISTACSSSSRAIISGQRLIEMGLVDVAIVGGADTLSRMPINGFNSLESLSRTQCAPFCENRQGITIGEASTLLLLTKAPQPVALLGVGESSDAWHMSAPHPEGKGAIDAINMALNNAKLSPQDIGYINLHGTGTTLNDQMESLVINQLFGENTPCSSTKHLTGHTLGAAGACEAALCWILLTRELPLPAQDFSRSERDKSLPACGLLSQPQALAKPIVMSNSFAFGGNNTSLILGAA

SEQ ID NO: 9813 - protein, 187 aa, Xenorhabdus bovienii
  Coding DNA sequence: Name=SeqID_3705
  Homolog annotation: Query=3..185bp; Hit=8..192bp; Blast score=216; Percent Identity=55.0; E value=2e-55; Homolog= ref|NP_290036.1|
MIRLFILSLVCLLAACSNFPQNGSPSAWLKPGVRVSLPAPAITPAIHEQQLLTATVKGKAQSLIVLLNADEQKLSLAGLSSLGIRLFKLDYDRNGIHAEQSIVVPEIPPANQVLADIMLSYWPISSWQPKLPTGWTLSDTVNRRQLKDNHGQVITEIHYDTQNEQRRPIRVQQFIFGYEIAIQHLEE

SEQ ID NO: 9814 - protein, 774 aa, Xenorhabdus bovienii
  Coding DNA sequence: Name=SeqID_3706
  Homolog annotation: Query=16..773bp; Hit=15..772bp; Blast score=874; Percent Identity=63.0; E value=0; Homolog= ref|NP_290035.1|
MTKNNTSNSEPRLLPIFWLLICGILLVSLVVLLPQSRLSTSVLALLPAQSAGDMPPALKDEFMQRLDRQLVWMVSPGQKEDAAPAQFWLEQLQKAPFLAAVKGPMAQDQQQAWGRFYYEHRNAMLDPATRDRLQENGNRQADWILSQVYSAFSGVSGQELNNDPLMLVRGSQLALQQTSSRLRLQNGWLVAKDETGRNWYLLHGELKSSSFDMQQGHDAVIELAELQQSLKNVFPDAEVISRGTLFYSDYASQQAKHDISTLGSATVLGVLLLIYGVFRSLKPLLLCVLSVSIGALAGTVLTLAIFGELHFMTLVMSISIIGISADYAIYYLTERMVHGQETTPWQSMQKVLPALLMALATAVIAYLIMMFAPFPGLRQLAVFAAAGLTASCLTVVCWYPRLTKNLPVRPIPAMITLMRWLALWRRQRLFYIGLPVFLALFALLGISRLQVNDDIAQLQALPQDIHQQEKRIAELTRQRSDQKWFVIYGESAEQTLQRLESFIPKLDAEKQHGTFKNYQRLPLSSLAQQQRDLALIQTATPNIMARLTDTGLPAKQPDLHPMTVTPDEWQNSIISEGWRLMWTTLPDGQSGVLLPVNGVKDSVRMRQLAEQQNGVSWVDRKLAFDEMFQFYRTMLGWLLAGSVIIITVSYIMRLGLRRGLISVLPSLLSLGCGLATLGFSGHSINLFSILALVLVLGIGINYTLFFSNPRGTPLTSLLAISVAMCTSLLTLGMLVFSSTQAISSFGIVLCSGIFTAFLLSPLAMPERQKRNKKS

SEQ ID NO: 9815 - protein, 199 aa, Xenorhabdus bovienii
  Coding DNA sequence: Name=SeqID_3707
  Homolog annotation: Query=16..197bp; Hit=17..198bp; Blast score=197; Percent Identity=61.0; E value=1e-49; Homolog= ref|NP_290034.1|
LLAANLFNLAHNVAQATTLDELQQRFANQPVVRAKFTQERQIDGMPQPLHSSGEMLVSPHKGLWWHQQKPFPLTMLLDDSRMVQVMPGQAPQVITAESNPQMFQFNHLMRALFQADRAVLEENFKTDFKDLGQEKWQLILTPKTSPLDKLFTTITLQGQANLDSILLTDRQGDRTELFFTQHRLTPKTLSHDEEQHFKF

SEQ ID NO: 9816 - protein, 140 aa, Xenorhabdus bovienii
  Coding DNA sequence: Name=SeqID_3708
  Gene classification: Gene name=FcbC; Function=Predicted thioesterase; Function class=R General function prediction only
  Homolog annotation: Query=1..140bp; Hit=1..140bp; Blast score=226; Percent Identity=77.0; E value=7e-60; Homolog= Z4859 COG0824
MLTDPRFTAEVELTVPFHDSDPMGVVWHGNYFRYFEIAREALLNQFNYGYRQMRESGYVWPIVDTRVKYRESLQFEQKIRVRATIEEFENRLKIAYHIFDAVSGRKTTTGYTIQVAVEENTQKMGFVSPDILFERMGVRP

SEQ ID NO: 9817 - protein, 571 aa, Xenorhabdus bovienii
  Coding DNA sequence: Name=SeqID_3709
  Gene classification: Gene name=WcaA; Function=Glycosyltransferases involved in cell wall biogenesis; Function class=M Cell envelope biogenesis, outer membrane
  Homolog annotation: Query=1..247bp; Hit=1..244bp; Blast score=364; Percent Identity=69.0; E value=1e-100; Homolog= Z4858_1 COG0463
MSLNAHAITPCVIIPCYNHGSTMPTVLARLAPFKLHCFIVDDGSAADTRHSLEALVKTTPDVTLIRLERNQGKGGAVMAGLKAAANAGYSHALQLDADGQHCIEDIPKFLDKAQQHPASLISGSPMYDASVPKSRLYGRYMTHFWVWVETLSFSIKDSMCGFRVYPLAPTLQLLSQKEIGRRMDFDIEIMVRLYWQGTESEFVPTKVTYPANGLSHFDALRDNLSISWMHTRLFFGMLPRIPSLLWRNRRHWSDIQERKGLHGMKFMLAVYRLLGRRPFEWLLYPVVGYFWATGGAQRQASRQYLERLKQTLHHQKIPLPHGLNSYRHYLRFGVAMLDKIASWRGDLKWGKDVEFAEGSEAVLLNGNTDGKLLLVSHLGDIEVCRALAQHAGKQTINALVFTEHAQRFKQIIEEVSPQAGINLLPVTDVGADTAIMLKEKIDAGEWVAIVGDRVAINPSRTHTPRVVWSQFLGHPAPFPQGPFILASVLRCPVLLMFALRQNDQFENSQLKIHCEPFADPLKLPRNQREQALQQAVDHYASRLEHYALQSPLDWFNFFDFWQLPADMKGKE

SEQ ID NO: 9818 - protein, 134 aa, Xenorhabdus bovienii
  Coding DNA sequence: Name=SeqID_3710
  Gene classification: Gene name=FabA; Function=3-hydroxymyristoyl/3 -hydroxydecanoyl-(acyl carrier protein) dehydratases; Function class =I Lipid metabolism
  Homolog annotation: Query=16..134bp; Hit=1..117bp; Blast score=120; Percent Identity=53.0; E value=4e-28; Homolog= Z4857 COG0764
MPKASAHGLHYRSYLMKPVEIYREQPAPNEAIVHLYLDPALDWFRGHFPIQPILPGVAQIDWVMHYAQTLLAPGWSFSSIEMVKFQLPLQPGNRLQLNMIWTEEKNLLIFHYGVENPNSGELHPASQGKIKLCR

SEQ ID NO: 9819 - protein, 461 aa, Xenorhabdus bovienii
  Coding DNA sequence: Name=SeqID_3711
  Gene classification: Gene name=Acs; Function=Acyl-coenzyme A synthetases/AMP-(fatty) acid ligases; Function class=I Lipid metabolism
  Homolog annotation: Query=12..460bp; Hit=3..452bp; Blast score=394; Percent Identity=47.0; E value=1e-109; Homolog= Z4856 COG0365
MAGTPTGEKTMKTHAISQWLSRDDCPDSPISWQGNDSITLRTLRHDVMALYLRMAENTATRWALCFEDSYHFCVGLLATLHAGKIPVIPGHCREAQLQEQQSLFDGVLTDLPLTLSCPCWQLFPNEGKIDLPETVLPGIAPDAVLVLFTSGSTGVPKQIIKSVSVMDQETQWLASLWGKILQSCLIRASVSHQHLYGLTFRIWLPMSLGLPFERTMVEFPEQLTNNPRCALISSPAFLQQLDQNLPAPDCSFVVSAGGPLHFSDAEQVMQWLNITPHEIYGCTETGIMAWRARKTDDTVWTTFSGVSFEKEDEMGMRVYSPLLSDPDGMALDDRLSFDAQGNFTLMGRRDRTVKIGEKRISLSDIERRLREMDGIADTAVLTVKRGKRCHIGAVVVLDDETYAHYQQQGITRFSRYWRRQLKLWLEPVALPRYWRVVKTIPLNAQSKRSWPALQELFNEAR

SEQ ID NO: 9820 - protein, 167 aa, Xenorhabdus bovienii
  Coding DNA sequence: Name=SeqID_3712
  Homolog annotation: Query=2..167bp; Hit=29..190bp; Blast score=134; Percent Identity=50.0; E value=5e-31; Homolog= ref|NP_290029.1|
MISYGQFHAMLVVIILFFVLRLLLIRASSHNQSPTGWDTGWILSIAGIILGLASFFLRSHQLLMYYPVVVNSVLLTLFGSSLRYGPPVVERMARLKEADLPPEGVAYTRKVTQIWCLFFIFNGTVALGTCLYNDMKLWALWNGMVSYLLIGLLIAIEWLVRQQVKKR

SEQ ID NO: 9821 - protein, 44 aa, Xenorhabdus bovienii
  Coding DNA sequence: Name=SeqID_3713
MRNNKIKRFNERPQGLLFVLTMMIIVRSVIAQRPQQHPVQCVRI

SEQ ID NO: 9822 - protein, 82 aa, Xenorhabdus bovienii
  Coding DNA sequence: Name=SeqID_3714
  Gene classification: Gene name=AcpP; Function=Acyl carrier protein; Function class=I Lipid metabolism
  Homolog annotation: Query=2..81bp; Hit=3..82bp; Blast score=95; Percent Identity=78.0; E value=1e-20; Homolog= Z4854 COG0236
MEKQQIFQEVSQLLVKLFELSPEQITPDARLYEDLELDSIDAVDMVVHLQKKTGKKIKPESFKSVRTVQDVVEAVEQLLNEQ

SEQ ID NO: 9823 - protein, 85 aa, Xenorhabdus bovienii
  Coding DNA sequence: Name=SeqID_3715
  Gene classification: Gene name=AcpP; Function=Acyl carrier protein; Function class=I Lipid metabolism
  Homolog annotation: Query=1..85bp; Hit=1..85bp; Blast score=115; Percent Identity=74.0; E value=7e-27; Homolog= Z4853 COG0236
MQELQTEIKEIIIDTLNLEDITPADIETEAPLFGEGLGLDSIDALELGLAIKNRYGIVLSAESEEVRQHFHSVATLAAYIQLQQA

SEQ ID NO: 9824 - protein, 264 aa, Xenorhabdus bovienii
  Coding DNA sequence: Name=SeqID_3716
  Gene classification: Gene name=PlsC; Function=1-acyl-sn-glycerol-3 -phosphate acyltransferase; Function class=I Lipid metabolism
  Homolog annotation: Query=9..249bp; Hit=4..244bp; Blast score=274; Percent Identity=58.0; E value=7e-74; Homolog= Z4852 COG0204
MEQKTAINMIERINWVWRLTMTGVCFALFGIGGLLLSLIWFNLLLVFQRNADKRCRLARHSISACFRLFFFLTRKVGVLDYHFDGIEKIRTDKGCLIVANHPTLLDYVLLASTLPDVDCIVKSALLRNPFVSGVIRSANYLINSEAESLLPICRERLTAGHNILIFPEGTRTIPDHPITLQRGAANIAVRCGCDLRIVHIICSQKMLDKKSKWYQIPPKKPIYTITVGEQLTHENFAVDAESGQAVAARQLNRQLTHLLTPSNH

SEQ ID NO: 9825 - protein, 239 aa, Xenorhabdus bovienii
  Coding DNA sequence: Name=SeqID_3717
  Homolog annotation: Query=1..239bp; Hit=9..247bp; Blast score=289; Percent Identity=59.0; E value=2e-77; Homolog= ref|NP_753121.1|
MKLTLDITDWQAIAPGLSTPEEWKDWSIGSPATIDGSRSLAKCTQLPMMTARRLSSGSRLAVDCGLSILRRNEVDAVVYTSRHGELERNYQILVNLAQEECVSPTNFAMSVHNSSVGNLTIVAKAPLVSSSISAGVDSFQQGLLEVLTLFHAGYGKVLLVDFDGYLPSFYHDVIGAKTPTYPFAVALLLQQGKSLHCEKQPSSNTEPELPQSLQFLHGWLSHTQGFTVTGDHCQWQWNR

SEQ ID NO: 9826 - protein, 357 aa, Xenorhabdus bovienii
  Coding DNA sequence: Name=SeqID_3718
  Gene classification: Gene name=SmtA; Function=SAM-dependent methyltransferases; Function class=Q Secondary metabolites biosynthesis, transport and catabolism
  Homolog annotation: Query=7..357bp; Hit=2..352bp; Blast score=503; Percent Identity=67.0; E value=1e-142; Homolog= Z4850 COG0500
MTQPHNYDKDECSALEAITEAQRIAFAPMLFQTAVNLRDFGILSFLDKNHKQGATKDEICNDSELDSYGVGILLDMGLSGRIILKRDERYFLSKIGHYLLHDKMTRVNMDFTQDVCYQGLFHLKESLQKNKPAGLKVFGEWPTIYPALSQLPEPAKTSWFSFDHFYSDSAFNAALKTIFALNPKLIYDVGGNTGKWALRCCQYDSRVSITILDLPQQIELAEKNILSQGMADRISGYPVNMLSDCELPKEADIWWMSQFLDCFSETQIIGILRKISAAMKPDARVCIMELFWDCQPFEAAAYSLNATSLYFTCLANGNSRFYSIEDFTQFLHKAGFIVESQIDQLGLGHTLLICKKQ

SEQ ID NO: 9827 - protein, 73 aa, Xenorhabdus bovienii
  Coding DNA sequence: Name=SeqID_3719
  Homolog annotation: Query=1..73bp; Hit=57..129bp; Blast score=81; Percent Identity=54.0; E value=3e-15; Homolog= dbj|BAC93847.1|
MNDVSPGIIDGLLKNRSHDVKIRITYTDKNYTIHYVSSQNLKAHDGNIHRNYNRWINSLDNDIQLRLAAMANQ

SEQ ID NO: 9828 - protein, 101 aa, Xenorhabdus bovienii
  Coding DNA sequence: Name=SeqID_3720
MRILTSWLRFLRRPSIIPGETSFITHLRFCPASKMAFFTVGSEFFVMIVVCGVNIGAVRAQPASMATQAKLINSLDVIFMDFLWLDKCIKLVNVCVSRSLY

SEQ ID NO: 9829 - protein, 52 aa, Xenorhabdus bovienii
  Coding DNA sequence: Name=SeqID_3721
MIYAILMINVRLVVLIGRYFYVILKIGRVKFILQFYYLSVNEMFFHSPLLLL

SEQ ID NO: 9830 - protein, 32 aa, Xenorhabdus bovienii
  Coding DNA sequence: Name=SeqID_3722
MKCFFIHLSYYYKYYEFIGVYIFIFFMIVVFK

SEQ ID NO: 9831 - protein, 100 aa, Xenorhabdus bovienii
  Coding DNA sequence: Name=SeqID_3723
MRTETLPRDCTGRLVAQCRLRQSSGGLTSLKTFFRFVSGWTMVLCLEQKNMFQSKPLNSKISMRWKNAMLRDDLSSAPYISVLQRLSSSSIFTLIYKPNH

SEQ ID NO: 9832 - protein, 517 aa, Xenorhabdus bovienii
  Coding DNA sequence: Name=SeqID_3724
MAQRGYYLFCYVRIRAVTRWIVVWLLDTPRRPATYTHRYRHLVDSRIFAVPSQYDIRIDRRHSMINSLPLYDGDCFVQVNDDVAAKLDGFELRLLASRVVAIRDNQFFDLQNLIAGGGAITRNDNPYDLRRQNLAVLYYDLSRHGELELRESDADGARLAVLTPKVTVAASSSPIQAVRLSPSDRLAFLPFEETRNVPNIAADAIHNIATQLTLSHWPANRTPARYKANLSTESVLRFVPDMSEYPDVRHVTTDHFDLDGLASVYALIAPEHAQSHGQLLVDVARFGDFSCGHSTKARRLAFALNTITEQALHAAGTVPNESVRITALFRTLLPALRDLLDASVIRDALWRDAEQHHMETEALLDSPNVTIEQYPEIDLAVFRLPTSHVPYVRVPQRYFGFSPIAFHNRTPLSTIALVTQDDVVVHQRYEGWVELHSAAPRPRRDLSILARALQSAETEDCRWHYDGVQHIMPRLGRDGAPLSSLSVETIVCELKRFLAIAPAAWSPSVGCAKVVGG

SEQ ID NO: 9833 - protein, 92 aa, Xenorhabdus bovienii
  Coding DNA sequence: Name=SeqID_3725
MTIAVSACNTTMTASAALCIARDVVARRSNGVFTGGSCLSSVMLIMRPTVPVVTVNDCTLLIMPIVAHPAIPNACRALNRAIPVTGSMMSPH

SEQ ID NO: 9834 - protein, 467 aa, Xenorhabdus bovienii
  Coding DNA sequence: Name=SeqID_3726
  Gene classification: Gene name=ProP; Function=77 Permeases of the major facilitator superfamily; Function class=G Carbohydrate transport and metabolism
  Homolog annotation: Query=2..459bp; Hit=4..460bp; Blast score=175; Percent Identity=36.0; E value=7e-44; Homolog= Rv1634 COG0477
MSSNNAPSWGELLSGRNGLLSIALAGGVALHAINIYIATTILPSVVRDIGGLEYYAWNTTLFMVASIIGAPLSKNVLSRFGPRAAYLVALIVFCGGTLVCASAKDMLWMLVGRFVQGFGGGILFALSYALIRIVFDGRLWPRAMAMVSGMWGIATLCGPAIGGIFAHSDTWRLAFIALLPVAAVLAVIVLAQLPAYEKSSAQTERAAIGKILLLGVSVLIISIASLSKEIFANIAGVAAGLVIVVLIARVDRKSKIKLLPTGAYDIRASLGAIYACMSLLVIGMTSEIFVPYFLQTIHGYQPLIAGYATALMAAGWTVGSLFSSGRSAQTAQALVRRGPILVVLALIVLAIIMPSQHLLGPVSSLTLMCIALAAVGAGIGAAWPHLLTQVFTNAPAGQEDLASTSITTVQLYATAIGSAFAGIVANLAGFSDPGGLAGAQSAAMWLFAVFAIAPVVATFVVRRVRLT

SEQ ID NO: 9835 - protein, 287 aa, Xenorhabdus bovienii
  Coding DNA sequence: Name=SeqID_3727
MLTFELINLDINPTDAEQVTRTLSEQCTAAGYRLNMAEADNTTPDGIFVLSRGAPTAINSKRLAEVGRIAVAQIGIDPENTGGEASAVWHEYPQSMFCYPLSLEMKSVDASADVARDWLAGFATFTACIKMWRRLRDKPEDGRPRELRVNHINILAQDLDKSVDFYHRILGASYCYNLGPKKVVMELNGFDFFIEQTDTVTYPPGYHFGVRTDPEGVKSIAAIVGADGDIKIVKGNGPTLGYHSGPDRVRTAFYFEDPDGLVIEIYSPEIEMLESNPHLISQHFSQA

SEQ ID NO: 9836 - protein, 350 aa, Xenorhabdus bovienii
  Coding DNA sequence: Name=SeqID_3728
  Gene classification: Gene name=SmtA; Function=SAM-dependent methyltransferases; Function class=Q Secondary metabolites biosynthesis, transport and catabolism
  Homolog annotation: Query=25..306bp; Hit=8..298bp; Blast score=70; Percent Identity=24.0; E value=2e-12; Homolog= Rv0567 COG0500
MSELVTETIYESTNDKVALTSVIDLVKLSDQYRQSAVLHYAVAEKLFDLTQESCTSAKVAKNFGMVEGKVSILLNALVALGLLRKDGNEFLNTELTTRYLTSTSSDYIGAIVEHQHLQWENWPRLGEILRSEKPLNFQQESRFMRDERARDAFNDAMVRLSQPMRDVVSGLSVFANANTSIDLAGGHGTYIAEALHRHPQLTGQIWDLPTTRDAAQKTIEAYGLNGRLEFCEKNLLDALNFEKAAADVVMLNDCLHYFDETEALAVIRYASCLVKPGGALLILTMTMDENLVTPPLSADFSLHMMVNTNHGELHPTQWIARAVHGNGLSISEHAIGRYTLLIGQRPASEV

SEQ ID NO: 9837 - protein, 327 aa, Xenorhabdus bovienii
  Coding DNA sequence: Name=SeqID_3729
  Gene classification: Function=Uncharacterized BCR; Function class=S Function unknown
  Homolog annotation: Query=121..309bp; Hit=27..222bp; Blast score=90; Percent Identity=36.0; E value=3e-18; Homolog= CT145_2 COG1262
MKPMLADNPNHLSDRAAMALPENLFVARMPTTVFSMHLDLLQLEPAEWIAIAQNPSTSFERRYAAGTLLSFSGDPRIRPLDPEMCDVPGASVWLGTAPEQVPQVVAEWQRVGVIEEWIAKECPCYNVEIKAFRIMRYPVTNLEYRLFLEQTRAPWFPTSWFLGVYPGERANHPVWSVPPEAAEAYADWLSEATGRRFRLPREAEWEYAASGGTGSEYPWGNEFDPYAANTVEAGPLSTTPVGIFPLSRSAFGIDDLAGNVEEYVADDYSPYPGGDVINDDLASTQGSYRIARGGSFTRFGDLARCARRHGRYQRDIYAMGFRLVESL

SEQ ID NO: 9838 - protein, 231 aa, Xenorhabdus bovienii
  Coding DNA sequence: Name=SeqID_3730
  Homolog annotation: Query=71..169bp; Hit=63..163bp; Blast score=63; Percent Identity=36.0; E value=2e-09; Homolog= ref|NP_844858.1|
MSSDTKPHYIDAQRTIVPVDVPSTAPRDYEEVLRSDFVSSYNEGRDAWTEEAAMQQASVILHAHLGRSSDVLDAGAGRGRDTGFLLAQGHRVTAVDLVELPEWAQLVRNWGSQVQFRITPVTELDGENLFDGVLDNGCLHHQHPDAYIEYLRRIHDLLRPAGLFTISVFESKEPGRLYANKMRRLYREFTDSELTELLRVAHFTLVSVHRVPRPTAGLNYLVLTVRKSGSY

SEQ ID NO: 9839 - protein, 565 aa, Xenorhabdus bovienii
  Coding DNA sequence: Name=SeqID_3731
  Gene classification: Function=WD40 repeat protein; Function class=R General function prediction only
  Homolog annotation: Query=17..316bp; Hit=136..431bp; Blast score=90; Percent Identity=24.0; E value=3e-18; Homolog= slr0143_2 COG2319
MITHHAPISGIAAYRDKYVLTAGYDNQVILWDANTQRPLARAMHDHLANQGVFSPDGAYAVTSSSDYSARLWTVPDLRLVAVFADHEDDVEMSVFHPDKPLVATASRDHHVRVYDFSGKLLHTFKGHSADVISVAWMHNADELISSSDDGTIKRWSLEKNCLVADIDLGGIETDTIAIAADGRIFAGNDEGEIISIGTDGSQVTFRAHDAGVKRLVLDHNRSLLVSLSYDRTMRLWQVGPFGQLEELVSASLPPEVWPRSCSFEGDDHIVFATFQSGYRLYNWKTDEWDLTELAPTHVVNAAVSVDGQQWTIGDAGIVRVDQREHACMGSLCNFLTPVGDVILTGGQLGKVFDARTGRELYQHRSPLNCGVSFKRNGIDHAVIGAYTGEGIVLRIEGSQVTHIADLPLHGNAVKGVAISGDLLFSIAADASAAWYRVSTLEQVCTLKRAHEKIANGCTGLNDGYFASVSRDLKLRIWSPNHQADIIATPHTHSIKCVAAGVNGRYIATGSYNGRVAIYDRIDNLWVINVWVTTAGVSSLSYDPITHVFLASSYDGNVYHIPLEYI

SEQ ID NO: 9840 - protein, 40 aa, Xenorhabdus bovienii
  Coding DNA sequence: Name=SeqID_3732
MVFADLRAPIAMIRTIEGHSGLSHMPDPNPASLAQPVVSS

SEQ ID NO: 9841 - protein, 222 aa, Xenorhabdus bovienii
  Coding DNA sequence: Name=SeqID_3733
  Gene classification: Gene name=PspE; Function=Rhodanese-related sulfurtransferases; Function class=P Inorganic ion transport and metabolism
  Homolog annotation: Query=118..222bp; Hit=7..113bp; Blast score=97; Percent Identity=50.0; E value=1e-20; Homolog= Rv0324_2 COG0607
MKTINRTSHALNEMADFAKTLGHSHRLTLVEAIFRHESSVEHLAEISGLSITNTSQHLQQLRRAGFVQTRREGKHVLYRIGDGPVANILAALRDYLAYQQTEMQRVVSDSVHHPEHLEGVSVEELLRRQEEGVLLLDVRSEEDYAVGHIPGAINIPTEALVHHLGELPRNQDILAYCGGRYCVLSIQAVSLLRSKGFKALRLGDGFPGWRAAGLRVEVSPIG

SEQ ID NO: 9842 - protein, 402 aa, Xenorhabdus bovienii
  Coding DNA sequence: Name=SeqID_3734
  Gene classification: Gene name=ProP; Function=77 Permeases of the major facilitator superfamily; Function class=G Carbohydrate transport and metabolism
  Homolog annotation: Query=1..394bp; Hit=1..394bp; Blast score=287; Percent Identity=47.0; E value=1e-77; Homolog= PA2269 COG0477
MANPYRELLTTPGAMGLVIASSIVRLPQAMIGIGIITMLVQQTGIYWLAGSIAGTFALTNALIGPQVSKLVDQRGQSRVLPFMTAFSIGMLLALIIAVYMSAPTLLLFILAALVGTMPSMPAMIRARWTQLFRGKPQLHTAFSLDTVLTELAFIIGPPLTIGLSTSFFAEAGPLVAVLLLAIGVTVFLLQRETEPKVVVGIRRNASSTLLIPGVRTIVLALLAMGVIGGSIDVAVVAFANAQGWLASASFILAAYALGSMIAGLTFGALRISLPIEKQFFIGVLVTSVTAVLPIFSPDVYILSGMLFMAGVSFAPTMIIVMNLGTIIVPPSRITEGLTWMTTGISIGVALGSVLAGMVIDIYGARAGFGVTIVAGLIMVVIVLLGLRTLRATSAVCAEPTFL

SEQ ID NO: 9843 - protein, 59 aa, Xenorhabdus bovienii
  Coding DNA sequence: Name=SeqID_3735
MIERYAHLHASGVITNAVTTSFACSIKCTLQSPVNHPKSLHPVQRDTHQRRIINWRNHG

SEQ ID NO: 9844 - protein, 47 aa, Xenorhabdus bovienii
  Coding DNA sequence: Name=SeqID_3736
MGRNIPAFLAASYLGQALVGLVMCDNTGEMIRLMRLIYIIERFCKRR

SEQ ID NO: 9845 - protein, 44 aa, Xenorhabdus bovienii
  Coding DNA sequence: Name=SeqID_3737
MKSDRSPLAEYSQRSLFISTAEKKHSGLLGHESCFSWAEIYQHF

SEQ ID NO: 9846 - protein, 33 aa, Xenorhabdus bovienii
  Coding DNA sequence: Name=SeqID_3738
MSYGSGSVHLQVKPAMIIFLSAKEPVSLTYSFL

SEQ ID NO: 9847 - protein, 180 aa, Xenorhabdus bovienii
  Coding DNA sequence: Name=SeqID_3739
  Homolog annotation: Query=1..177bp; Hit=28..204bp; Blast score=218; Percent Identity=61.0; E value=5e-56; Homolog= ref|NP_639975.1|
MTYFSEQDVALINAHRKSENKMGFAVLLFCLRSIGFIPDINSPHPVSLLKSIASRLNLSDEFWQDYALGRDTTWREHLTELYRYINLRTFTKQIQQDCIGHLIPLTTRTDKGILLAEELLDYLQQNCIIISGMEVLDRICAEAMASGDKQVFTALNTQLTPKHKTALDSLLPSPNNQLTG

SEQ ID NO: 9848 - protein, 270 aa, Xenorhabdus bovienii
  Coding DNA sequence: Name=SeqID_3740
  Homolog annotation: Query=183..269bp; Hit=1..86bp; Blast score=108; Percent Identity=64.0; E value=1e-22; Homolog= emb|CAC38405.1|
MYTLGEFVAGKACSDNKRENACYFESTAETKPVSDGDNTIELKITIPERPFIAKEYPIGHEKDPFEKNKFESEIQGRIARKTYPRQGWASLCGPAAFFYCLQKDRPDIYEQSARELWKYGKTKIGRLDIKPGDGCRHPSGSFYNNGEPTISGLDWITLASLRDSENAIFSYNQVEAETAGVTMWGKLTEWFEKAGYEKIFDNISIFSHSNINDIINLNDYIRKGYIVVSLISVGMLKGSAGETSGKNHWIVWEGEVSSKGKSINLNKNSK

SEQ ID NO: 9849 - protein, 204 aa, Xenorhabdus bovienii
  Coding DNA sequence: Name=SeqID_3741
  Gene classification: Function=Predicted transposase; Function class=L DNA replication, recombination and repair
  Homolog annotation: Query=15..155bp; Hit=1..141bp; Blast score=151; Percent Identity=53.0; E value=5e-37; Homolog= Z4330 COG3335
MPIIAPIPRNERQKMKKLIQKTQNKDYARRMMALLMLHKGDTVSHVAKTLCASRSSVNRWVNWFTLYGLDGLKSLPPGRPAIWNLEPLLAVVSFLLKHSPQHFGYLRSRWSLELITHKINVLLDISLSQSTLYRYFYRAGIVWRRAAPTLRLSDPEHDEKRAKITGSYPMPQSNILFFMRMRWILTLTQKSGQIGVSRDNKSML

SEQ ID NO: 9850 - protein, 136 aa, Xenorhabdus bovienii
  Coding DNA sequence: Name=SeqID_3742
  Gene classification: Function=Predicted transposase; Function class=L DNA replication, recombination and repair
  Homolog annotation: Query=1..117bp; Hit=165..281bp; Blast score=140; Percent Identity=58.0; E value=4e-34; Homolog= Z4330 COG3335
VDIDLNPKIGADWCFKGQQKHVVTPGKNQKHYLAGCLNAKTKEITYVGGLRKNSDLFIKLLDTLNNQYVNAKTITLILDNYGIHKSQKVIAWLAKNPKFNLLFLPVYSPWLNKIERLWQSLHETVTRNHCCQFMGQ

SEQ ID NO: 9851 - protein, 294 aa, Xenorhabdus bovienii
  Coding DNA sequence: Name=SeqID_3743
  Homolog annotation: Query=1..283bp; Hit=1..283bp; Blast score=339; Percent Identity=57.0; E value=3e-92; Homolog= ref|NP_927753.1|
MSNLEELYCCVDDFCQKFIPLWHQQLIENGLLKRRREASLSLSEVMTLLILFHMSHYRDFKTFYIQHVKHYLKADFPRLVSYTRMLTLKHRALIPLCAFFSSRKAETQGIAFIDSTKIAVCHNLRIPRHRVFEGVAQRGKTSTGWFYGFKLHLVINDCGELLAVKLTSGNKDDRHPVKALVQGLTGCLYGDKGYLSQALCDELEAEGITLITHVRSNMKAKALSLWDKLMLRKRFLIETVVDQLKNISQIAHSRHRSQLGFLLEIVAGLIAYTFQPKKPSLNLRDCDIAIFKRS

SEQ ID NO: 9852 - protein, 40 aa, Xenorhabdus bovienii
  Coding DNA sequence: Name=SeqID_3744
METVCLVQAETSKMDIMKKNISHFYFIGLKTNPPNVCFKK

SEQ ID NO: 9853 - protein, 345 aa, Xenorhabdus bovienii; identical to SEQ ID NO: 7397
  Coding DNA sequence: Name=SeqID_3745
  Gene classification: Function=Predicted transposase; Function class=L DNA replication, recombination and repair
  Homolog annotation: Query=165..332bp; Hit=20..184bp; Blast score=76; Percent Identity=29.0; E value=4e-14; Homolog= BH2520 COG3335

SEQ ID NO: 9854 - protein, 66 aa, Xenorhabdus bovienii
  Coding DNA sequence: Name=SeqID_3746
LRITWNPSDYKTPVLTATEKDYSRIQTQGMPIHAGEITIKISGGVYGNMFTKVGKFNKIYTIKVKE

SEQ ID NO: 9855 - protein, 217 aa, Xenorhabdus bovienii
  Coding DNA sequence: Name=SeqID_3747
  Homolog annotation: Query=1..193bp; Hit=1..191bp; Blast score=233; Percent Identity=61.0; E value=1e-60; Homolog= ref|NP_287332.1|
MKKLLELRQQKTDLTQQMRSLLTRAEDEKRSLTTDEAKQFDDLRSQSDVLNAEIARYEVLSDEERNQVKNQTANEKLSNDELRNYILTGETRSLSTGVPVDGGYTVIPELNKQIMQQLADESVMRQICTLKTTCSNEYKQLVSVGGAAVAHGEEGKTRCETATPKMEEVSIKLFPIYAYPKTTQEIIDFSDVDNANARRTTATKSGCPYPLTARKPL

SEQ ID NO: 9856 - protein, 591 aa, Xenorhabdus bovienii
  Coding DNA sequence: Name=SeqID_3748
  Homolog annotation: Query=14..572bp; Hit=9..577bp; Blast score=645; Percent Identity=57.0; E value=0; Homolog= pir||S10632
MPQSAALAACISTPWNKPVLPITRPFPTYAEQYQKEEENRTIANAIKERARVQRLLRKQPSIVRLDVQYKASVLEKEQGVPRAEAFLSKTFVDRILPRVTLVTNRYQIQEISADNALYMARFNRIPDMSREDLELLANDIAEFVTQKLQTVADDMLPEDGDLKRAHVLYMRAAAITKAYRQDAPYWDKLTGRFFDETQVIAAISRMTSDKWWLGRLRRLAAEWREHLQISINRVSKKSSTYASKTTISEWKEQKHRTKEFIKSMELEDEEGNRISLIDKYYGSVANPAIRRTEMMVRIRGFENICNELGYVAEFYTLTAPSKYHATTRHGHRNRKWNGCSPADTQQYLSGLWAKIRAKLHRNNLRIFGIRVAEPHHDGTPHWHMLFFMQPDQADQVRAIIGEYALQEDRHELRTEKALKARFHAEKIDPEKGSATGYVAKYISKNIDGYAMDDERDDESNRPIKDAAIAASAWAARWRIRQFQFVGGAPVTVYRELRRMADHDAAMGLSIEFAAVHDAADNGDWANYINAQGGPFVRRDDLVARLWYETEQETNAHGEDVIRIKGVFSPLVGMDILIWWRSFVVRWHYPHH

SEQ ID NO: 9857 - protein, 38 aa, Xenorhabdus bovienii
  Coding DNA sequence: Name=SeqID_3749
LWHLWLEFAELAARLGLYAAGYRYGFHSPTPADTGLHA

SEQ ID NO: 9858 - protein, 155 aa, Xenorhabdus bovienii
  Coding DNA sequence: Name=SeqID_3750
MNLFMTTPSSIHFVNLDETDFSTIKNNKNRCIGVLNSCCEDVNVEILDRLNQCFIVRCVGVENIFDNQNLPTNCKKGDYVVLSQEGGYDWLDDIEHRITVSIDEVYYLRNGLDNPDETNISFYEYSLLTPEHFFYEGANENAHQACSPVSAGVGE

SEQ ID NO: 9859 - protein, 163 aa, Xenorhabdus bovienii; identical to SEQ ID NO: 7546
  Coding DNA sequence: Name=SeqID_3751
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 9860 - protein, 117 aa, Xenorhabdus bovienii; identical to SEQ ID NO: 7849
  Coding DNA sequence: Name=SeqID_3752
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 9861 - protein, 34 aa, Xenorhabdus bovienii
  Coding DNA sequence: Name=SeqID_3753
MPLLLWRISCGCAFPFCHQSDLLRRNQQSILRYS

SEQ ID NO: 9862 - protein, 91 aa, Xenorhabdus bovienii
  Coding DNA sequence: Name=SeqID_3754
VRGATVSTRLVLESFPDSLCSLYLENSCAVNSIASGSPMHSLAQSIVVRRLAPSPNVTPCALYQISTKSRNLRVSLALLSIHGLPLSLSNS

SEQ ID NO: 9863 - protein, 255 aa, Xenorhabdus bovienii
  Coding DNA sequence: Name=SeqID_3755
  Gene classification: Gene name=XerC; Function=Integrase; Function class=L DNA replication, recombination and repair
  Homolog annotation: Query=8..253bp; Hit=91..332bp; Blast score=297; Percent Identity=60.0; E value=6e-81; Homolog= ZintT COG0582
MLWASECMGDPLAIEFTAQLFSKYREQRLSGKLSRTKRVETVAPRTVNLELSYFLAVFNELKRLGEWEGDNPLENVRAFRTDESEMAFLTHEQIADLFKACEESSAQDLSLVVKIALSTGARWAEAETLQRSQITQNKITFIKTKGKRNRTVPISQDLYDEISNKSSKKGKLFTPCYYAFRSAINRAKIELPDGQLSHVLRHTFASHFMMNGGNILVLQRILGHTDIKMTMRYSHFAPEHLDDAVRLNPLSRKTI

SEQ ID NO: 9864 - protein, 237 aa, Xenorhabdus bovienii
  Coding DNA sequence: Name=SeqID_3756
MKKLFKEHGHYFILVIIIFIAVISLILYFYTFNSSLSNNSGDWGAFGSFVGGIWGPLATIGSIAVLIRTLRTMQNQLKESEIIRNFGHILELLKALNSIMNRVISNQKEADNNGLYKWMTDSIEPIVDDSSHTQEKLLDIGRKAARQNSDIKNGCIVLTEILRKIKNIENQESQQTAKIMLQSSLSETHRFLLYCGANEQNFEISQELESYGFSDLPSSLNKKIYCEKFLDEDGDPT

SEQ ID NO: 9865 - protein, 55 aa, Xenorhabdus bovienii
  Coding DNA sequence: Name=SeqID_3757
MAFQTCPLVLTKRFIVRNFLMKMETPLKVSQKCRDKKETSNNIALYFNLTCCFLF

SEQ ID NO: 9866 - protein, 373 aa, Xenorhabdus bovienii
  Coding DNA sequence: Name=SeqID_3758
  Homolog annotation: Query=1..369bp; Hit=3..372bp; Blast score=248; Percent Identity=36.0; E value=1e-64; Homolog= ref|NP_415977.1|
MKELVDVFSDFPDPRCQGKVKHRFIDILVIAVCAVIAGANAWTDIEQYGQLKKDWLSSFLPLKEGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDGHGRTVRRRGWVLPLTSETKHLRSWPDIQALLVTETIRQEHYSDTVTSDFRYYLSSCHDSPAFQLGAIRKHWAIENSLHWVLDVTFREDDSRMRERVATRIFAQLRKMALNIVKRDINSKLSLSARRKSAGWDNGYMEALLFNQF

SEQ ID NO: 9867 - protein, 45 aa, Xenorhabdus bovienii
  Coding DNA sequence: Name=SeqID_3759
VINITDKDTTTAHCRSSVNRLYLTLLPEGILWQGLRMKFWSAKID

SEQ ID NO: 9868 - protein, 87 aa, Xenorhabdus bovienii
  Coding DNA sequence: Name=SeqID_3760
  Gene classification: Gene name=Nlp; Function=Predicted transcriptional regulator; Function class=K Transcription
  Homolog annotation: Query=7..71bp; Hit=7..71bp; Blast score=90; Percent Identity=72.0; E value=4e-19; Homolog= sfsB COG3423
MNNVKNDWHQADIIAALRKRGTTLAAVSRESGLSSSTLANTLSRPWPKGEWIIANYLEIHPSEIWPSRYFDSYGRLIERHARNKLLE

SEQ ID NO: 9869 - protein, 131 aa, Xenorhabdus bovienii
  Coding DNA sequence: Name=SeqID_3761
  Homolog annotation: Query=1..130bp; Hit=234..364bp; Blast score=192; Percent Identity=73.0; E value=1e-48; Homolog= ref|NP_931002.1|
MQISAGLPKDLQGQWPSVHSLIEVVSERGEKGEIHRDSRWYISSLPLEPEVAAKAIRRHWAIENELHWVLDMTFREDTLSLKDPEGAAQMALFNRIALNVIKQHTRMKDSHAAKRRRAGWSGEFRNELIFG

SEQ ID NO: 9870 - protein, 66 aa, Xenorhabdus bovienii
  Coding DNA sequence: Name=SeqID_3762
VYGWPLALKVFRKSGTDLHNSAKFCTSMSFIFLCKFNPFITIVVAGKTRFYKLVKSTLIAFNTDDS

SEQ ID NO: 9871 - protein, 58 aa, Xenorhabdus bovienii
  Coding DNA sequence: Name=SeqID_3763
  Homolog annotation: Query=1..57bp; Hit=1..57bp; Blast score=66; Percent Identity=68.0; E value=9e-11; Homolog= ref|NP_930709.1|
VKQSEFRRWLESQGVEIKNGKNHLILLNGDARSAMPRHPSKEINEKLRLAILKQLKLK

SEQ ID NO: 9872 - protein, 139 aa, Xenorhabdus bovienii
  Coding DNA sequence: Name=SeqID_3764
  Gene classification: Function=Uncharacterized ACR; Function class=S Function unknown
  Homolog annotation: Query=2..136bp; Hit=7..142bp; Blast score=116; Percent Identity=50.0; E value=8e-27; Homolog= Z2281 COG1598
MIMRYPVNIEEDGTNLFVSFPDIPEALTCGDDLADAKVMAYDALLTAFSMYFDDESKEIPLPGNTVTEHHIDIPASVAAKILLLNAMVRSGVSRSELGRRVGIQKQNVKQLLDVYHATKIDTVEKALSSLGYELILTAA

SEQ ID NO: 9873 - protein, 34 aa, Xenorhabdus bovienii
  Coding DNA sequence: Name=SeqID_3765
MIIKEKFHFTWKSRSWRKAALNCGIQTGCGFVGY

SEQ ID NO: 9874 - protein, 258 aa, Xenorhabdus bovienii
  Coding DNA sequence: Name=SeqID_3766
MIHMIDYNVASDSDLLAELNKLSGDSSVGVSRRKKEFLYIIRKLGTDEYPIAVLSGDLDGKKGTLILLTNTNIHFVRISLFKKVHHDKFPVVSITGCEDKKGLLFAKIVFHIDDQEYVFSNIEKKPLEKFISRMWRSWGYESAPDKQTVSQPSESQTTASTIPSKDPKQPILDTSSLVEKLELIEELKDFEVINTKEFNTLKNYILAANLDHSLATVNIETLAKDLDRLNDFVNDGVITKKDFSAQKQALLEALPTSK

SEQ ID NO: 9875 - protein, 33 aa, Xenorhabdus bovienii
  Coding DNA sequence: Name=SeqID_3767
MIGIGNVKNLVRHFCDTDYRKQKSHLLKSGLMH

SEQ ID NO: 9876 - protein, 46 aa, Xenorhabdus bovienii
  Coding DNA sequence: Name=SeqID_3768
MESKKKCQSNSVRVRQSTISNQNNLSKKRPESLKPKLAYHQTVKLR

SEQ ID NO: 9877 - protein, 260 aa, Xenorhabdus bovienii
  Coding DNA sequence: Name=SeqID_3769
MNKHHLSAAIFDHHQIEDKFFSSISQMHAHISEHVRAYVTGLGTYALNFLLVTDGHMKTEEALKTAIQLMDENVSVPFGIFAVEPDSKTLEVIQQAGFVPDPDSMTTAMRLDLANWQMSEGAFLAYEIRNVDHCLADWAIPIESAFETGNMLSGQYQVCHQAALDAGKCLQHYALYVDGQPLCALTLSRVDNIVRLDDIGTVVGKQGKGYASALINYVLREAKQHGAGACYLDASHDGNALYQRIGFKPLFEYQGFIRES

SEQ ID NO: 9878 - protein, 650 aa, Xenorhabdus bovienii
  Coding DNA sequence: Name=SeqID_3770
  Gene classification: Gene name=RpoD; Function=DNA-directed RNA polymerase sigma subunits (sigma70/sigma32); Function class=K Transcription
  Homolog annotation: Query=35..650bp; Hit=1..613bp; Blast score=970; Percent Identity=90.0; E value=0; Homolog= ZrpoD COG0568
LPLLKKAAIQENLLLAYLFRRPIPTNTLKCGYRLMEQNPQSQLKLLVTRGKEQGYLTYAEVNDHLPEDIVDSDQIEDIIQMINDMGIQVMEEAPDADDLMLAENTNDTDEDAAEAAAQVLSSVESEIGRTTDPVRMYMREMGTVELLTREGEIDIAKRIEDGINQVQCSVAEYPEAITYLLEQYDRVEAGESRLSDLITGFVDPNAEEDLSPTATHIGSELPQAELDDSDDDDDEESEDDADSEDDNSIDPELARQKFQELRDQYETTRQSIKSYGRSHPNTAAEILTLSEVFKQFRLIPKQFDYLVNNMRSMMDRVRLQERQIMKMCVELCKMPKKNFITLFSGNETTDTWFTAAKAMNKPWSDKLSEVEDDVMRSLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPSPEELAERMLMPEDKIRKVLKIAKEPISMETPVGDDDDSHLGDFIEDTTLELPLDSATSESLRSATHDVLAGLTAREAKVLRMRFGIDMNTDHTLEEVGKQFDVTRERIRQIEAKALRKLRHPSRSEVLRSFLDD

SEQ ID NO: 9879 - protein, 37 aa, Xenorhabdus bovienii
  Coding DNA sequence: Name=SeqID_3771
MRHLSREFCVFVLKFWFRTYFIRLYCNNHQLPYNRVI

SEQ ID NO: 9880 - protein, 582 aa, Xenorhabdus bovienii
  Coding DNA sequence: Name=SeqID_3772
  Gene classification: Gene name=DnaG; Function=DNA primase (bacterial type); Function class=L DNA replication, recombination and repair
  Homolog annotation: Query=1..582bp; Hit=1..581bp; Blast score=846; Percent Identity=71.0; E value=0; Homolog= dnaG COG0358
MAGRIPRAFINDLLARTDIIDLIDIRVPLKKKGKNHQACCPFHNEKTPSFTVNSDKQFYHCFGCSAHGNAIDFLMNYDRLDFVESIEELAAMHGLEVPYEANSGGGHIERHQRQNLYQLMDTINSFYQHSLTAPNGQPAQQYLLRRGLSEEVIHRFSVGFAPAGWDNVLKQFSHNAEDRKQLNDAGMLVTNDNGRTYDRFRERVMFPIRDRRGRVIAFGGRVLGDALPKYLNSPETEIFHKGRQLYGLYEAQQNHNSLSRLLVVEGYMDVVALAQFGIDYAVASLGTSTTAEHIQLLFRTTDNVVCCYDGDRAGRDAAWRALETALPYLNDGRQLRFMFLPDGEDPDSLIRKEGREVFEQRMEKALTLSVFLFESLLPQVDLSTPEGTTKISSLAMPLISQVPGETLRLYLLQELGNLLGTPDTTQLERFLAKLVKRDTSAYQALKLKPTTMRILIALLVQNPHLATLVPSLQGLFSAQIAGLPLFIELVDACLAQPGLTTGQLLEQYRDNEYAKQLEKLAAWNDIQVDEIAEKTFSDALNHLFASALDERFSFLIAKERTEGLTPEEREEVRLITESGGRK

SEQ ID NO: 9881 - protein, 71 aa, Xenorhabdus bovienii
  Coding DNA sequence: Name=SeqID_3773
  Gene classification: Gene name=RpsU; Function=Ribosomal protein S21; Function class=J Translation, ribosomal structure and biogenesis
  Homolog annotation: Query=1..71bp; Hit=1..71bp; Blast score=77; Percent Identity=100.0; E value=2e-15; Homolog= rpsU COG0828
MPVIKVRENEPFDVALRRFKRSCEKAGVLAEVRRREFYEKPTTERKRAKASAVKRHAKKLARENARRTRLY

SEQ ID NO: 9882 - protein, 44 aa, Xenorhabdus bovienii
  Coding DNA sequence: Name=SeqID_3774
MFQFSSALYKAVFIEVKFRTILKTAGTIPPATNPISIEVIGTCQ

SEQ ID NO: 9883 - protein, 67 aa, Xenorhabdus bovienii
  Coding DNA sequence: Name=SeqID_3775
LRFRFHRRTFLYLKLAFYYSSRHYSIYYYFMYYYSIRYSIDAMLFVCFASTSTGVSVSLSVYNHIRL

SEQ ID NO: 9884 - protein, 345 aa, Xenorhabdus bovienii
  Coding DNA sequence: Name=SeqID_3776
  Gene classification: Gene name=QRI7; Function=Metal-dependent proteases with possible chaperone activity; Function class=O Posttranslational modification, protein turnover, chaperones
  Homolog annotation: Query=1..342bp; Hit=1..336bp; Blast score=577; Percent Identity=85.0; E value=1e-165; Homolog= ygjD COG0533
MRVLGIETSCDETGIAIYDDKAGLLANQLYSQVKLHADYGGVVPELASRDHIRKTVPLIQAALKEAGLTSKDIDAVAYTAGPGLVGALLVGATIGRSLAFAWDVPAIPVHHMEGHLLAPMLEENTPEFPFVALLVSGGHTQLISVTGIGEYKLLGESVDDAAGEAFDKTAKLLGLDYPGGPVLSRIAQQGEAGRFVFPRPMTDRPGLDFSFSGLKTFAANTIRNHIHGHDPSEDEQTKADIARAFEDAVVDTLAIKCKRALEQTGFKRLVMAGGVSANRTLRTKMQEVMEKLGGEVFYARPEFCTDNGAMIALAGMIRLQGGTEGALGVTVKARWPLADLPSLQK

SEQ ID NO: 9885 - protein, 332 aa, Xenorhabdus bovienii
  Coding DNA sequence: Name=SeqID_3777
  Gene classification: Gene name=SmtA; Function=SAM-dependent methyltransferases; Function class=Q Secondary metabolites biosynthesis, transport and catabolism
  Homolog annotation: Query=27..329bp; Hit=35..336bp; Blast score=96; Percent Identity=25.0; E value=4e-20; Homolog= mll8050 COG0500
MLVIRISIMLTEMTTVYRKSIALFTFVDSKAPTYLSTQDGKTAEQLAKLCHVSVDRFHRLLNYMQSLGVLLEKDDKFYLTEQCSSLSDPNSLETLHIKFELNPICWSSWTKYNASLNEENDKSSFEIHYHEKFFDYLGHEQNKVLKNTFDNLMSKVTNIMNEDIIKHIPLHNISSVIDVGGGKGALAKEIKKNHPNINCAVMDQYDFSQQESEGITFINGNFFSAIPAGYDAYCMKNVLHNWPDEKVVDILKNCYQAMHKDSTLYIIDMIKERNNAEAESFDLYMDVLLLGKERYQSEFEALAKQTGFTITNMYKMSISKTGAPPHVIEIRK

SEQ ID NO: 9886 - protein, 62 aa, Xenorhabdus bovienii
  Coding DNA sequence: Name=SeqID_3778
MITFIIFILNKNGGYQYFLITLSKIIINKFKHNELKIIFLSYHLIRFRINNSSNKLNNDLIS

SEQ ID NO: 9887 - protein, 32 aa, Xenorhabdus bovienii
  Coding DNA sequence: Name=SeqID_3779
MQGGAFRVALMEKVGSPLRGLSVITRLAVPAL

SEQ ID NO: 9888 - protein, 267 aa, Xenorhabdus bovienii
  Coding DNA sequence: Name=SeqID_3780
  Gene classification: Function=Predicted membrane protein; Function class=S Function unknown
  Homolog annotation: Query=49..249bp; Hit=1..201bp; Blast score=328; Percent Identity=83.0; E value=4e-90; Homolog= ygiH COG0344
MTANSSINTISITTFSPFFGSPDTTSGQMCVLSIVRVKKTTLIHWRYLMSAIALGMIIFAYLCGSISSAILICRLAGLPDPRQNGSGNPGATNVLRIGGKGAALAVLICDVLKGMIPVWLAYKLNIQPTYLGIIAIAACLGHIYPVFFRFKGGKGVATAFGAIAAIGWDLMGLIAGTWLLTVLLSGYSSLGAIVSALIAPFYVWWFKPELTFPVAMLSCLILLRHHDNIQRLWRGQESRIWQKLKKKQEMTDKEKIQAVKEQEQQDE

SEQ ID NO: 9889 - protein, 120 aa, Xenorhabdus bovienii
  Coding DNA sequence: Name=SeqID_3781
  Gene classification: Gene name=FolB; Function=Dihydroneopterin aldolase; Function class=H Coenzyme metabolism
  Homolog annotation: Query=1..117bp; Hit=2..118bp; Blast score=166; Percent Identity=72.0; E value=3e-42; Homolog= ZygiG COG1539
MDIVFIEELAVITTIGVYDWEQTIKQKLVFDIEMGWDNKRASSSDNVEHCLDYAKVSEAVVHYVESQRFALVERVAEEVADILLNQFHSPWVKIKVSKPGAVAQAKSVGVVIERSLNGLV

SEQ ID NO: 9890 - protein, 393 aa, Xenorhabdus bovienii
  Coding DNA sequence: Name=SeqID_3782
  Gene classification: Gene name=PcnB; Function=tRNA nucleotidyltransferase/poly(A) polymerase; Function class=J Translation, ribosomal structure and biogenesis
  Homolog annotation: Query=1..389bp; Hit=1..405bp; Blast score=483; Percent Identity=58.0; E value=1e-136; Homolog= cca COG0617
VKVYLVGGAVRNQLLGLPVTERDWVIVGGRPEELLSQGYQQVGKDFPVFLHPKTHDEYALARTERKSGQGYTGFTCYAAPDVTLEEDLLRRDLTINAIAQTAEGELIDPYHGADDLKHRILRHVSGAFSEDPLRVLRLARFAAYFAHLSFSIAPETQSLITKMVKSGELSSLTPERVWRETEKALTSPSPQIYFQVLRDCGALAILFPEIDRLFGVAPISSWEKAPLQMDAGIHALKALHMATQLSQEIDIRFASLCAHTEAMQVKQMCERLRIPNAARDLAVIVAQYHNWVHTAEQLPPETLLALFNAVDAWRKPQRIEQLILCSQADTRAYAELEASRYPQGRYLRDAFTTVSQVNVQDVIARGFQGAEIRTELDRQRQLAITKWKQHSTG

SEQ ID NO: 9891 - protein, 206 aa, Xenorhabdus bovienii
  Coding DNA sequence: Name=SeqID_3783
  Gene classification: Function=SH3 domain protein; Function class=T Signal transduction mechanisms
  Homolog annotation: Query=1..206bp; Hit=1..206bp; Blast score=223; Percent Identity=58.0; E value=1e-58; Homolog= ygiM COG3103
MQKLHRLFILFLGFTLPLSVHAEEKRYVSDELSAYIRSGPSNQHRIMGSLNSGEEVTLLSNNSENGYSQVKDSKGRISWILTNELSTIPSLHERIPAMEQEIKTLTSKLANIDNDWKQRTADMQNKVSASDKIINDLKKENAKIQNKLTVAEKKVDMANLQLDDKQREIILQWFIYGGAVAGIGLILGLVLPHIIPRRKRKDRWMS

SEQ ID NO: 9892 - protein, 45 aa, Xenorhabdus bovienii
  Coding DNA sequence: Name=SeqID_3784
LTDNFNSTSTERICLSLNLYCGFRRRTRFSLRVTSFGECWGKEKK

SEQ ID NO: 9893 - protein, 313 aa, Xenorhabdus bovienii
  Coding DNA sequence: Name=SeqID_3785
  Gene classification: Function=Uncharacterized ACR; Function class=S Function unknown
  Homolog annotation: Query=5..312bp; Hit=4..321bp; Blast score=213; Percent Identity=42.0; E value=1e-55; Homolog= ygiF COG3025
MRSVEVELKLSVKPDAIPAVRQQLFQFSHHYFSPQHLTNIYFETPDNQLRRWDMGLRIRGFDGHYEMTIKTAGKVLGGLHQRPEFNVPLHHPELDLAQFPAHIWPENTDITQLQAQLIALFSTDFTREKWIVNHGQSEIEVALDQGVIRSGHRTAAICEFELELKKGNVADILLLADRLALQEGLRLANKSKAAQGYALAYGLTQTDLSQVPETLGWQQPLSVLLPEILAQWQEQEEGWLAGIPEGKTGLEQVLVWVEQLIEQQAEALPVFDSLPALKVALSAVNADAETLCYSASWLQCKLALTQWLMAQAR

SEQ ID NO: 9894 - protein, 946 aa, Xenorhabdus bovienii
  Coding DNA sequence: Name=SeqID_3786
  Gene classification: Gene name=GlnE; Function=Glutamine synthetase adenylyltransferase; Function class=O Posttranslational modification, protein turnover, chaperones
  Homolog annotation: Query=1..944bp; Hit=1..943bp; Blast score=1191; Percent Identity=66.0; E value=0; Homolog= glnE COG1391
MLPLSVPLAHQLQHVVANFQQSAGTIKSFAPHEQAVLSLSDFVAENLLLHPTWLDEIRQNPPQPEEGQHYPDWLNQALSVASDENSLMRILRLFRHRMLVRIAWLQALQGSTTEQILQQLSMLAEVLIVAARDRLYLRCCQDWGTPTNLEGVAQPLLILGMGKLGGGELNFSSDIDLIFSYPENGVTQGGRREMDNSQFFTRLGQKLIKVLDQQTVDGFVYRVDMRLRPFGDSGPLVFSFSALEDYYQEQGRDWERYALVKARILGYDEQVYCQELRQMLRPFIFRRYIDFSVIQSLRNMKGMIEREVRRRGLKDNIKLGAGGIREIEFITQVFQLIRGGREPSLQSRSLLLTLKAIEVLALLTPEQVRELEESYLFLRRLENLLQSIRDQQTQTLPESTLDRARLSWGMGFVDWDGLLAETEHRMHAVRSIFRQLIGDETDENVEEASHVPFKSVWQEALNRGELMTLVPHLDEADAQKMLDVIALFRHDVSKRTIGPRGRDVLDRLMPRLLAKIGVREDTNTVLERMVPLLLSIVSRTTYLELMLESEQVMTHVIRLCAASPMIASQLTLHPLLLDELLDPKSLYEPLPLEAYRDELYQYLLRIPEDDEEQLLEALRQFKQAQLLRIAAEDIAGVLPVMKVSDHLTYLAEAIIGTVVQQAWNQMVKRYGAPAHLSQQPGLGFAIIGYGKLGGWELGYGSDLDLVFLLDCPMDVVTDGERAIDARQFYLRLAQRIIHLFSTRTASGVLYDVDARLRPSGESGMLVSTLDAFDDYQKHEAWTWEHQALIRARMVFGDEKMRGDFERIRRETLCRSRDPDLLCQQVREMREKMHRHLGSHQHDQFDIKADPGGITDIEFIAQYQVLRYAPENAKLTRWSDNVRIFELMANYNIMDGQEAMALTQAYITMRDELHHLALQALPSRVPAESFSQQQILVRDSWQKWLGR

SEQ ID NO: 9895 - protein, 474 aa, Xenorhabdus bovienii
  Coding DNA sequence: Name=SeqID_3787
  Gene classification: Gene name=RfaE; Function=ADP-heptose synthase, bifunctional sugar kinase/adenylyltransferase; Function class=M Cell envelope biogenesis, outer membrane
  Homolog annotation: Query=1..472bp; Hit=1..472bp; Blast score=753; Percent Identity=79.0; E value=0; Homolog= rfaE COG2870
MKVILPDFHRAGVLVVGDVMLDRYWCGLTSRISPEAPVPVVKVDTIEERPGGAANVAMNIASLGAHSHLIGLTGIDDAARALNEKLSSVKVQCNFVAVPTHPTITKLRVLSRNQQLIRLDFEEGFQNVDAQPMLEKIQQSLPHVGALVLSDYAKGALSQIQTMIKLANEAHVPVLIDPKGSDFERYRGATLLTPNMSEFEAVVGHCKDDDELVEKGTKLVQDLELKALLITRSERGMSLLRVGQPPLHLPTQAQEVFDVTGAGDTVIGVLAAALAAGKPLNEACYLANAAAGVVVGKLGTSTVSPVELENAVRGRAETGFGVMSEAQLKNVVAQARQRGERIVMTNGCFDILHAGHVSYLSNARKLGDRLIVAVNSDASTKRLKGETRPVNPLDQRMIVLSALESVDWVVAFEEDTPQRLIAGVLPDTLVKGGDYTPEEIAGSQEVWAAGGEVMVLNFEDGISTSNIIKAIKNQ

SEQ ID NO: 9896 - protein, 127 aa, Xenorhabdus bovienii
  Coding DNA sequence: Name=SeqID_3788
MFLAGHKRHRLIYEGELCTAAILLTHYSACSVFFSIPACGFPIRTSSSSRRCSIAASFSRVRSKIWVWISNSSRLTRSSLLSWDCKTVRNFFSTSSPNSFTPFGIELWIWRAICSIFFGSSMISILL

SEQ ID NO: 9897 - protein, 97 aa, Xenorhabdus bovienii
  Coding DNA sequence: Name=SeqID_3789
MGYQNQGNFEELMLQKNTATKQQASASARLMLLFSPIRTITVGSRITLDLLTSVLSIVVLRHLRTTKKITANRALAGLMKSPESSFTLPPVGTFTLP

SEQ ID NO: 9898 - protein, 217 aa, Xenorhabdus bovienii
  Coding DNA sequence: Name=SeqID_3790
  Gene classification: Gene name=RibB; Function=3,4-dihydroxy-2 -butanone 4-phosphate synthase; Function class=H Coenzyme metabolism
  Homolog annotation: Query=1..217bp; Hit=1..217bp; Blast score=340; Percent Identity=81.0; E value=8e-94; Homolog= ribB COG0108
MNQTLLSLYGTPFQRVERAVAALRAGRGVMVLDDENRENEGDMIFAAETMTVEQMALTIRHGSGIVCLCLTEERRQQLQLPMMVENNSSQYQTAFTVTIEAAQGVTTGVSAADRITTIHAAIAEGAQPNDLSRPGHVFPLRAQPGGVLTRRGHTEATIDLVKLAGFKPAGVLCELTNDDGSMARASEVIEFAKRHDMPVVTIEDLVDYRQQVAKVAS

SEQ ID NO: 9899 - protein, 55 aa, Xenorhabdus bovienii
  Coding DNA sequence: Name=SeqID_3791
VCGLRPFKRTLNITDIFYPDTFSIPNSFLFHPRKQYGRKQYDLAGNLRYLLAIVY

SEQ ID NO: 9900 - protein, 64 aa, Xenorhabdus bovienii
  Coding DNA sequence: Name=SeqID_3792
VSSGYLQGHSLDYHDQRIKRVFSGDSFSSLIQQIKHSRLRRLSIMTKILWQDYDFSSLNTANQK

SEQ ID NO: 9901 - protein, 258 aa, Xenorhabdus bovienii
  Coding DNA sequence: Name=SeqID_3793
  Gene classification: Function=Uncharacterized ACR; Function class=S Function unknown
  Homolog annotation: Query=1..258bp; Hit=10..271bp; Blast score=322; Percent Identity=61.0; E value=2e-88; Homolog= ygiD COG3384
MSLLRIPALFVGHGSPMNALEDNRYSRAWFELGKKLPRPRAILVISAHWYTDGTVVTAMTQPRTIHDFGAFPQALHDMQYPAQGFPELAVLVQDILEPIEVETDFEHWGLDHGSWGILAKMYPDADIPVIQLSMDRNQPASFHYEIGKKLAVLRDEGVLIMGSGNVVHNLPAEKLGVEPYSWSLSFEQFVRESLTSLEEPHPLFHALDREDGKLSNPTPEHFLPLFYVMGTWDKKEPISTPVEGIEDGSLSMLSIQVG

SEQ ID NO: 9902 - protein, 386 aa, Xenorhabdus bovienii
  Coding DNA sequence: Name=SeqID_3794
  Gene classification: Gene name=Gsp; Function=Glutathionylspermidine synthase; Function class=E Amino acid transport and metabolism
  Homolog annotation: Query=1..386bp; Hit=1..386bp; Blast score=633; Percent Identity=76.0; E value=0; Homolog= ygiC COG0754
MKRIGITERPDWREKAAEYGFNFHTMHDQPYWSEEAYYQFSLSQIEEIEDATTELHQMCLQVVEKVVNSEELLTKFQIPKHCWEFIRSSWITSQPSLYSRLDFAYDGKNPPKLLENNADTPTSLYESAFFQWIWLEDQLNAGNLPANADQFNSLQEKLIERFGQLREKHGFGLLHMACCQDTEEDRGTIQYLQDCASEAGIPTEFLFIEDIGLGEKGQFTDLQDQVIGNLFKLYPWEFMLREIFSTKLADAGVRWLEPAWKSIISNKALLPMLWKMFPNHPNLLLAYFADEHYPEMDSYVIKPLFSREGANIRIIKQGREIASADGPYGKEGMIVQQFHALPKFGDSYTLVGSWLVDDQSAGICIREDRELITQDLSRFYPHIILD

SEQ ID NO: 9903 - protein, 240 aa, Xenorhabdus bovienii
  Coding DNA sequence: Name=SeqID_3795
  Homolog annotation: Query=16..228bp; Hit=1..221bp; Blast score=309; Percent Identity=81.0; E value=3e-83; Homolog= ref|NP_931156.1|
MGLALIQIPPRWMPPMTMKRTKEINHDTFRKTWRNYRLAPVALAISAVFMLSACEQNDETVSLYTNADECSQANPSQSEQCKTAYNNALKEAEKTAPKYASREECVAEFGEQQCTQTPAQAGVGTQAQSQAQSSSGSFWMPLMAGYMMGRLMGGSSTPSQPLFTSKSASSPANGKFVDATGKSYGSAAAGGRTMTVPKTAMAPKPATTTTVTRGGFGDSVAKQSTMQRSSASSTSRSMGG

SEQ ID NO: 9904 - protein, 454 aa, Xenorhabdus bovienii
  Coding DNA sequence: Name=SeqID_3796
  Gene classification: Gene name=TolC; Function=Outer membrane protein; Function class=M Cell envelope biogenesis, outer membrane
  Homolog annotation: Query=1..444bp; Hit=3..454bp; Blast score=473; Percent Identity=61.0; E value=1e-133; Homolog= tolC COG1538
MKKLLSLFIAMNLVGFSTLSHAEDLLQIYKQAKETNPELLKAQADRNSIVEKINEVRSPLLPQLGLNAGVDYGKSFRSKTDSENYGTNAKLQLTQTIFDMSKWYQLNQAEKSAGIADISYQVAQQKLILDTAKAYFDVLSKIDALTYTEAQKASLYRQLDQSSQRFKVGLVAITDVQNAQAQYDTILALEVSDRNNLENSLEGLRLMTGSYYPQLASLNIVQFKTNQPNPVDSVLKEAETRNLSLLSARLTQDLKREFIKDARTGYMPTVNLTASTGVTNKHDRGAQRSDSYDGGNSVGLSLSLPLYSGGLTNSQVEQAKYNFISASQDLENTYRKVIQDVRSSSNNLSASISSITANKQAVVSTQSSLDSMEAGYQVGTRTIVDVLDATTKLYQAKQSLSKARYDYLINQLVNKQARGTLNEDDLVALNNILGTKISTDASNIIKEMKTPTTR

SEQ ID NO: 9905 - protein, 71 aa, Xenorhabdus bovienii
  Coding DNA sequence: Name=SeqID_3797
MAQTASLAYWHSLLKSVVLVCTQRQIKQNSCTTRNANEKIALSFYRYESGRFQHFKPCRRSITNLQAGERN

SEQ ID NO: 9906 - protein, 211 aa, Xenorhabdus bovienii
  Coding DNA sequence: Name=SeqID_3798
  Gene classification: Gene name=MutT; Function=NTP pyrophosphohydrolases including oxidative damage repair enzymes; Function class=L DNA replication, recombination and repair
  Homolog annotation: Query=8..208bp; Hit=8..208bp; Blast score=296; Percent Identity=74.0; E value=1e-80; Homolog= rdsA COG0494
MSENLVSPLTFTTQDVEIISRKTLYRGFFKMTEYQFRHRLFRGGWSDNIKREVFERGHAAVLLPYDPVRDEVVLIEQIRIPAIETSETPWLLEVIAGMIEEGEDVEQVVCREAMEEAGLEVKRCQPALSYLSSPGGTTERMAIFVGEVDAATASGIHGLAGEHEDIRVLVVSREQAYQWVEEGIIDNAASVIAIQWLALHHEKLKTAWLGK

SEQ ID NO: 9907 - protein, 78 aa, Xenorhabdus bovienii
  Coding DNA sequence: Name=SeqID_3799
MPSSASPLLAKRCVSVICSILAVAPSATGTLSRLSKWFPFPVSHKNYSSVSLQKRSADWDTLPVFQHKLGIISLTMLS

SEQ ID NO: 9908 - protein, 271 aa, Xenorhabdus bovienii
  Coding DNA sequence: Name=SeqID_3800
  Gene classification: Gene name=Icc; Function=Predicted phosphohydrolases; Function class=R General function prediction only
  Homolog annotation: Query=1..271bp; Hit=9..275bp; Blast score=326; Percent Identity=61.0; E value=2e-89; Homolog= icc COG1409
VAEGATARILQITDTHLFASKGDALLGINTYRSYHAVLDAILEQSIDIDLIVATGDLVQDQTIGAYQNFAEGIARLPVPCVWLPGNHDYQPTMVDVLAAAGISPSKQILIGQHWQLVMLDSQVQGVPHGELTDYQIEWLQKCLDEHNDRNTIVMLHHHPVPSGCTWLDQHSLRNAPALAESLKDKRQVKAILCGHIHQELDKMWNGIRVMATPSTCMQFKPHCTNFMLDTVAPGWRYLELSVAGNREAKLQTQVHRLKSNEFCPDLDSDGY

SEQ ID NO: 9909 - protein, 202 aa, Xenorhabdus bovienii
  Coding DNA sequence: Name=SeqID_3801
  Gene classification: Function=Predicted esterase; Function class=R General function prediction only
  Homolog annotation: Query=1..190bp; Hit=1..190bp; Blast score=286; Percent Identity=71.0; E value=1e-77; Homolog= yqiA COG3150
MSTLLYLHGFNSSPQSAKANALKMWLHQQHPEIDMLVPQLPPYPEDAASLLEDLVMTRAGENIGLVGSSFGGYLAIWLSQCFGLPAVVVNPAVRPFDLLQNYLGENVNPYTEERYTLQQSHIYDLKVMHIDLLESPDLIWLLQQTGDEVLDYRQAIAYLMQCRQTVESGGNHAFIGFEHYFPQIINFLGLTSGNNKKIAKNR

SEQ ID NO: 9910 - protein, 631 aa, Xenorhabdus bovienii
  Coding DNA sequence: Name=SeqID_3802
  Gene classification: Gene name=GyrB; Function=DNA gyrase (topoisomerase II) B subunit; Function class=L DNA replication, recombination and repair
  Homolog annotation: Query=1..631bp; Hit=1..630bp; Blast score=1126; Percent Identity=85.0; E value=0; Homolog= parE COG0187
MTQSSYNAEAIEVLSGLEPVRRRPGMYTDTTRPNHLAQEVIDNSVDEALAGHAKHIEVILHSDQSLEVIDDGRGMPVDIHPEEKVSAVELILTRLHAGGKFSNKNYQFSGGLHGVGISVVNALSRRVEVTVRRDSQVHQIAFENGDKVQELEVIGSCGKRNTGTSVHFWPDESYFDIPRFSASRLTHLLKAKAVLCPGVEIVFKDKLAGTEQKWCYADGLTDYLLEAVNGLVTLPQAPFVGVLRGDTEAVDWALLWLPEGGELLAESYVNLIPTIQGGTHVNGLRQGLLDAMREFCEFRNILPRGVKLSADDIWDRCAYVLSLKMQDPQFAGQTKERLSSRQSAAFVSGVVKDAFSLWLNQHIQDAEQLAEMAIASAQRRMRAAKKVVRKKLTNGPALPGKLADCTSQDLKLTELFLVEGDSAGGSAKQARDREYQAIMPLRGKILNTWEVSSDEVLASQEVHDISVAIGIDPDSDDLSQLRYGKVCILADADSDGLHIATLLCALFVRHFLTLVKRGHVYMAMPPLYRIDLGKEVHYALDEGEKAAILERLSRKRGKPNVQRFKGLGEMNPIQLRETTLDPNTRRLVQLTIDDDNYQETFSVMDMLLAKKRSEDRRNWLQERGSSFDIEV

SEQ ID NO: 9911 - protein, 751 aa, Xenorhabdus bovienii
  Coding DNA sequence: Name=SeqID_3803
  Gene classification: Gene name=GyrA; Function=DNA gyrase (topoisomerase II) A subunit; Function class=L DNA replication, recombination and repair
  Homolog annotation: Query=7..750bp; Hit=3..743bp; Blast score=1189; Percent Identity=79.0; E value=0; Homolog= parC COG0188
MSEITHDGVERQPLHTFTENAYLNYSMYVIMDRALPFIGDGLKPVQRRIVYAMSELGLNNSAKFKKSARTVGDVLGKYHPHGDGACYEAMVLMAQPFSYRYPLVDGQGNWGAPDDPKSFAAMRYTESRLSKYAELLLSELGHGTVDWAPNFDGTLQEPKMLPARLPNILLNGTTGIAVGMATDIPPHNVREVVSALVAMLDNPNCSLDDVMEYIKGPDYPTEAEIITSKEDIRKIYKNGRGSVRMRAVWSKEESNVVITALPHQVSGAKVLEQIASQMRAKKLPMVDDLRDESDHENPTRLVIVPKNNRVDVEQVMNHLFVTTDLEKSYRVNLNMIGLDNRPNVKGLVEILSEWLVFRRETVRNRLNYRLEKVLKRLHILEGLLTAYLSIDEVIHIIRNEDEPKPVLMQRFELTETQAEAILELKLRHLAKLEEVKIRGEQDGLAKERDKLQAILGSERKLSTLLKKEIIADAENYGDHRRSPLKERSEAKAMSDHDILPSEPITVVLSEMGWVRSAKGHEIDPAGLNYKSGDSFRSAARGKSNQPVVFIDTTGRSYSVDPLDLPSARGQGEPLTGKLLALPAGASIEHLLIAKEEQKFLMASDAGYGFICTFSDLIAKNRAGKALITLPENAKVMQPLEITNEQDDMLLAITKEGRMLMFPVADLPQLSKGKGNKIVSIPAAQAASGEDMLSWLLVLPVQSSITLYFGKRKLLLRPEDLQKFRAERGRKGTSLPRGLQRVERIEVGMPRS

SEQ ID NO: 9912 - protein, 243 aa, Xenorhabdus bovienii
  Coding DNA sequence: Name=SeqID_3804
  Gene classification: Gene name=PlsC; Function=1-acyl-sn-glycerol-3 -phosphate acyltransferase; Function class=I Lipid metabolism
  Homolog annotation: Query=1..236bp; Hit=1..236bp; Blast score=352; Percent Identity=70.0; E value=1e-97; Homolog= ZplsC COG0204
MLAIIRGIIVFLLSILICLFGSIYCLFSPRNPGHVMTFGHAFGKLHKVFGIKMLKRIPEEAKQYGPSIYIGNHQNNYDMVTMSNAVQPRTVTVGKKSLLFIPFFGPLYWLTGNILINRENRSKAHGTISQVVQQIKKRHISVWMFPEGTRSRGRGLLPFKTGAFHAAIAAGVPIVPVCVSSTHDRIKFNRWNNGTIIVEMLPPIDTTKYTKEQVRQLAEHCRQMMQAKIEELNNEVEVMDKRR

SEQ ID NO: 9913 - protein, 473 aa, Xenorhabdus bovienii
  Coding DNA sequence: Name=SeqID_3805
  Gene classification: Gene name=SufI; Function=Putative multicopper oxidases; Function class=Q Secondary metabolites biosynthesis, transport and catabolism
  Homolog annotation: Query=1..470bp; Hit=1..468bp; Blast score=608; Percent Identity=63.0; E value=1e-174; Homolog= ZsufI COG2132
MSLSRRQFIQASGLAMCLGALPFAVRANKDQQTALPLPPLLESRGGQPLFLALQKTHWSFDGKNKVQVWGINGRYLGPTIRVRKGDNVKLIYSNRLSEPVSMTVGGLLVPGTLVGGSARLISSNENWSPIIPINQPAATCWYHANTPNRMAQHVYAGLAGMWLVEDEDSRSLPLPKNYGVDDFPVILQDKRLDNFGVPQYNPAINQGFLGDTLLINGVENPFIEVARGWVRLRLLNASNARRYQLQLSDGRPFYMVGTDQGLLPAPVTVQQLSLAPGERREVLVDMSKVDSVAITAGESAGMLDRLKGLFEPSTKLLSTTVLTIKASGLLSLVTDQLPTQLVVDTTEINSSIHNRQFVLGDATQGINGVLLNRNRIDISSQQGAWERWVVTTSAPQPFHIQGGRFKVISHNGNRPLPQDYGWKDTVWIEGRTELLVNMMQPSYEVFPFKYYSQILEMADDGVAGQMVVTPATS

SEQ ID NO: 9914 - protein, 36 aa, Xenorhabdus bovienii
  Coding DNA sequence: Name=SeqID_3806
MAPSALTGLRGIFLIPTSGKAVVVIIIGFFLSSWLE

SEQ ID NO: 9915 - protein, 31 aa, Xenorhabdus bovienii
  Coding DNA sequence: Name=SeqID_3807
MPRSPVRADGAIISENQGAPDDAITCLELGA

SEQ ID NO: 9916 - protein, 64 aa, Xenorhabdus bovienii
  Coding DNA sequence: Name=SeqID_3808
MAFSIPITRSIAIAAIKLIFIKSPYRQINSMKILDTIRKGLLSVDKISNLFRTNSVFMHQVPSK

SEQ ID NO: 9917 - protein, 161 aa, Xenorhabdus bovienii
  Coding DNA sequence: Name=SeqID_3809
  Gene classification: Gene name=FolA; Function=Dihydrofolate reductase; Function class=H Coenzyme metabolism
  Homolog annotation: Query=3..160bp; Hit=2..159bp; Blast score=262; Percent Identity=75.0; E value=9e-71; Homolog= folA COG0262
MNISLIAAMAMDRVIGMENAMPWTLPGDLAWFKRNTLGKPVVMGRVTYESIGRPLPGRLNIVISSQPARDDSATWVRTIEEALAAAGDVDEIMVMGGGKIYEQFIPLAHRMYLTHIDAEVIGDTHFPDYAPDEWNSVFTEYHDADEHNSHGYCFEILERRE

SEQ ID NO: 9918 - protein, 272 aa, Xenorhabdus bovienii
  Coding DNA sequence: Name=SeqID_3810
  Gene classification: Gene name=ApaH; Function=Diadenosine tetraphosphatase and related serine/threonine protein phosphatases; Function class=T Signal transduction mechanisms
  Homolog annotation: Query=1..268bp; Hit=1..268bp; Blast score=435; Percent Identity=75.0; E value=1e-122; Homolog= ZapaH COG0639
MATYLIGDIHGCYHEFRALLQQIAFHPSKDTLWLTGDLVARGPDSLEVLRYIKQLGPAVKLVLGNHDLHLLAVYAKISRNKPKDQLDKLLSAPDVDDLINWLRKQPMLQIDDELKLVMAHAGLAPQWDLDTARICAREVEAILRSDSYPLFLNAMYGDMPNNWDPELSGLARLRYSTNALTRMRYCFPNGQLDMICKSKPENVSAPLKPWFELPHNIPEEYSIAFGHWAALEGKGTPIGIYALDTGCCWGGKLTMLRWEDKQYFSQSSLLNR

SEQ ID NO: 9919 - protein, 125 aa, Xenorhabdus bovienii
  Coding DNA sequence: Name=SeqID_3811
  Gene classification: Gene name=ApaG; Function=Uncharacterized protein affecting Mg2+/Co2+ transport; Function class=P Inorganic ion transport and metabolism
  Homolog annotation: Query=1..125bp; Hit=1..125bp; Blast score=176; Percent Identity=65.0; E value=4e-45; Homolog= apaG COG2967
MLNEPRIHIQVQSTYVESQSEPEQQRFVFAYTISIHNLGHSPVQLISRYWRITNSDGHRTEIQGEGVVGKQPVILPGTDYRYSSGAILETPLGTMEGHYEMRDHDGRPFRVAIPVFRLAIPTLIN

SEQ ID NO: 9920 - protein, 274 aa, Xenorhabdus bovienii
  Coding DNA sequence: Name=SeqID_3812
  Gene classification: Gene name=KsgA; Function=Dimethyladenosine transferase (rRNA methylation); Function class=J Translation, ribosomal structure and biogenesis
  Homolog annotation: Query=1..268bp; Hit=1..268bp; Blast score=432; Percent Identity=78.0; E value=1e-121; Homolog= ZksgA COG0030
MNNKVHQGHYARKRFGQNFLTDQFIIESIVDAMNPQPGQAVVEIGPGLGALTEPVGERMDKMTVVELDRDLAARLHVHPKLKDKLTIIQQDAMTVDFGQLAKEQGQSLRVFGNLPYNISTPLMFHLFSYTDAIADMSFMLQKEVVNRLVAGPGSKAYGRLSVMAQYYCQIIPVLEVPPTAFTPAPKVDSAIVRLMPYKAMPYPVKDIRMLARVTTQAFNQRRKTIRNSLGDLFSVEQLSELGVDPGTRAENISVEQYCKMANWLSSQAKTARNQ

SEQ ID NO: 9921 - protein, 333 aa, Xenorhabdus bovienii
  Coding DNA sequence: Name=SeqID_3813
  Gene classification: Gene name=PdxA; Function=Pyridoxal phosphate biosynthesis protein; Function class=H Coenzyme metabolism
  Homolog annotation: Query=4..331bp; Hit=1..328bp; Blast score=485; Percent Identity=73.0; E value=1e-137; Homolog= pdxA COG1995
MVAMHNNKPIIITPGEPAGVGPDLVIALAQKEWPIQLVVCADPELMLSRAKQLNLPLQLQPYSPEYISPTQAAGTLTILPVSLHSPVIAGELNRENGIYVTETLAKACEGCLNGEFSALVTGPVHKGVINEAGVPFTGHTEFFADHSQCSRVVMMLATEELRVALATTHLPIMDVPKAITFDSLREVVTILNHDLKTKFGIRRPHIYVCGLNPHAGEGGHMGHEEIDVIIPALDSLRAEGIWLEGPLPADTLFQPKYLDHADAVLSMYHDQGLPVLKYQGFGRAVNVTLGLPFIRTSVDHGTALELAGTGQADVGSFITALNLAIKMIQNSNE

SEQ ID NO: 9922 - protein, 435 aa, Xenorhabdus bovienii
  Coding DNA sequence: Name=SeqID_3814
  Gene classification: Gene name=SurA; Function=Parvulin-like peptidyl -prolyl isomerase; Function class=O Posttranslational modification, protein turnover, chaperones
  Homolog annotation: Query=1..428bp; Hit=1..426bp; Blast score=499; Percent Identity=61.0; E value=1e-141; Homolog= surA COG0760
MKNWRALILGLMFSVNTVAMAAPQELNRVAAVVNNGVVLESDVDEQLQSVKLSAKHAGQQIPDEKALRHQILERLIMDDIILQMAKQMQITIPDQVLDSTISNIAAQNHMGLDELKKNLTAEGLNFNTYRNQIRKEMVIAEVRNNEIRRRVTILPQEVEALAKNLSSENNQNTELNVSNILIPLRENPSQAQVEKATAIINKILSELKNGADFGKLAITYSGDTQALKGGNMGWRKLQELPSLFTEQLQSAHKGQIIGPIRSGVGFHILKINDIRGSNMPPVAATEVNARHILLKTSPIMTDDQARSTLMKLREEILSGKTTFNAAAEKHSEDPGTAMRGGELGWNVPSTYAPAFRDALVKLKKDELSQPVHSTFGWHLIQLIDTRKVDRTDSAQKDNAYRLLLNRKLGEETQNWMQDLRASAYVKILDGSDAQQ

SEQ ID NO: 9923 - protein, 38 aa, Xenorhabdus bovienii
  Coding DNA sequence: Name=SeqID_3815
MSALQFFIRFPSYQSRLGGVIVFTLCLHHVYQYQNARW

SEQ ID NO: 9924 - protein, 661 aa, Xenorhabdus bovienii
  Coding DNA sequence: Name=SeqID_3816
  Gene classification: Gene name=Imp; Function=Organic solvent tolerance protein OstA; Function class=M Cell envelope biogenesis, outer membrane
  Homolog annotation: Query=1..658bp; Hit=127..781bp; Blast score=792; Percent Identity=59.0; E value=0; Homolog= imp COG1452
NLNSKDTDMEHGKYQMVGRQGRGNADKLMVRDENRYTIMNNGIFTSCLPGNDSWSVVGSEVILDRKEEVAEIWNARFRVANVPVFYSPYLQLPIGDKRRSGFLIPNGSYSNKEGVQFKLPYYWNIAPNYDATITPNLISKRGLKLDNEFRYLTKAGAGTVAFDWLGHDRLYADDKKLDKNLSDRESNNRWLFYWNHSGVLNQAWRFSADYTKVSDSKYFTDFTSQYGTSTDGYATQKFSIGYAQQNWDATLASKQFQIFTAGKDRKAYRAEPQLDLNYYKNDLGPFDFRTHAQVAKFTSVGKDYPEATRWHVEPTINLPLSNRWASLNNEFKLMATHYQQDVPATIQNSALEKTVNRVLPLFKSDAKMVFERTMYMNKDYTQTLEPRVQYLYVPYKNQDNINNFDSSLLQANYSGLFRDRFFSGLDRISSANQFTSGITTRIYDEDLVERFNLSVGQIYYFESPRTQDTDSKDSNKNILNTKKSTGATTWAGDVEWKINDSWGFKGGLQYDTRLNSVAMGNTVVEYRNDAERLVQLNYRFVNRDYIQATLGSQAPSFQQGISQVGLVASWPLADRWAFVGSYYYDTKEKQPASQLVGLQYNTCCWAVNVGYERKIVSWKDNSSEYDNKWSFNVELRGLSSNQSLGSQKMLERGILPYQRAF

SEQ ID NO: 9925 - protein, 186 aa, Xenorhabdus bovienii
  Coding DNA sequence: Name=SeqID_3817
  Gene classification: Function=Predicted transposase; Function class=L DNA replication, recombination and repair
  Homolog annotation: Query=13..82bp; Hit=9..78bp; Blast score=74; Percent Identity=50.0; E value=6e-14; Homolog= Z5815 COG1943
LSQHNEWLDGFLRKRHSVSKLVVHLIFTTKYRRTLFDGCMIEQLREAFTSAATKLECDIIEMDGEQDHVHLLIAYPTHSPISLSSCQPSPPSTSSGSRPAKVSLPAILLATPFTIEFMAKEQTDRTTLDLFADERRPGRPKTNPLSRDEQLRINKRNQLRRDKVKGLRRVELKLNEDAVDALNHLA

SEQ ID NO: 9926 - protein, 33 aa, Xenorhabdus bovienii
  Coding DNA sequence: Name=SeqID_3818
VSFSEKTVEPFIMLTQLKYSCRLLLSLNSINER

SEQ ID NO: 9927 - protein, 399 aa, Xenorhabdus bovienii
  Coding DNA sequence: Name=SeqID_3819
  Gene classification: Function=Predicted transposases; Function class =L DNA replication, recombination and repair
  Homolog annotation: Query=3..380bp; Hit=5..387bp; Blast score=233; Percent Identity=36.0; E value=3e-61; Homolog= DR1593 COG0675
MLRATKVRIYPTLEQAEYLNAQFGAVRFAYNKALHIKKHVYKRDGVSLSPRKDLKPLLATAKKSRKYSWLKAYDSIALQQAVINLNTAFDNFFNPKLRAKFPVFKRKHGKQSSYHCVGVKVLNEAIKIPKLTPIEARIHREINGEVKSITLSRTPTGKYFASILCKDGKEPPVPPDVIDADKSTGCDLGLTHFLICSDGRKQANPRYLIRASKNLRRKQKALSRKRKGSKNRGKARLIVARCHEKVANARGDFQHKLSRQLIDENQAVIVETLKTTHMLKNRRLARHIADAGWHSFVTKLEYKAKEAGKHLVRLDPWYASSKTCHCCGHQESEMPLSQRYWVCAVCQTEHDRDINAALNIQQQGLFELQAAGLVVSAHGGQRQTCHGQAAACEVGSLAR

SEQ ID NO: 9928 - protein, 142 aa, Xenorhabdus bovienii
  Coding DNA sequence: Name=SeqID_3820
  Gene classification: Gene name=LysR; Function=Transcriptional regulator; Function class=K Transcription
  Homolog annotation: Query=26..120bp; Hit=172..266bp; Blast score=62; Percent Identity=31.0; E value=1e-10; Homolog= lrhA COG0583
MVITKEIAGQPTNTNNNNILLIDSLHWVASKAIYFNEFQEIPLVIFSEGCVIRECAIKTLENVDKPYFFVYVSSSFENIKSAVEHGLGVSLLPLRALTNDLYVLSSEHGVPSVPAIKLVLHIAAQGDLYEFFADYLRRSLSE

SEQ ID NO: 9929 - protein, 32 aa, Xenorhabdus bovienii
  Coding DNA sequence: Name=SeqID_3821
MNSLLIIYAAHYQNSIQNFSLCKFEKEFSFLR

SEQ ID NO: 9930 - protein, 33 aa, Xenorhabdus bovienii
  Coding DNA sequence: Name=SeqID_3822
MKNTYIKLKQKRRRYNKYLMLVLLMTIFSEPSD

SEQ ID NO: 9931 - protein, 196 aa, Xenorhabdus bovienii
  Coding DNA sequence: Name=SeqID_3823
  Gene classification: Gene name=AcrR; Function=Transcriptional regulator; Function class=K Transcription
  Homolog annotation: Query=4..161bp; Hit=6..160bp; Blast score=77; Percent Identity=32.0; E value=9e-15; Homolog= uidR COG1309
LSKQTEKQRAKRKQIIDAAISCFIEKGFHATSTAEICKAAGMSPGNLFHYYPTKNAIIEAIAEEDSHDYNEILHTNDDENSVMATIEKMMTSLIHLYNQPDYARLSIEIIAEASRNPTINKIFIENEKKVRERLALLIRKGIETGEIDKQINAEQTASWLMITAGGAIGRELVEPNFKWLESMGSFTYMIRKIFTS

SEQ ID NO: 9932 - protein, 46 aa, Xenorhabdus bovienii
  Coding DNA sequence: Name=SeqID_3824
MLLYRLNVYSSYLIVRNSFMSITLIKMLKCYLCPAVNLHKNMPDIK

SEQ ID NO: 9933 - protein, 1027 aa, Xenorhabdus bovienii
  Coding DNA sequence: Name=SeqID_3825
  Gene classification: Gene name=AcrB; Function=Cation/multidrug efflux pump; Function class=Q Secondary metabolites biosynthesis, transport and catabolism
  Homolog annotation: Query=4..1015bp; Hit=16..1027bp; Blast score=793; Percent Identity=42.0; E value=0; Homolog= CC3197 COG0841
MKYQLSEWAIRKPIPTIVIFLALTVAGLFSFLKLPINANPVINFPVVTVTVTQNGSSPSELENAVTQPIERAVSGLPGIRHINSTITDGVSITIIEFDLKIDPHVATNDIREQITQIRSELPQSIDEPLISRIDVEGSAILNYAVQSKDKNLTELSWFVDDKLSKKLLMVPGVQKITRLGGTNKEILIEPDPVKMAALKISVADINQLLLQNNVNIPGGKMVVAGQDHTIRILGAKNEIDYLRQLKLPLANDNWIKLGDIATVRDSHKETITIARLNDEPVVGFAVFRAKGSSDTEVEKGVVRALQETGREYPDVNIKLVSSNVKYTVASYNATMQTLIEGAVLTVIVVFFFLKSWRATLIAAIALPLSILPAFFILHLFGYTLNSITLLALTLVIGILVDDAIVEIENIEKYIERGERPYIAAIKASDAIGFAIVAITITIVAVFLPVSFIGGFIGKYFVPFGITVSAAVLSSLLVARLVTPLMSAYLLQPKKHQKTDKTETPKWIKKYLSILEKTLKFRKTALLLAIVFLLGSLALVALLPSGFMPKADISITTIEVEAPPGTQAAQSDETLQKIIKKLQGRPEIIDIFSVAGVDGSSGEISQNKSNIIINLVPTGERDWSQKEFEQSLVPILNEIPDIRYNFGNSSGSRDISIVLASENPKILSQTIKQLRQEMMQLEGLKNIQLLQPLPRREIIITPNVDTAAKAGVTTDAIGTVIRTATIGEINSRVAKFNLPDRQVPIRVLLSKEDRDNLTVLNDLYVNSTSNVNVPVKSVANISFASGPDKIERIARQRKASIDADLNGIAVGTAFMQVNELPTMKKLPPEVKRVEYGEVEYMNEMFDRFTTTIMLSIMMVLAILIILFKDFLQPMTILIALPFAIGGAIIALLIYGAAIDLPVIIGILMLMGIVSKNSILLVEFILEKSRNGMPRNEAIIQAGRERVRPIIMTTIAMIAGMIPLVITSGADASFRAPMAISVIGGLLSSTLLSLLFVPVIYSYMDDFKNFITPHLKKFTSVTKDDLDYH

SEQ ID NO: 9934 - protein, 368 aa, Xenorhabdus bovienii
  Coding DNA sequence: Name=SeqID_3826
  Gene classification: Gene name=AcrA; Function=Membrane-fusion protein; Function class=Q Secondary metabolites biosynthesis, transport and catabolism
  Homolog annotation: Query=31..361bp; Hit=59..361bp; Blast score=99; Percent Identity=25.0; E value=4e-21; Homolog= CC3196 COG0845
MARNLLSLLGVCFSMFIFSTNAQSPQEQMHVSTTTMQAVQFTPSVKILGSVVAKNEIVISPALPQHIITEVLVEEGDYVKKGDVLATLETLVQDEKVKQAKAELEKALALIKQNEATSNQAQSELNRAKPLVNTGVISASEFDKYKMQANSSLSALNAAKAEYRQLQAQLEGEKTQRAKTTIFAPKEGVISERTAMAGMITDSSQLFKLIENNLHEFSAEAYISDLKQINTGIPAAISLTSGSKITGKVRYISPKINPVTQIGKIRIALENVPADVKLGDFGHALFQLKPEKVNAIPYSAVNMGNENKPSVYVVGKNNAVEKKEINTGRIFDNWIEIKSGLSPKDKIIVSASPFLQEMDTVAIMPQGK

SEQ ID NO: 9935 - protein, 51 aa, Xenorhabdus bovienii
  Coding DNA sequence: Name=SeqID_3827
LGNDIDGIMAAFERVSDQEHHSGLIQKQESLPDITLMRQNRQLCRYENVHS

SEQ ID NO: 9936 - protein, 86 aa, Xenorhabdus bovienii
  Coding DNA sequence: Name=SeqID_3828
MCPWVSDLRAELTQSGGNEGRTGDLRRPRHIAGCYVWYPCSARLSGNAKSLLAPDGEWMKRTLKSKASGNTFTGRLIPTGRPLISC

SEQ ID NO: 9937 - protein, 69 aa, Xenorhabdus bovienii
  Coding DNA sequence: Name=SeqID_3829
  Gene classification: Function=Putative transposase; Function class=L DNA replication, recombination and repair
  Homolog annotation: Query=1..58bp; Hit=99..156bp; Blast score=94; Percent Identity=79.0; E value=2e-20; Homolog= XF2303 COG3316
MDETYIKVKGQWKYLYRSVDTDGQTIDFLLTARRDAEAALRFFCKAIRQYGRPTVVTILFSLAKTLLVP

SEQ ID NO: 9938 - protein, 329 aa, Xenorhabdus bovienii
  Coding DNA sequence: Name=SeqID_3830
  Gene classification: Gene name=AraC; Function=AraC-type DNA-binding domain-containing proteins; Function class=K Transcription
  Homolog annotation: Query=207..320bp; Hit=4..117bp; Blast score=82; Percent Identity=33.0; E value=5e-16; Homolog= PA4436_2 COG2207
MKQLSITALVFSHTSVTSVAMPIEILTIAANAIGGPIPHVRIISPASQEMNGTNSLLTEPAPTSHSDLYHGQQPDIILVGSLGFPVWQPQYCSPEIIEWLKAMDEKHIPIVSVCSGTFILAKAGLLKTSATIHPHFSREFKDLFPHIPLYADKKITRDNNRFCISSAYGCSKSMMSIVELIYGQYAREQCSQFLFGENDPKISSDSVSFAPYRQHSDSLIHKLQDWMHTSPSEILSVADLANKIHLCERQMKRRFKIATGKTPIQYIQQIRLSQAKHWLEKSQKTIEEISHEVGYEDTRYFRELFKRCNGLTPKEYRQKYHHSGSFSVG

SEQ ID NO: 9939 - protein, 720 aa, Xenorhabdus bovienii
  Coding DNA sequence: Name=SeqID_3831
  Gene classification: Gene name=SunT (BS); Function=ABC-type bacteriocin/lantibiotic exporters, contain an N-terminal double -glycine peptidase domain; Function class=Q Secondary metabolites biosynthesis, transport and catabolism
  Homolog annotation: Query=19..718bp; Hit=25..718bp; Blast score=971; Percent Identity=72.0; E value=0; Homolog= VC1446 COG2274
MVDAFSFTSDAGTDDLTNNHALDCVAYLGTQFHKVASVRQLHHALGLDSLTLTDWQLREAIDAIGLHSKFDRLTADTAATLPLPALIELDQCWWVLLEVSPDQFTVLNPITEKQEIRPLHGTQTTPEEAKHSEYKILLVADKFLTKQQVKFGLSWFYPSIFRQKNQLRDIFLFAIVLQLFALASPLLFENVIDKVLVGRSLSSLHVLGLAMLALAVAEPLYGFLRNTVFGHMASQINAELSGRLYRHLVGLPLPYFKQRQTGQIIARVREMAQIRQFLTGSTLMLLLDLIFIILFLGVMFHYSTLLTWIVISSLALYFLLWIAIGPLIRRKVETEYEADAHATSFLTESVMGIETIKTTATEKRFLYQWQKVLSQQLIRRFSAQKSGLAAGQGIALIQKVVAALLLWWGVRSVLNGELSPGELIAFNMLAGHVTQPILRLAQVWQDFQHTLIALRRVGDILDEPMESSKQGLAASPELAGQIEFRNIRFRYHTDTPEVLANLSLTIKAGEFIGITGPSGSGKSTLTRLLQRLYVPQHGQVLVDGMDLAIADPVSLRRNMSVVLQESILFSGSIADNIRLCKPSASDEEVYRAATLAGATDFINEFPHKFAHPVGEKGSNLSGGQRQRIALARALLNDPKILILDEATSALDYESEAAIMSNLDEIRRNRTVISIAHRLNTIRHADKIFVLDQGTIVESGSHDDLLQQNGLYAQLWHQQTE

SEQ ID NO: 9940 - protein, 451 aa, Xenorhabdus bovienii
  Coding DNA sequence: Name=SeqID_3832
  Gene classification: Gene name=AcrA; Function=Membrane-fusion protein; Function class=Q Secondary metabolites biosynthesis, transport and catabolism
  Homolog annotation: Query=20..451bp; Hit=36..467bp; Blast score=534; Percent Identity=68.0; E value=1e-152; Homolog= VC1447 COG0845
MFKAILRKGIKNLRTPSPDYDFLPTHLALSQRPPSPFARYTAITLSIGVLVVLLWAYLGKLDVQATATGRLIASGRSQIIQAYEQSRLLSIHIQNGQHIEKNAPLLTLNTLGVNQDVTRLLEQREYLIEEKIRYQALLGKHDPESLPLFQQQTLSQQEKIQAHYEHEKHEFDAIITNLYAEMDVNLSSQKAKNGDIQALTNLRENINQRLQARKILSQKQVISRVEYLEQEKELLETQRIITQQKAELGILMTQYKSLEERLKGINTQKEREWFEKKKQAEMQLGVLKQELSKMQEREALEIVRSPVAGTVQQLSVHTLGAVLQPAQNLMVIVPDDHVQLAEIQILNKDVGFVRPGQHVTVKVDAFPYTRYGTIEGELLSISRDSTTDERLGLVFPAQISLRQNNIIVDGKPVEITAGMSITAEIKTDQRRVIDYLLSPIQEYQSEALREK

SEQ ID NO: 9941 - protein, 685 aa, Xenorhabdus bovienii
  Coding DNA sequence: Name=SeqID_3833
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..683bp; Hit=37..719bp; Blast score=951; Percent Identity=69.0; E value=0; Homolog= VC1448 COG1132
MISNGKPIVIPDKNINNNDDYLFTLNKLKKEHHISIKNKRSINKKLNTLSLPAILFDGNGHPFILAKHDEQRVLIQKPNQEAPEILDKENFIRLWSGRWIKIKQKSNQFNIRWFIPEFIRQRKNLTEILLFSFILQILALISPLVVQVVMDKVLVHQALSTLDVLIFGLVVASLIEVVLRGLREYQYAHTANRIDIKLGLKLVRHLLGLPLLFFKFRQVGAIVTRVRELETVREFLTGSMFTLCIDVLFMFVFIYVMSLLSGTLTLLFLATIPFYGLLAWWVTPKIEKAVEKQFTHAAINTSFLTETVAGAETLKSLAAEPRFIRRWDSQTENMVSTSYDVQQWDNRSSHLVMLLQKVTSAVIIWLGASEVLSLHMTIGQLIAFNMMVSHTQQPLAKLVQLWGQFIRSRIAIDKLGDMLNLPTEQQSGKERVSLQGAISFSDIVFRYQPDLSPTINRFTLDIRAGETLGVVGTSGSGKSTLARLLLRLYTPEHGTITLDGIPLQEFNIESLRQQIGIVLQENFLFNKTVHENIAQSRPDAPLSDIIEAARLAGAHDFILKLPMGYDTIIAEGGQSLSGGQRQRLAIARTLLSDPTILILDEATSALDDESQSIIQSNMANIAQGRTVITIAHRLSTVRQCDRIIVLHQGQIIEQGSHEQLLQQGKQYRKLWQLQQELKQEVTSHV

SEQ ID NO: 9942 - protein, 36 aa, Xenorhabdus bovienii
  Coding DNA sequence: Name=SeqID_3834
MFLSGITMGLPLDIIIINLINDIVVFSISFIGVNLF

SEQ ID NO: 9943 - protein, 33 aa, Xenorhabdus bovienii
  Coding DNA sequence: Name=SeqID_3835
LSLGSVQNLRVLILNFLTNVVFMLFLSGISYSS

SEQ ID NO: 9944 - protein, 121 aa, Xenorhabdus bovienii
  Coding DNA sequence: Name=SeqID_3836
  Homolog annotation: Query=1..118bp; Hit=6..121bp; Blast score=152; Percent Identity=72.0; E value=1e-36; Homolog= ref|NP_928644.1|
MSEKFVQTISSVNYNKGVFSLYFVGQEPNRMANGILAENDQELQLKQVIHMPASGFMYMVSMVKSMLEDPRMEAEMNKLIAAGFLPVPEMSEGEMPAEPETAVAETVEPKKRPARDAEKSK

SEQ ID NO: 9945 - protein, 153 aa, Xenorhabdus bovienii
  Coding DNA sequence: Name=SeqID_3837
  Gene classification: Gene name=HlyC; Function=ACP; Function class=O Posttranslational modification, protein turnover, chaperones
  Homolog annotation: Query=1..153bp; Hit=1..153bp; Blast score=234; Percent Identity=71.0; E value=3e-62; Homolog= VC1450 COG2994
MMITHQPATLSDTEIQAMIGGVMLLCQHSPLHRRYLVAEWQQRIFPSFQLNQFCYYEDEHQRPVAFCNWAFLSDSSRDAILSGEREISQEDWRSGQHIFFPEMIAPFGHAKGIARDLRRRVFAAWKGQKACTVRGMLDTQNDHCIRRVQWFTV

SEQ ID NO: 9946 - protein, 4716 aa, Xenorhabdus bovienii
  Coding DNA sequence: Name=SeqID_3838
  Gene classification: Function=RTX toxins and related Ca2+-binding proteins; Function class=Q Secondary metabolites biosynthesis, transport and catabolism
  Homolog annotation: Query=1..1971bp; Hit=14..1974bp; Blast score =2400; Percent Identity=64.0; E value=0; Homolog= VC1451 COG2931
MGKSSNRSAAYAFTGKYEDDNDGNTIHAIGIGGVINAYGGNDHIVVGSVGATVNTTWGHDTVVGAAGYLDINDTSGTLTVKGGSGYTSINKTSDGTIDFAGAAGGLKINHTGDKGRIDYSGASGYNGITRKGLEGNFTFKGAGAYNELWHETNQGNFYFAGAGGGNKIDRTWFNRYQGSNGDLTFEGIGAANIISSRVESGDIFFAGAGAANNLVRRGKIGNVTLTGAGASNRIERTRQTDDVYSETRGDIKFEGAGGYNSLYSDVAHGDIRFAGVGGYNQITRKGTAHDFDNEGMEYAKAEDIVLKNATLSGKWIGYNEQVTGLKSAQEANTYLFAFADGMYTKVNKVQLRNDPETGKLIYHSTAWYKNGNHLKDLEKQDISGEGGFAGVNIDGAYTLSNLTVEHQQSVTVHAVEEKLAEDQWMNHGDGVLVNVADVTLSNAKMGGYAIDSKGGTADVQVVKSNHKSNTYIYAKRIDKYTKIVVIELRNDPKTGMLQYNAQAWLSLEDRMAKLANEDISSANGYQAVPAGIYTLSDLHYSAKAVRTASGRVSGMHEYSDLALFKAPTSSGKSSGDVHYTGAGGGNVIHSNVTRGNVYFNGAGIANVIEHTSEFGNTEFNGGGSANVIVKKGKEGNLTFNGVGIANVILHQGLRGDMDVNAGGAANILVRVGDGRYLAHLLAVGNISIHKGNGNSRISMGGGFNTHTQIGHGDAFWSGVGGFNVLTQMGKGHVSSILLGGANVLTKVGEGDLESAMLGGANIITHISNYRETSNTKAIALGGANVLTKKGKGDVLSVMGGGANVLTHVGDGKTTGILLGGVNILTKVGNGDTTGIMLGLGNILTHVGNGQTLGVMAAAGNIFTKVGEGTTIAAMVGAGNIFTHVGQGNAWALMGGIGNIFTKVGDGDALALMLAAGNVFTHVGDGMSVALMVAKGNIATKVGHGEVLSAMIGEGNILTQIGNGDTFAAMLGKANILTKVGNGLTAGLMVSEANIYTHVGDGTSIGLFVGSVNVMTKVGNGTTLAAMFGKANIMTHVGDGLTGVLALGKANIMTKVGNDFMGVVAASEANVVTHVGDGTTAAVLLGKGNVLTKVGDGTTVGLLISKIGNVMTHLGDGTTIGFAKGEANIMTKLGDGLGINAVWGKANIMTHIGEGDRYNFAKGEANIITKVGDGQEVTVVQGQANIVTHVGKGDDYTGAWGKANVITKVGDGRNVVLAKGDANIVTQIGNGDSFNALWSQGNVVTKVGDGMQVTAAKGKGNITTTVGNGLSVTTVHGDLNVNTKVGDGVSVNVAWGKLNVNTRVGDGLNVSVMKGQANANIRVGDGLNINASYARNNVVIQVGNGDFYSLAVAESNTESNKLGALFDNVKQTLLGVAGSKGISYLVNGDEANTSGTHKGRGAINLPEVSALNGFQLTEMEQVKSDLQNSLKGSVTGVDTPDTDSIQNTLGNEKRLSSNQSRNLIVNGDFEQGADGWQSTNGIEAYYAAQSYGLSNEGHGERVSELDAYTHADKDSNTSIYQDISDLTVGESITLSFDFAKRADISADNGMEVLWNGKTVFSISAGNAEWQNKTLSLTAQEGSNRLEFKGTGTNDGLGYILDNVVAKSELPDSAIAGHVQQDAAAQNALQDKEKAEADRQRLEQERDTQLAAVSGSRAQLEATDLEALNGNGQDQCDAINNEAEAVTEELAEKVKGLATLDSYGKHHGKSGEQWRAQFAGGLLGQVQTQLNRANDTAQQQLDRSQHAASERFGDLRDAVAKSEAGVSKGEQHQQQSQKEIEQTRTNAEFRKQQALSQKKQAEHAESDAKAAVQKAEQRGQHEVSEAGSQTARVQSDVKAAKQSDNYKPNHAGAAGSGLSGTAYESHAAENQPERIKTDNPIGFAPKDETNTGFSKELQYLDEDLDELTEAKAALNRLQINAAKRGKSTGATLISAYTETSASQPVSKTADVPTEWVRNTPKISGLDLSGLQALGETHVQQGSTDAPEAPATAIRAQKVADVYRWLDSDNNIATDTYIPVPGFDRGDADIPDNIRQRLVTFVEGYLEGTDNNVPKEQVAPLAKLFVDATIDCNWDKRVEFVSKLEQYGYSFEPVHGDKSIVSFWSGKNFKQYRNVLDAVQTDGKKVVYDIDVKGNSFAIELNKTLMRWGNVYLDSDNAEHNALQTAINASARSNTGFWSSLYATGSRDDVYVIAEGGLRLGNYFWNVELPVLRQLQREGLVGEIRLLDKPAREYQGAAPETIGRRLTEAGVSVKARFDSLSIGEQERLLTLNPAGYKPDTLIDLDIKLSAIDNMLNQALPFYGLRTERNLLVREADDEGFEVRRWPGHDGDDFKTIMVEDAEDPAQIKAIERFILANYDDYGKLPDALYLVADQIVSHEQGRTRIVAKKVDGSWNYKPKTDLMSVSEFKDAASVKGKILGDSYRNVLEALGSYEKALQNGADYDLDAVEKLISLHQQVEGYLLGHPDSKRLPAMTNLLSQINVRMEESRVLAEPTLTSTGKGSFSELYNKLGNANLKDSKHLYIDEQGDFVTRGKSNIQLVMKAEETEKAVRQIKVAVTREYGQEVAETVFSNLKPQDLSKDGNGIDVSGLRKVHQAIEQQLSPVSATLFVWKPSDHSRLGHAALQIGQGRIQVSAEDAGGFNEKNYVSWWPKGGKSTSPGHIFNVSTAENPDVRLRWRDLSQPASQNETLKFDVGSEEGDNFGLKDGTYKLEKFIEKLQAAKGVDAKFEDISEGFAMSALANPNLLKSAGIPEHISRPFIEQWENGNIDMQDIGRDFAEALRTAAKQKITPELTEKRITNIVRQFAERELSDIQDFKASEADQGRVFRINLAGLDAAAMQAEWNKISQNPDARYQILNGNCSSIVAKVLKAGGADKVIGHTWRPNFGIWTPTELFNYAQKLQEAQIERIANKPKRIVGEDLEALNQQAKKDNVLEKVAIDNDGKPPRDREPFNPVTRFLNNELYGAKEDRRNVHGYTQTALDTAVTNGTADKVTLRGDAGRLTGYYHQGEQKPDVATEPNAAKKVVLFIHGSGSSAEEQASVIQNQYQKQGIDMLAVNMRGYGSSDGRPSEKGLYHDARTMFRYLVNDRGVRPENIIIHGYSMGGPIAANLARYAERNGQTVSGLLLDRPMPSMTKAITAHEVPNPAGMTGVLAKSVNGQFSVEKNLQGISKQTPIMLLTDNEGLGEAGEKLRAKLVIDGYQVSGEHTFYGHEASSRLMNQYAEQIVTGLFDVKRQPDESTALKGIKSDLKRYGEALEPQKGAPGKTKDIRATQDFLTGYQQGHAEQTVDGFRSDMNIKQLVDLLVKGNWTAEQKGSLAWEIESRALKITFQPQAEKHNRLFNDVVSAGVADTKANKHLAPQLLLLNLSNDGFGGRCDPLSKLVLVAKQLENNGQDGVARKLLEKMYSAAAVLSNLELYSDTERGNASKLLGSLAALHARNPMHDTSMKVWQEKLEGKQALTVNGVIGKVTAANADGKPVLLELDAPGHAMAAWAKGSGENRVYGFYDPNAGIVEFSSAEKFGDYLTRFFGKSGLNMEQSYKLPKNDAGEITFNRVVVMDGSVLATYSPTRADKTTMQGILDLNIFDETPIKAHSGVEITHEVKVPLKDNLPEGVDRVVNNENVEYWEPAFVKPQAEGGDSRFNGQVIIQTENDPVAAKAAARLAGKHPDSSVIVQLDANGQYRVVYGDPATLSGKLRWQIVGHGRDESVQNHTRMSGYSADELALKLKQFRTDFKQAGSPDHISLVGCSLISDDKRDGFARHFISELDKQGIRTTVSARSSEVAVDSIGRKFTRNAEEQWVHKLVDNKIVLGWNDKGELETHAERIRRGISESDINLSRIGHMDTDVKAKGAIAENTETFHAPEQHKKVNDDSSATSPAKSSNNKLSYSGNIQVQAGDGEFTAINWGTTNVGIKVGTGGFKSLAFGDNNVMVHMGHGDSKHSVNIAGYQALEGAQFFMGNRNVSFNKGRSNDLIVMMDKSIPTPPLINPFDGASRISGVLQGIAGSFDSPDWLSAQDQQWTLESAKKYVSDLSGLDLTSSVDYNTLTDLDAENERSSRGLKSDIETTLNKKYNQWLGRKGNTREMGNVSRADKFRQANEKLAFNFAVGGQGADIQVTTGNWNFMFGDNIQSILDTNLGSLFGLMTQEYTSTGMAKTTFTFSPTDLPRQLKNKLLGNLAGVSADTTLADIFGVDYTADGHIVSRSNQSVDGVAILREMLEVIGEFSGDQLQAFTDPAKLLDSLEAGLNMGADGVKSFAESHGLKAKAPDENKEGHVSISEKGKPVQEAEELPSDRAFGFNLPSLFTTLFKQDKQVEMASLVADLKENLTADLLNMQDKMFDFLRNSGHLQGDGDMHVSLGNYNFNWGGDGKDLGAYLGDNNNFWGGRGDDVYYSVGTSNIFTGGEGNDMGVLMGRENMMFGGAGNDVAVLAGRINYAYMGDGDDQVFVFGEGGVIDGGKGRDYIVASGNFNNIHSGEGQDYVVAIGNNNQVGLGAGNDFATVFGNYNNIDGNAGNNAIKLMGYHAEINGGTGDDHLIADVVSKFSQLNGGDGDDLLVLGGYQNHFKGGTGVNSFVVSGAVIDNVVEDIKRGDKIIFNNPNWQKLWFQRSGYDLVLLTGRDVTDTSAQGKFEAMGSVTFNDYFNGNRADIVTQMGDKDAQGEREYTALSANSVDSLVQAMSGFAPNMGDTGFIDTLDSQTKSTILTAWADTTSGKSKLA

SEQ ID NO: 9947 - protein, 95 aa, Xenorhabdus bovienii
  Coding DNA sequence: Name=SeqID_3839
  Homolog annotation: Query=1..94bp; Hit=153..246bp; Blast score=107; Percent Identity=48.0; E value=5e-23; Homolog= ref|NP_927613.1|
LDNHDYSNYQVKFISETPWKSGFRHEAEFITNPPSPLIFYCWSHEDYENAANKAGLKHFEWRKPMIMESDIERYPPGFWDNHQNNSWEVGFMCQF

SEQ ID NO: 9948 - protein, 55 aa, Xenorhabdus bovienii
  Coding DNA sequence: Name=SeqID_3840
VILRSNPRVFGMIINVTVLIQRLFVNFNKIILRKITGDFPIIFSLHSKQPNSQII

SEQ ID NO: 9949 - protein, 245 aa, Xenorhabdus bovienii
  Coding DNA sequence: Name=SeqID_3841
  Homolog annotation: Query=1..245bp; Hit=1..247bp; Blast score=416; Percent Identity=78.0; E value=1e-115; Homolog= ref|NP_927613.1|
MTDNILYNPIAHLYENFSDSSPHIDVEIRTIMHLAGEVQGKSVLDLACGYGLFSRKFKKLGASNVIGVDISDKMIQIAKNKSRQYQDDIEFHIRNVCKMESFGKFDLIVAAWLFCHAESFEDLKTMFRVVADHLKPSGKLIAYTFEPDYRLEKGNYENYFIKVLSEEPVKDTTLLKAEFTTTPPSPFTMYRWSREQYAAAINEAGLKHFEWHKPMLQERDIEKQPPGFWDDYQRNCLDTALVCQL

SEQ ID NO: 9950 - protein, 39 aa, Xenorhabdus bovienii
  Coding DNA sequence: Name=SeqID_3842
MVINKNNYIKFFIVTLTYTTEKPSSNITSILNNKSHRKK

SEQ ID NO: 9951 - protein, 54 aa, Xenorhabdus bovienii
  Coding DNA sequence: Name=SeqID_3843
LNLHRNLVDLTLTLVMSINLACNFNMIIGKFNILKIELMIKMSLFNIYFLLGFL

SEQ ID NO: 9952 - protein, 91 aa, Xenorhabdus bovienii
  Coding DNA sequence: Name=SeqID_3844
  Homolog annotation: Query=1..91bp; Hit=1..91bp; Blast score=119; Percent Identity=61.0; E value=1e-26; Homolog= ref|NP_931360.1|
MSKGYFLTVSDKTTCGGEILTGTSNIKFYGRQAAIEGSTVTCGRYSGNYVIVGGVGSFLDKGAKLAGTLDSQSTCPCNASLICSIPDSYQK

SEQ ID NO: 9953 - protein, 88 aa, Xenorhabdus bovienii
  Coding DNA sequence: Name=SeqID_3845
  Homolog annotation: Query=1..81bp; Hit=1..83bp; Blast score=67; Percent Identity=43.0; E value=6e-11; Homolog= ref|NP_929618.1|
MKIINNTQSNIIVSVNKWGDDGQTGRFTVSPGSRESWDRTDERGFVMAILKEGVQDSFYIFADSYIKIFDSYVTDSGRRIKPATDRYY

SEQ ID NO: 9954 - protein, 42 aa, Xenorhabdus bovienii
  Coding DNA sequence: Name=SeqID_3846
LYLFLLLCYINNYHLIILLCDNYFSLYAIVKLSFNLCVDEVK

SEQ ID NO: 9955 - protein, 69 aa, Xenorhabdus bovienii
  Coding DNA sequence: Name=SeqID_3847
MKIDNCLIFYDCFYIMRQEYLSMEFYLNRVVRFFIALFILLLSSFVLNAFAGNEAPYAQYIKKTNFVIP

SEQ ID NO: 9956 - protein, 35 aa, Xenorhabdus bovienii
  Coding DNA sequence: Name=SeqID_3848
LLFPDIKREFDFIISPHSVWTDTVIIFLLKNDELP

SEQ ID NO: 9957 - protein, 289 aa, Xenorhabdus bovienii
  Coding DNA sequence: Name=SeqID_3849
  Gene classification: Gene name=MhpC; Function=Predicted hydrolases or acyltransferases (alpha/beta hydrolase superfamily); Function class=R General function prediction only
  Homolog annotation: Query=36..286bp; Hit=2..252bp; Blast score=311; Percent Identity=59.0; E value=6e-85; Homolog= ybfF COG0596
MPFSLSLPTCHGIKHHDIKRCINDIKFRQTMNSNNQLNYHFHTPENPQSSTPIVLIHGLFGDLSNLGILGRDLQQHYPVIQIDVRNHGISPQMENMDYRDMAQDVLSLLDELNVAKAIIIGHSMGGKIAMTITAVAPERIEQIVVIDIAPVTYLTRHHDSIFAALNQVTEAGAQTRQAATEIMRKDIHEDGVIQFLLKSFRQGEWKFNLPVLQKEYEKIIGWEAIPAWPKPALFIRGGNSDYITEAYREDIMRQFPQATAWVIAGCGHWVHAEKPEAVLRAIHRFLAKK

SEQ ID NO: 9958 - protein, 177 aa, Xenorhabdus bovienii
  Coding DNA sequence: Name=SeqID_3850
  Gene classification: Gene name=SeqA; Function=Negative regulator of replication initiationR; Function class=L DNA replication, recombination and repair
  Homolog annotation: Query=1..177bp; Hit=1..181bp; Blast score=223; Percent Identity=62.0; E value=9e-59; Homolog= seqA COG3057
MKTIEVDEDLYRFIASQTLHIGESASDILRRILKVDAGQPVQTTPPARESVSVSKVPAARSRDVVRIVRELLLSDEYAEKKKSVERFMSILSTLYSLNSESFAKTTEAMHGRTRTYFAGDEQTLLASGNHTKPRHIPGTPFWVITNTNTDRKRSMVEHVMQDMKFPANVIEKVCGTI

SEQ ID NO: 9959 - protein, 33 aa, Xenorhabdus bovienii
  Coding DNA sequence: Name=SeqID_3851
LIKLHWRISQCSLSGEIKWQLIQERGSLPSSMI

SEQ ID NO: 9960 - protein, 546 aa, Xenorhabdus bovienii
  Coding DNA sequence: Name=SeqID_3852
  Gene classification: Gene name=Pgm; Function=Phosphoglucomutase; Function class=G Carbohydrate transport and metabolism
  Homolog annotation: Query=1..542bp; Hit=1..542bp; Blast score=867; Percent Identity=76.0; E value=0; Homolog= pgm COG0033
VATHPRAGQPAQQHDLINIAQLTSQYYTLQPHPENPAHQVKFGTSGHRGSSGRNSFNEAHILAISQAIVEVRAQQGITGPCYVGKDTHALSEAAFISVLEVLTANGVEVIVQENNGFTPTPAISHAILCYNRQGKNRADGIVITPSHNPPEDGGIKYNPPNGGPADTDLTSIIEKRANALLANDLNGVKRLPYERVLKSEYLHPQDLVDPYVTSLGDVVDMAAIQQAGLKIGIDPLGGSGIAYWQRIGEYYNLDLTLVNDKVDQTFRFMTLDHDGVIRMDCSSRWAMAGLLELRGKFDLAFANDPDYDRHGIITPAGLMNPNHYLATAVDYLFRHRPQWSEKVAVGKTLVSSAMIDRVVADLGRELLEVPVGFKWFVDGLYRGELGFGGEESAGASFLRFDGTPWSTDKDGIILCLLAAEMTATTGENPQQRYDKLGARFGTPSYSRIQAPASHQQKALLSKLSPEMVKANTLAGDPITARLTTASGNGASIGGLKVMSDNGWFAARPSGTEEAYKIYCESFLGAEHREKIEQEALEIVNQVFTAG

SEQ ID NO: 9961 - protein, 40 aa, Xenorhabdus bovienii
  Coding DNA sequence: Name=SeqID_3853
MCNMRLTLFLMMVANHHNYYDTSAAGVALITAGALMVALG

SEQ ID NO: 9962 - protein, 38 aa, Xenorhabdus bovienii
  Coding DNA sequence: Name=SeqID_3854
MVVSYHHKKQGEPHIAHLSETLLISEGPLFHLPRQHQY

SEQ ID NO: 9963 - protein, 337 aa, Xenorhabdus bovienii
  Coding DNA sequence: Name=SeqID_3855
  Gene classification: Function=Transposase; Function class=L DNA replication, recombination and repair
  Homolog annotation: Query=12..329bp; Hit=2..310bp; Blast score=138; Percent Identity=31.0; E value=9e-33; Homolog= NMB1750 COG3547
MASNKRRVIMYYVGIDVSKNKLDICLLYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELAELEALIAEHINQHPNLKKDFELLTSIKGVGTQIGLNMLIILRTNTFTRATQVAAYLGVIPIAKQSGTSVHGRVRLSKTGPAKIRAKLFMSALTAVRFNPHINDLYNRLVNKGKAKMLALGAAMRKLVHLCYGVLNTQQSYDENYAIRT

SEQ ID NO: 9964 - protein, 135 aa, Xenorhabdus bovienii
  Coding DNA sequence: Name=SeqID_3856
  Gene classification: Function=Predicted membrane protein; Function class=S Function unknown
  Homolog annotation: Query=1..123bp; Hit=1..119bp; Blast score=85; Percent Identity=53.0; E value=1e-17; Homolog= PAB0665 COG2510
MSTWLIYALLSALTAALVAIFGKIGLQNLDANTATAIRAVIMALFLVGVVVVQGKLNLIGEILVNRKALLFILLSGIAGALSWLFYFLAIKQGHVSQVAPIDKLSVVFAVILAVILFGEKISLISYRLDGQVLIA

SEQ ID NO: 9965 - protein, 40 aa, Xenorhabdus bovienii
  Coding DNA sequence: Name=SeqID_3857
MCSYSINPIGNSKGVHDIPIINTDSRKYDAHFYLLFLVSL

SEQ ID NO: 9966 - protein, 964 aa, Xenorhabdus bovienii
  Coding DNA sequence: Name=SeqID_3858
  Gene classification: Gene name=GlgX; Function=Pullulanase and related glycosidases; Function class=G Carbohydrate transport and metabolism
  Homolog annotation: Query=104..916bp; Hit=116..879bp; Blast score =501; Percent Identity=37.0; E value=1e-141; Homolog= DR0405 COG1523
MESHFWKKAYLILLSSLFFLLLTSCDNKNNLPKITEEPMAYIPNNIPAKVTTADDLQASAHWVDKRTLLWPEGADKPHVRLYYNRHNKVEPNDEGNFTDSYLVLTPTTLSKKTAERFPHLAALPAFQLPENTDVDRLITGDLVALATNEEGLLLSATQVQIAGVLDDRFAGTAETLEYGALINDTEVTFRLWAPTAQNVDLVIYNEDKQAIANHTMNRDAESGSWSWQGDTNLIGAYYRYALTVYHPYSRKVERYEVTDPYSHSLSTNSEYSQVINLDDEALKPQNWDDLSMPHPQKTSADIARMALYEAHIRDLSVADSTVPQAWRGKYLALTANSSDMFKHLKALSQAGMTHIELLPVFDIASINEFSHNVVDLNQPFNRLCQVNTTVKNSRFADYCNRSLTVREVLQALQRGDSASNPQVQELNEMIAETDSYNWGYDPFHYSVPEGSYATHAEGSVRIKEFRAMVQAIKQQLGMNVIMDVAYNHTNAAGPAHRTSVLDKVVPWYYHRLDEITGNVENNTCCSDTAPEHRMFSKLIEDSLVTWVKHYKIDAFRFDLMGYHPKAQIVSALAKVRTINPSVYFFGEGWNSGQDDRFETASQINLKGSGIGTFSDRLRDSVRGGGPFDSADNIRINQGMGNGAGTLPNEIAVLDANEARHLADLVRLGMAGNLADFVMIDKDGKVKAGREINYKGVAAGYAADPIEVINYVSKHDNQTLWDIISYKAAYQADLATRLRMQAISLSTVLLGQGLAFDQQGSELLRSKSFTRDSYNAGDWFNRVSYNYKDNNYDVGMPGKRDDGDNYALIHRVKNQVKKPGQSELLQMMVFYQELLRLRQFSPLMTLGKGESVKQRIDFRNVGPHQQLGLLVMTIDDGNTTDDDRDLRFDGLVVVINAASKPVTVRDLNTHGLKLNDIQSRLGNASLAAGIKITEDGMVTMPAWSAAVLVLPQKGIRGTGLPVRRK

SEQ ID NO: 9967 - protein, 221 aa, Xenorhabdus bovienii
  Coding DNA sequence: Name=SeqID_3859
  Gene classification: Gene name=OmpR; Function=Response regulators consisting of a CheY-like receiver domain and a winged-helix DNA -binding domain; Function class=T Signal transduction mechanisms
  Homolog annotation: Query=1..220bp; Hit=5..224bp; Blast score=324; Percent Identity=70.0; E value=5e-89; Homolog= kdpE COG0745
LIVEDEKEIRRFVRLALEGENWRVFECDTLKRGLIEAATRKPDLLILDLGLPDGNGIDLIHDIRQWSSIPIIVLSARDNEQDKVAALDGGADDYLSKPFGINELLARVRVALRRATKANQPDPVIHFADISVDLINRRVLKGQKELHLTPTEYRLLTELLTNSGKVLTQRYLLNHVWGPHYVEHSHYLRIYMGHLRQKLEEDPARPKHLLTETGVGYRFMP

SEQ ID NO: 9968 - protein, 905 aa, Xenorhabdus bovienii
  Coding DNA sequence: Name=SeqID_3860
  Gene classification: Gene name=KdpD; Function=Osmosensitive K+ channel histidine kinase; Function class=T Signal transduction mechanisms
  Homolog annotation: Query=5..904bp; Hit=4..893bp; Blast score=1132; Percent Identity=63.0; E value=0; Homolog= ZkdpD COG2205
MDQIEPLRPNPDDLLTLANEKPRGKLKIFFGACAGVGKTYAMLQEAQRLLSQGLDVIAGVVETHERQETAALLTGLPQLPPKHIRYHERRIAAFDIDAAIARHPAIILMDELAFSNPHSSRHPKRWQDVEELLEAGIDVLTTINVQHLESLNDVVGAITGIRVRETIPDHIFDHADDVVLVDIPPDDLRQRLNDGKVYISGQAERAIEHFFRKGNLIALRELALRRTADRVDDQMRAFRDTRGKEPVWHTRDNLLLCIGCNAGNEKLIRTAARLAAKLSCKWHAVYVETPKLHRLPEIKRRTILKALKLAQELGAETATLSDPHEERAILRYAREHNLGKILVGRYYGSHLNSFSDKWFGFKWRSDFVERLGKLGPDLDLIIVALEDKKRWDKEQRDNRAFHEKWRVQIHGFLMAIILCTLITLFSHTFLLTLDKANLVTLYLLGVVIIALFYGRWPSVFAAFINVISFDIFFVQPQWSLAVTDMQYLLTFTVMLIVGVVVGNLTAGIRYQARVARYREQRTRHLYEITRELSRALNEEDVARISYHFLSNSFQAKTGLLLPDSDARLYQVKSNNGGQMQIDEAIAKWSFDKKQPAGAGTDTLPGVPYQLFPIATASQVFAVLAIESPNLRQLLVPEQQRLLQTFTGLIANALERLHLSRRAESAKLETEREQLRNSLLAALSHDLRTPLTVLFGQTEILMLDLSTENSPHTQQVNQIRQQILSTSRLVNNLLDMARIQSGGIQLNLEWQSLEEIVGSTLRSLEYTLSRYTVELSLPANLLLHCDASLLERVFINLLENAIKYTHEQTPLGIRATTEHKQVHIEIWDAGSGIPQGQEQFIFDKFSRARKESAIPGVGLGLAICRAIIEIHGGRIWATNNKKGGASFHFVLPLDEAPKIEEIIEET

SEQ ID NO: 9969 - protein, 192 aa, Xenorhabdus bovienii
  Coding DNA sequence: Name=SeqID_3861
  Gene classification: Gene name=KdpC; Function=K+-transporting ATPase, c chain; Function class=P Inorganic ion transport and metabolism
  Homolog annotation: Query=1..188bp; Hit=1..188bp; Blast score=172; Percent Identity=50.0; E value=2e-43; Homolog= ZkdpC COG2156
MIGLRASIVLLTFLTLITGIAYPLLITGIANALFPHQAKGALIEHNGKLVGSELIGQSFTQAIYFHGRPSMTSEQPYNALSSGGSNLSTTNPALTHQIHQRVTQVRLFNHSENNAIPVDLITASGSGLDPHISPNAAEFQAQRVATARHLSINVINKLIQAHTAYPPLEYMGEPVVNVLELNLALDNLKSQG

SEQ ID NO: 9970 - protein, 688 aa, Xenorhabdus bovienii
  Coding DNA sequence: Name=SeqID_3862
  Gene classification: Gene name=KdpB; Function=High-affinity K+ transport system, ATPase chain B; Function class=P Inorganic ion transport and metabolism
  Homolog annotation: Query=1..684bp; Hit=1..678bp; Blast score=1002; Percent Identity=78.0; E value=0; Homolog= ZkdpB COG2216
MKDKQQALFEPALIRHALIDAVKKCHPAIQWRNPVMFVVYLGSCLTTVLWLGMLTEQLTGNALFTGSIALWLWFTVLFANFAEALAEGRSQAQASSLKGVKKTTWATRLASASRDAAKEKVTSDHLRKGDIVLVEVGEIIPCDGEVLEGGASVDESAITGESAPVIRESGGDFASVTGGTRVLSDWLIIECSVNPGETFLDRMISMVEGAKRRKTPNEIALTILLTALTIIFLLACISLLPFSLFSVQTNQSGDPISITVLVALLVCLIPTTIGGLLSAIGVAGMSRMLGANVIATSGRAIEAAGDVDVLLLDKTGTITLGNRQASQFLPAPGVTEEQLADAAQLSSLADKTPEGRSIMILAKQRFNMRERDLRALNATFIPFSAMTRMSGVNIGNRMIRKGAVDAIRRYVEANHNQFPDAIDLLVQQVASKGATPLVVAENQRVLGVVALKDIVKGGIKERFSEMRRMGIKTVMITGDNHLTAAAIAAEAGVDDFLAEATPEAKLALIRQYQSEGCLVAMTGDGTNDAPALAQADVAVAMNSGTQAAKEAGNMVDLDSNPTKLIEVVHIGKQMLMTRGSLTTFSIANDIAKYFAIIPAAFAVTYPQLNALNIIHLHSPESAVLSAVIFNAIIIIVLLPLALKGVSYRAMNALSLLRRNLWVYGLGGLIVPFIGIKLIDILLTILAFK

SEQ ID NO: 9971 - protein, 568 aa, Xenorhabdus bovienii
  Coding DNA sequence: Name=SeqID_3863
  Gene classification: Gene name=KdpA; Function=K+-transporting ATPase, A chain; Function class=P Inorganic ion transport and metabolism
  Homolog annotation: Query=1..561bp; Hit=1..556bp; Blast score=694; Percent Identity=68.0; E value=0; Homolog= kdpA COG2060
MVVSAFLLITSFLVILFVLSKPLGSLIANLVEGELPRWLTSAENSLWRCCGLQKPGGHVKEMNWWQYALAIITFNIMGLLLLFILLISQEHLPLNPQHFAGMKWDLALNTAISFITNTNWQAYSGENTLSYLSQMAGLTVQNFLSAATGIAVAFALMRAFSRQGVKTLGNAWIDITRITLYLLLPLSIIIALIFASQGVIQNFSPYALAHTLEGQQQLIPMGPVASQEAIKLLGTNGGGFFGANSAHPFENPNALSNFVQILTIFLIPCALCFAFGLVVGDNRQGHALLWAMTIVFIIAVTIVIYAEIMGNPHFIQAGASSNLNMEGKESRFGILTSSLYSVVTTAASCGAVNAMHDSFTALGGMIPLWLMQIGEVIFGGVGSGLYGMLLFVLLAVFIAGLMIGRAPEYLGKKIDVHDMKMVALAILVTPSLVLLGTALATSIDAGRVAIMNPSAHGFTEVLYALSSAANNNGSAFAGLNANSMFYNLLLGAIMFLGRFGVILPVLAIAGSMISKKRQTISSGTLPTHGSLFTGLLILVVLLMGALTFIPALALGPVAEHLQLWQAPR

SEQ ID NO: 9972 - protein, 77 aa, Xenorhabdus bovienii
  Coding DNA sequence: Name=SeqID_3864
LLDFPWVPYQLIPLIFLYFFYAFIISFNNFFAWLFLCCNHLVNKDISTMNTFIIIGVFLAVSLLFYLIYALLNAEDF

SEQ ID NO: 9973 - protein, 74 aa, Xenorhabdus bovienii
  Coding DNA sequence: Name=SeqID_3865
  Homolog annotation: Query=6..73bp; Hit=1..68bp; Blast score=90; Percent Identity=72.0; E value=8e-18; Homolog= ref|NP_928721.1|
MRRVLMSTYREYSWHQVLLRRTGAVTLGVIALPVMLFRRDRARFYSYLRKVWIKTSDKPVWLESSEMAAGIRNR

SEQ ID NO: 9974 - protein, 64 aa, Xenorhabdus bovienii
  Coding DNA sequence: Name=SeqID_3866
LLPRLLLICTTSRIASIATNSDKSKTPRQHKQARCQNTLSGEKIRMESDKPEQYSHVTYIMMPS

SEQ ID NO: 9975 - protein, 264 aa, Xenorhabdus bovienii
  Coding DNA sequence: Name=SeqID_3867
  Gene classification: Function=Uncharacterized ACR; Function class=S Function unknown
  Homolog annotation: Query=18..264bp; Hit=1..247bp; Blast score=352; Percent Identity=67.0; E value=3e-97; Homolog= ybgI COG0327
MTGKYFMAKALNDGGSVMNNVELEHVLNTELNVREFQDYAPNGLQVEGRPHIQRVITGVTACQALLDEAVHLEADAVIVHHGYFWKNESPVIRGMKRRRLQTLLSNDINLYGYHLPLDAHPTLGNNVQLARQMGVKIIGQIDSLLPHGAFDQPITPAELTERLEKRLERKVLHCGDNAPEEIRTLAWCTGGGQSFIEQAAEFGVDAFVTGEVSEKTIHVAREMGLHFYAAGHHATERYGIKVLGEWLANHYGLDVTFVDIPNPA

SEQ ID NO: 9976 - protein, 36 aa, Xenorhabdus bovienii
  Coding DNA sequence: Name=SeqID_3868
MVINRFCENKLGKNNGATVLIAPPDKLISCEQIKPD

SEQ ID NO: 9977 - protein, 387 aa, Xenorhabdus bovienii
  Coding DNA sequence: Name=SeqID_3869
  Gene classification: Gene name=ProP; Function=77 Permeases of the major facilitator superfamily; Function class=G Carbohydrate transport and metabolism
  Homolog annotation: Query=16..384bp; Hit=1..368bp; Blast score=291; Percent Identity=50.0; E value=6e-79; Homolog= VCA0267 COG0477
MLTFRAINNSSEENIMHTRPSLWLAITLMMFPQIVETIYSPALTNIASGFSVNAEQAAQTLSLYFFAFAIGVVVWGRMCDVIGRRPTIIAGLLLYGAASLLALLTEHFWLLLAARMLSAFGAAVGSVCTQTIMRDTYCGEELSRIFSIMGIALAASPAIGMISGSILNHFGGYKAVFAGLAILSAILMGWSVIRLPETRPVNVPKIALFGTAVTMFKDISIWRNAFLIAFFNICLFSYYQLAPFRFQQFGLSQAQFGYTGLLFTFGVGLGSLLNKHLLKKQWLSEKLISLAAMIVLLSGIGVYLLENSWLFIFPMLGIVTAYGLAIPNILASALNNYVDRLGTAGALLGLFYYLLLGGGLALAGWSQALGSILICCGVSTVLLTRKW

SEQ ID NO: 9978 - protein, 283 aa, Xenorhabdus bovienii
  Coding DNA sequence: Name=SeqID_3870
  Gene classification: Gene name=AraC; Function=AraC-type DNA-binding domain-containing proteins; Function class=K Transcription
  Homolog annotation: Query=23..277bp; Hit=1..253bp; Blast score=206; Percent Identity=43.0; E value=2e-53; Homolog= VCA0266 COG2207
MSFYDNKGSLFMYSDIKLKDINMAWLRQSDHFDPDGLKYSLNVPVIGIAAEMGQHDSGFHQHDMGQLLFTQQGCIKITLANQLSILPPTRVAWIPPKTLHRAEMRGSVGYRSIYLDISGIEWISRQSEILQTTPLLRVILERIAISPFDTDWRQGKGAHLLAVFFDEMSDAGKEPTLLPLPSDRRLARLPFEQFPPPLQILATHVGASEKTITRIFLRETGMNYQQWRQQWRLIKAIELLAQDKTLSYVAQELGFANDSAFVTFFRKNMGRPPREYMAGACRR

SEQ ID NO: 9979 - protein, 427 aa, Xenorhabdus bovienii
  Coding DNA sequence: Name=SeqID_3871
  Gene classification: Gene name=GltA; Function=Citrate synthase; Function class=C Energy production and conversion
  Homolog annotation: Query=1..427bp; Hit=1..427bp; Blast score=769; Percent Identity=84.0; E value=0; Homolog= gltA COG0372
MADKKATLTINGAAAIELDVLTPTLGSEVIDVRTLGSKSFYTYDPGFTSTASCESKITYIDGDEGILLHRGFPIDQLATGSSYLEVCYILLYGEPPTPEEYETFKKTVIRHTMIHEQITRLFHGFRRDSHPMAVLCGVTGALAAFYHDALDVHNPHHREITAYRLLSKMPTVAAMCYKYSIGQPFVYPRNDLSYAANFLHMMFSTPCEEYKVNPVLERAMDRIFILHADHEQNASTSTVRTAGSSGANPFACIAAGIASLWGPAHGGANEACLRMLEEIQTVEHIPEFIARAKDKNDSFRLMGFGHRVYKNYDPRATVMRETCHEVLNELGLNDSLLEVAMELERIALNDPYFIEKKLYPNVDFYSGIILKAMGIPSSMFTVIFAIARTIGWIAHWTEMHDEGLRIARPRQLYTGHTQRDFKSQLEK

SEQ ID NO: 9980 - protein, 32 aa, Xenorhabdus bovienii
  Coding DNA sequence: Name=SeqID_3872
MALCYRREFKIRLVSHYITLKSHYGRQRFLGC

SEQ ID NO: 9981 - protein, 61 aa, Xenorhabdus bovienii
  Coding DNA sequence: Name=SeqID_3873
LTRIKHLSYIYDGIYCLPSFSGGKVNFTKNKSYAKVLIRHKMTTFYVKNTLNITPRNFLTT

SEQ ID NO: 9982 - protein, 70 aa, Xenorhabdus bovienii
  Coding DNA sequence: Name=SeqID_3874
MLTIILCGNCNKYVKYLYCRKVSGLPCCRSIQRSQITTFDEHVRIVNLIMLCLCILLALSDSRPGPEDGK

SEQ ID NO: 9983 - protein, 136 aa, Xenorhabdus bovienii
  Coding DNA sequence: Name=SeqID_3875
  Gene classification: Gene name=SdhC; Function=Succinate dehydrogenase/fumarate reductase cytochrome b subunit; Function class=C Energy production and conversion
  Homolog annotation: Query=12..136bp; Hit=5..129bp; Blast score=162; Percent Identity=72.0; E value=8e-41; Homolog= sdhC COG2009
MENKKSCVGKIVKKQRPVNLDLRTINQPVSAITSILHRISGVITFIAVGILLWLLGMSLSSQEGFLQASEIMTGFFAKFILWGILTALAYHICGGIRHVLMDFGFLEENLATGSASAKVAIVIAVILSILAGVLLW

SEQ ID NO: 9984 - protein, 115 aa, Xenorhabdus bovienii
  Coding DNA sequence: Name=SeqID_3876
  Gene classification: Gene name=SdhD; Function=Succinate dehydrogenase hydrophobic anchor subunit; Function class=C Energy production and conversion
  Homolog annotation: Query=1..114bp; Hit=1..114bp; Blast score=110; Percent Identity=72.0; E value=2e-25; Homolog= sdhD COG2142
MVSNASALGRTGIQDWLLLRASAIVIVLYVLYLVGFVATTSDITYEVWRGFFSSSLTKVFTVLVLLSILVHAWIGMWQVLTDYVKPLALRLVLQLVIIVALLVYLIYGTIVVWGA

SEQ ID NO: 9985 - protein, 588 aa, Xenorhabdus bovienii
  Coding DNA sequence: Name=SeqID_3877
  Gene classification: Gene name=SdhA; Function=Succinate dehydrogenase/fumarate reductase, flavoprotein subunits; Function class=C Energy production and conversion
  Homolog annotation: Query=1..588bp; Hit=1..588bp; Blast score=1080; Percent Identity=90.0; E value=0; Homolog= sdhA COG1053
MKLPVREFDAVVIGAGGAGMRAALQISQMGLSCALISKVFPTRSHTVSAQGGITVALGNTHEDNWEWHMYDTVKGSDYIGDQDAIEYMCKTGPEAILELEHMGLPFSRLDNGRIYQRPFGGQSRNFGGEQAARTAAAADRTGHALLHTLYQQNLKNNTTIFSEWYSLDLVKNQDGAIVGCTAICIETGEIVYFKSKATILATGGAGRIYQSTTNAHINTGDGVGMALRAGVPVQDMEMWQFHPTGIAGAGVLVTEGCRGEGGYLLNKNGERFMERYAPNAKDLAGRDVVARSIMIEIREGRGCEGPWGPHAKLKLDHLGKDVLESRLPGILELSRTFAHVDPVKEPIPVIPTCHYMMGGIPTKITGQALTVNEKGEDVIIPGLFAVGEIACVSVHGANRLGGNSLLDLVVFGRSAGLHLKECLMEQGTSRDASESDVDAALQRLNRWDNTRSGEDPVEIRKALQACMQNNFSVFREGDAMAKGLEELKVIRERLQNARLDDTSSEFNTQRIECLELDNLMETAYSTAVSANYRTESRGAHSRFDYPERDDANWLCHSLYLPQTESMTRREVNMQPTLREAFPPKVRSY

SEQ ID NO: 9986 - protein, 271 aa, Xenorhabdus bovienii
  Coding DNA sequence: Name=SeqID_3878
  Gene classification: Gene name=FrdB; Function=Succinate dehydrogenase/fumarate reductase Fe-S protein; Function class=C Energy production and conversion
  Homolog annotation: Query=34..271bp; Hit=1..238bp; Blast score=447; Percent Identity=88.0; E value=1e-126; Homolog= ZsdhB COG0479
VKLTCSLRCVKLSRRKCVLTNCVADVPVAEKEIMKLEFSIYRYNPDIDNAPRMQDYTLEVEEGRDMMLLDALIQLKEQDPTLSFRRSCREGVCGSDGVNMNGKNGLACVTPVSVLRRGNKKIVIRPLPGLPVVRDLVVDMSQFYTQYEKIRPYLINDGKNPPAREHLQSPEQREKLDGLYECILCACCSTSCPSFWWNPDKFIGPAGLLAAYRFLIDSRDTETASRLDGLNDAFSVFRCHSIMNCVSVCPKGLNPTKAIGHIKSMLLKHSA

SEQ ID NO: 9987 - protein, 138 aa, Xenorhabdus bovienii
  Coding DNA sequence: Name=SeqID_3879
MSGVDKRFIWTCLMHVLYWGFPTLQGTFKNWISVFKGSFISKHAPSFAVGNLSFFILNALHQLDISFKIVEGNIICIIYTRFMRYLCTIFYLCAVFQQHRLNMTNRFCRVQPFRTDADTVHDAMAAENAERIIQAIQP

SEQ ID NO: 9988 - protein, 935 aa, Xenorhabdus bovienii
  Coding DNA sequence: Name=SeqID_3880
  Gene classification: Gene name=SucA; Function=Pyruvate and 2 -oxoglutarate dehydrogenases, E1 component; Function class=C Energy production and conversion
  Homolog annotation: Query=1..935bp; Hit=1..933bp; Blast score=1648; Percent Identity=83.0; E value=0; Homolog= sucA COG0567
MQNGAMKDWLDSSFLAGANQSYIEQIYEDYITDPNSVDASWREIFQQLPDTGLSGEQLHSQTRDYFRRLAKDATRYHTSVSDPAMDAKQVKVLQLINAFRFRGHQSANLDPLGLWKQEPVPDLDPVFHNLTKADFEETFNVGSFAIGKETMKLADLYDALKRIYCGSIGAEYMHITNTEEKRWIQQRLESVAVGSQFSADEKHRFLAELTAAEGLERYLGAKFPGAKRFSLEGGDALIPMLKELIRHAGKQGTREVVLGMAHRGRLNVLVNLFGKKPADLFDEFAGKHKEHLGTGDVKYHQGFSSDFETEGGLVHLALAFNPSHLEIVSPVVIGSVRARRDRLDEGQSNMVLPVTIHGDAAVIGQGIVQETLNMSQARGYEVGGTVRIVVNNQIGFTTSNPKDARSTQYCTDIVKMVQAPIFHVNADDPEAVAFVTRLALDFRNTFKSDVMIDLVCYRRHGHNEADEPSATQPLMYQKIKKQPTPRKIYADKLIAEGLLAANDVTEMANLYRDALDHGECVVDEWRPMGMHSFTWEPYLNHEWDEDYPHKVEMKRLQDLGKRISTIPAEVEMHSRVAKIYGDRAEMANGNKLFDWGGAETLAYATLVDEGIPVRLSGEDAGRGTFFHRHAVIHNQPNAAVYVPLANVHNSQGVFNVWDSVLSEEAVLAFEYGYATTEPRALTIWEAQFGDFANVAQVVIDQFISSGEQKWGRMCGLVMLLPHGYEGQGPEHSSARLERYLQLCAEQNMQVCVPSTPAQVYHMLRRQALRGMRRPLIVMTPKSLLRHPLAVSSLDELANGKFEPVIGEIDALDPKGVKRVVLCSGKVYYDLLEQRRKNEQADVAIVRVEQLYPFPRQNLQTLLEHYAHVHDFVWCQEEPLNQGAWYCSQHNFREVIPFGASLRYAGRPASASPAVGYTSVHQQQQQALVNDALNVE

SEQ ID NO: 9989 - protein, 404 aa, Xenorhabdus bovienii
  Coding DNA sequence: Name=SeqID_3881
  Gene classification: Gene name=AceF; Function=Dihydrolipoamide acyltransferases; Function class=C Energy production and conversion
  Homolog annotation: Query=1..404bp; Hit=1..405bp; Blast score=619; Percent Identity=81.0; E value=1e-177; Homolog= sucB COG0508
MSSVEILVPDLPESVADATVATWHKKAGDTVQRDDVLVEIETDKVVLEVPASEAGVLEAILEEEGATVLSKQLLGRIRLSDSTGIPAEVKEKTESTPAQRQTASLEEESNDVLSPAVRRLIAEHDLDPAAIKGSGVGGRIVREDVEKYITAHKKESGKVAEAAPAQSSQLPHRSEKRVPMTRLRKRVAERLLEAKNNTAMLTTFNEVNMKPIQELRKQYGDAFEKRHGMRLGFMSFYVKAVVEALKRYPEVNASIDGTDVVYHNYFDISIAVSTPRGLVTPVLRDADALGMADIEKSIKELAIKGRDGKLTVEELTGGNFTITNGGVFGSLMSTPIINPPQSAILGMHAIKDRPMAVNGQVEILPMMYLALSYDHRLVDGRESVGFLVTIKEMLEDPTRLLLDV

SEQ ID NO: 9990 - protein, 48 aa, Xenorhabdus bovienii
  Coding DNA sequence: Name=SeqID_3882
MTSPGAGLHIHFLHQHCFTSDWAEFNTLHPDGDAIHPATNVSDLPAFP

SEQ ID NO: 9991 - protein, 388 aa, Xenorhabdus bovienii
  Coding DNA sequence: Name=SeqID_3883
  Gene classification: Gene name=SucC; Function=Succinyl-CoA synthetase beta subunit; Function class=C Energy production and conversion
  Homolog annotation: Query=1..388bp; Hit=1..388bp; Blast score=657; Percent Identity=89.0; E value=0; Homolog= sucC COG0045
MNLHEYQAKQLFARYGLPAPAGYACTTPREAEEAASKIGSGPWVVKCQVHAGGRGKAGGVKVVNSKEDIRAFAEQWLGKRLVTYQTDAQGQPVHQILVEGATDIAKELYLGAVVDRGTRRVVFMASTEGGVEIEKVAEETPELIHKAIIDPLAGPMPYQGRELAFKLGLTSKQVGQFTKIFMGLANLFLERDLAMVEINPLVITTQGDLICLDGKLGADGNAMFRQAELREMHDPSQEDPREAQAAQWELNYVALDGNIGCMVNGAGLAMGTMDIVKLHGGAPANFLDVGGGATKERVTEAFKIILSDENVKAVFVNIFGGIVRCDLIADGIIGAVEEVGVHVPVVVRLEGNNAELGAKKLADSGLNIIAASSLTDAAKQAVAAAGNK

SEQ ID NO: 9992 - protein, 291 aa, Xenorhabdus bovienii
  Coding DNA sequence: Name=SeqID_3884
  Gene classification: Gene name=SucD; Function=Succinyl-CoA synthetase alpha subunit; Function class=C Energy production and conversion
  Homolog annotation: Query=1..288bp; Hit=1..288bp; Blast score=472; Percent Identity=92.0; E value=1e-133; Homolog= sucD COG0074
MSILIDKNTKVICQGFTGSQGTFHSEQAIAYGTQMVGGVTPGKGGTEHLGLPVFNTVREAVEATGATASVIYVPAPFCKDSILEAIDAGIKLIITITEGIPTLDMLTVKVKLDQAGVRMIGPNCPGVITPDACKIGIMPGHIHKAGKVGIVSRSGTLTYEAVKQTTDAGLGQSTCVGIGGDPIPGSNFIDILKLFQEDPQTEAIVMIGEIGGTAEEEAAAYIKEYVTKPVVAYIAGVTAPKGKRMGHAGAIIAGGKGTADEKFAALEAAGVKTVRSLADIGDAVKGLLAGN

SEQ ID NO: 9993 - protein, 32 aa, Xenorhabdus bovienii
  Coding DNA sequence: Name=SeqID_3885
LRQPDSVNGSLVTTSNKCLKHNNELLSKSDIQ

SEQ ID NO: 9994 - protein, 523 aa, Xenorhabdus bovienii
  Coding DNA sequence: Name=SeqID_3886
  Gene classification: Gene name=CydA; Function=Cytochrome bd-type quinol oxidase, subunit 1; Function class=C Energy production and conversion
  Homolog annotation: Query=1..518bp; Hit=2..519bp; Blast score=857; Percent Identity=84.0; E value=0; Homolog= cydA COG1271
MFDIVELSRLQFALTAMYHFLFVPLTLGMAFLLAIMETVYVLSGKQIYKDMTKFWGKLFGINFALGVATGLTMEFQFGTNWSYFSHYVGDIFGAPLAIEGLMAFFLESTFVGLFFFGWDRLSKKQHLAVTWLVGLGSNFSALWILVANGWMQNPIASDFNFETMRMEMVSFSELVLNPVAQVKFVHTVAAGYVTGAVFVLGISSYYLLKGRDIPFAKRSFAIASSFGIAAILSVIVLGDESGYEMGDVQKTKLAAIEAEWETQPPPASFTLIGIPDQDKMENKYSIQIPYILGLIATRSTDTPVVGLRDLMGQHEQRIRNGIKAYELLEELRSGNIDPTVRNAFNESKKDLGYGMLVKRYTQDVANATEEQIKSAAKDSIPRVAPLYFAFRIMVASGFLMLLVIGLAFLSVIRNRIGQQKWLLRAALFSIPLPWIAIEAGWFVAEYGRQPWAIGEILPTAVAASTRSVGDLIFSMVLICGLYTLFLIAEMFLMFKFARLGPSSLKTGRYHFEQKTASSANNIE

SEQ ID NO: 9995 - protein, 379 aa, Xenorhabdus bovienii
  Coding DNA sequence: Name=SeqID_3887
  Gene classification: Gene name=AppB; Function=Cytochrome bd-type quinol oxidase, subunit 2; Function class=C Energy production and conversion
  Homolog annotation: Query=1..379bp; Hit=1..379bp; Blast score=536; Percent Identity=75.0; E value=1e-152; Homolog= cydB COG1294
MLDYDVLRFIWWLLIGVLLIGFAVTDGFDMGVGVLLRIIGKNDTERRIMINSIAPHWDGNQVWLITAGGALFAAWPMVYAAAFSGFYVAMILVLAALFFRPVGFDYRSKLENSQWRSMWDWGIVIGSFVPPLVIGVAFGNLLQGVPLAIDSYMRLSYEGSFFGLLNPYGLLAGIISLMMIVTQGATYLQMRTTGELHLRSRTATHVCALVTVVAFLVAGVWLIYGIDGYVVTGGLDVNGPSNPLHKEVAHQAGAWLINFNKYPALWAVPALGVILPLLTMLATRMDKGGWAFLFSSLTVACIILTSGIAMFPFVMPSSIDPNISLTMWDATSSQWTLQVMFVVALIFVPLILSYTTWCYYKTFGRLDKNYIENNKNSLY

SEQ ID NO: 9996 - protein, 51 aa, Xenorhabdus bovienii
  Coding DNA sequence: Name=SeqID_3888
LVAFISQHYFSPLSVAFFDSLCSSAKAAMIAKLQAKSVPRIQAKYHMRYAP

SEQ ID NO: 9997 - protein, 95 aa, Xenorhabdus bovienii
  Coding DNA sequence: Name=SeqID_3889
  Gene classification: Function=Uncharacterized BCR, predicted membrane protein; Function class=S Function unknown
  Homolog annotation: Query=7..94bp; Hit=9..96bp; Blast score=92; Percent Identity=57.0; E value=5e-20; Homolog= ybgE COG3790
MLADKCYQLMDKGPLRALILIMALALASCVFWDPARFAANTSSLHVWQGVLLIWAVCSGVTFGVGFHPKQIIWRLFFHPLPAFFILLFGLYHFFK

SEQ ID NO: 9998 - protein, 131 aa, Xenorhabdus bovienii
  Coding DNA sequence: Name=SeqID_3890
  Gene classification: Gene name=FcbC; Function=Predicted thioesterase; Function class=R General function prediction only
  Homolog annotation: Query=2..131bp; Hit=5..134bp; Blast score=171; Percent Identity=65.0; E value=1e-43; Homolog= ybgC COG0824
MLFRWPIRVYYEDTDASGVVYHAQYLAFYERARTEMLREKGFHQKYMLDEQIGFVVSRMTVDYRKPARLDDLLVVESEITNIRGASLTFTQRIVDCNGVAISSAESLVVCVNSSQMKPIALPKSIVAEFKQ

SEQ ID NO: 9999 - protein, 226 aa, Xenorhabdus bovienii
  Coding DNA sequence: Name=SeqID_3891
  Gene classification: Gene name=TolQ; Function=Biopolymer transport proteins; Function class=N Cell motility and secretion
  Homolog annotation: Query=1..220bp; Hit=4..223bp; Blast score=351; Percent Identity=88.0; E value=4e-97; Homolog= tolQ COG0811
MNILDLFLKAGFLVQLIMLILIGFSIVSWAIIIQRTRILNAATREAEAFEDKFWSGIELSRLYKESQSRRDSLNGTEQIFHSGFKEFARLHQVNSHVPEAVITGASRAMRISMNRELETVENHIPFLGTVGSISPYIGLFGTVWGIMHAFIALGAVKQATLQMVAPGIAEALIATAIGLFAAIPAVMAYNRLSQRVNKLEQIYDNFMEEFLAILHRQAFTPNTNKS

SEQ ID NO: 10000 - protein, 143 aa, Xenorhabdus bovienii
  Coding DNA sequence: Name=SeqID_3892
  Gene classification: Gene name=ExbD; Function=Biopolymer transport protein; Function class=N Cell motility and secretion
  Homolog annotation: Query=1..141bp; Hit=1..142bp; Blast score=160; Percent Identity=75.0; E value=3e-40; Homolog= tolR COG0848
MARTRSRRRELKSEINIVPLLDVLLVLLLIFMATAPIITQSVEVDLPDAVDSKAVSSSDNPPVIMEVSGIGQYNMIVNQERLELLPEQQIIVEAQALMKANPKTVFLIGGSKEVPYDEIIKALNMLRQAGVKSVGLMTQPIGA

SEQ ID NO: 10001 - protein, 373 aa, Xenorhabdus bovienii
  Coding DNA sequence: Name=SeqID_3893
  Gene classification: Gene name=TolA; Function=Membrane protein involved in colicin uptake; Function class=M Cell envelope biogenesis, outer membrane
  Homolog annotation: Query=4..139bp; Hit=1..132bp; Blast score=94; Percent Identity=54.0; E value=1e-19; Homolog= ZtolA COG3064
MSSVGKTNEQNNRLNRAIIISVILHIILIGFLIWGSLMQKTEMGGGGAGGTVIDAVMVDPNAVVQQYNQQQQQQANAKSAEQQRKKKAEQQAAELRVKQAEEQERLKSAEEERIKAQQASEEQKKQADAAASKAREEQKLAEEAAAKAKAEKEIILKEQAEARQKAEVQAKKEAEETAKRKAASEAKAKAEAEAQAKAEAEAKTKAKAEAESKVKAEAESKAKSEAEAETKAKTEAKAKAKAKAEATKQAQEVDDLLGGLTSSAPKQGGASAAGQGGGKKSGPSQSDINNYKGQIQTAIQQNFHDPSLYLGRTCELRIKLAPDGLLIDIKAGAGDPALCRAAVAAARQTKIPRPPSKEIYEHFKNSSLDFKPQ

SEQ ID NO: 10002 - protein, 96 aa, Xenorhabdus bovienii
  Coding DNA sequence: Name=SeqID_3894
  Gene classification: Gene name=TolB; Function=Periplasmic component of the Tol biopolymer transport system; Function class=N Cell motility and secretion
  Homolog annotation: Query=6..96bp; Hit=2..92bp; Blast score=131; Percent Identity=65.0; E value=1e-31; Homolog= tolB COG0823
MKQTFKQSFKIVLGFLMMWAALAHAEVRIEITQGVDSARPIGVVPFKWTGAANAPEEIGSIIAADLRNSGKFNPIDSNRMPQQPTTASEVTPAAWS

SEQ ID NO: 10003 - protein, 200 aa, Xenorhabdus bovienii
  Coding DNA sequence: Name=SeqID_3895
  Gene classification: Function=Uncharacterized BCR; Function class=S Function unknown
  Homolog annotation: Query=19..196bp; Hit=3..178bp; Blast score=174; Percent Identity=51.0; E value=5e-44; Homolog= ymbA COG3009
MKKLMLRLAFFISVSVFAVSSVFISGCSSSQPQKTYYQLPALTSTSQESRLGVKDERQLWVKGVTLADYLASPGIVYQTGDVIYVNASNHLWASPLEQQLQQVLITELSAAFPQKLVAGQPLEKNADTLNITITAFHGRYDGKVMIQGYWMLFNQNGVIKRPFNLELKQKIDGYAELVRTLATGYSQLAQSIASQIASPV

SEQ ID NO: 10004 - protein, 554 aa, Xenorhabdus bovienii
  Coding DNA sequence: Name=SeqID_3896
  Gene classification: Gene name=PqiB; Function=Paraquat-inducible protein B; Function class=R General function prediction only
  Homolog annotation: Query=10..553bp; Hit=2..545bp; Blast score=759; Percent Identity=67.0; E value=0; Homolog= ZpqiB COG3008
MRSRKVTDKEEDLTQARISKLKSWSPVWIVPIITVLIGAWILFYHFSHQGPEVTLMTSNAEGIEAGKTKIKSRSVDIGIVERVSLSDNLGQVIIKARLNDGMERLLYQDTAFWVVKPQIGREGISGLSTLLSGVFIELQPGNQGGEENKFSLLDSPPLASPDAKGMRLVLISEKAGQLTPGDPVLFRGYRVGSVETSTFDPKSRLMRYQIFVNAPYDGLLTSGVRFWKDSGVAFDMSSQGLRVEVASLSTLFGGGVSFDVPKGWDLGNPVKEKETFKLYDSEKNIQNSLYTKHKDLLLFFADSVRGLQLGAPVEFRGIRVGTVAKVPFYTEGVRQRLDNDFRIPVLIHIEPERFEKEIGSGFYTDKELEEIIARGLRASLKSGNLLTGALFIDLDFYPNEEKWTGPYEIAGYEILPTVSGGLAQIQQKVIMALDKINNMPIEPVFVQATRTLEESQKTIKAARKTMDELNRILASKEAQGLPKDIQNTLQELNRSMQGIQPGSPAYNKLIDNMQRLDQVLRELQPVLKTLNNKSNALVFEAEEMKDPEPKKARN

SEQ ID NO: 10005 - protein, 433 aa, Xenorhabdus bovienii
  Coding DNA sequence: Name=SeqID_3897
  Gene classification: Gene name=PqiA; Function=Uncharacterized paraquat-inducible protein A; Function class=S Function unknown
  Homolog annotation: Query=12..420bp; Hit=1..408bp; Blast score=526; Percent Identity=66.0; E value=1e-149; Homolog= ZpqiA COG2995
MALLICYRRNTLCSNNHQHDKLVLCPQCDMLVAVPNLEQGNKAACPRCETLLTAKWKEPRNQPTGYAASALLMLFLASLFPFVSMNIAGIVSEISLPQIPKVMFSEDYSSIAVFFLIFVQLVPAFCMVAIILLCQNIKMARRLKIELARILFQMKTWCMAEIFLAGVLVSFVKLMAYGDIGIGLSFLPYCLFCLFQVRAFQCLDRHWFWNEIEPAPEVCIPLQAGKPGLVQGVRRCQCCTAILPAQLPQCSRCHTTGHARRRHSLQYTMALLITSAILYIPANLLPIMVTQALSSHINSTILEGIILLWSTGSYPVAMVIFIASIMVPILKMLAISWLCWDAKSQSSHDSETMHFIYEMVEFVGRWSMIDVFVIAVLSALVRMGQFMSVYPATGAVLFALVVILTMFASITFDPRLTWDKANHKFELQKNEES

SEQ ID NO: 10006 - protein, 57 aa, Xenorhabdus bovienii
  Coding DNA sequence: Name=SeqID_3898
MLMIIGTQSVSPVANQQGHTLDLSNCCCVHSPQPHSDLCARGISSLTAALQIEIYWK

SEQ ID NO: 10007 - protein, 636 aa, Xenorhabdus bovienii
  Coding DNA sequence: Name=SeqID_3899
  Gene classification: Gene name=Uup; Function=ATPase components of ABC transporters with duplicated ATPase domains; Function class=R General function prediction only
  Homolog annotation: Query=1..636bp; Hit=1..634bp; Blast score=938; Percent Identity=76.0; E value=0; Homolog= Zuup COG0488
MSLINLSGAWLSFSDAPLLDNTELHIEENERVCLVGRNGAGKSTLLRVLAKEQPLDDGQVIYEQDLIVARLQQDPPRDVEGTVFDFVSEGVKEQADCIKAFHHASRLVETDPSDKNLNRLAELQEVLDIQGLWLLDSRISDVLKQLSLPAEAKLSSLSGGWLRKAALGRALVSSPRVLFLDEPTNHLDIDTIEWLENFLKDFNGSLVFISHDRSFIRSMATRIIDLDRGKLTSWPGNYDKYLESKEEALRVEELQNAEFDKKLAQEEVWIRQGIKARRTRNEGRVRALKALRVEHSDRRNVMGTAKMQVEEATRSGKIVFEMENVNYQIGDKTLVKNFSAQVQRGDKIALVGPNGCGKTTLLKLMLGDLSSESGRIHCGTKLEVAYFDQHRAALDPDKTVMDNLAEGKQEVMVNGRSRHVLGYLQDFLFHPKRAMTPVRALSGGERNRLLLARLFLKPSNLLILDEPTNDLDVETLELLEELVDGYTGTVILVSHDRQFVDNSVTECWIFEGNGEINNYVGGYYDAQQQRTQTISLHQSSEKKNSIETKAVKSKETSKRASNKISYHLLRELEQLPSLLETLEEEIEQLQSQVGDSEFFNQPHAVTQNVLNELANKEQKLEKAFDRWQELEMIKNG

SEQ ID NO: 10008 - protein, 705 aa, Xenorhabdus bovienii
  Coding DNA sequence: Name=SeqID_3900
  Gene classification: Function=Predicted N6-adenine-specific DNA methylases; Function class=L DNA replication, recombination and repair
  Homolog annotation: Query=1..379bp; Hit=1..379bp; Blast score=544; Percent Identity=68.0; E value=1e-154; Homolog= ycbY_1 COG0116
MNSLFASTARGLEELLKNELEMLGAQSCKIAQGGVHFQGDDRVMYKSLLWSRLASRILMPLNEFNVYSDLDLYLGVQSIDWSEIFSVDSTFSVHFSGTNEEIRNTQYGALRVKDAIVDSFVRKIKQRPDVAKQQPDIRIDVFLNKEKATLSLDLSGEGLHIRGYRDLAGQAPLKETLAAAVVLRSGWKAGTPLIDPMCGSGTLLIEAAMMAADGAPGLHRQHWGFTSWLKFDQEIWREMMAEAQVRFRKGLQETTSRFFGSDIDRRVMDMARSNARRAGVAHLIQFQQGDASKLENPLPEGAVGTILSNPPYGERLESEPALVALHSIFGRIMKSRFPGWRLSLFSASPELLSCLQLRAEREFKAKNGPLDCVQKNYQLSDKPQSLDAGIADDYANRLRKNEKKLSKWAKQQGIDCYRLYDADLPEYNVAIDRYADKVVVQEYAPPKTVDANKARQRLFDVISATMNVLELSSNQLILKTRQRQTGKNQYEKMAEKKEFFLVNEYGAKFWVNLTDYLDTGLFLDHRIARKKLGEMSQGKDFLNLFAYTGSATVHAGLGGARSTTTVDMSRTYLEWAEKNLQANGLSGRQHRLIQADCLGWLAQSREQFDLIFIDPPTFSNSKRMEDSFDVQRDHIPLMKQLKCLLRRGGTLMFSNNKRGFKMDFAELEKLGLVAEEITEKTVSQDFARNRQIHNCWLLRHAGEEK

SEQ ID NO: 10009 - protein, 32 aa, Xenorhabdus bovienii
  Coding DNA sequence: Name=SeqID_3901
MYRDVTELSFSMPKKCFLFFDKVSNFMTCCWY

SEQ ID NO: 10010 - protein, 370 aa, Xenorhabdus bovienii
  Coding DNA sequence: Name=SeqID_3902
  Gene classification: Function=Uncharacterized Fe-S protein; Function class=R General function prediction only
  Homolog annotation: Query=1..273bp; Hit=1..273bp; Blast score=364; Percent Identity=59.0; E value=1e-101; Homolog= ycbX_1 COG3217
MITLSRLYTYPVKSMRGLQLSHSFTGESGLMFDRNFMITKTDGSFMTARLYPQMLLFTPSMLNNGIYLRAPNGESATILYSDFKEERHPTEVWGNHFTALVAPDEVNTWLGGFFDTPVQLRWLSEELTRRVKQFPDISLSFADGFPYLIINEASFHALQQRCPASIKIEQFRANIVVTGAAPFEEDSWQTIQIGNIIFDLPRPCSRCILTTVSTEKGRKNPKSEPLATLQSFRTAKENGAVDFGQNAIVRNNGIIRVGDSVTILEKKTPREYGCGEQAKDLNIQKAIGQAISIEFNGQRFTGNNQQIILEQLEKQGIKIPYSCRAGICGSCKISLIEGNVSPLKSTAIKDNGKILACSCIPQNDLVIELN

SEQ ID NO: 10011 - protein, 32 aa, Xenorhabdus bovienii
  Coding DNA sequence: Name=SeqID_3903
MAERFNILSHFVNITCHLSPFNSNIQNIFCLN

SEQ ID NO: 10012 - protein, 183 aa, Xenorhabdus bovienii
  Coding DNA sequence: Name=SeqID_3904
  Homolog annotation: Query=1..183bp; Hit=1..181bp; Blast score=259; Percent Identity=70.0; E value=2e-68; Homolog= ref|NP_929038.1|
MKIRPDDQWRWYFDSEHSRVMLDLANGMVFRSRFPAKMLTDYAITMEEMPFSVDDAALYYAFEEHFRCINIASELRAELALNGVVAFRFMKPQMPKSWYFSSFSVMTKPEQGEIVQVRLQDCGTEVLFMVAEVGDSASLCLLAQQKLELNDRVMNFCDPIKIMNDRLMPYTEPTRETIYGRAI

SEQ ID NO: 10013 - protein, 40 aa, Xenorhabdus bovienii
  Coding DNA sequence: Name=SeqID_3905
LGVYFYSQLVYILSDRLIFLSVFLVFHYGSVIYFEPNKLF

SEQ ID NO: 10014 - protein, 401 aa, Xenorhabdus bovienii
  Coding DNA sequence: Name=SeqID_3906
  Gene classification: Gene name=PyrD; Function=Dihydroorotate dehydrogenase; Function class=F Nucleotide transport and metabolism
  Homolog annotation: Query=66..401bp; Hit=1..336bp; Blast score=553; Percent Identity=78.0; E value=1e-157; Homolog= pyrD COG0167
VIYLKKSPRRLRAELSFFLRRWPEDVCQQIEKYLPAHLHFDRISLRCSALISQSPRPVITPAGDCMYYSLLRKALFQLDPEQAHELTFRQLKLVTGTPFEFLIRQSVATKPVTCMGLSFKNPLGLAAGLDKNGDCIDAFGAMGFGFVEIGTVTPRPQVGNDKPRLFRVVEAEGIINRMGFNNLGVDNLVENVKRAKYDGIIGINIGKNKDTPIENGKDDYLICMDKIYPHAGYITINISSPNTPGLRTLQYGEALDDLLSAIKNKQSELQQKFQKYVPIAVKIAPDLTEEELIQVADSLMRHRIDGVIATNTTLDRKLIEGLNHCQQAGGLSGRPVQLRSTEIIRCFSQELKGKIPIIGVGGIDSLVAAREKMEVGSSLIQIFSGFIYKGPKLIKDIVNHI

SEQ ID NO: 10015 - protein, 872 aa, Xenorhabdus bovienii
  Coding DNA sequence: Name=SeqID_3907
  Gene classification: Gene name=PepN; Function=Aminopeptidase N; Function class=E Amino acid transport and metabolism
  Homolog annotation: Query=1..870bp; Hit=1..869bp; Blast score=1282; Percent Identity=73.0; E value=0; Homolog= ZpepN COG0308
MTQQRLVKHRLDYQAPDYTITDIDLDFDLHADKTTVTAISQVKRLNHDTTPLILDGENLTLKSIHIDDKAWEHYHEQDGKLSIEQLPAQFTLTIVNEIYPSANTALEGLYISGDALCTQCEAEGFRNITYYLDRPDVLARFTTRIAADISKYPYLLSNGNRIGQGELSDGRHWVKWQDPFPKPAYLFALVAGDFDVLRDTFVTRSGREVALELFVDRGNLDRTDWAMTSLKNSMKWDETRFGLEYDLDIFMIVAVDFFNMGAMENKGLNVFNSKYVLAKTETATDKDYLGIEAVIGHEYFHNWTGNRITCRDWFQLSLKEGLTVFRDQEFSSDLGSRSFNRINNVRIMRAAQFAEDASPMAHPIRPDQVMEMNNFYTLTVYEKGSEVIRMIHTLLGEEQFQAGVQLYVHRHDGSAATCDDFVQAMEDASNVDLTLFRRWYSQSGTPILTVRDEYDAEKQQYTLHVSQMTPPTSDQKEKQPLHIPLDIELYDEHGSVIPLRRDGQPIHHVLNIINAEQTFVFDDVPSLPVPSLLREFSAPVKLDYPYSDTQLAFLMKHALNEFSRWDAAQSLLANYVKLNVARYQQSLTLELPMHVIDAFRAVLLNQDIDPALAAQILTLPSENEMAELFTVIDPKSIHDVLHAITRGLANEMADEFTAVYHSIHTGAYRVDHQDIAKRALRNTCLYYLAFIDDKEQVDQLVAAQYYQADNMTDTVAALSAAMSAELPCSYQLMDEFEQRWHQDGLVMDKWFALQATNPAFDALDKVRSLMNNRSFSLSNPNRVYSLLRTFFANNLVAFHAEDGRGYQFLQEVLTELNSRNPQVASRLIEPLIRWKRYDEARQSLMRATLEQLKVLENLSGDLFEKITKALES

SEQ ID NO: 10016 - protein, 37 aa, Xenorhabdus bovienii
  Coding DNA sequence: Name=SeqID_3908
LKGWNLYGSVRDWKISMETEYASILWLKLYRCYQYAD

SEQ ID NO: 10017 - protein, 63 aa, Xenorhabdus bovienii
  Coding DNA sequence: Name=SeqID_3909
MKPLFSDVNQLLNKGVNDVSRILVLSCKLSSHISCNMILSADGLTLIVTVRKNICGYVALITK

SEQ ID NO: 10018 - protein, 404 aa, Xenorhabdus bovienii
  Coding DNA sequence: Name=SeqID_3910
  Gene classification: Gene name=PncB; Function=Nicotinic acid phosphoribosyltransferase; Function class=H Coenzyme metabolism
  Homolog annotation: Query=1..403bp; Hit=1..399bp; Blast score=550; Percent Identity=67.0; E value=1e-157; Homolog= pncB COG1488
MTLDATPIIKSLLDTDAYKFHMQQAVYHHYRHIPVVAEFRCRGDELLGEYAETLRHQIDMMADLTLTEREANYLASLPFFKEDYLNWFKSFRFNPEQVKISVTDEGQLAIRISGLWHEVILWEVPLLALISELVHRHRSPEIKPEVAVSQLRKLIELFHQDAAEKNIDLAGFKLMDFGTRRRFSHEVQYAIVNELKNNFPYLIGTSNYQLAEQLSLAPLGTQAHEWFQAHQQISPELANSQRAALQTWLNEYPAQLGIALTDCITMDAFLRDFDKTFATAYQGLRHDSGDPIEWGEKAIAHYQSLGIDPMTKTLVFSDSLDLQKSLNLYRRFHKRINVMFGIGTRLTCNIPGVKPLNIVIKLVECNGKPVAKLSDSPGKTICEDDEFVDRLRRAFDIPYIEKAV

SEQ ID NO: 10019 - protein, 33 aa, Xenorhabdus bovienii
  Coding DNA sequence: Name=SeqID_3911
MGKNREKRLFTCVTSMKLVTQGTINEDYTAFSM

SEQ ID NO: 10020 - protein, 466 aa, Xenorhabdus bovienii
  Coding DNA sequence: Name=SeqID_3912
  Gene classification: Gene name=AsnS; Function=Aspartyl/asparaginyl -tRNA synthetases; Function class=J Translation, ribosomal structure and biogenesis
  Homolog annotation: Query=1..466bp; Hit=1..466bp; Blast score=839; Percent Identity=85.0; E value=0; Homolog= asnS COG0017
MSVAPVVDVLQGRVPVDSEVTVRGWVRTRRDSKAGISFLAVYDGSCFNPVQAVVNSNLPNYQDEVLHLTTGCSVEITGTVVASQGKGQSFELQATNVVVVGMIDDPDTYPMAAKRHSIEYLREVAHLRPRTNLIGAVARVRHTLSQALHRFFHEKGFFWVSSPLITASDTEGAGEMFRVSTLDLQNLPRTDKGDVDFSKDFFGREAFLTVSGQLNGEAYACALSKIYTFGPTFRAENSNTSRHLAEFWMLEPEVAFADLNDIASLAEKMLKYVFKAALEERADDLAFFAERVDSEVVSRLEKFVDSDFIQLDYTDAIEILENCGQEFENPVFWGVDLSSEHERYLAEKHFEAPVIMKNYPKDIKAFYMRMNEDGKTVAAMDVLAPGIGEIIGGSQREERLDMLDQRMEEMDLNKEDYWWYRDLRRYGTVPHAGFGLGFERLVAYVTGVSNVRDVIPFPRTPRNASF

SEQ ID NO: 10021 - protein, 38 aa, Xenorhabdus bovienii
  Coding DNA sequence: Name=SeqID_3913
MNQLNNWAKINPLKSQRKLAFFILWFKPDEKSSLKFTF

SEQ ID NO: 10022 - protein, 380 aa, Xenorhabdus bovienii
  Coding DNA sequence: Name=SeqID_3914
  Gene classification: Gene name=OmpC; Function=Outer membrane protein (porin); Function class=M Cell envelope biogenesis, outer membrane
  Homolog annotation: Query=4..362bp; Hit=19..362bp; Blast score=341; Percent Identity=57.0; E value=8e-94; Homolog= nmpC COG3203
MRVIIMKRNLLAVVIPALLVAGTANAAEIYNKDGNKIDVYGKVDVRHMFGKSKDYKADKEHGDDSRARLGVKGETQINDQLTGFGRYETEWKSNGTEAAGSGYKTRLAYAGLKFANYGSLDYGRNYGVIYDTAAWTDVLPLFGGDSMAQTDNYMTGRSTGLLTYRNNDFFGLVDGLNFALQYQTKNHENTINDRKKLSEANGDGYGLSTSYDVGYGITLGAGYSNSARTKGQKDSEASGKRAEAWDIGAKYDANNVYLAALYGETRNMTRFGKDLIVEDNDFGKSIANKTQNIELVAQYYFSDFGLKPSLAYVQSKGKDLDLGESENRNNQDLVKYVSVGTYYYFNKNLSTFVDYKINLLNKISSLETQVSALTTYLVWV

SEQ ID NO: 10023 - protein, 78 aa, Xenorhabdus bovienii
  Coding DNA sequence: Name=SeqID_3915
LILFSRGSALKLSAKPRIGSAGAAVIFSNIFLIPRLGELSPKNKLYAAQGNSKKLVCQQFVAKRRQSCEVVYGVKKRS

SEQ ID NO: 10024 - protein, 396 aa, Xenorhabdus bovienii
  Coding DNA sequence: Name=SeqID_3916
  Gene classification: Gene name=TyrB; Function=Aspartate/aromatic aminotransferase; Function class=E Amino acid transport and metabolism
  Homolog annotation: Query=1..396bp; Hit=1..396bp; Blast score=656; Percent Identity=78.0; E value=0; Homolog= aspC COG1448
MFEKITAAPADPILGLADSFKADPRENKINLGIGVYKDETGKTPVLTTVKKAEKLLLESETTKNYLAISGLPEFGRVTQELLFGNTSAIITDKRARTVQSPGGTGALRTAADFIAKQTNAKRVWISNPTWPNHKGVFSSAGLEIREYQYYNAEKHALDFDGMLTSLSEAQAGDVVLLHGCCHNPTGIDPTAEQWQKLADLSAANGWLPVFDFAYQGFARSLDEDAEGLRIFTKNHNELIVASSYSKNFGLYNERVGACTIVATDSDTAEKAFSQAKSIVRTNYSNPPAHGASVVTAILSNDELKAEWIQELATMRERIRRMRQLFVNTLQEKGAKQDFSFIISQNGMFSFSGLTKEQVDRLREEFGIYAVSSGRINVAGLTLENMVPLCEAIVAVL

SEQ ID NO: 10025 - protein, 210 aa, Xenorhabdus bovienii
  Coding DNA sequence: Name=SeqID_3917
  Gene classification: Gene name=GloB; Function=Zn-dependent hydrolases, including glyoxylases; Function class=R General function prediction only
  Homolog annotation: Query=1..210bp; Hit=1..210bp; Blast score=288; Percent Identity=61.0; E value=3e-78; Homolog= ZycbL COG0491
MNYHIIPVTTVMQNCTLIWCEETLEAAIVDPGGEAEKLISEIERRGLKLTQILLTHGHYDHVGATVDVAKYFNVPVHGPHKADAFWIEALEVQCQMFGVEACPSFTPERWLDEGDTLQIGNIEFSVLHCPGHTPGHIIFVNHTDKLISMGDVLFKGSIGRTDFPGGNYDDLIQSIKEKVIPLGDDFHFIPGHGPMSTLGHERKTNPFLQD

SEQ ID NO: 10026 - protein, 182 aa, Xenorhabdus bovienii
  Coding DNA sequence: Name=SeqID_3918
  Gene classification: Function=Uncharacterized BCR; Function class=S Function unknown
  Homolog annotation: Query=1..182bp; Hit=1..182bp; Blast score=250; Percent Identity=67.0; E value=5e-67; Homolog= ycbK COG3108
MNDIDYSRRKWLGVGAAALGLSLLPQHALAALTTPRPRILRFDNLHTGETLKAEFFDGRRYNKSELARLNYLFRDYRQNKIKSIDPKLFDQIYLLQMMIGINKPVQLVSGYRSLATNNMLRQASGGVAKRSYHTRGQAMDFHIDSVQLAHIRKAALKMRAGGVGFYPKSNFIHIDTGPVRTW

SEQ ID NO: 10027 - protein, 31 aa, Xenorhabdus bovienii
  Coding DNA sequence: Name=SeqID_3919
MNERRKFKINICTVREIALFSSLLFSPYPVF

SEQ ID NO: 10028 - protein, 572 aa, Xenorhabdus bovienii
  Coding DNA sequence: Name=SeqID_3920
  Gene classification: Function=Uncharacterized BCR; Function class=S Function unknown
  Homolog annotation: Query=56..562bp; Hit=63..607bp; Blast score=524; Percent Identity=48.0; E value=1e-148; Homolog= ZycbB COG2989
MAKNTVSLLKVSFICSALAVSEGTFASQQNGLIVNDTQQFSEEQKKKDVVASPDQIIPISAVNSIEANRKQIQSWLPQQVKPIFIDRLATLYAVNKMKPLWQDKNTVQQFEQQLFELSLAGVQPQFGKWLTQLHSAELSDMGRDIILSDAMLGYLHFVNNVKRKGEPWLYSKNSYKLDLPPSDLIDKWQQHITDNHVLSYITALSPDNPMYKNMRKEMLKQLADKQQLSEFSMKGTLRPGQNSESVVALREILIRSDTLDSLTVKPENKVYNKELVAAVKRFQALHGLSADGVIGQSTKVWLNTTPQTRARIMALNIQRLRIIPGNIPTGLLVNIPNYSLFYYLDGKEVLNSKVVVGRPSRKTPIMSSELNNVVINPPWTVPTSMTRKDIAPRAMRDPSYFRSRGYTVFSSWSNDAKVIDPSSINWEVTTPNNFPYRIRQAPGPTNSLGRFKFNMPNSEAIYLHDTPNQASFGREMRAVSSGCVRVNKAPELANMLLGNAGWNKDRVSNSLKTWTTAYVNIPKKIPVFLYYQTAWVDEGGVPQYRADIYDYDMSAREQSELLPEILATRNDL

SEQ ID NO: 10029 - protein, 237 aa, Xenorhabdus bovienii
  Coding DNA sequence: Name=SeqID_3921
  Gene classification: Gene name=AphA; Function=Acid phosphatase (class B); Function class=R General function prediction only
  Homolog annotation: Query=1..237bp; Hit=1..237bp; Blast score=304; Percent Identity=57.0; E value=6e-83; Homolog= ZaphA COG3700
MRKVTLALSAIALAFGLNGMAQAKMFMPEQVSSGVTTVDLAQRQAVHWVSVAQIDKSLQNQPPIAVGFDIDDTVLFSSPGFYRGKLKYSPNDKSYLKNPAFWEKMNNEWDKFSMPKQIGIELVQMHLKRGDDIYFITGRTETKTETVTKYLQEGLHIPADKMHAVIFAGDEPSKNDKVSWMKNHKLKIYYGDADADIAAAHELNIRGIRILRASNSSYQPLPKAGRFGEEVVIKSEY

SEQ ID NO: 10030 - protein, 75 aa, Xenorhabdus bovienii
  Coding DNA sequence: Name=SeqID_3922
VNCFLHIKSNNYIHRNNIRLLCGISHFDSIRTFIISRCCNQYRVRNNNAESDVSIKCDCTCFWPEWYGSGKNVYA

SEQ ID NO: 10031 - protein, 287 aa, Xenorhabdus bovienii
  Coding DNA sequence: Name=SeqID_3923
  Gene classification: Gene name=LysR; Function=Transcriptional regulator; Function class=K Transcription
  Homolog annotation: Query=2..60bp; Hit=1..59bp; Blast score=61; Percent Identity=47.0; E value=1e-09; Homolog= cynR COG0583
MILSKKINHFLSVAECGSFKNASKNIHISPPALCKSIADIEDTLGFKLFNRSNVGVTLTEEVVNLYKYLLPIRDDVENIKSSLPTILTEKEIKVGTDSYNQAFKKLLSKIIENEYVDLLSEMYYFDEHRIKLLSGKLDFFISTHPPIEDKLERITYKVHERETEVFIISKSLFNKNNSLTNVVRNEKMILHSGTTKHPCFDEMLKYRKEHKINTQMLVFPDISHIIEFVCFGIGYSIINNSILNVDYLNSVGVKIIPNTLFSSETFSYIYYLKRKELELRKFINYLN

SEQ ID NO: 10032 - protein, 387 aa, Xenorhabdus bovienii
  Coding DNA sequence: Name=SeqID_3924
  Homolog annotation: Query=18..381bp; Hit=7..370bp; Blast score=480; Percent Identity=62.0; E value=1e-134; Homolog= gb|AAM48710.1|
VTNSVHRNEHQKQNNSPTHVECHTEWGKLRHVIVGRADNACIPPPEPAFMARIPENSDMRGRYGPRSQESIDAANEQLDGLASILTSRGIRVDRPTPLDFNSPVQTPDFTQGTMFGCQPPRDVLITVGREILEATMSFRSRFFEYLCYRPLISTYLKEDGGMRHESAPRPRLSDASYRHGYLSEAISMKTRKEWVKKKEFVTTEEEPIFEAADIFRCGKDLFVQHGFTTNMKGVDWLKRHFSDYRIHPINFPGDPFPSHIDCTLLPLRPGLILSNPVRPLLPEFKQFFIHNDWQIIEAASPAHSQSPPLCYSSVWLSMNLLSLDEKTVCVEETEIHQMEQLDKLGFEIIPIPFRNAYPFGGGLHCATTDIWREGNLEDYFPAESYLC

SEQ ID NO: 10033 - protein, 365 aa, Xenorhabdus bovienii
  Coding DNA sequence: Name=SeqID_3925
  Gene classification: Function=Uncharacterized ACR; Function class=S Function unknown
  Homolog annotation: Query=27..250bp; Hit=5..251bp; Blast score=87; Percent Identity=28.0; E value=3e-17; Homolog= aq_1723 COG0585
MNNIEFNTSFLKQSPTSFHNRDFQYFLKRVPEDFLVEEVPKFYKPSMKKQIWHFQLCKEGMTTSEAITNISNILGIPENHIGYAGLKDEDGVTSQRISIQSLPNNVDINAINSRLDMVSGKWLSLHKIGCFEENIKIGQLVGNSFRVVIRNLHNHIAHTLAKQSSHNHAFINYYDTQRFGVPGGPSTTHLIGQSFHQGEWEKALLLVRESASPEAQTAQKWQGKPVNFFHQLDPRRLSFYYASYGSYQWNHLVAQEFQRDHEGLRVIRSSIPYILPNAYSDIMAFAAAMPWYPFSRIEIIDGKKTEKQSLRPTVVHTYVKIVELTDDHEFPDRSSLTVEFFLPSGCYATMAICQFVYLANAHTTL

SEQ ID NO: 10034 - protein, 447 aa, Xenorhabdus bovienii
  Coding DNA sequence: Name=SeqID_3926
  Gene classification: Function=Fe-S oxidoreductases family 2; Function class=C Energy production and conversion
  Homolog annotation: Query=1..379bp; Hit=4..375bp; Blast score=77; Percent Identity=25.0; E value=3e-14; Homolog= PH0819 COG1032
MRILLLIPPYIPSYFNAGHHLPLFQVATYIREKNPSWQVTALDGGTLNLTWHDLAKELAKGYNFIGLFNDFDAVDGFGRTVMYCREILPQVKMFTFGRLSKQVPDWFKQFGFEGIAFSGDYESSVESFLLNYGPNTGSIPGLIVKTPEGYLQGNAGHMLSPEEWILPDTLEIPYAAYDRMYKNDLNKFCGIPDRRELVIPVARGCPVGCEFCDVPSMQGKSERRLSVDRVIKYITDQQQIQPFDYISFYAPTFTLNRRWVKELCHKFIELKLPVKWKCVTTIYHLNEELIALMAQAGCIRISLGVETISVSQNLQLPRIKLNTEAKIQELLAIAKHNGIEINAFIILGLPGDTMEASIKTIEWLIAEGARVRPTVYTPYNELHEGSSLAEVGKYNRQIFHETPQSPMERLKGYSLLFANDKDRPTEVMKKIALQVTDEKDQISGGSL

SEQ ID NO: 10035 - protein, 209 aa, Xenorhabdus bovienii
  Coding DNA sequence: Name=SeqID_3927
  Homolog annotation: Query=13..204bp; Hit=15..211bp; Blast score=103; Percent Identity=33.0; E value=2e-21; Homolog= gb|AAF61921.1|
MNIRRYSPDFKQKKEPFEWFCSDRFLSPKVFARLQSEFPQNGYRKSHREEGDEKYYSTWDLLAIDNGVPVLDTWNNLTTAWKSMLITILSEGYRNYSSTLTGRDLTETHLHVRFTIYHENCWLAPHCDRTDKVITQTLYFPTGAIEGGELLILGSSDPDDIKETVAPAPNRSVILLPSPYSWHSVRKVVSGSQHARRALLLHYVSSDNK

SEQ ID NO: 10036 - protein, 203 aa, Xenorhabdus bovienii
  Coding DNA sequence: Name=SeqID_3928
  Homolog annotation: Query=16..201bp; Hit=21..211bp; Blast score=117; Percent Identity=34.0; E value=9e-26; Homolog= gb|AAF61921.1|
MFNLLLPETLTDTPYHWGIVSPFIHNDIANSLMETFPDNGFIVAEKIAGEPNDKKMYSLETLQLEKDTPLSPIWHEFIQYLRSDQYRDRMGALIGKDLSSTMLNLTLWRYRSSQWLGPHTDKPEKIVTQIFNFNRNWSSDWGGCLRILRSDDSQDVDREIPPELNTSAILHRSDHSWHMVTPVSDTAPVGTYRRVLTAVFISN

SEQ ID NO: 10037 - protein, 436 aa, Xenorhabdus bovienii
  Coding DNA sequence: Name=SeqID_3929
  Gene classification: Gene name=MurA; Function=UDP-N-acetylglucosamine enolpyruvyl transferase; Function class=M Cell envelope biogenesis, outer membrane
  Homolog annotation: Query=1..436bp; Hit=1..412bp; Blast score=175; Percent Identity=30.0; E value=9e-44; Homolog= BH3784 COG0766
MHKIEVTGGSPLSGQVQVSGFKHAFPPLFSLALSSNQPSLIKNVPDIADIRILGKIGQLLGADIVYEPEKRAMYIDPRSLNNSNIPGDLSALIHGAWYLAPGLLARTGHIVLGETGGCKIGGGQEGERPIEQLCSVLQRFGATVKAEENIIQATAQRFSSARIDMADFAVPEEGTDKLTGPLYSGATKAALLCAARAEGISEIINPYPKPDVVALVEAIKCQQVAIQWEKNRIIIEGKPEAGGFETTIGPDLIEVMTYLTLSTYCHAPISITNVSRKHIETGLSAEIACLEKLGYLLQWQGNNLSIAHVSPASRLDIQVTSHGIFSDNQPFMALLLMASEQGGSLTEQVWVKRFQYIEELEKMGAKIIRSGRTVEIMPGVPGKSGITVNATDLRGAAALVIAALQISGKTQIGGVDHLERGYPDLLGQLRLLGAKV

SEQ ID NO: 10038 - protein, 364 aa, Xenorhabdus bovienii
  Coding DNA sequence: Name=SeqID_3930
  Gene classification: Gene name=HisC; Function=Histidinol-phosphate aminotransferase/Tyrosine aminotransferase; Function class=E Amino acid transport and metabolism
  Homolog annotation: Query=60..344bp; Hit=55..328bp; Blast score=89; Percent Identity=26.0; E value=4e-18; Homolog= AF2024 COG0079
MADITSINYPLPLAPERPSRTREFLEHGTNLRSGELHHTALTKMIQDIDIPPQRHQFYPYPQIEHNRAAKMLGIDSSCIYFTPGSDIAIGLILRLIARTTGRLIIPIPNYFGWIDHANLNQINILPIYFNDQCTENFCLKTLLGTIQTTPPSIVAISNPNSPTGIEFDDETILAISNSCIRQGHLLVIDECFMAFGNIDHLAVLGQPEHIIYVRSFSKGYGLAGARIAAVIASPTIIDILSQERTEAAISGSAWAVLQGILVKEYQIKQICQSIIQAREYVIGTIMKLRPNWQILPSGANFINVKICGDSPAQLVKTAALGGFYIRDMSSQERMDGYIRIGIGELALMVKFLKQLFPSEYKYSE

SEQ ID NO: 10039 - protein, 231 aa, Xenorhabdus bovienii
  Coding DNA sequence: Name=SeqID_3931
  Homolog annotation: Query=59..181bp; Hit=386..509bp; Blast score=64; Percent Identity=38.0; E value=2e-09; Homolog= gb|AAF61216.1|
MRTHFNHVNKLCICPIHHADILNGRILRTNHTDNNSRGTLIRCGIQRGKEKASLNTLSGILPINSWVDLRTPEEYEPQFNSHDLPEIIKYLALPIRFKPPENHLSHIVKQSDYVDLYFTMSTAAWSIAQTVTELLHAGNVVLHCSLGKDRTGLVAAAVLYQLKFSTADIAHDFALSARFLRRQYQLIQDKAQRNGVPNHLQARRYELLGHTIIPLLDKWRKITELNRNDHD

SEQ ID NO: 10040 - protein, 179 aa, Xenorhabdus bovienii
  Coding DNA sequence: Name=SeqID_3932
  Gene classification: Gene name=Adk; Function=Adenylate kinase and related kinases; Function class=F Nucleotide transport and metabolism
  Homolog annotation: Query=7..171bp; Hit=1..167bp; Blast score=120; Percent Identity=39.0; E value=1e-27; Homolog= BH1014 COG0563
MIMINDMHRILIIGSPGAGKSSFAKRLNDICSIPLFHLDKEYWCEGWVAPSAEEWQQKLLLLTNKPRWIIDGNYGSSLSQRLKKADTVIHLYMPTYVCLFQAVKRVLKWYGKQRPDMASGCHEKVNLNFFRQILNYRKHQFKKDKLLLADFNGVYIRLTSRAQVEEFLNNMAKYYKLNH

SEQ ID NO: 10041 - protein, 409 aa, Xenorhabdus bovienii
  Coding DNA sequence: Name=SeqID_3933
MALNIQGRLFLVAMAIGSMGGGIWRPIAIFYLVLVQELNIVEVGLAMTIGAIIALLIAGFPAGLLADKLGPSHSTLIGSLLRFIAFPWMMVVSTPWQIAVIVMFVSIGERIFWCANPAAIRTLFPAKNTQLNVFAIINSCRNIGLGCGALLSMFFIGKDGMSNNIADFIILGNSLGYFISGMIIFMITQKAAKKINEDTQEAVQEDKMKISSFSIINDKKYLVFVFLVGILLLAGKSIEIVLPYYFLIERALPSWFAVFVFTGLCFGIPCFQKVALRLSNKFGCLKSLAWSGFLQTVAYGIIFFLNGDLLLQFILIFIVTILLSLSEAILGAQIGVAILMFSRSGYEGRYSSILQFAFGGATVVAPWLFTQLLSFSTTLLWGSIILYVTLAGIGFLILNKYQSDRAIIL

SEQ ID NO: 10042 - protein, 447 aa, Xenorhabdus bovienii
  Coding DNA sequence: Name=SeqID_3934
MDGNEMTKQLISDNWFTEITKALKEYWQNREVGFLIDYSDNLDTLKALMFELQTCGAKIKAIISVSDESWRPKGVLCWHIVNINQRPLKEILENQCMSIKHWLDKIDPERNITFLGGVRLPLSQFADRPVYGWQKPEWAQFEDKIYIDDSLRRWGINTPAYQIIDPNINDAVAAFHLLNKGKGVILAIDGSESFSAGANGLAWIKDHHEIAHVLDKFRDKTRKLRVAEFIQGIPCSILAMVLPNGVAVFDPIEILTVFEKTTNHLLFCGSSNRWQSGKAEDVMRHCTRLAGQKLAEEVGYRGIFSLDGIWTGSDFFATEINPRHASGLGLRRAAPMFPCYLFNRAVQENSPFIMNIDSVRVEMTLRGMVRNYSGQDIIILDKDEKQQRVIEIEANDNMIVLGVPSEGIDALIHCSLNQEKLLGNIVAELASKVSDLDYISFVNRDIN

SEQ ID NO: 10043 - protein, 54 aa, Xenorhabdus bovienii
  Coding DNA sequence: Name=SeqID_3935
MPSRQFHLYIQSCCSWLPFNIGAGVEGETRGLRLLTKSRLNVQSEAHLVSYDGS

SEQ ID NO: 10044 - protein, 337 aa, Xenorhabdus bovienii
  Coding DNA sequence: Name=SeqID_3936
  Gene classification: Function=Transposase; Function class=L DNA replication, recombination and repair
  Homolog annotation: Query=12..329bp; Hit=2..310bp; Blast score=138; Percent Identity=31.0; E value=8e-33; Homolog= NMB1750 COG3547
MASNKRRVIMHYVGIDVSKNKLDICLLYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELAELEALIAEHINQHPNLKKDFELLTSIKGVGTQIGLNMLIILRTNTFTRATQVAAYLGVIPIAKQSGTSVHGRVRLSKTGPAKIRAKLFMSALTAVRFNPHINDLYNRLVNKGKAKMLALGAAMRKLVHLCYGVLNTQQSYDENYAIRT

SEQ ID NO: 10045 - protein, 455 aa, Xenorhabdus bovienii
  Coding DNA sequence: Name=SeqID_3937
  Homolog annotation: Query=54..454bp; Hit=9..403bp; Blast score=219; Percent Identity=33.0; E value=8e-56; Homolog= emb|CAC11141.1|
MKIRDVICTVFGLSLYLVLISLFSVFVWLVYPSSHRKNIFYIIKLRQGNIMRVLVLNRRPIVEKIALWFAQTNAEVFLVTPKVLMPTSANSSDRGHQYFKEIYSVDNYDSPAVNELIMKVVEEKHIERIVSATEIDVLRAAQVRRKMGLIGQDEVSALSYRNKWIMKSRLQKHGIPVARMQQVVDRQWVEEFAHKYGFPIVIKPVEGGGSVGVQIIHHIGQLQHIDFEQLKQGYLVEEWIEGEFFTIDGLMRNGMMLHCWPSRTTANFSAVSGNSTLLSWMLLADDPLTAQLSTLVSRVIMALPPTPDTTAFHAEAFFCEKTQRLVLCEIACRPGGAGHVPVYEMAFGLNLYKETLLGQAGLCSQETYRDVYPHAMAGFAWFPPKEAIFGYAPESCPVDGINGYQLMACSGQRYQSPHSISDHIAKAFALQPVDCDPAKVITEVDVWWKTNVIWN

SEQ ID NO: 10046 - protein, 629 aa, Xenorhabdus bovienii
  Coding DNA sequence: Name=SeqID_3938
MINWLNTLSEYDDAVASGSGIPIIRPEKPSQEARWHQVMAEMYAEEFRISHNKDVAILNIGENTDSMALLYTKVMGYRVIPVNDIHNIKLLIQEISEKDILIIAMAYELKVGLVASILETVAQAGKNIGFLCGRDLSSLSYLVAKSLLQPSLSEQRECLIDAPKHKYTNDENDLEQLILLLSQPSMLKTIRSHGEGSHAKLPSLTVCGLLEETEFPLMPSCGCSRMARRCKRAHGKTHVFYGLDIRAYVINYICCNGFNIAEELYPSPVSMTLALTEGWSAAVLAPIRPLIAPDYLLTLFRQMAQEKVPLGQIAAALNDACAALGQPFTFVLLGDPALQLALQDVSQHQPADKCDRVETETTCGAIGWIKAVLEEGIHGHRLLRSIDAWLGRTVVDKLSSLREKLTNIERMALFTLKKQEVSYNPDDYKQLLRNNALIQILISQWEKILVSLLHEGRESFDAFDLLHYDQLLNVVRTAEPCQRCGTPIEISLFGNSEATTGSSETYLCRVCGPLSAHRHGGIYLENLTEILSARQGEKVAAKIRLYVPHSDNPVSHRIHLELRGYDKSTGQCFASEIKTTELRHDDVVIFDIKLDENQGCDLHSIRVIAVSGFNIAFLRIRLACLPKQP

SEQ ID NO: 10047 - protein, 221 aa, Xenorhabdus bovienii
  Coding DNA sequence: Name=SeqID_3939
  Homolog annotation: Query=65..215bp; Hit=60..210bp; Blast score=96; Percent Identity=33.0; E value=2e-19; Homolog= gb|AAF61921.1|
MAEVLNLNALKRMKLNHDPSPWAMCDNTFQKTISADMFPVSHWTYHSQRKLAEALGKTGSDEWYQHNVKTRPLLELGETEPYAPDELADIWLVVAGDLLSDDYRECISDVSEYDVSKLQFQAHFWEFGSGSFFQPHVDKPHKIVTHLMYLTDDWVPEMGGCLQLLRSADPKDVVVEIAPKKNTSAIIRRTDSAWHAVTSIPKEMQLVRKVLQVWFWDKPVV

SEQ ID NO: 10048 - protein, 311 aa, Xenorhabdus bovienii
  Coding DNA sequence: Name=SeqID_3940
  Gene classification: Gene name=Tas; Function=Predicted oxidoreductases (related to aryl-alcohol dehydrogenases); Function class=C Energy production and conversion
  Homolog annotation: Query=9..284bp; Hit=6..291bp; Blast score=137; Percent Identity=34.0; E value=2e-32; Homolog= PA1739 COG0667
MIDYSSRFLKTSGLWVSRLAVGSSHFGLGVSRKEVMHIVSTALDIGVNFFDTADVYGKGESEIALGRALYGYRHDVVIATKFGHDETARGASQTVMTQSLNNSLKRLNTDYIDLYQLHAPDLSTPIEETISTLQAWVKEGKIRSYGICNVKSSEIKHYCCTAQTMGGALLTSVQNPLNILNYPDYEEIKPSLKEFQLGLLASLPLARGLLGGHYRTVLDVPCTHPLSGYKGLGYRNIRTKNAIGRLMHAAKQLNRPPSVLALEVILASEDLVSVLVGISNSNQLLSLIDLNPSLIQQETIDYLLGRRPELG

SEQ ID NO: 10049 - protein, 71 aa, Xenorhabdus bovienii
  Coding DNA sequence: Name=SeqID_3941
MKNTKKDVNDLLDDLVSKPEVQARWEDVPEQVMQEYQLTPAQYRALSEGNIDALINEGLADRHVQQMRVSW

SEQ ID NO: 10050 - protein, 211 aa, Xenorhabdus bovienii
  Coding DNA sequence: Name=SeqID_3942
  Gene classification: Gene name=WbbJ; Function=Acetyltransferases (the isoleucine patch superfamily); Function class=R General function prediction only
  Homolog annotation: Query=4..205bp; Hit=18..219bp; Blast score=263; Percent Identity=59.0; E value=8e-71; Homolog= VCA0253 COG0110
MSGNQKHWSQVEYLHSTVTNPNIKIKGTHSYYSHCWSDSFEKSVVRYLYGDEISLGWEPLGVVDKLYIGNYVCIASEAVILMGGNHTHRMDWFSVYPFLEGIKESYQHSGDTILSDGCWIGMRSMIMPGVTIGEGAVVAAGSIVTKDVSPYTVVGGNPARFIKYRFEPSVISRLLALKIYDLDEEMVEKLLPYLKGDDIDSLESAYYSINQ

SEQ ID NO: 10051 - protein, 224 aa, Xenorhabdus bovienii
  Coding DNA sequence: Name=SeqID_3943
  Gene classification: Gene name=GrpB; Function=Uncharacterized ACR; Function class=S Function unknown
  Homolog annotation: Query=52..215bp; Hit=27..191bp; Blast score=134; Percent Identity=43.0; E value=6e-32; Homolog= BH1888 COG2320
MFLSCKEVILDMISFNPLGIDRKIRSELMINPKDIIFFPEPDPNENPWVHGKPAEEVIGVVAYNPEWVVTWQQLSASIKKALGNIVLHIEHVGSTAVPGLAAKPVIDIDLIVLDPIQEQTYVPALEQLGYDLTVREPSFYQHRCLRLAKPRVNLHVFGPDCPEHIRHILFRDWLREHPEDCQRYMTAKINAKDNVSQVMHYNQRKEQVVREIYQRIFQSQGLLS

SEQ ID NO: 10052 - protein, 1483 aa, Xenorhabdus bovienii
  Coding DNA sequence: Name=SeqID_3944
  Gene classification: Gene name=MukB; Function=Uncharacterized protein involved in chromosome partitioning; Function class=D Cell division and chromosome partitioning
  Homolog annotation: Query=1..1472bp; Hit=1..1472bp; Blast score=1977; Percent Identity=76.0; E value=0; Homolog= mukB COG3096
MIERGKFRSLTLVNWNGFFARTFDLDELVTTLSGGNGAGKSTTMAAFVTALIPDLTLLHFRNTTEAGATSGSRDKGLHGKLRAGVCYSTLDVVNSRHQRIIAGVRLQQVAGRDRKVDIKPFMIQGVPASVQPTQLLTENIGERQARVLPLNELKERLDEMEGVQFKQFNSITDYHSLMFDLGVIPKRLRSASDRSKFYRLIEASLYGGISSAITRSLRDYLLPENSGVRKAFQDMEAALRENRITLEAIRVTQSDRDLFKHLITEATAYVSADYMRHTNERRIHLDEALALRSELFGSRRQLVAEQYRHVEIARELTEQSGASSDLEMDYQAASDHLNLVQTAMRQQEKIDRYQGDIEELTYRLEEQTEVVEEAKELQAEYDTVSEAAEQEVDELKSQLADYQQALDVQQTRSIQYQQALQALERARELCQLPDLLIENADEWQETYQAKEQQATETLLALEQKLSVADAAHSQFEQAYQLVKNIVGEVSRSGAWQSAREVLREWPSQRHLTDRVQPLRIQLAELEQRLNSQQNAERLLGEFCKRHNQQYQPEDLEALQGELEAQLEELSLNASESGERRMQMRQQLEQLKQKIQGLTTRAPVWLTAQDALNQLCEQSDETFESANDVTEYMQQLLEQERETTVERDDVAAQKRELEKHIERLSQPSGAEDSRLLALAERFGGILLSEIYDDITIDDAPYFSALYGPARHAIVVPDLSLVSPHLEALEDCPEDLYLIEGDPQSFDDSVLDFEERKNAVLVKSSDRQWRYSRYPDVPLFGRAARENRLEILNLERDTLAERYATLSFDVQKIQRAYQAFSRFVGKHLSVAFDDDPEADIRSLNQQRIELERELSQFEAQTQQHHQKLAQVKESLSALNRLIPQITLLLDETLIDRVETVREEMSEAQDAARFLQQHSHALNKLEPLVSVLQSDPQQHEQLKQDYETAKHTQNKAKQQAFALTEVVQRRAHFSYSDSVGMLSDNADLNDKLRQRLEHAESDRSRAREQLRQQQSQYAQFNQVLASLKSSYDTKQDMLKELEQEMKDIGVQADPNAESRARERRDQLHTALSTNRSRINQLEKQIAFCEAEMENLQKKLRKSERDYYQKREQVVSSKAGWCAVMRMVKDNGVERRLHRRELAYMNGDELRSMSDKALGALRLAVADNEHLRDALRLSEDPKRPERKIQFFVAVYQHLRERIRQDIIRTDDPVDAIEQMEIELARLTEELTAREQKLAISSKSVANIIRKTIQREQNRIRMLNQGLQAVSFGQVGGVRLNVNVRESHSILLDVLSEQQEQHQDLFKSQRLTFSEAMAKLYQRLNPQIDMGQRLPQTIGEELLDYRNYLELDVEVNRGSDGWLKAESGALSTGEAIGTGMSILVMVVQSWEEESRRLRGKDISPCRLLFLDEAARLDAKSIATLFELCERLQMQLIIAAPENISPEKGTTYKLVRKIFNNHEHVHVIGLRGFGQDAPAIEQPQPILEE

SEQ ID NO: 10053 - protein, 249 aa, Xenorhabdus bovienii
  Coding DNA sequence: Name=SeqID_3945
  Gene classification: Gene name=MukE; Function=Uncharacterized protein involved in chromosome partitioning; Function class=D Cell division and chromosome partitioning
  Homolog annotation: Query=19..242bp; Hit=1..223bp; Blast score=342; Percent Identity=80.0; E value=2e-94; Homolog= ZmukE COG3095
MITEPRCRHMSSTHIEQFMPVKLAQALSNTLFPELDSQLRSGRHIGMDDLDNHAFLMDFQEELETFYARYNVELIRAPEGFFYLRPRSTTLIPRSVLSEMDMMVGKILCYLYLSPERLSNQGIFTFQELYDELLSLADESKLMKLVNQRSTGSDLDKQKLQEKARTSLNRLRRLGMAYFLQNDSNKFTITETVFRFGADVRSGDDPREAQLRMIRDGEAMPVEGNLLQEDNEHEEVSEHSAEGAEDKQS

SEQ ID NO: 10054 - protein, 440 aa, Xenorhabdus bovienii
  Coding DNA sequence: Name=SeqID_3946
  Gene classification: Gene name=MukF; Function=Uncharacterized protein involved in chromosome partitioning; Function class=D Cell division and chromosome partitioning
  Homolog annotation: Query=1..440bp; Hit=1..440bp; Blast score=694; Percent Identity=80.0; E value=0; Homolog= mukF COG3006
MSEYSQTVPELVSWARKNDFSISLPPERLAFLMAISVLNSERFDGEMSEGELVDAFREVCKGFEQTSEAVAVRANNAINDMVRQKLINRFTSELADGNAIYRLTPLGIGISDYYIRQREFSTLRLSMQLSIVANELHRAAESAEEGGDEFHWHRNVFAPLKYSVAEIFDSIDMSQRTMDEQQNSVKTDIAALLNQDWQAAIANCEHLLSETSGTLRELQDTLEAAGDKLQANLLRIQDANMGSGGLELVDKLVFDLQSKLDRIISWGQQAIDLWIGYDRHVHKFIRTAIDMDKNRIFAQRLRQSIQHYFDHPWALTIANAERLLDMRDEELTLRNEEVMGELPPDMEYEEFSEINEQLAEMVARALAVYQQARLPLDLGAVLRDYLAQYPRNRHFDVARILVDQAVRLGVAEADFSGLPAEWLAINDYGAKVQAHVIDTY

SEQ ID NO: 10055 - protein, 261 aa, Xenorhabdus bovienii
  Coding DNA sequence: Name=SeqID_3947
  Gene classification: Gene name=SmtA; Function=SAM-dependent methyltransferases; Function class=Q Secondary metabolites biosynthesis, transport and catabolism
  Homolog annotation: Query=1..261bp; Hit=1..261bp; Blast score=321; Percent Identity=58.0; E value=5e-88; Homolog= smtA COG0500
MRDRNFDDIADKFSRNIYGTTKGKIRQAVVWQDINELLNHLPQRPLRILDAGGGEGNMACQLAELGHQVILCDLSEEMILRAKCNAQERGVLHQMQFIQSPVQDIGQHIKQPVDLILFHAVLEWITDQKDAIETLGEIITPGGALSLMFYNANGLVMRNAILGNFHLATPNIQRRRKRSLSPQNPLVPEQVYQWLIELNMEITGKTGVRVFHDYLQSRQLQNTDFPALLELEQRYCRQEPYISLGRYIHVMARKTTLKSEL

SEQ ID NO: 10056 - protein, 43 aa, Xenorhabdus bovienii
  Coding DNA sequence: Name=SeqID_3948
MKNCLTDKLSLIYLLSNNAGYCYFGTVLIEFTTFSPKFDPGRL

SEQ ID NO: 10057 - protein, 268 aa, Xenorhabdus bovienii
  Coding DNA sequence: Name=SeqID_3949
  Gene classification: Function=Uncharacterized ACR; Function class=S Function unknown
  Homolog annotation: Query=1..263bp; Hit=1..259bp; Blast score=252; Percent Identity=54.0; E value=2e-67; Homolog= ycbC COG1434
MLFLLKKYVGALLMPLPLIILVSLTALLFLWFTRWQKTGKAILSLSWLALLLFSLQPIADKLLLPIEGKYVQRYEPDKAYTAPVKYIVVLGGGFTYNSQWAPSANLISNSLPRVTEGIRLYHLNPGTKMIFTGGRGVNSISSAEIAAIVAQSLGIPVEDTIALREPLDTEEEAAEVEKVLGQQPFILVTSANHMERSLKFFERRGMHPIAGPANQLAVTTPLYAWEKYIPSAYYFSHTERAWYETLGKIWQAIKPVNKEAATEKSENS

SEQ ID NO: 10058 - protein, 249 aa, Xenorhabdus bovienii
  Coding DNA sequence: Name=SeqID_3950
  Gene classification: Gene name=KdsB; Function=CMP-2-keto-3 -deoxyoctulosonic acid synthetase; Function class=M Cell envelope biogenesis, outer membrane
  Homolog annotation: Query=2..243bp; Hit=3..244bp; Blast score=369; Percent Identity=76.0; E value=1e-102; Homolog= ZkdsB COG1212
MFTVIIPARFASTRLPGKPLADIHGKPMIVRVMERAIRSGANRVIVATDNQAVFDAVTAAGGEACMTSAHHHSGTERLAEVIDQYQFADDEIIVNVQGDEPLIPEQIIKQVADNLAESDAGMATLAVQIQDAEEAFNPNAVKVVMDAQGYALYFSRATIPWERDRFMQSKETVGDNFLRHIGLYAYRAGFIRRYVQWAPSPLESIEMLEQLRVLWYGEKIHVAKALQAPGAGVDTPEDLEAVRKAFAEC

SEQ ID NO: 10059 - protein, 47 aa, Xenorhabdus bovienii
  Coding DNA sequence: Name=SeqID_3951
MITVNMNYFSSSAGRARASFSNSTGMPSRTGKARWSSLQISSKFSLS

SEQ ID NO: 10060 - protein, 331 aa, Xenorhabdus bovienii
  Coding DNA sequence: Name=SeqID_3952
  Gene classification: Gene name=LpxK; Function=Lipid A biosynthesis protein LpxK, tetraacyldisaccharide-1-P 4'-kinase; Function class=N Cell motility and secretion
  Homolog annotation: Query=1..323bp; Hit=1..324bp; Blast score=413; Percent Identity=64.0; E value=1e-115; Homolog= ZycaH COG1663
MIERIWFGRSWLYILLLPLSALYGLISGLRRLGYKLGLIRSWKAPVPVVVVGNLTAGGNGKTPVVIWLVEQLQRTGYQVGVVSRGYGGKAEHYPLLVTGEVTTAQAGDEPVLIHRRTGAPVAVAPKRTDAIKALLTHFPVDIIITDDGLQHYALQRDYEIVVIDGIRRFGNGCWLPAGPMRELAGRLNTVNTIIVNGGTPEAGELPMTLKGELAINLLTGESRQVSDIPNGVAMAGIGHPPRFFATLQQLGAVLQETYAFADHQSYDKTQLSALTDDGQNLLMTEKDAVKCFEFAQPNWWYLPVSAHFPEEKEQKMLDEICALLPKVNMRR

SEQ ID NO: 10061 - protein, 581 aa, Xenorhabdus bovienii
  Coding DNA sequence: Name=SeqID_3953
  Gene classification: Gene name=MdlB; Function=ABC-type multidrug/protein/lipid transport system, ATPase component; Function class=Q Secondary metabolites biosynthesis, transport and catabolism
  Homolog annotation: Query=2..581bp; Hit=3..582bp; Blast score=938; Percent Identity=83.0; E value=0; Homolog= msbA COG1132
MNDKDLSTWQTFRRLWPLITPFKLGLAVAAIALVINAAGDTLMLSLLKPLLDEGFGKADMSVLEWMPLVVIGLMLLRGISGFISSYCISWVSGKVVMQMRRRLFTHMMGMPVSFFDQQSTGTLLSRITYDSEQVASSSSGALVTVVREGASIIGLFILMFYYSWELSLILIVIAPIVALVIRLVSVRFRNISKNMQNSMGMVTTSAEQMLKGHKEVLIFGGQKIETKRFNKVSNHMRQQGMKMVSASSISDPIIQLIASFALAFVLYAASFPEIMGALTAGKITVVFSSMIALMRPLKSLTNVNAQFQRGMAACQTLFAILDMEQEKDEGKLELKKAKGDLEFRNVTFCYPTKDHPALKSISMTIPKGKTVALVGRSGSGKSTIANLLTRFYDINEGGIILDGHDLREYSLSSLRSQIALVSQNVHLFNDTVANNIAYASEGKFSREEIERAAEMAYAMDFIKKLDQGLDTMIGENGVLLSGGQRQRIAIARALLRDSPILILDEATSALDTESERAIQAALDELQKNRTSLVIAHRLSTIENADEIIVVEDGFIVEKGNHSVLLEKDGAYAQLHRMQFGQ

SEQ ID NO: 10062 - protein, 789 aa, Xenorhabdus bovienii
  Coding DNA sequence: Name=SeqID_3954
  Gene classification: Gene name=ComEC (BS); Function=Predicted multitransmembrane, metal-binding protein; Function class=R General function prediction only
  Homolog annotation: Query=18..448bp; Hit=16..436bp; Blast score=257; Percent Identity=37.0; E value=3e-68; Homolog= ZycaI_1 COG0658
MSAQRHNRMWPIIFFPFTCILSIWRKPLFIISLNQAAIAIILGMIPLLLLAELPQQKEICFLIGLAFCLWFVPCKSTRITSLMLWTFIFGCWHGHLILNQITYFSETSRSATVMIESVSLGAEKNNEGEKERYRIRLIESDGKYIFPALFASVLWNSPESLCAGQIWQVTMKLRPVHAQLNHGSYDSQRYALSIRQPLNGKITKARLLNGQCSFRQDLINKLAPEIQPLKYAGIALALTFGERKWLDQQTRLLLQQTGIAHLMAISGLHIAMASLFGWSLARGIQFLFPARWVSFRFPLLMGWLTAALYAWLSGWGIPAVRAILGLTLWIYLRCRNRFCFSWQWALWSAALILLFDPLAILSDSFWLSFTAVMALLFWFHWMPLPEGIRYGWQWSWLRGLHMQLGMMLMLLPLQLLLFQGLNIASLVANLWAVPIVSFLSVPLVMLALSCFFLPVIQPILWQLVDYSIVLALAPLQILTHSWFETGYFPIFITLVGWFFVIFWRLGWWKSYKWLLGVSIGIIVCYLKRDDEYQWRFSMLDVGHGLAVVIDKGGKAIIFDTGNRWETGSMAEKVIAPYLRWHRLTPEQIILSHDHLDHTGGVEYLREKYPDIQIRSSLIEQSHLPCIRGEQWTWQELTFRVIWPQEKTAVVGNNQSCVIRIDDGKHSLLLTGDLEKQSEYRLVSLEREHLNATILQVPHHGSNTSSTAVFIRTVMPKYALTSVARYSPWKLPSVKVQKRYKNAEIQWHSTSVSGQITGCFYRDHIKLAGYRQHIMSRWYHQWFGIHSDHE

SEQ ID NO: 10063 - protein, 36 aa, Xenorhabdus bovienii
  Coding DNA sequence: Name=SeqID_3955
VPFFCDYFRIILSSFLDRRTNLRSDSILVLICLVAA

SEQ ID NO: 10064 - protein, 96 aa, Xenorhabdus bovienii
  Coding DNA sequence: Name=SeqID_3956
  Gene classification: Gene name=HimA; Function=Bacterial nucleoid DNA -binding protein; Function class=L DNA replication, recombination and repair
  Homolog annotation: Query=1..93bp; Hit=1..93bp; Blast score=160; Percent Identity=89.0; E value=2e-40; Homolog= himD COG0776
MTKSELIERLTEQQSHMPAKAVEDAVKEMLDHMAETLAAGERIEVRGFGSFSLHYRAPRVGRNPKTGDKVELEGKYVPHFKPGKELRDRVNIYSDS

SEQ ID NO: 10065 - protein, 557 aa, Xenorhabdus bovienii
  Coding DNA sequence: Name=SeqID_3957
  Gene classification: Gene name=RpsA; Function=Ribosomal protein S1; Function class=J Translation, ribosomal structure and biogenesis
  Homolog annotation: Query=1..557bp; Hit=1..557bp; Blast score=958; Percent Identity=93.0; E value=0; Homolog= rpsA COG0539
MTESFAQLFEESLQVIETRPGAIVRGVVVSIDKDVVLVDAGLKSESAIPVEQFKNAQGELEIQVGDEIDVALDAVEDGFGETILSREKAKRHEAWLMLEKAYEEAETVTGVINGKVKGGFTVELNGIRAFLPGSLVDVRPVRDTAHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPESTRLTGRVTNLTDYGCFVEIEEGVEGLVHVSEMDWTNKNIHPSKVVNVGDVVEVMVLDIDEERRRISLGLKQCKSNPWQQFAETHNKNDRVEGKIKSITDFGIFIGLDGGIDGLVHLSDISWNVAGEEAVREYKKGDEIAAVVLQVDAERERISLGIKQLAEDPFNNYLSVNKKGTIVNGKVTAVDAKGATVELADGVEGYLRASEASRDRIEDATQVLNVGDEVEAKYVGVDRKNRIVNLSVRAKDEADEKDAIASVNKQEDTSFANNAMAEAFKAAKGE

SEQ ID NO: 10066 - protein, 58 aa, Xenorhabdus bovienii
  Coding DNA sequence: Name=SeqID_3958
MGLFYIPRNYSLLQGALVCQHILLPTYQDSIYIFLVRCCKSTTCENNNYAGSASAFFA

SEQ ID NO: 10067 - protein, 244 aa, Xenorhabdus bovienii
  Coding DNA sequence: Name=SeqID_3959
  Gene classification: Gene name=Cmk; Function=Cytidylate kinase; Function class=F Nucleotide transport and metabolism
  Homolog annotation: Query=17..242bp; Hit=1..226bp; Blast score=334; Percent Identity=80.0; E value=6e-92; Homolog= cmk COG0283
MTRLLCGKRYAKRRKIMVAIASVITVDGPSGAGKGTLCQALAEALGWQLLDSGAIYRVLALAAIHHQVDIQSEDSLVPLAANLDVRFMPANGKLRVILEGEDVSNEIRTEAVGNTASQAATFPRVREALLRRQRAFRIAPGLIADGRDMGTVVFPDAPVKIFLDASAEERARRRMLQLQEKGFSVNFDRLLSEIQERDFRDRNRAVAPLVPAHDALLLDSTSMSIEEVIDKALTYAKNALALPA

SEQ ID NO: 10068 - protein, 428 aa, Xenorhabdus bovienii
  Coding DNA sequence: Name=SeqID_3960
  Gene classification: Gene name=AroA; Function=5-enolpyruvylshikimate -3-phosphate synthase; Function class=E Amino acid transport and metabolism
  Homolog annotation: Query=1..425bp; Hit=1..425bp; Blast score=667; Percent Identity=79.0; E value=0; Homolog= aroA COG0128
MQSLTLKPISCINGTINLPGSKSVSNRALLLAAFAKGTTRLTNLLDSDDIRHMLNALTALEIPYRLSDDRTCCEVDGIGGTITGKGALELFLGNAGTAMRPLAAALCLGDNNVVLTGEPRMKERPIGHLVDALRQGGAKIDYLEQENYPPLHIKGGFSGGKVVVDGSVSSQFLTALLMAAPLAANDTEIHIQGDLVSKPYIDITLALMESFGVTVENHQYQIFHVKGQQQYQSLGHYLVEGDASSASYFLAAAAIKGGTVRVTGIGKNSLQGDTKFADVLEKMGATIRWGNDFVECERGTLIGVDMDMNAIPDAAMTIATTALFAQGETVIRNIYNWRVKETDRLNAMATELRKIGAEVEEGNDYIRVVPPQKLNHAEIETYNDHRMAMCFSLVALSDTPVTILDPGCTAKTFPDYFNQLEKLSQYIM

SEQ ID NO: 10069 - protein, 41 aa, Xenorhabdus bovienii
  Coding DNA sequence: Name=SeqID_3961
MKVFRYWLNLWLILNAVTHNALIIGRNETSRCEYSSFISKN

SEQ ID NO: 10070 - protein, 362 aa, Xenorhabdus bovienii
  Coding DNA sequence: Name=SeqID_3962
  Gene classification: Gene name=SerC; Function=Phosphoserine aminotransferase; Function class=H Coenzyme metabolism
  Homolog annotation: Query=1..361bp; Hit=1..361bp; Blast score=547; Percent Identity=69.0; E value=1e-156; Homolog= ZserC COG1932
MSQVYNFSAGPAMLPAEVLRRAEQELCNWHGLGTSVMEISHRSKEFMDVAAEAEKDLRDLLAIPENYKVLFCHGGARGQFSALPQNLLGNKTTADYIVSGYWSECAAKEAEKYCTPNVINITTEVDGIRSVKPMSEWALSSDAAYVHYCPNETIEGIAIFEEPDFGDDKIVIADYSSTILSAPIDVNRYGVIYAGAQKNIGPAGITVVIVREDLLGKAHQHTPSILDYTVQAKSGSMYNTPPTFAWYLSGMVFKWLKEQGGLQEISKRNLAKAELLYRAIDNSNLYINRVAPQNRSIMNIPFQLANPTLDGKFLEEAYAHGLHALKGHKVAGGARASIYNAMPYEGVQVLAEFMADFERRNA

SEQ ID NO: 10071 - protein, 73 aa, Xenorhabdus bovienii
  Coding DNA sequence: Name=SeqID_3963
VTSRENRIYLYDVNVIFYGYLNKKLTTRESMQETKPIVHPLYKSVQCFVYLHSVVINNGKSGLGYLIYLSERH

SEQ ID NO: 10072 - protein, 53 aa, Xenorhabdus bovienii
  Coding DNA sequence: Name=SeqID_3964
MRFSLEVTRINPNYPKKLQIRIFPIGDIIDRDNLPLIYRGHHYDSRNYEYCSQ

SEQ ID NO: 10073 - protein, 1019 aa, Xenorhabdus bovienii
  Coding DNA sequence: Name=SeqID_3965
  Gene classification: Gene name=EntF; Function=Non-ribosomal peptide synthetase modules and related proteins; Function class=Q Secondary metabolites biosynthesis, transport and catabolism
  Homolog annotation: Query=2..610bp; Hit=450..1042bp; Blast score=334; Percent Identity=33.0; E value=3e-91; Homolog= BS_srfAB_1 COG1020
MIQEIMNIAPSSFAERLTHVIDNSVIDIFIQKTVEYPENKAIITAERTVSYRELAQQAQSLAVYLRQQGVKYESPVAILLEPGIEQIICQVAILLAGGSCVPLDPAMPDERLGFMLQDLQVNLTLTDIKSQERPLPTNFITMNESLLKPTDAVHLLDIHSGKTHRTHILFTSGTTGKPKAVEIEAQGILHFVVNTNYINFVATDKIACIANPTFDASLFEIWGALLNGATIVIIPRKTVIDPYLFEATLKRFSVNTMFITTTLFNLVASTCPWAFRGLRYLLVGGKALNPYSLRQVLQSSPPQHLINGYGPTESTIFATTHEITLDQLTGESIPIGKPINNTEVYILDDQQQFVAPSQLGGIYIGGTGLARGYWNRPEINAQRFIVADVNKNNTLRRAYNTGDLGWQRSDGVFMYAGRADNQIKLRGHRIEIEKIEAQLLESQFLKSAAVCVIKKENIEPYLTGFIVPKDPDSFSKQELIQWINTRLPNYMLPQLVVIGHIPVTHNGKIDRARLLEECLENQEQQLLPQSSTQMSEEESAILNIWQQVLDSYDLTLDSDFFQSGGSSLQAARLVVEIRRKMQRSLSVQNLYDAPTPRKLVESLQQNHQEDIDICTVMLKDGVLPLDIQPLSQPLQPWLTPNTGRVLLTGATGFLGAFFLRDLLLQPEINQVTCLVRAHDNDAALLRVKKNLNQYGVWQDEFLPRLQVIAGDITEPLLAMNPQTYKRLSVECDVIFHLAAHVNYIQPYSAHRAGNVVGTLNLLRFAVSEKVKSFHYISTITVFGPAGLLSPISTIYEDDDIMPYLDAMRYDSGYSQSEWVVERIIWQARDRGIPLSVYRPGFIMGDSQTGAGNPNDSIARLLKGCIEIGAYPLLVNQRREFVPVNYVSSALLNISRDNNRLGRAYHLVTPDNKHSVDFNQFFELLKQCGYQLNGLDYSEWLEKLEADPALVDNPLMPLIPILSEKIYGQLTRWEVYENMPAYDAKNTNIALKKIHKLYAPMDSHLLERYLSYWRRIGFLS

SEQ ID NO: 10074 - protein, 58 aa, Xenorhabdus bovienii
  Coding DNA sequence: Name=SeqID_3966
MIDKRLFIFQELFKIPYVFWRRPYHSLLVYILMFYIPLTWIFIGNIRKNNVKHFNSSM

SEQ ID NO: 10075 - protein, 44 aa, Xenorhabdus bovienii
  Coding DNA sequence: Name=SeqID_3967
MLNLNTERRIKGVFLLFYILHLSNYSFVGYKLKSIRYKSGINIE

SEQ ID NO: 10076 - protein, 349 aa, Xenorhabdus bovienii
  Coding DNA sequence: Name=SeqID_3968
  Gene classification: Gene name=AnsB; Function=L-asparaginase/archaeal Glu-tRNAGln amidotransferase subunit D; Function class=E Amino acid transport and metabolism
  Homolog annotation: Query=1..349bp; Hit=1..348bp; Blast score=458; Percent Identity=70.0; E value=1e-129; Homolog= ZansB COG0252
MKKTKKTAIAGFLTLVSGSALALPNITVLATGGTIAGGGESATQSSYTAGKVGIDSLLNAVPAIKNIADLKGEQVVSIGSQDMNDQVWLTLAKKINADCDKTDGFVVTHGTDTMEETAYFLDLTTQCQKPIVMVGAMRPSTALGADGPLNLYNAVVVAADKSSANRGVLLAMNDSVIHGRHIGKLSTTEVQAFQAINSGAEGFVHSGKVSYYSATAAPEKAHKAAFDVSKLDKLPKVGIVYNYSNASELPAKAFVENGYQGIVSAGVGNGNIYKSIFDTLAQAAKDGVVVVRSSRIPFGYTTKNAEVNDSKYGFVASERLNPQKARVLLQLALTQTSDPAKIQEMFTQY

SEQ ID NO: 10077 - protein, 49 aa, Xenorhabdus bovienii
  Coding DNA sequence: Name=SeqID_3969
LEVVNGIFQRGVFAGDIGLRHRYSLQFLLKAAYHTAFFLSALSIPKNYC

SEQ ID NO: 10078 - protein, 587 aa, Xenorhabdus bovienii
  Coding DNA sequence: Name=SeqID_3970
  Gene classification: Function=Uncharacterized ACR; Function class=S Function unknown
  Homolog annotation: Query=1..585bp; Hit=4..588bp; Blast score=970; Percent Identity=78.0; E value=0; Homolog= ZycaO COG1944
MTQTYIPGKDAALEDSINHFQSKLTSLGFNIEEASWLNPVPNVWSVHIRDRDCPLCFTNGKGASKKAALASALGEYFERLSTNYFFADFYLGNAVANGEFVHYPNEKWFPLPEDDSLPEGILDERLHHFYNPDNELCASQLIDFQSGNEERGICALPFTRQSDNQTVYIPMNIIGNLYVSNGMSAGNTMNEARVQGLSEVFERYVKNRIIAECISLPEIPESVMNRYPSVVESVNKLQAEGFPLYCYDASLGGQFPVICVVLFNPNNGTCFASFGAHPDFGVALERTVTELLQGRSLKDLDVFTPPSFDDEEVSEHTNLETHFIDSSGAISWDLFKQDADYTFADWSFKGTTEEEFATLMGIFNTLDAEAYIADYEHLDVYACRILVPGMSDIYPVEDLHIANNTMGTHLRETILALPNSQWQPAEYLTFLEQLDDEGLDDFTRVRELLGIAAGKDNGWSNLRIGELKSMLALAGNDLEQALIWVEWTQDFNASVFTAERANYYRCLQTLLLLTQEEDRDPSQYHQAFVKMYGQETVDAASAAIDGKNGFYGLWSVDSELKTLPAHQALLNAYEKLQKAKREFWSNK

SEQ ID NO: 10079 - protein, 313 aa, Xenorhabdus bovienii
  Coding DNA sequence: Name=SeqID_3971
  Gene classification: Gene name=FocA; Function=Formate/nitrite family of transporters; Function class=P Inorganic ion transport and metabolism
  Homolog annotation: Query=29..308bp; Hit=1..280bp; Blast score=398; Percent Identity=73.0; E value=1e-111; Homolog= focA COG2116
MIHVKFRSMLVCYYHYVLKLIKDKESVSMKTDNPFNLFPPAVMAQIADDSGVYKVNKHPAVTYLSAIMAGVFISIAFVFYITATTGTSSIPYGLAKLTGGICFSLGLMLVVIFGADLFTSTVLTIVSKATGRITWSQMLKNWINVYIGNLIGALFFVILMWQSGQYAVANGSWGLNVLQTADHKMHHTFIEAVCLGILANLMVCLAVWMSYAGRSLIDKLFALILPVAMFVASGFEHSIANMFLIPFGIIIKNFAPTEFWAKVGATPEQFPQLTVSHFITDNLIPVTIGNIIGGAILVGLIYWFMYLRGGQKY

SEQ ID NO: 10080 - protein, 760 aa, Xenorhabdus bovienii
  Coding DNA sequence: Name=SeqID_3972
  Gene classification: Gene name=PflD; Function=Pyruvate-formate lyase; Function class=C Energy production and conversion
  Homolog annotation: Query=1..760bp; Hit=1..760bp; Blast score=1413; Percent Identity=88.0; E value=0; Homolog= pflB COG1882
MSELNEKFSVAWQGFNEGSWQNEVNVRDFIQQNYAPYEGDETFLAGATKATDILWKKVMEGIKIENRTHAPVDFDTDVASTIISHDAGYIAKDLEQIVGLQTEAPLKRAIIPFGGIKMVESSCKAYNRELDPKLKQIFTDYRKTHNQGVFDVYTPDILKCRKSGVLTGLPDAYGRGRIIGDYRRVALYGIDLLRDEKYAQFTSLQEKLENGEDLEATIRLREEIAEQHRALSQIKEMAAKYGCDISYPAITAKEAVQWTYFAYLAAVKSQNGAAMSFGRVSSFLDIYIERDLQAGRLTEQEAQELIDHLVMKLRMVRFLRTPEYDELFSGDPIWATESLAGMGLDGRTLVTKNSFRFLNTLYTMGPSPEPNMTILWSEKLPINFKKFAAKVSIDTSSLQYENDDLMRPDFNSDDYAIACCVSPMIVGKQMQFFGARANLAKTMLYAINGGVDEKMKIQVGPKEEPMRDEVLDYDKVMARMDHFMDWLAKQYVTALNIIHYMHDRYSYEAALMALHDRDVYRTMACGIAGLSVAADSLSAIKYAKVSPIRDEDGLATDFNIEGEYPQFGNNDPRVDDIACDLVERFMKKIQKLQTYRNAVPTQSVLTITSNVVYGKKTGNTPDGRRAGAPFGPGANPMHGRDQKGAVASLTSVAKLPFAYAKDGVSYTFSIVPNALGKDDEVRKANLAGLMDGYFHHEANIEGGQHLNVNVMNREMLLDAMENPEKYPQLTIRVSGYAVRFNSLTKEQQRDVITRTFTQTI

SEQ ID NO: 10081 - protein, 246 aa, Xenorhabdus bovienii
  Coding DNA sequence: Name=SeqID_3973
  Gene classification: Gene name=PflA; Function=Pyruvate-formate lyase -activating enzyme; Function class=O Posttranslational modification, protein turnover, chaperones
  Homolog annotation: Query=1..246bp; Hit=1..246bp; Blast score=434; Percent Identity=82.0; E value=1e-122; Homolog= pflA COG1180
MSVLGHIHSFESCGTVDGPGIRFIVFFQGCLMRCLYCHNRDTWNTHGGITVTVEELIKEATTYRHFMNASGGGVTASGGEAILQAEFVRDWFRACHAENIHTCLDTNGFVRRYDLIIDELLDDTDLVMLDLKQLDDEIHQKLIGVSNHRTLEFAHYLAKRNQKTWIRYVVVPGWSDDDKSVHMLGEFTQDMKNIEKIELLPYHELGKHKWIAMGEEYKLEGVKPPSKEIMERVKEILVSYGHHVIY

SEQ ID NO: 10082 - protein, 273 aa, Xenorhabdus bovienii
  Coding DNA sequence: Name=SeqID_3974
  Homolog annotation: Query=24..272bp; Hit=6..251bp; Blast score=196; Percent Identity=49.0; E value=4e-49; Homolog= ref|NP_928896.1|
MDNQDINFNSGEKNVSLTKEKSTFIPGGRAVGAGAAIEWIGNAWQMVKANPMMWILLTFIYMVIIVGLQFIPFLSFFTALLGSVFIAGFIAAAEKQRTTGNFEIELLFHGFKNKFGSLVAVGGLVFGIYLLGVIAAVIIGGTSIYQLILASQYADPDPALLLGSLSSIMLAVLVLTIFSMIALAFSWFAPALIIINDLKFGEAVSMSLSAVKKNLFGGFLFFLLVGILVGISMIPFFLGMIITIPIYMATFYTTYRSIFYTEEVKEQKSSLIS

SEQ ID NO: 10083 - protein, 268 aa, Xenorhabdus bovienii
  Coding DNA sequence: Name=SeqID_3975
  Homolog annotation: Query=24..266bp; Hit=6..248bp; Blast score=173; Percent Identity=45.0; E value=3e-42; Homolog= ref|NP_928896.1|
MNNKNIDFSSRSRNVSLTKDKETFIPNGRAAGANAAIEWIRNSWEIVKPNFGNWILLLFLYLICFTIILLVPFINLIALFIAPVFMGGFMAICEEYRKKGSFNIGLFFHGFKKNFGSLLAVGIFTILILTVGVLAAIVIGSVGIYQFYLIGQGSEIDIAMVLLIFFIFILIYIAIIFFSILGLAYTWFAPALIVINGLKFSDAISMSFNAVKKNLLGGFIFFLLMNMIITLSIIPLGLGLFITIPIYLAAYYTSYRSIFYVESKESEN

SEQ ID NO: 10084 - protein, 429 aa, Xenorhabdus bovienii
  Coding DNA sequence: Name=SeqID_3976
  Gene classification: Gene name=SerS; Function=Seryl-tRNA synthetase; Function class=J Translation, ribosomal structure and biogenesis
  Homolog annotation: Query=1..429bp; Hit=1..430bp; Blast score=714; Percent Identity=82.0; E value=0; Homolog= serS COG0172
MLDPNMLRNELDAVAEKLARRGYTLDVETLCKQEERRKVLQVETETLQAERNSRSKAIGAAKARGEDIEPLRQEVNQLGEKLDLAKAELEALQAEIRELALRMPNIPDDSSPYGKDDSDNQEISRWGEPRQYDFEVKDHVSLGELTNGLDFAAAVKLTGSRFVVMKGQIARLHRALAQFMLDLHTEQHGYLETYVPYLVNHETLYGTGQLPKFGEDLFHTNPLEEETGSNYALIPTAEVPVTNLVRGDILDESALPLKMTAHTPCFRSEAGSYGRDTRGLIRMHQFDKIELVQIAHPEKSMDALEELTGHAEKVLQLLKLPYRKMLLCTGDMGASARKTYDLEVWLPAQNTYREISSCSNMWDFQARRMQARFRSKDDKKTQLVHTLNGSGLAVGRTLVAVMENYQQADGRIEIPEVLRPYMKGLEYIG

SEQ ID NO: 10085 - protein, 428 aa, Xenorhabdus bovienii
  Coding DNA sequence: Name=SeqID_3977
  Gene classification: Function=Uncharacterized ATPase related to the helicase subunit of the Holliday junction resolvase; Function class =L DNA replication, recombination and repair
  Homolog annotation: Query=1..428bp; Hit=20..447bp; Blast score=719; Percent Identity=84.0; E value=0; Homolog= ycaJ COG2256
MRPVTLDHYIGQQHLLAEGKPLPRAIRAGHLHSMILWGPPGTGKTTLAEIIGHYAQADIERISAVTSGIKEIRESIEKASQNRNAGRRTILFVDEVHRFNKSQQDAFLPHIEDGTITFIGATTENPSFELNSALLSRARVYLLKSLSAAEIEQVLFQAMNDKERGFGGQNIVLQDDTRQMAAELVAGDARRSLNLLEMMSDMAKANAQGQRVLTPELLKEVSGERSARFDNKGDRYYDLISALHKSIRGSAPDAALYWYARIITAGGDPLYVARRLLAIASEDVGNADPRGMQVAIAAWDCFTRVGAAEGERAIAQAIVYLACAPKSNAVYMAFKAAMVDAQDKPDYDVPAHLRNAPTKLMKEMGFGEAYRYAHDEPNAYAAGEVYFPPEMRETRYYHPTARGLEGKIGDKLNWLIEQDKNSQIKRYR

SEQ ID NO: 10086 - protein, 202 aa, Xenorhabdus bovienii
  Coding DNA sequence: Name=SeqID_3978
  Gene classification: Gene name=LolA; Function=Outer membrane lipoprotein-sorting protein; Function class=M Cell envelope biogenesis, outer membrane
  Homolog annotation: Query=1..202bp; Hit=2..203bp; Blast score=275; Percent Identity=66.0; E value=2e-74; Homolog= lolA COG2834
MKKLMLIGCLMMGVSVGTAWADASQDLQGRLGKVNSFHASFTQTVTSSDGSAIQNGEGQLWVKRPNLFNWHMTSPDESVLVSDGKTLWFYNPFVEQVTANWLKDAAGNTPFMLIARNDSADWKQYNVVQSGNNFELTPSNANGNLKHFSITVTPEGTIQKFTAVEQDGQKSAYQLKGQQNTRVDESKFKFTMPEGVTLDDQR

SEQ ID NO: 10087 - protein, 38 aa, Xenorhabdus bovienii
  Coding DNA sequence: Name=SeqID_3979
MQYPHSHPSSDNQSTSVFSCARYLQFIFIISINSRYRI

SEQ ID NO: 10088 - protein, 1100 aa, Xenorhabdus bovienii
  Coding DNA sequence: Name=SeqID_3980
  Gene classification: Gene name=FtsK; Function=DNA segregation ATPase FtsK/SpoIIIE and related proteins; Function class=D Cell division and chromosome partitioning
  Homolog annotation: Query=463..1097bp; Hit=312..957bp; Blast score =722; Percent Identity=60.0; E value=0; Homolog= VC1903 COG1674
MVALVSFNPSDPSWSQTSWNGPVHNFGGSVGAWLSDILFSAFGILAYAVPLFMFLGCWNAFRQKDRQEYVDFFTLALRVIGALALVLTSCGLVALNIDDLNDFAAGGVIGNLFSKAILPWFNILGATLALLGIWAIGFTLFTGWSWLTIAEKIGAVILESLSFMVNCTRNEPEYGELEDEVIPEHLASGQNRADNVNTDDIGMTASAAKAVEVDEDDVLLSAPTVVELVKTDSAPPAISASQAMDTAQESGSPEKVQPVQQNENRQQSIAQEAITLPESVQTESDHTEEDQEPVHYTFELPADYQLDTESEFSKTAQITAQSELSTDSTVATNIQPQNDVIESFTFSPNDNLKNVAAGVSSAAVVMKTPQMKQGIGPEMPRPNPVRIPTRRELYGVKVPSQRLSEHLQREEKERQSDLIAETDEQQMDEQQQDMLRQQFLEQQRERYGSNFEEETKGHREEIAQIHKQSATAEFVEHSVDEPSEQEEALRVAFEQQQRERYQKIQPAIPSQAEKPAFDYSSLADGFEKSEPVELLPLQSESSIRSEQEKRTVSVSGPSHESKIQHTFAQQPQQPQQPQQPQQPQQPQQSSLFHPFLMRNDQPLPKPTTPMPSLDLLAKPPAEEEPVDMFALEQTSRLIEVRLNDYRIKADVVGFSPGPVITRFELDLAPGVKASRISNLSRDLARSLSAVAVRIVEVIPGKPYVGLELPNKKRHTVYLREVLDCEKFRDNPSPLTIVLGKDIAGQPVVADLGKMPHLLVAGTTGSGKSVGVNAMILSILYKAKPEDVRFIMIDPKMLELSVYEGIPHLLTEVVTDMKDAANALRWCVNEMERRYKLMSALGVRNLAGYNDKIKQAENMGRPIPDPFWKPGDSMDVTHPMLKKEPYIVVMVDEFADLIMTVGKKVEELIARLAQKARAAGIHLVLATQRPSVDIITGLIKANIPTRIAFTVSSKIDSRTILDQGGAESLLGMGDMLYLAPNSSIPVRVHGAFVRDQEVHEVVNDWKARGRPQYIDSIIKGGEDGEGGLGLDSDEELDPLFDQAVQFVTEKRRVSISGVQRQFRIGYNRAARIVEQMEAQQIVSTPGHNGNREVLAPPPHEH

SEQ ID NO: 10089 - protein, 54 aa, Xenorhabdus bovienii
  Coding DNA sequence: Name=SeqID_3981
LKLTSATIKYTTQIAITNRMASRSRRLLLIFFNLTRLSSVYSWFKKGSPGFPVD

SEQ ID NO: 10090 - protein, 164 aa, Xenorhabdus bovienii
  Coding DNA sequence: Name=SeqID_3982
  Gene classification: Gene name=Lrp; Function=Transcriptional regulators; Function class=K Transcription
  Homolog annotation: Query=1..164bp; Hit=1..164bp; Blast score=304; Percent Identity=97.0; E value=3e-83; Homolog= lrp COG1522
MIDNKKRPGKDLDRIDRNILNELQKDGRISNVELSKRVGLSPTPCLERVRRLERQGFISGYTALLNPHYLDASLLVFVEITLNRGAADVFEQFNTAVQKLEEIQECHLVSGDFDYLLKTRVPDMSAYRKLLGETLLRLPGVNDTRTYVVMEEVKQSNRLVIKTR

SEQ ID NO: 10091 - protein, 35 aa, Xenorhabdus bovienii
  Coding DNA sequence: Name=SeqID_3983
MRSRSFPGRFLLSIILLLSLYIPTPITFSLSLSSS

SEQ ID NO: 10092 - protein, 31 aa, Xenorhabdus bovienii
  Coding DNA sequence: Name=SeqID_3984
MISLLCLAVLMNTSFPLSHIADLGIVGEIIS

SEQ ID NO: 10093 - protein, 319 aa, Xenorhabdus bovienii
  Coding DNA sequence: Name=SeqID_3985
  Gene classification: Gene name=TrxB; Function=Thioredoxin reductase; Function class=O Posttranslational modification, protein turnover, chaperones
  Homolog annotation: Query=1..317bp; Hit=1..318bp; Blast score=545; Percent Identity=84.0; E value=1e-155; Homolog= trxB COG0492
MSTAKHSKLIILGSGPAGYTAAVYAARANLNPVLITGVEKGGQLTTTTEVENWPGDPEGLTGPDLMERMFQHAEKFQTEIISDHIQKVDFEKRPFRLYGDDQEYTCDALIIATGASARYLGLPSEDAFKGRGVSACATCDGFFYRKQKVAVVGGGNTAVEEALYLANIAAEVHLIHRRDTFRSEKILIDRLMEKVKNGNIILHTDRTLDEVLGDDMGVTGIRIHDTKSDNAEELDVTGVFIAIGHSPNTGIFEGQLELQNGYIKVQSGLHGNATQTSIPGVFAAGDVMDHVYRQAITSAGTGCMAALDAERFLDGLATK

SEQ ID NO: 10094 - protein, 57 aa, Xenorhabdus bovienii
  Coding DNA sequence: Name=SeqID_3986
MIQCIKKAGDTVCQRPNLMFPVKKRYRNSALKKEGLFSCQSIKKTFSIQCSHTASTC

SEQ ID NO: 10095 - protein, 589 aa, Xenorhabdus bovienii
  Coding DNA sequence: Name=SeqID_3987
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..589bp; Hit=1..588bp; Blast score=702; Percent Identity=64.0; E value=0; Homolog= cydD COG1132
MDKTRQSELVRWLRQQSAPARRWLRLSMLLGLISGLLIISQAWLLASILQALIMDKIPRENLIVQFLMLIAAFTLRAIVSATRERIGFICGKVVRQQIRSIVLDKLAQLGPVWVKGKPAGSWATIILEQIEDMQDFYSRYLPQMALATIIPLLILMTVFPVNWAAGLILLVTAPLIPLFMSLVGLGAADANRRNFVALSRLSGNFLDRLRGLETLRVFHRGEAEVKQITESTDSFRHRTMEVLRMAFLSSAVLEFFAAVSIAVVAVYFGFSYLGELHFGSYGLGVTLFAGFLALILAPEFFQPLRDLGTFYHAKAQAVGAAESLFTLLNSDGEHTVSNGEKMLPDTKSVTIEANELEIRSHDGHHLAGPLSFTIDKHQRIALVGKSGAGKSSLINLLLGFLPYRGSLKINGIELRELNLTKWREQLSWVGQNPHLPEQTLLDNIRLGQFDATQDQINDVMERAYVSEFIHALPEGVNTVIGDNAARLSVGQAQRIAVARALLNPCQLLLLDEPAASLDAHSEQRVMMALNQASSQQTTLLVTHLLEETLEYDQIWVMENGLIIEKGHYQSLSQSQGAFSRLLSHRSVEL

SEQ ID NO: 10096 - protein, 580 aa, Xenorhabdus bovienii
  Coding DNA sequence: Name=SeqID_3988
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..572bp; Hit=1..571bp; Blast score=701; Percent Identity=65.0; E value=0; Homolog= cydC COG1132
MRILLPFLALYRRHWFLISLGMVLAVVTLLASIGLLTLSGWFLAGTALAGFAGLYTFNYMLPAAGVRGAAIFRTAGRYGERLVSHDATFRVLAHLRVFAFQKILPLSPGGIARFRQGELLNRIVADVETLDHLYLRVISPVLSALVVIVVLTFGLGFLDVTLAYTLGGIMLGLLMILPFVFYHAGKPYGRDITLLRGQYRTLLTSALQGQAELTVFGALGRFRQSMTDVESDWLKCQQQQANLTGLSQAVMIFATGMTVTLLLWLAAAGVGEHSQPGALIALFAFCALAAFEALGPVTVAFQHMGQVISSATRVSQLMHQEPEVTFPAHGPQTTDSLNLEIKNIDFTYPEQPLPVLKNISLSLTSGEHIALLGKTGCGKSTLLQLLSRAWGVDHGEIRLNQQPISQYDEATLRSMMSIVPQRIHVFSHTLRENLLLAKPDASDDELEIVLKQVGLGNLLDNNEKLNCWMGEGGRQLSGGEQRRLGIARALLHNAPLMLLDEPTEGLDADTEQQILSLLRHSCQHKTLIVVTHRLTGLQHMDRICVMDEGRIIEQGKHDVLLAQQGRYYQFYQRQSYLEQE

SEQ ID NO: 10097 - protein, 229 aa, Xenorhabdus bovienii
  Coding DNA sequence: Name=SeqID_3989
  Gene classification: Gene name=Aat; Function=Leu/Phe-tRNA-protein transferase; Function class=O Posttranslational modification, protein turnover, chaperones
  Homolog annotation: Query=1..227bp; Hit=1..229bp; Blast score=262; Percent Identity=58.0; E value=2e-70; Homolog= Zaat COG2360
MSIAQLGNSYAFPHPTHALVEPNGLLAFGGDLCAERLRVAYHEGIFPWFSPDELPLWWSPDPRAVLIPGELHTGRTLRRFIRKLPYQITVNYAFDQVIYGCAQRQEGTWIGSDVQQGYQALHQEGLAHSIEVWYDCQLVGGLYGVNVGTLFCGESMFSKMENASKCAFVAFYHHFLHHGGQLLDCQVLNHHTKSLGAKNIPRKEFLQHLYLCREQSLQAGCWAAQMLDL

SEQ ID NO: 10098 - protein, 42 aa, Xenorhabdus bovienii
  Coding DNA sequence: Name=SeqID_3990
MPKNPHYVKECRILNHHFPHNGYRHSRREQHKSLDFDYKSSI

SEQ ID NO: 10099 - protein, 72 aa, Xenorhabdus bovienii
  Coding DNA sequence: Name=SeqID_3991
  Gene classification: Gene name=InfA; Function=Translation initiation factor IF-1; Function class=J Translation, ribosomal structure and biogenesis
  Homolog annotation: Query=1..72bp; Hit=1..72bp; Blast score=132; Percent Identity=98.0; E value=5e-32; Homolog= infA COG0361
MAKEDNIEMQGTVLDTLPNTMFRVELENGHVVTAHISGKMRKNYIRILTGDKVTVELTPYDLSKGRIVFRSR

SEQ ID NO: 10100 - protein, 761 aa, Xenorhabdus bovienii
  Coding DNA sequence: Name=SeqID_3992
  Gene classification: Gene name=ClpA; Function=ATPases with chaperone activity, ATP-binding subunit; Function class=O Posttranslational modification, protein turnover, chaperones
  Homolog annotation: Query=1..750bp; Hit=1..751bp; Blast score=1235; Percent Identity=84.0; E value=0; Homolog= clpA COG0542
MLNQELELSLNIAFAKARDNRHEFMTVEHLLLALLSNTSAREALEACKVDLVMLRQELENFIAQTTPLLSENDDRDTQPTLSFQRVLQRAVFHVQSSGRSEVSGSNVLVAIFSEQESQAAYLLRKHDVSRLDIVNFISHGTRKDESDNESHHSVNPIQEEQVISEDRLENFTTNLNQLAQKGQIDPLVGRQHELERTVQVLCRRRKNNPLFVGESGVGKTAIAEGLAWRIVQKDVPEVMKDCTIYSLDIGSLLAGTKYRGDFEKRFKSLLKTLEQDSKSILFIDEIHTIIGAGAASGGQVDAANLIKPLLSSGRIRVIGSTTYHEFSNIFEKDRALARRFQKIDILEPSSEETVQIINGLRTKYEAHHDVRYTAKAIRAAVELSVKYITDRHLPDKAIDVIDEAGARTRLMPASRRKKTINVADIESVVARIARIPEKTVSASDKDVLRTLDDRLKMLVFGQDKAIGVLTEAIKMSRAGLGQDHKPVGSFLFAGPTGVGKTEVTLQLAKMLNIKLLRFDMSEYMERHTVSRLIGAPPGYVGYDQGGLLTDAIIKHPHSVLLLDEIEKAHPDVFNLLLQVMDNGTLTDNNGRKADFRNVILVMTTNAGVRETQRKSIGFTEQDNSIDGMEEIKRIFTPEFRNRLDGIIWFDALSAEVIQLVVDKFIVELQAQLDEKGVSLEVSADARQWLCDKGYDRAMGARPMTRVIQDNLKKPLANELLFGSLIHGGSVRINLDKDKRALIYDFRSAQKSSKKKSEDAVL

SEQ ID NO: 10101 - protein, 106 aa, Xenorhabdus bovienii
  Coding DNA sequence: Name=SeqID_3993
  Gene classification: Function=Uncharacterized ACR; Function class=S Function unknown
  Homolog annotation: Query=8..105bp; Hit=8..105bp; Blast score=152; Percent Identity=75.0; E value=7e-38; Homolog= yljA COG2127
MSEFYNSLKIEELIEDKTEQTLQPPSMYKVILNNDDYTPMEFVVDVLRKFFSYDVERATQLMLDIHYQGKAICGIYTAEVAETKAAQVNMYAKEHEHPLLCSLEKV

SEQ ID NO: 10102 - protein, 63 aa, Xenorhabdus bovienii
  Coding DNA sequence: Name=SeqID_3994
MKHSAYPLFDLWIKIPPKNRISLSISNFRYLRQLEVISVLDGVMNFTTVYFVSTALAGRLLIS

SEQ ID NO: 10103 - protein, 76 aa, Xenorhabdus bovienii
  Coding DNA sequence: Name=SeqID_3995
  Gene classification: Gene name=CspC; Function=Cold shock proteins; Function class=K Transcription
  Homolog annotation: Query=1..68bp; Hit=1..68bp; Blast score=127; Percent Identity=85.0; E value=3e-30; Homolog= cspD COG1278
METGTVKWFNNAKGFGFICPASGGDDIFAHYSTIQMDGYRTLKAGQKVNFSIHQGPKGNHASLIVPLEDDSKSKKE

SEQ ID NO: 10104 - protein, 50 aa, Xenorhabdus bovienii
  Coding DNA sequence: Name=SeqID_3996
MFLERVEISGFSGVNRLSRVGRHRTTRFRHLCPLWVGSEQALKRIYLRVS

SEQ ID NO: 10105 - protein, 302 aa, Xenorhabdus bovienii
  Coding DNA sequence: Name=SeqID_3997
  Gene classification: Function=Uncharacterized membrane protein; Function class=S Function unknown
  Homolog annotation: Query=1..299bp; Hit=17..314bp; Blast score=283; Percent Identity=59.0; E value=2e-76; Homolog= ybjE COG2431
MYSGLLIVLMPLILGYLIRLNNKTALATVHYLLNIMIYVILFLMGVSLAMLENLGNNLLSILLYAMTFFLCIFATNLLALLLLDKRDPWIIQVNKQEKSPSQLHMAFDSIKLCSALILGFLLGLTDWSLFHFASRASEIALILLLLLVGIQLRNNGMSLKQTLLNRRGTIIALIVAISSLLGGMIAAFLLGLPTKTGLAIASGYGWYSLSGILLSDAYGPVIGSTAFFNDLARELASILLIPMLINRYRSTALGLTGAASIDFTLPILQRCGGISIVPAAIVHGFILSLMTPVFIAFFTQQA

SEQ ID NO: 10106 - protein, 53 aa, Xenorhabdus bovienii
  Coding DNA sequence: Name=SeqID_3998
MIITILCRYYCIVILMRLISLQSINYSYLSHEHSIKKHKLFLWNASGPVRYQF

SEQ ID NO: 10107 - protein, 242 aa, Xenorhabdus bovienii
  Coding DNA sequence: Name=SeqID_3999
  Gene classification: Gene name=GlnQ; Function=ABC-type polar amino acid transport system, ATPase component; Function class=E Amino acid transport and metabolism
  Homolog annotation: Query=1..242bp; Hit=1..242bp; Blast score=365; Percent Identity=73.0; E value=1e-101; Homolog= artP COG1126
MSIQLKNINCFYGTHQALFDINFECTSGETVVLLGPSGAGKSSLLRVLNLLEMPRSGQLSVATHQFDFKQQPGAKEIRTLRQKVGMVFQQYNLWPHLTVMDNLIEAPCRVLGLSRQQAREKAAKLLARLRLDEFSNRFPQHLSGGQQQRVAIARALMMEPQILLFDEPTAALDPEITSQVINIIKELAGTGITQIIVTHEVELARKAATHIVYMEKGRIIEKGDASHFLKPKTEAFAHYLSH

SEQ ID NO: 10108 - protein, 249 aa, Xenorhabdus bovienii
  Coding DNA sequence: Name=SeqID_4000
  Gene classification: Gene name=ArtI; Function=ABC-type amino acid transport system, periplasmic component; Function class=E Amino acid transport and metabolism
  Homolog annotation: Query=3..249bp; Hit=1..243bp; Blast score=340; Percent Identity=68.0; E value=7e-94; Homolog= artI COG0834
MTMKKLLFAALLTAMTLSASATAAEKETLRFATEATYPPFEFIDANNKIQGFDVDLANAICAKINAECTFTNQAFDSLIPSLKFRRFDALMAGIDITPDRRKQVDFTHTYYDNSAVFIAIKGKFTHSADLKSKQVGIQNGTTHQKYLMEQHKEIKTVPYDSYQNAILDLKNGRIDAVFGDTAVANEWLKKNKELGSVGDKVTDKNYFGIGLGIAVRKGNTALLDKLNKALAEVKQDGTYNSIYKKWFEQ

SEQ ID NO: 10109 - protein, 258 aa, Xenorhabdus bovienii
  Coding DNA sequence: Name=SeqID_4001
  Gene classification: Gene name=ArtM; Function=ABC-type amino acid transport system, permease component; Function class=E Amino acid transport and metabolism
  Homolog annotation: Query=19..256bp; Hit=1..238bp; Blast score=334; Percent Identity=77.0; E value=4e-92; Homolog= ZartQ COG0765
MVLITPSIKNGLNNNRILMNELQSLINAAGITVGLAVSSLVIGLILAMLFAAWESARWKPFAFLGSCWVTLIRGLPEILVVLFIYFGSSQLLITLSEGFDVNLIVWQFRIQMEIDNFDVSPFLCGVIALSLLYSAYASQTLRGALKAVPMGQREAGQALGLSQSRIFFRLTVPQMWRHALPGLGNQWLVLLKDTALVSLISVNDLMLQTKSIATRTQEPFTWYVIAAMIYLVITLVSQFILKRLEMRATHFERSASDV

SEQ ID NO: 10110 - protein, 222 aa, Xenorhabdus bovienii
  Coding DNA sequence: Name=SeqID_4002
  Gene classification: Gene name=ArtM; Function=ABC-type amino acid transport system, permease component; Function class=E Amino acid transport and metabolism
  Homolog annotation: Query=1..221bp; Hit=1..221bp; Blast score=282; Percent Identity=71.0; E value=2e-76; Homolog= artM COG0765
MFEYIKDILPGLQTSLSLTVTALLAAFILSVVLTFILTMKLPILSQLVKGYITLFTGTPLLVQFFLIYYGPGQFPSIKEYPWLWQLMSEPWLCAMVTLALNSAAYSTQLFYGAVRAIPAGQWQSCQALGMSKTHSMRILLPYAFKRALSSYSNEVVLIFKSTSLASTITLLDIMGYSQLQFGRSYDVTVFVAAGIIYLCVNALLTLLMRMIERRALSFEQRY

SEQ ID NO: 10111 - protein, 377 aa, Xenorhabdus bovienii
  Coding DNA sequence: Name=SeqID_4003
  Gene classification: Gene name=TrmA; Function=SAM-dependent methyltransferases related to tRNA (uracil-5-)-methyltransferase; Function class=J Translation, ribosomal structure and biogenesis
  Homolog annotation: Query=1..373bp; Hit=1..373bp; Blast score=525; Percent Identity=68.0; E value=1e-149; Homolog= ZybjF COG2265
MQCAQYTAGHCHSCQWLNKSYSQQLSDKQQHLQQLLRETSATYWLPPVSSLISGFRNKAKMVVSGSVERPQLGMLHRDGRTVDLCDCPLYPQYFQPVFEAIKIFIAKSGLVPYNVARKKGELKYILLTESRASGEMMLRFVLRSEIKLAQLEHALPWLQEQLPQLAVISANIQPTHMAILEGEKEIIFTEHKMLKETFNGIPLYIRPRSFFQTNPEIASALYATAGRWVRELNSSSMWDLFCGAGGFGLHCADKETRLTGIEISAEAIACAKNSAKSLGLEQVEFQALDSTHFALDKAQLPELVLVNPPRRGIGKALCEYLSRMAPKFILYSSCNAETMAKDIAALEQYRIEKVQLFDMFPHTEHYETLVLLIFDGK

SEQ ID NO: 10112 - protein, 196 aa, Xenorhabdus bovienii
  Coding DNA sequence: Name=SeqID_4004
  Homolog annotation: Query=26..196bp; Hit=1..170bp; Blast score=222; Percent Identity=73.0; E value=3e-57; Homolog= ref|NP_928874.1|
LIVLLLARCFLQVACTTFWSYEVDSMDSMVVPNLATLRNWLERLKISYFENDSNSVLHLPHMQNIDGLFDAKIDLLGDVVLFSALAEVRPTAIIPLVANLSQINASSLTAKAFLDIQDENLPKLIVCQAFPIAAGMTFPQFSHFLQQSEEQIANVIFEIHSNNFLYINNDMESEMEVEVEDEESLASTETSTFTLH

SEQ ID NO: 10113 - protein, 103 aa, Xenorhabdus bovienii
  Coding DNA sequence: Name=SeqID_4005
  Homolog annotation: Query=9..101bp; Hit=8..100bp; Blast score=112; Percent Identity=66.0; E value=1e-24; Homolog= ref|NP_928873.1|
MKKISTKEMRSLSDMPKLVILLEILGIGLLVLAYLSITDSIILSPLLMTTEAHIAMILLGIGCLIPAAIHIIWHAVYNLSFLGIDHKKVDKNHQTGSDDEKTK

SEQ ID NO: 10114 - protein, 87 aa, Xenorhabdus bovienii
  Coding DNA sequence: Name=SeqID_4006
  Gene classification: Gene name=GrxC; Function=Glutaredoxin and related proteins; Function class=O Posttranslational modification, protein turnover, chaperones
  Homolog annotation: Query=1..86bp; Hit=6..91bp; Blast score=140; Percent Identity=79.0; E value=2e-34; Homolog= VC1146 COG0695
MYTVIFGRPSCPYCVRAKELAEKLKAERDDFDYRYIDIWAEGITKDDLSKTVGKPVETVPQIFLDEKHIGGFTDFEAYAKEHLNLYK

SEQ ID NO: 10115 - protein, 38 aa, Xenorhabdus bovienii
  Coding DNA sequence: Name=SeqID_4007
MWILVNIMNLPLSRRKHRHFWLDSEFYGYLYRFRCSLA

SEQ ID NO: 10116 - protein, 52 aa, Xenorhabdus bovienii
  Coding DNA sequence: Name=SeqID_4008
MLTKIHISTELKKICNFFLNNENFHHITQSELMPLLFFDVPILRSPIVTHFG

SEQ ID NO: 10117 - protein, 65 aa, Xenorhabdus bovienii
  Coding DNA sequence: Name=SeqID_4009
MAFPSPQSQQAANVMGKINTRYFAIKIASKIIAGDESGVALIKVNTLWLSCSSKVSLTSVILTQI

SEQ ID NO: 10118 - protein, 180 aa, Xenorhabdus bovienii
  Coding DNA sequence: Name=SeqID_4010
  Gene classification: Gene name=PgpB; Function=Membrane-associated phospholipid phosphatase; Function class=I Lipid metabolism
  Homolog annotation: Query=1..180bp; Hit=23..198bp; Blast score=162; Percent Identity=50.0; E value=2e-40; Homolog= ZybjG COG0671
MILLAIFIAKYLVFIFPITLAACWLWGEGKAISHQRIVVSKSCIAFAFAIAGSDIIGTFVPHARPFVEGFGYNFLYHSPTASFPSNHGTAVFTFALAFIFWHRIRSGLCLMIIACMIAWARIYVGVHWPIDMIGAFLVSLMGCAFSQIFWRLYGEYWHSKLIRLYQFCCAFFIRKGWIKN

SEQ ID NO: 10119 - protein, 435 aa, Xenorhabdus bovienii
  Coding DNA sequence: Name=SeqID_4011
  Gene classification: Gene name=SdaC; Function=Amino acid permeases; Function class=E Amino acid transport and metabolism
  Homolog annotation: Query=1..434bp; Hit=1..427bp; Blast score=551; Percent Identity=74.0; E value=1e-157; Homolog= sdaC COG0814
MDTSQSGSIAASAASGKSDYTTWRKSDTVWMLGLYGTAIGAGVLFLPINAGIGGLIPLIIMTLLALPMTFFAHRGMCRFVLSGKKHGEDITGVVEEHFGKVAGFLITILYFFAIYPILLVYSVALTNTVDSFITHQLHMTAPPRALLALVLILGVMSIIRFGEQFIVKAMSVLVFPFVAVLMLLALYLIPHWNTTIFDTLSLENVLTSTNGHGLLFTLWLAIPVMVFSFNHSPIISAFAVAKREEYGENAEKKCSRILGYAHIMMVITVMFFVFSCVLSLSPANLAEAKAQNITILSYLANHFSAPTIEYIAPLIAFIAITKSFLGHYLGAREGFNGIVNKALSTQGKTIQRKSLNRITSLFMLVSAWIVATLNPSILDIIQSLGGPIIAMILFIMPMYAIHKVPAMRKYAGKPSNVFVVVTGLIAISAAVYSVM

SEQ ID NO: 10120 - protein, 30 aa, Xenorhabdus bovienii
  Coding DNA sequence: Name=SeqID_4012
MYELRINRKMPVNREVGRHFYGAAVVEISA

SEQ ID NO: 10121 - protein, 402 aa, Xenorhabdus bovienii
  Coding DNA sequence: Name=SeqID_4013
  Gene classification: Gene name=DacC; Function=D-alanyl-D-alanine carboxypeptidase; Function class=M Cell envelope biogenesis, outer membrane
  Homolog annotation: Query=10..401bp; Hit=7..399bp; Blast score=536; Percent Identity=65.0; E value=1e-152; Homolog= dacC COG1686
MMKKRRQVQIIKSFTVGLGVFWLMGVNAYAMDEPSAPEIDAKSYILMDYASGKILASHNPDERLDPASLTKVMTSYVVGQSIKSGKISTEDQVTVGKDAWATGNPALKGSSLMFLKPGDRVKVIDLNRGIVIQSGNDASIALADYVAGSQDAFVDLMNKYSKTLGLENTHFKTVHGLDAAGQYSTARDMALLSQAMIRDVPEEYALNKEKEFTFNNIRQPNRNRLLWNQNMNVDGVKTGHTNGAGYNLVASAAEGPMRLISVVLGAPSDRMRFSDSEKILSWGFRFYEASTPLKASDTLVTERVWFGTRSEVALGVEKDTAVTVPRGQANNLKASFTLNQTSLEAPLAKNQVVGTVNFSLNDKVIDQRPLVVKEAVEESGFFGRIWDLIVKTVSGWFNSIFG

SEQ ID NO: 10122 - protein, 62 aa, Xenorhabdus bovienii
  Coding DNA sequence: Name=SeqID_4014
LTPINQKTPKPTVKDLIICTCRLFFIIARPFCLQPEYKSSINIGCYETRLQPNNVKIFLLPE

SEQ ID NO: 10123 - protein, 207 aa, Xenorhabdus bovienii
  Coding DNA sequence: Name=SeqID_4015
  Gene classification: Gene name=Gst; Function=Glutathione-S -transferases; Function class=O Posttranslational modification, protein turnover, chaperones
  Homolog annotation: Query=2..207bp; Hit=1..206bp; Blast score=216; Percent Identity=48.0; E value=2e-56; Homolog= PA2813 COG0625
MMLTIWGRKSSSNVKKVIWCLEELNVPYQQIDVGGQFGKLNTPEYLLMNPNAVIPCLQEDDFILWESNAIVRYISAKFGENSLYPADLQERARIDQWMDWVGYNLFPPIKQLMINIVRTPEDQRDPKVVAQILKEIEKLLKIVDNVLGKQKYLSGDKFGMADIALAPLVYPWLKVGIERPSLPNLERWYQLLTERPAFQKIVMIEIS

SEQ ID NO: 10124 - protein, 277 aa, Xenorhabdus bovienii
  Coding DNA sequence: Name=SeqID_4016
  Gene classification: Gene name=WcaG; Function=Nucleoside-diphosphate -sugar epimerases; Function class=M Cell envelope biogenesis, outer membrane
  Homolog annotation: Query=2..276bp; Hit=1..273bp; Blast score=307; Percent Identity=58.0; E value=1e-83; Homolog= yeeZ COG0451
MVKKVSIIGLGWLGMPLAQILQGYGMQVVGSKTTADGVEAARMCGVDCHLLNLTPQIICETDDLERLMSVDVLVLTLPVSGIAGGGEGYVKAVQLVVDTALSHSVPHIIFTSSTSVYGSSVGHLNEDAPLFPETRSAKALVELENWLHRLPNTSVDIVRLAGLVGSGRHAGRFLAGRKAIEGGEKVVNLVHQDDVISAIKRLIEQQKGGHIYNLCAPEHPKRKEFYSQASSQLDLAPPEFSQSKAQGAASKVVDGSRICRELGFEYQFPDPGRMPMS

SEQ ID NO: 10125 - protein, 32 aa, Xenorhabdus bovienii
  Coding DNA sequence: Name=SeqID_4017
MKSNFFFKGAVCIVLIVCFINKTGVVVKAICR

SEQ ID NO: 10126 - protein, 48 aa, Xenorhabdus bovienii
  Coding DNA sequence: Name=SeqID_4018
VSSLSTFFNICLRTRIGCLPFNLYDFVYEKQLFFQRSCLYCSNCLFYK

SEQ ID NO: 10127 - protein, 95 aa, Xenorhabdus bovienii
  Coding DNA sequence: Name=SeqID_4019
MGIFSANAIRRCCCKLILMPQRASNARESSLRRPDFCMAIRKRVLSSMLCFTLSQYSIYKSRKLAIKNPRKIFRGFFIVLMPPEDLLNVFQHTTA

SEQ ID NO: 10128 - protein, 299 aa, Xenorhabdus bovienii
  Coding DNA sequence: Name=SeqID_4020
  Gene classification: Gene name=HisG; Function=ATP phosphoribosyltransferase (histidine biosynthesis); Function class=E Amino acid transport and metabolism
  Homolog annotation: Query=1..299bp; Hit=1..299bp; Blast score=496; Percent Identity=87.0; E value=1e-140; Homolog= hisG COG0040
MLDKTRLRIAMQKSGRLSDDSRALLARCGIKINLQQQRLIAFAENMPIDILRVRDDDIPGLVMDGVVDLGIIGENVLEEELLNRRAQGEDPRYNTLRRLDFGDCRLSLAAPFDYDYTGVECLQNSRIATSYPYLLKRYLDKKGIRFKSCLLNGSVEVAPRAGLADAICDLVSTGATLEANGLREVEVIYRSKACLIQRDGEMPEAKQQLIDKLMIRIQGVIQARESKYIMLHAPNDKLEEIISLLPGAERPTILPLAGAQNRVAMHMVSSETLFWETMEKLKSLGSSSILVLPIEKMME

SEQ ID NO: 10129 - protein, 438 aa, Xenorhabdus bovienii
  Coding DNA sequence: Name=SeqID_4021
  Gene classification: Gene name=HisD; Function=Histidinol dehydrogenase; Function class=E Amino acid transport and metabolism
  Homolog annotation: Query=5..432bp; Hit=3..430bp; Blast score=589; Percent Identity=72.0; E value=1e-168; Homolog= hisD COG0141
MSTHFKTIIRWQECPPEQQKVLLTRPAVAASEDISRTVKQILETVKANGDEALREFSQRFDKTTIDTIPISISEVNAAASRLAPEIKQAMQQAMNNIRLFHEAQKPAVIEVETLPGVHCQQVTRPIDSVGLYIPGGSAPLLSTVLMLGTPASIAKCRKVILCSPPPIADEILYAAQLCGINEIFQVGGAQAIAAMAFGTESVPKVDKIFGPGNAWVTEAKRQVSQRFDGAAIDMPAGPSEVLVIADSGANPAFTAADLLSQAEHGPDSQVVLVTPDETFAEQVIREIETQLAALPRQQIAVQALQSSRIIVTDDLTQCVAISNQYGPEHLIIQTRQPEQLVEQITNAGSIFLGDWSPESAGDYASGTNHVLPTYGYTSTYSSLSLADFLKRMTVQQITPQGLRNLAPTIETLAQAEQLTAHKNAVTLRIAALNNSDVE

SEQ ID NO: 10130 - protein, 368 aa, Xenorhabdus bovienii
  Coding DNA sequence: Name=SeqID_4022
  Gene classification: Gene name=HisC; Function=Histidinol-phosphate aminotransferase/Tyrosine aminotransferase; Function class=E Amino acid transport and metabolism
  Homolog annotation: Query=1..354bp; Hit=1..353bp; Blast score=476; Percent Identity=64.0; E value=1e-134; Homolog= hisC COG0079
MSTVFDVNSLARENVRQLVPYMSARRLGGNGNIWLNANEYPIAPDFQFSEKTLNRYPECQPVSVIQRYADYAGLQPDQVLVSRGADESIELLIRVFCEPGKDAVLFCPPTYGMYSVSAEAFGVEQKKISTRADWQPDIAAIENNLDRVKLIYICSPNNPTGNLIAPAALRQILELARNRAIVAIDEAYIEFCPQHTTTGWLQDYPHLVILRTLSKAFALAGLRCGFTLASPDIIALMLKVIAPYPLATPVADIAAQALTEAGINIMKDRVEEVAENRTYLRQALNELAMVEKVFPSETNYILVKFTDAEIVFRTLWEQGIILRDQRKQAGLDNCLRITIGSRNECEQLVNAIAALRSQTQPLKETENP

SEQ ID NO: 10131 - protein, 355 aa, Xenorhabdus bovienii
  Coding DNA sequence: Name=SeqID_4023
  Gene classification: Gene name=HisB; Function=Imidazoleglycerol -phosphate dehydratase; Function class=E Amino acid transport and metabolism
  Homolog annotation: Query=151..355bp; Hit=3..207bp; Blast score=357; Percent Identity=84.0; E value=7e-99; Homolog= hisB_2 COG0131
MSQKLLFIDRDGTLITEPPTDYQVDRLDKLAFEAGVIPALLSLQKAGYKLVMITNQDGLGTDSFPQADFEPPHALMMQVFTSQGIQFEEVLICPHKPEDNCNCRKPKLGLVEKYLTEGMVDTKNSCVIGDRETDLQLAENMGIKGIRYQAQSLGWSAICEQLTRKDRHASVERKTRETGINIDIWLDREGRSEINTGVGFFDHMLDQIATHGGFRMNVQVKGDLCIDDHHTVEDTGLALGEALKQALGDKRGIARFGFTLPMDECLARCALDISGRPHLEYKAEFKHQRVGDLSTEMIEHFFRSLSYTMGCTLHLKTKGKNDHHRAESLFKVFGRTLRQAIRVEGDVLPSSKGVL

SEQ ID NO: 10132 - protein, 202 aa, Xenorhabdus bovienii
  Coding DNA sequence: Name=SeqID_4024
  Gene classification: Gene name=HisH; Function=Glutamine amidotransferase; Function class=E Amino acid transport and metabolism
  Homolog annotation: Query=2..202bp; Hit=1..196bp; Blast score=268; Percent Identity=67.0; E value=3e-72; Homolog= hisH COG0118
MMKVVILDTGCANLASVTYAIRRLGYDPVVSLDADIVRSADKLFLPGVGTAMAAMDQLQQRQLIPLISSLTQPVLGICLGMQLLAATSEESNSEKDDNVSLLALIDAPVKKMATAGLPLPHMGWNQVKAQTGHPLFCHIEDNARFYFVHSYALPVGEYTIAQTEYGNSFSSAIAKDNFFGVQFHPERSGTAGAQLLKNFLEM

SEQ ID NO: 10133 - protein, 245 aa, Xenorhabdus bovienii
  Coding DNA sequence: Name=SeqID_4025
  Gene classification: Gene name=HisA; Function=Phosphoribosylformimino- 5-aminoimidazole carboxamide ribonucleotide (ProFAR) isomerase; Function class=E Amino acid transport and metabolism
  Homolog annotation: Query=1..245bp; Hit=2..246bp; Blast score=350; Percent Identity=67.0; E value=8e-97; Homolog= ZhisA COG0106
MIIAALDLIDGNVVRLHQGDYDQQRTYGNSPLSHLQQYEKEGAKLLHLVDLTGAKDPTRRQMILLRELLDDVSVPVQVGGGIRSENDIKSLLEAGASRVVIGSTAITQPELVKQWFQRYGAESIVLALDIRISTDGAKQIAISGWQENSNTTLEQVIEQYLPVGLKHVLCTDISRDGTLNGSNIALYQEISQHYPQIQFQASGGIGNLADISLLPTTGVAGVIVGRALLEGKFTLTEAIQCWQNA

SEQ ID NO: 10134 - protein, 258 aa, Xenorhabdus bovienii
  Coding DNA sequence: Name=SeqID_4026
  Gene classification: Gene name=HisF; Function=Imidazoleglycerol -phosphate synthase; Function class=E Amino acid transport and metabolism
  Homolog annotation: Query=1..258bp; Hit=1..258bp; Blast score=447; Percent Identity=82.0; E value=1e-126; Homolog= hisF COG0107
MLAKRIIPCLDVRDGQVVKGVQFRNHEIIGDIVPLAQRYAQEGADELVFYDITASSDGRVVDKSWVAKVAEVIDIPFCVAGGIKTTKEAGQILSFGADKISINSPALADPSLISRLADRYGVQCVVIGIDTWFDENSNSYSVYQFTGDEKRTTATQWQTLDWVKEVQQRGAGEIVLNMMNQDGVRNGYDLTQLKLVRDICSVPLVASGGAGTPEHFLDAFKLANVDGALAASVFHKQIINIGELKQYLATQGVEVRTC

SEQ ID NO: 10135 - protein, 206 aa, Xenorhabdus bovienii
  Coding DNA sequence: Name=SeqID_4027
  Gene classification: Gene name=HisI; Function=Phosphoribosyl-AMP cyclohydrolase; Function class=E Amino acid transport and metabolism
  Homolog annotation: Query=1..112bp; Hit=1..112bp; Blast score=183; Percent Identity=74.0; E value=1e-46; Homolog= ZhisI_1 COG0139
MLTAQQIEKLDWKKVDDLMPVIVQHAVSGTVLMMGYMNQEALNATQESGKITFFSRTKQRLWTKGESSGHFLNLVDIYPDCDNDTLLALVNPIGPTCHTGTESCFAPAQTEWGFLYQLEQLLASRKNAPPASSYTARLYASGTKRIAQKVGEEGIETALAATVNDREELTSEAADLIYHLLVLLQDQDLDLSCIIRQLQERHVAKE

SEQ ID NO: 10136 - protein, 104 aa, Xenorhabdus bovienii
  Coding DNA sequence: Name=SeqID_4028
MLVVLPTRFRHHTKRLWLFLKRQCNSINLAISMARFKKKRGGTRYAELTITAPHFDSTYFMNRLRRRNDCNLLKPQFLLSKLFFSYMPFLQLADDTTEIQILIL

SEQ ID NO: 10137 - protein, 383 aa, Xenorhabdus bovienii
  Coding DNA sequence: Name=SeqID_4029
  Gene classification: Gene name=EutG; Function=Alcohol dehydrogenase IV; Function class=C Energy production and conversion
  Homolog annotation: Query=1..383bp; Hit=1..383bp; Blast score=534; Percent Identity=73.0; E value=1e-152; Homolog= ZyiaY COG1454
MAVSTFFIPPVNKIGMGCMTEAVELMKNYGYRQALIVTDRVLNEIGVVGEVQSLLAEAGIKSAIYAGTNPNPTTINVEEGLIILRQHDCDCVISLGGGSPHDCAKGIALVAANGGDIRDYEGVDRSAKPQLPLIAINTTAGTASEMTRFCIITDVDRHIKMAIVDKNVTPILSINDSALMAGMPKGLTAATGMDALTHAIEAYVSTAANPITDACALKAVTMISDYLRRAVANGNDMEARENMAYAQFLAGMAFNNASLGYVHAMAHQLGGFYDLPHGVCNAVLLPHVQKFNAKVSASRLKEIAAAMGADIANLNDRQGAEVCIQEISKLAKDVNIPAGLSELSVKVEDLPTLATNALKDACGFTNPIQASHEEIVAIFKAAM

SEQ ID NO: 10138 - protein, 40 aa, Xenorhabdus bovienii
  Coding DNA sequence: Name=SeqID_4030
MHPIPILFTGGIKKVDTAIRNSLGFTEVFQISMQKKWVTM

SEQ ID NO: 10139 - protein, 52 aa, Xenorhabdus bovienii
  Coding DNA sequence: Name=SeqID_4031
MSISSYGDYYMNNIPTLIIVVFLIISFVLIVGLDSEVAHFIEKFAERLIQKN

SEQ ID NO: 10140 - protein, 475 aa, Xenorhabdus bovienii
  Coding DNA sequence: Name=SeqID_4032
  Gene classification: Gene name=Gnd; Function=6-phosphogluconate dehydrogenase, family 1; Function class=G Carbohydrate transport and metabolism
  Homolog annotation: Query=8..475bp; Hit=1..468bp; Blast score=819; Percent Identity=86.0; E value=0; Homolog= gnd COG0362
MIRREFFMSKQQIGVVGMAVMGRNLALNIESRGYSVSIFNRSSDKTDEVIAENPGKKLVPSYSIEEFVNSLEKPRRILLMVKAGEATDKTIASLTPHLDKGDILIDGGNTYFQDTIRRNRELSAQGFNFIGTGVSGGEEGALKGPSIMPGGQKEAYELVAPILKEIAAKVDGEPCVTYIGADGAGHYVKMVHNGIEYGDMQLIAEAYSLLKHSLNLSNQELADVFSDWNQGELSSYLIEITADIFRKKDEEGKYLVDVILDEAANKGTGKWTSQSSLDLGVPVTLITESVFARYISSLKDQRVAASKVLSGPEAQPFNGDKAEFIEKVRRALYLGKIVSYAQGFQQLKASSDEYNWDLNYGEIAKIFRAGCIIRAQFLQKITDAYNENSAIANLLLAPYFKQVADEYQQALRDVVSYGVQNGIPTPTFSAAISYYDSYRSAVLPANLIQAQRDYFGAHTYKRTDKEGIFHTEWLD

SEQ ID NO: 10141 - protein, 59 aa, Xenorhabdus bovienii
  Coding DNA sequence: Name=SeqID_4033
LFGHEKLPSDHDCCPPRCLTQHYVNQTMSITNVIYNKITVGNLLMRLHVNSGIGFRGSY

SEQ ID NO: 10142 - protein, 42 aa, Xenorhabdus bovienii
  Coding DNA sequence: Name=SeqID_4034
MQPISSYCFFAEKISNWDKSPIDISDTNPHYSVIGRSRHIKR

SEQ ID NO: 10143 - protein, 526 aa, Xenorhabdus bovienii
  Coding DNA sequence: Name=SeqID_4035
  Gene classification: Function=Hemolysins and related proteins containing CBS domains; Function class=N Cell motility and secretion
  Homolog annotation: Query=233..525bp; Hit=2..293bp; Blast score=351; Percent Identity=59.0; E value=1e-96; Homolog= yegH_2 COG1253
MEWIADPTIWAGLATLIVLEIVLGIDNLIFIAILADKLPEKQRDKARLTGLTCALVMRLLLLFSLSWLISLTTPLLTLWDHPFSARDLIMLIGGIFLLFKATMELNERLEGKMLHNNQQRKGANFWAVVVQIIVLDAVFSLDSVITAVGMVSHIGTMMAAVIIAMILMIWASKPLTKFVNAHPTIVILCLSFLLMIGFSLVAEGFGYVIPKGYLYAAIGFSIMIEALNQFSQFNRRRFLSASRSLRERTAEAVLHILNGKRENADLDNHASNLIADHEDHKAVFEPQERHMIARVLSMAQRTVSSIMTSRHDVVYLDIHAPTGKLTTLLEKQPHTRIVVTDEQASDEPLGVVHVIDILNQQLTHKSFDLRKLVQQPLIFPESLSLLQALEQFRQAQTHFAFVVDEFGSVEGVVTVTDVMETITGNLPAGGGEIDARHDIQVTEEGYWIANGFMPLDDLVLYVPLPLDEKREYQTLAGLLMEDLQRVPQQGEQLQIGEYLFEPLEVISHRINKVKITSLKTEEKIEA

SEQ ID NO: 10144 - protein, 69 aa, Xenorhabdus bovienii
  Coding DNA sequence: Name=SeqID_4036
VREFPVVENGQCQNYLPRHTSPCDTRLSYGAGLISLRHKLGECVFVETSCRQCQMRHSIAPAKLSRQII

SEQ ID NO: 10145 - protein, 46 aa, Xenorhabdus bovienii
  Coding DNA sequence: Name=SeqID_4037
MQNISYSYETLILSTINRRIANPATGNFAEKILGQYEGGGDFSAHE

SEQ ID NO: 10146 - protein, 1803 aa, Xenorhabdus bovienii
  Coding DNA sequence: Name=SeqID_4038
  Homolog annotation: Query=4..195bp; Hit=2..198bp; Blast score=210; Percent Identity=58.0; E value=2e-52; Homolog= ref|NP_927397.1|
MSTKYFALLTHAGTSKLENATTSGTKLEITHMAVGDGGGSLPIPNVNQSKLINEKHRAEIDVLTIDPKKPNHIIAEQVLPEGQGGWWIREIGLFDKDGTLVAVGNCADLYKPQLQEQTVSMALPVSNSDWPGWVNELFSGLATRNYVREKIKDHAESRNHPDATLKEKGLVTLSNAVDSDNETHAATSKAVRTTYALATKAYDLANVTKPTDKWVPLTRKVNGKELSSDININAVDVGTYNKAEIDIQVNKAVETAGSKVPLTRKVNGKELSSDININAVDVGTYNKAEIDTQVNKAVETADSKVPLTRKVNGKELKEDIVLSAADLDTYKKDEIDHKVGKVEALAETANKNATSAIQSADSKVPLIRKVNGKELLTDIELTALDVNAYNRPETDELIGIVKKQADTANQNATAALQSADSKVPLTRKVNNKELLTDIDLNAADVGTYNKSEIDAHINKVEQLADTVNKNATSAIQNADNKVPLTRKVNGKELLTDIELNATDIGTYNKVEINEHISKVEKLAETANQNATTAIQSADSKVPLTRKVNDKELSVDIQLDAADVGAYNKVETDTHINIVKTQVDNVNKLAETANQNATTAIQNADSKVPLTRKVNGKELSADIQLSAADVGAYTKVETDDRISDVKTQVDNVNKLAETANQNATTAIQSADNKVPLTRKVNDKELSADIQLDAADVGAYNKVETDTHINIVKTQVDNVNKLAETANQNATTAIQSADNKVPLTRKVNDKELSADIQLDAADVGAYNKVETDTHINIVKTQVDNVNKLAETANQNATTAIQNADSKVPSTRKVNGKELSADIQLSAADVGAYSQKETDDHINIVKTQVDNVNKLAETANQNATTAIQSADSKVPLTRKVNDKELSADIQLNAADVGAYTKEDTDAHIKDVKVLAETANQNATTAIQNADSKVPSTRKVNGKELSADIQLSAADVGAYSQKETDDHINIVKTQVGNVNKLAETANLNATTAIQSADSKVPSTRKVNGKELSADIQLSAADVGAYSQKETDDRISDVKTQVDNVNKLAETANLNATTAIQNADSKVPLTRKVNDKELSADIKLNAADIGAYTKVETDDHINNVKVLAETANQNATTAIQSADSKVPLTRKVNDKELSADIKLSAADVNAYSQKETDDRISDVKTQVGNVNKLAETANQNATTAIQNADNKVPLTRKVNDKELSADIKLDAADVGAYNKVETDTHINIVKTQVDNVNKLAETANQNATTAIQSADSKVPSTRKVNGKELSADIQLSAADVGAYSQKETDDHINIVKTQVDNVNKLAETANQNATTAIQSADSKVPLTRKVNDKELSVDIKLVAADVGAYTKEETDTHINNVKVLAETANQNATTAIQSADNKVPLTRKVNGKELLTDIELSAADIGTYNKTEIDERINKVDKLADTANQNAISAIQNADSKVPVTRKVNGKELLTDIQLTADDVGAYNKKETDDRINIVDKLADTANKNAISAIQNVDSKVPLTRKVNGKELSTDIELTAIDIDVYNKADVNILFEDVKELANNANNNADNKVPLTRTVNGKSLLTDIKLQASDLNVYSKGEVDSRIEDVKELANSANNNADSRVPLTRTVNGKALLSDIKLIASDVGAYTKAETDLRISKVEDLAKSANNNASGRLEKGQNGADIPDKKAFVKNLGLSDLIGLGIESRRVGTDVTIIKLGDIIKINGLAIASEPIGEVNSFVIGGITYYTHYYKIQLPTSLPNGIISCHASIVGNNFDNQQPGYLADVKTQRNNPNGVGVSKDTLTISVTTPQVGWVPHFDYQVIGY

SEQ ID NO: 10147 - protein, 37 aa, Xenorhabdus bovienii
  Coding DNA sequence: Name=SeqID_4039
MRLWCWFICREMQRKMCLAGRLGLNYRILKVIAEAIT

SEQ ID NO: 10148 - protein, 619 aa, Xenorhabdus bovienii
  Coding DNA sequence: Name=SeqID_4040
  Gene classification: Gene name=AsmA; Function=Uncharacterized protein involved in outer membrane biogenesis; Function class=M Cell envelope biogenesis, outer membrane
  Homolog annotation: Query=1..619bp; Hit=1..616bp; Blast score=469; Percent Identity=39.0; E value=1e-132; Homolog= ZasmA COG2982
MKRLLTTLVILLVVIVAGLAALVVLINPNDFRGYIVEQVQKKSGYHLVLQDDLRWHIWPKLSILTGQISLTAPDAEIPAVVAENMRLDVELLPLLSHQFVVKKVMLKGAVLRFMPDSQPQKQAEAPIAPKSDIQYPVAGGQGWKLDIARIKVADSLLVWQTDTDSQLNIRDINFLMERRDQDHVNLEFSSKINKNQQELAFEFNTSVDISDYPQRLAADVSSLKYQLKGVGLPSEGIKGTGSVSLAYQSSPSFISLQKLALTVNESELNGNIAVNLQNKPQYTINLSSPKLNLDNLLGWDALPQNDLQARHDYRIENSLLKPVIATSVSPLSNYDLSLLKAFEANLSFVADKFIYQGMDIDNFALKAVNNDGMAEILKLSGDVFGGHFALPTTIDATVNPAKLHTKPLLQNIELKPLLTALALPPVFSGQLELDGDLLGEGYDEYAITHYWQGDLNIGLENARLEGLNIPQLIQQSFSRATDQVNQPENTDDFTEAKNMSVRAQLNQGELKVDNLSAISGMLNITGQGKANLLKQNTDMSLWVQLTGGWGKQNEFVRKLQKLKVPLRVYGNWDNLQYKLNVEALLSDELQEKAKQSIRNWIEQNSRAEDRKEFENLLNK

SEQ ID NO: 10149 - protein, 193 aa, Xenorhabdus bovienii
  Coding DNA sequence: Name=SeqID_4041
  Gene classification: Gene name=Dcd; Function=Deoxycytidine deaminase; Function class=F Nucleotide transport and metabolism
  Homolog annotation: Query=1..193bp; Hit=1..193bp; Blast score=336; Percent Identity=86.0; E value=9e-93; Homolog= dcd COG0717
MRLCDRDIIKWLDEGKLVITPRPPIERINGATADVRLGNQFRVFRGHTAAYIDLSGPKAEVNAALDRVMSDEIVLPEGEVFFLHPGELALAVTLESVTLPDNLVGWLDGRSSLARLGLMVHVTAHRIDPGWHGQIVLEFYNSGKLPLALRPGMVIGALSFEPLSGSADRPYNRRQDAKYKNQQGAVGSRISED

SEQ ID NO: 10150 - protein, 213 aa, Xenorhabdus bovienii
  Coding DNA sequence: Name=SeqID_4042
  Gene classification: Gene name=Udk; Function=Uridine kinase; Function class=F Nucleotide transport and metabolism
  Homolog annotation: Query=1..213bp; Hit=19..231bp; Blast score=344; Percent Identity=78.0; E value=5e-95; Homolog= udk COG0572
MADEAHKCTIVGIAGASASGKSLIASTLYRELRAQVGDHNIGVIPEDCYYKDQKNTPLEERYKVNYDHPSSMDHSLLFEHIQALKAGKSIELPQYDYVAHTRKTESIHFEPKRVIILEGILLLTDKRLRQEMDFSIFVDTPLDICLMRRIKRDVNERGRTLDSVIEQYKKTVRPMFLQFIEPSKQYADIIVPRGGKNRVAIDILKAKIGQFYE

SEQ ID NO: 10151 - protein, 74 aa, Xenorhabdus bovienii
  Coding DNA sequence: Name=SeqID_4043
VTLPPISLLRCTGRERKFLRKFLSAQFELGNFVSICDGTLLISNSYCNPSLRIRYKYLHPYFSVILLVLSLSGL

SEQ ID NO: 10152 - protein, 370 aa, Xenorhabdus bovienii
  Coding DNA sequence: Name=SeqID_4044
  Gene classification: Gene name=Mrp; Function=ATPases involved in chromosome partitioning; Function class=D Cell division and chromosome partitioning
  Homolog annotation: Query=1..370bp; Hit=11..379bp; Blast score=560; Percent Identity=74.0; E value=1e-159; Homolog= mrp COG0489
MNSQSPEQTSPDLLKEHVVKILATFKHPTLERDLIALKALHHCAMLDGVLHIELMMPFVWKRAFAKLKEETTQSLQTATGAKSVDWRLTHDICTLRRANNLQGVNGVRNILAVSSGKGGVGKSSTAVNLALALAQEGAKVGILDADIYGPSVPNMLGTAQERPTSPDGQHMAPIMVHGMATNSIGYLVTDDNAMIWRGPMASKALMQMLQDTLWPDLDYLVIDMPPGTGDIQLTLSQNIPVTGALVITTPQDIALLDAIKGIAMFQKVNVPVLGIIENMSIHICSNCGHQEPIFGTGGAEKLAEKYHCQLLGQIPLHISLREDLDRGEPTVISQPGSELADIYRDIAANISAQMYWQGEKIPTEISFRAV

SEQ ID NO: 10153 - protein, 73 aa, Xenorhabdus bovienii
  Coding DNA sequence: Name=SeqID_4045
LNVASIFTTCSFSRSGLVCSGDCEFIPAPFDLSFFNRKPFVHHSRSGRFGIRPKLKSTPNSALNKSNEDLALP

SEQ ID NO: 10154 - protein, 43 aa, Xenorhabdus bovienii
  Coding DNA sequence: Name=SeqID_4046
LRYPSDNVLDQVTSKALFNIRKSDPNYVSSREQIIGDLCVALC

SEQ ID NO: 10155 - protein, 675 aa, Xenorhabdus bovienii
  Coding DNA sequence: Name=SeqID_4047
  Gene classification: Gene name=MetG; Function=Methionyl-tRNA synthetase; Function class=J Translation, ribosomal structure and biogenesis
  Homolog annotation: Query=1..565bp; Hit=1..567bp; Blast score=990; Percent Identity=81.0; E value=0; Homolog= ZmetG_1 COG0143
MSQVANKLLVTCALPYANGPIHLGHILEHIQADIWVRYHRMRGKEVHFICADDAHGTPIMLKAQQSGISPEEMITKVSLEHQQDFAGFAISYDNYHSTHSEENKELATKIYLELKKNGHIKNRKISQLYDPEKGMFLPDRFVKGACPKCKAEDQYGDNCEVCGTTYSPTELINPRSAVSGATPEMRDTEHFFFDLPAFSDMLQKWTRSGSLQEQVANKMQEWFDSGLQQWDITRDAPYFGFEIPDEPGKFFYVWLDAPIGYMGSFQNLCSKRDDLNFDEFWSKDSEADLYHFIGKDIVYFHSLFWPAMLEGSNYRKPTNLFVHGYITVNGTKMSKSRGTFIKAETYLKHLDADCLRYYYAAKLSSRIDDIDLNLEDFIQRVNSDIVNKVVNLASRNAGFINKRFAGKLADQLADPALYQQFVDAAEGIAEDFTNREFSKAIREIMALADLANRYVDEQAPWVVAKQEGRDADLQAICSMGINLFRVLMTYLKPVLPSLTDRTEAFLNTELTWDGIRQPLLNHEVSPFKALFNRIEMAKVDAMVADSKESIEPQKTLTGPLADDPIQDTIAFDDFAKVDLRIALIKQADFVEGSDKLLKLTLDLGSETRQVFSGIRSAYPDPKALENRLTVMVANLAPRKMRFGISEGMVMAAGPGGKEIFLLSPDSGAQPGMQVK

SEQ ID NO: 10156 - protein, 149 aa, Xenorhabdus bovienii
  Coding DNA sequence: Name=SeqID_4048
  Gene classification: Function=Putative effector of murein hydrolase LrgA; Function class=R General function prediction only
  Homolog annotation: Query=9..135bp; Hit=5..131bp; Blast score=128; Percent Identity=57.0; E value=2e-30; Homolog= yohJ COG1380
MFMSFRNMLVIGWQYLRAFVLLYLCLIAGNIISALLPFSLPGSIIGLLLLFCLLAFQLIPAYWVKPGCSLLMKNMTLLFLPIGVGVMDYYPQLSQQMFPIVLSCIVSTVIVMIVVAYSSHYVHRERIIIGAQRKEPDLSSPPSQQSDKR

SEQ ID NO: 10157 - protein, 231 aa, Xenorhabdus bovienii
  Coding DNA sequence: Name=SeqID_4049
  Gene classification: Gene name=LrgB; Function=Putative effector of murein hydrolase; Function class=M Cell envelope biogenesis, outer membrane
  Homolog annotation: Query=1..231bp; Hit=1..231bp; Blast score=297; Percent Identity=72.0; E value=5e-81; Homolog= yohK COG1346
MLSHIWWSLPLTLLVFYCAKKLSRQLKLPIFNPLLLSMAVIIPLLLMTHTPYEHYFTGSRILNDLLQPAVVALAFPLYEQLHQIRAQWKSIISICFIGSIVAMVTGTAIALWAGASPEIAASVLPKSVTTPIAMAVADSVGGIPAISAACVITVGILGAIFGHNLFNLLEIKTSASRGLAMGTASHAVGTARCAELDHIEGAYSSLALMTCGIITSLMAPFLFPVLLHLFG

SEQ ID NO: 10158 - protein, 294 aa, Xenorhabdus bovienii
  Coding DNA sequence: Name=SeqID_4050
  Gene classification: Gene name=Cdd; Function=Cytidine deaminase; Function class=F Nucleotide transport and metabolism
  Homolog annotation: Query=1..290bp; Hit=1..289bp; Blast score=295; Percent Identity=58.0; E value=5e-80; Homolog= cdd COG0295
MQARFHAIWSEITPKLQEALLPYIGNDDFPAMLTAEQVESIRQICGFDDHALALALLPLAAACAITPISHFYVGAIARGESGNLYFGANMEFAGVPLQQTVHAEQSAITHAWLRGEKKLVSITVNYSPCGHCRQFMNELNSGTQLEVCLPNRPRLTLADYLPEAFGPRDLLDAPLLLDTVNHGYQLDTCDALVLAALDAANQSHAPYSQSHAGIALLDEQDQVYTGRYAENAAFNPSLPPLQAALILMNMSGGNCQSIKRAILVEGKNSHLSQSNATESTLTALGCTKIECHRF

SEQ ID NO: 10159 - protein, 81 aa, Xenorhabdus bovienii
  Coding DNA sequence: Name=SeqID_4051
MSFFDFTPSERSRGEFCHFVKLSLFHVCPNFLLNCCFFEMGSQNLWHSILVQPRAVNVDSVAFDWDRWLFFPSTSIARLMD

SEQ ID NO: 10160 - protein, 565 aa, Xenorhabdus bovienii
  Coding DNA sequence: Name=SeqID_4052
  Gene classification: Gene name=SfcA; Function=Malic enzyme; Function class=C Energy production and conversion
  Homolog annotation: Query=5..565bp; Hit=28..588bp; Blast score=845; Percent Identity=73.0; E value=0; Homolog= VC1188 COG0281
MELEHESKRPLYIPYAGPILLEFPLLNKGSAFTEEERSNFNLHGLLPQIVETIEEQAERAYRQFCDFKSDGDKHIYLRNIQDTNETLFYRLLDAHLSEMMPIIYTPTVGEACEHFSDIYRRARGLFISYPNKASIDDMLQNATKQNVKVIVVTDGERILGLGDQGIGGMGIPIGKLSLYTSCGGISPAYTLPVVLDVGTNNPQRLNDPLYMGWRHPRITGKEYDEFVGEFIQAVKRRWPNVLLQFEDFAQTNAMPLLTRYRHDLCCFNDDIQGTAAVALGSLVAASRAAGRQLRDQTVTFLGAGSAGCGIAEQIVAQMKSEGLSDEQARARVFMVDRFGLLTDKQPNLLDFQSVLVQKSSVLQSWDVSNDSLSLMDVVRNAKPTVLIGVSGQSGLFTEEIIREMHKHCERPIVMPLSNPTSRVEARPEDIINWTDGKALVATGSPFAPVKYDGQEYPIAQCNNSYIFPGIGLGVIASGARRVTDDMLMVASRALADCSPLAQTGSGPLLPPIDDIQNVSRKIAKEVAKKAQIQGMATVTSEDALEQAIERNFWKPEYRVYKRTSF

SEQ ID NO: 10161 - protein, 48 aa, Xenorhabdus bovienii
  Coding DNA sequence: Name=SeqID_4053
LSAISGNQNIASINALHSDLRPAKISYKPVSTVGRLLLQSENLLQYFK

SEQ ID NO: 10162 - protein, 239 aa, Xenorhabdus bovienii
  Coding DNA sequence: Name=SeqID_4054
  Gene classification: Gene name=SanA; Function=Uncharacterized membrane protein; Function class=S Function unknown
  Homolog annotation: Query=1..236bp; Hit=1..236bp; Blast score=323; Percent Identity=69.0; E value=1e-88; Homolog= sanA COG2949
MWKRLITGLVFIMAVLMLTVIMLDRWISWKTAPYIYDDLSQLPEREVGMVLGTSKYYTSGAYNQYYFYRIQGAANAYNSGKVNYLLLSGDNAQLSYNEPITMQKDFIKAGIPASKVIMDFAGFRTLDSIVRTRKVFNANNFTIITQRFHCERALFIAMHMGIDAQCYAVSSPKNMMIIRFREVFARLGALADLYILKREPRFLGPLTPIPSETVIPTGIEGYPAVSPGELQELGKKPRS

SEQ ID NO: 10163 - protein, 383 aa, Xenorhabdus bovienii
  Coding DNA sequence: Name=SeqID_4055
  Gene classification: Function=Uncharacterized membrane protein; Function class=R General function prediction only
  Homolog annotation: Query=9..381bp; Hit=45..420bp; Blast score=273; Percent Identity=45.0; E value=2e-73; Homolog= Z3408 COG2311
MENSEVMGQRIEAIDSVRGFAILGILILNIFSFALPYAASMNLFYKDSISFSDVMTWSVLSFFTQGKFLFILTLLFGASLELLWQRGSEWNIPRLIILAVIGLLHGILLWDGDILLLYGIAGLLAWHFIHTRHRLFGKGIIFYLFGLMMFYLLGLFPVGENSAFWQPTPQDIFHESHWKTQGGLLAIEHRFRQVSGMMIVVIVQYGWQMVGTMLCGAMLLRNGWLKGEFSLSHYRRVALWLLPLGMVIQVIALSIQCLYPFSYFASWTIRHTISELATPLLALAYIALIYGFWPIISHWRVNFWLRQVGRMALTSYLLQTLICTTIFYRWGLFDQFTRLELLVFIPLIWAFNIWFACWWLKRYQQGPIEKLWRDLTRKLAGRV

SEQ ID NO: 10164 - protein, 222 aa, Xenorhabdus bovienii
  Coding DNA sequence: Name=SeqID_4056
  Gene classification: Gene name=FolE; Function=GTP cyclohydrolase I; Function class=H Coenzyme metabolism
  Homolog annotation: Query=1..218bp; Hit=1..220bp; Blast score=344; Percent Identity=87.0; E value=4e-95; Homolog= folE COG0302
MSSLSTEAALVHSALVSRGLETPLREQTLEPEVRKVRIQEHMTEIMKLLNLDLSDDSLADTPSRIAKMYVDEIFSGLDYNNFPKITLIENKMKVDEMVTVRDITLTSTCEHHFVTIDGKATVAYIPKDKVIGLSKINRIVQFFAQRPQVQERLTQQILIALQTLLGTNNVAISIDAVHYCVKARGIRDATSTTTTTSLGGLFKSSQNTRQEFLRAVRHLHLS

SEQ ID NO: 10165 - protein, 36 aa, Xenorhabdus bovienii
  Coding DNA sequence: Name=SeqID_4057
MISTRVVCTYIVSVYNYLCTLSIRPIWITPYDSDCA

SEQ ID NO: 10166 - protein, 392 aa, Xenorhabdus bovienii
  Coding DNA sequence: Name=SeqID_4058
  Gene classification: Gene name=ProP; Function=77 Permeases of the major facilitator superfamily; Function class=G Carbohydrate transport and metabolism
  Homolog annotation: Query=20..383bp; Hit=14..379bp; Blast score=212; Percent Identity=45.0; E value=6e-55; Homolog= PA1412 COG0477
MRNQIITSGRRHYQAFQIALSGFLALVVAMGIGRFTFTPQVPLMIAESQFTLTGAGIVAAFNYLGYLAGSYDAMRAQRFVEYRLWSGLWGAVMITLLSALLDGPILHSIARFFIGWASGWTLVLVAAWANDELAKLHRPGLSAAVFAGTGIGILISGVLAVAIQSWEMSAANAWVIYGMLALLCSIYVSRYLPRRGELHRPQTNIQKLTLTPEIKRLIWSYSLAGFGYILPATFLSQMATERFPDSLFAQFVWPIFGGASALGIVLGILLSWVSTARIRLAITLWLQAIGILIAEVLQGIGGLLIGALLVGGGFMCVVQLALLYGRELAPNQARYMAGLLTTGYALGQLVGPVLSAISTWLTGKLEPALYIGFICLVVAGLLLFKRNQNHKE

SEQ ID NO: 10167 - protein, 445 aa, Xenorhabdus bovienii
  Coding DNA sequence: Name=SeqID_4059
  Gene classification: Gene name=MoeA; Function=Molybdopterin biosynthesis enzyme; Function class=H Coenzyme metabolism
  Homolog annotation: Query=38..441bp; Hit=4..407bp; Blast score=551; Percent Identity=68.0; E value=1e-157; Homolog= ZmoeA COG0303
MTTILHQSDLCHNAASTGINVYPLSAAYWEFFMDHCHTSGLISLEQALEKLLAQAVALTHTETISLMQAAGRITATDIISPINVPSFDNSAMDGYAVRLADLNGNQALPIAGKAFAGAPFQGEWLAGSCIRIMTGAPIPAGADAVIMQEQAEVTEAGIRFPYPAQPGQNIRTIGEDIAQNAVVLPKGTKLSTAQLPVIASLGIAKVKVIRRLKVAIFSTGDELQAIGEPLQAGQIYDTNRFAVRLMLEKLDCEVIDLGVISDDPDALRDAFAKADKQADLVISSGGVSVGEADYTKAILEEVGKINFWKLAIKPGKPFAFGKLENAWFCGLPGNPVSAVLTFYQLVQPLIARLSGFTAWQAPMRLNAKAITPLKKSPGRLDFQRGNASINEHGELEVQTTGHQGSHIFSSYSLGNCFIVLERERGHITAGETVQIEFFNHLLKNQ

SEQ ID NO: 10168 - protein, 250 aa, Xenorhabdus bovienii
  Coding DNA sequence: Name=SeqID_4060
  Gene classification: Gene name=ThiF; Function=Dinucleotide-utilizing enzymes involved in molybdopterin and thiamine biosynthesis family 2; Function class=H Coenzyme metabolism
  Homolog annotation: Query=4..248bp; Hit=3..247bp; Blast score=363; Percent Identity=70.0; E value=1e-100; Homolog= moeB COG0476
MAIELTDEETLRYNRQIVLRNFDFDGQEKLKSAKVLIVGMGGLGCASSQYLTSAGVGTITLLDFDAVSLSNLQRQILHRDERIGMPKVHSAAQTLREINPHVTLHPIEGLLDDPSLDELIGRHDLILDCTDNVAIREQLNRLCYGRKVPLVSGAAIRMEGQLAVFTYQPDEPCYRCLSRLFGENSLTCVEAGVMAPLVGIIGSLQAMEAIKLLTQYGKVSRGKVLLFDAMTLQFREIRLPKDPQCEVCQS

SEQ ID NO: 10169 - protein, 65 aa, Xenorhabdus bovienii
  Coding DNA sequence: Name=SeqID_4061
LPELILTTNPILYSLPFLPEKTRVKGNKNIDDDLITLSDEDQISLPEYSCDDHIQTLLPSFIFLP

SEQ ID NO: 10170 - protein, 34 aa, Xenorhabdus bovienii
  Coding DNA sequence: Name=SeqID_4062
MKIKFLYPNTHVMTTYRHYSLLLYSFLRIVFELW

SEQ ID NO: 10171 - protein, 217 aa, Xenorhabdus bovienii
  Coding DNA sequence: Name=SeqID_4063
MQELNGKKSTEADALLSNIAKNIDFLMKNNNIDSQTLSRLTGLGIATINSLRRGVGNPTIATVSSIADVFGVNVGEITDGKLSESNGNEEIISSVPLVRYDELDGYVSGKIITKNLYKLSIQDNHEDSLFAVEFGNNLLFPYFDSNTIAIVSKTEAVCDSDVVLVKIKDAPICFRQVFVGESGIYFSILGIENERKTVLTQNYTIIGVVIRSIRNLK

SEQ ID NO: 10172 - protein, 160 aa, Xenorhabdus bovienii
  Coding DNA sequence: Name=SeqID_4064
VGKIISFLKKIFETRYIYSLQKFEPIKENGFYILKELGTHTCIKAKAEDIFDGDLLYNINPQDIIFIARFEEYDMREKQKFKIIEERRDLSFIIQNAYSRRQIHGKELLIEQNIVEKIDPTSLVRIAYMSGLKDGRKISDDISKAEKIKPSKSPNLKVIK

SEQ ID NO: 10173 - protein, 232 aa, Xenorhabdus bovienii
  Coding DNA sequence: Name=SeqID_4065
  Homolog annotation: Query=36..223bp; Hit=1..189bp; Blast score=91; Percent Identity=27.0; E value=1e-17; Homolog= ref|NP_052341.1|
MTQNYPTHSRFKYDSLFISLSVTIMITCDVLVYKTLDFYDFKITFSGILFSFYFLISTIQTEVYGYRQGVKTVWIMVLCQSIFVMVIFVASHMQPENNQISMNFKSLFGEFWRVMVGTWTSVPISYFINGFVISSLKKVFLGRFFFIRYLIASMTTQAALLLSAYPISLSSKYNFNELITIITTTWSYKVVMSIILLPIGIILADKIKKLESADVYDWGISYNPFFLRGNKK

SEQ ID NO: 10174 - protein, 247 aa, Xenorhabdus bovienii
  Coding DNA sequence: Name=SeqID_4066
  Gene classification: Gene name=Icc; Function=Predicted phosphohydrolases; Function class=R General function prediction only
  Homolog annotation: Query=3..227bp; Hit=16..235bp; Blast score=80; Percent Identity=24.0; E value=1e-15; Homolog= PA4969 COG1409
MKVVNLTDIHLTRNRDKKLFDVNPYDNFDFVCEEIRRIQNLTGIELIIVSGDIANDGDIDAYRYFLNRMESLKIPYISILGNHDLNKNFEIALAEEKPKYIITSREYNNNNWYMTSVDTVVEGEDYGFITQDNLAELERKIITNSNFNIAIFMHHHAMPVGTPIVDSCMLNNAKAVLELCEKHKVKFIGSGHAHTPRIWHHNNMTACVSPAVSFQWLSGTDTVKISKGFGFNVIDFVPDLSITSCIY

SEQ ID NO: 10175 - protein, 550 aa, Xenorhabdus bovienii
  Coding DNA sequence: Name=SeqID_4067
  Gene classification: Gene name=Uup; Function=ATPase components of ABC transporters with duplicated ATPase domains; Function class=R General function prediction only
  Homolog annotation: Query=20..548bp; Hit=1..529bp; Blast score=923; Percent Identity=85.0; E value=0; Homolog= ybiT COG0488
MRDYRFFPNSLLSTLRAKVVLSTNNITMQFGSKPLFENISAKFGNGNRYGLIGANGAGKSTFMKILGGDLTPTAGNVSLDPNERLGKLRQDQFAFETYTVLDTVIMGHAELWEVKQERDRIYALAEMSEEDGYRVADLEVAYGEMDGYSAEARAGELLLGVGIPVDQHYGLMNAVAPGWKLRVLLAQALFSNPDVLLLDEPTNNLDINTIRWLEQVLNERNSTMIIISHDRHFLNMVCTHMADLDYGALRLFPGNYDEYMTAATQARERQLADNAKKKAQIADLQSFVSRFSANASKSKQATSRARQIDKIQLEEVKASSRQNPYIRFEQEKKLFRNALELESVTKGYDNEPLFKNLNLLMEVGEKMAVIGENGIGKTTLLKTLVGEAEPSSGTIKWSENNTIGYYAQDHASDFDCDLTVFEWMSQWKREGDDEQAVRGALGRLLFGQDDIKKKVKVLSGGEQGRMLFGKLMMHKPNILIMDEPTNHLDMESIESLNLALELYQGTLIFVSHDRSFVSSLASRILEIKSDKVVDFRGTYDEYLRSQGIAE

SEQ ID NO: 10176 - protein, 93 aa, Xenorhabdus bovienii
  Coding DNA sequence: Name=SeqID_4068
LLLKWIKGNLEKIDSRALCHNKKKVSPEYLDLYLKNQNTDPVHIKKINKIFLWNRLYSIVMKFAAKARDNGSELRRGKTDCFSHIALLYHASV

SEQ ID NO: 10177 - protein, 104 aa, Xenorhabdus bovienii
  Coding DNA sequence: Name=SeqID_4069
MHFQPNANIGRVPCHIPVLSGDFFGWVFEPAFLDVQLAPQWCYCHSLYPLTNVRLPFPQLRPPLVSNPLIRCGTACNKYSERHTMRIHGQMYLDVEPPFVRPIS

SEQ ID NO: 10178 - protein, 59 aa, Xenorhabdus bovienii
  Coding DNA sequence: Name=SeqID_4070
MLSPLLYVPYPDYPLYAPANVAQVSPLYDLKYHDGSARGCSLLMQLYLWDILIIAQNIS

SEQ ID NO: 10179 - protein, 82 aa, Xenorhabdus bovienii
  Coding DNA sequence: Name=SeqID_4071
MNSGKKLNPCYLHTKYKIRHPLGCYRLRVDNRAAMNTIFFVLRTGCQWNALNATGICSSSSVWYVGKSVLKIMKPCFIWLVV

SEQ ID NO: 10180 - protein, 408 aa, Xenorhabdus bovienii
  Coding DNA sequence: Name=SeqID_4072
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=18..403bp; Hit=42..431bp; Blast score=294; Percent Identity=41.0; E value=1e-79; Homolog= BS_yhjL COG0399
MKDVPIINSRIFSVKSRKELLTEWSEISEIINNENEYDGSGVVSFLPLNRLNSNSEREECLNVISKVMETGNFTSGSYISEVEKYLCEFYQADICVATSSGTDALKIALKAAGVGHSDEVILPLNSFAATENAVMAIGAIPIFANMDASYNIAPEEIERLTTPRTKAVLPVCLYGSTKNISEVYKKAKQHNLLVIVDAAQCFGIKNVIGYCDLMALSFNPFKNIGTVGKSGAVLTCSPELACRARQYSYHGFAEGKKNIKAQNWGFNSRMDNMQAATLMVKLNHFEKNATKRAFLAARYIHSLNHLETDLSLPSERIENTWHLFPLVIKKRTRDELLQFAKKHHVELDVYYPVLSHCGVHELATHYPDRKQFLSSERIHTNLVQLPLHNHMSLQEQDIVIEVLNEFFN

SEQ ID NO: 10181 - protein, 275 aa, Xenorhabdus bovienii
  Coding DNA sequence: Name=SeqID_4073
  Gene classification: Gene name=Cof; Function=Predicted hydrolases of the HAD superfamily; Function class=R General function prediction only
  Homolog annotation: Query=1..275bp; Hit=1..275bp; Blast score=358; Percent Identity=58.0; E value=2e-99; Homolog= PM1047 COG0561
MNFLTEILPPEFPCPVSVKTLVCCDLDETYIPFSLENKPFGGVRELEQFLCEEGKKKGILLGWITGTNLSSAIRKAKGYISRSPHFLCCSLGTEFYWVRNGKLVPSVSWAERIKKSGYNRENVEKILYLIGEKGIFLEKQPDDYQGKYKASFYYHIREDMESDFEWIESIAKTFQIRTFFTKSNPAAGDPEDCYDVEFIPYCCGKGETVSFLMEKMHIPRNSVLAFGDSCNDLPMFECVGHSYLVANAEKTAIQKHGSNLNKPYCHGILSVLTGL

SEQ ID NO: 10182 - protein, 197 aa, Xenorhabdus bovienii
  Coding DNA sequence: Name=SeqID_4074
  Gene classification: Gene name=MviM; Function=Predicted dehydrogenases and related proteins; Function class=R General function prediction only
  Homolog annotation: Query=3..194bp; Hit=4..195bp; Blast score=95; Percent Identity=36.0; E value=3e-20; Homolog= BS_yhjJ COG0673
MVIGIIGCGGIARAHVYSLSLISMVKGLAFYDVSDDNMRHLSKLSALPVIFCSSLKELAIHSDGFIICAPNNFHVSLAEEVLKYKTIPFVCEKPLSTDLKSAKRLVEIAPLASIVSFNYRYNKIVIKIQEIIEKRALGKLNFFSAEFNKNSALIRNNLTWRDSSQQSKSSGALGDLSCHLLDLFCFLAEDTIRTIRN

SEQ ID NO: 10183 - protein, 345 aa, Xenorhabdus bovienii; identical to SEQ ID NO: 7397
  Coding DNA sequence: Name=SeqID_4075
  Gene classification: Function=Predicted transposase; Function class=L DNA replication, recombination and repair
  Homolog annotation: Query=165..332bp; Hit=20..184bp; Blast score=76; Percent Identity=29.0; E value=4e-14; Homolog= BH2520 COG3335

SEQ ID NO: 10184 - protein, 141 aa, Xenorhabdus bovienii
  Coding DNA sequence: Name=SeqID_4076
  Homolog annotation: Query=2..141bp; Hit=111..248bp; Blast score=152; Percent Identity=56.0; E value=8e-37; Homolog= emb|CAA11512.1|
VVKGTRVNNKSDGPVEVDDNGYVFGRADGGAFFRIRASKSDDDGSQLGLHINLVFDEGEIHYSTTDENKLFLTFFSKLGVEEVMLETRKIIPDPNRELPFWSDSFYYLLLDWCRLLQNHGKSKALPFLPAGLHIQEIIEEF

SEQ ID NO: 10185 - protein, 88 aa, Xenorhabdus bovienii
  Coding DNA sequence: Name=SeqID_4077
  Homolog annotation: Query=7..85bp; Hit=7..85bp; Blast score=62; Percent Identity=44.0; E value=2e-09; Homolog= ref|ZP_00067239.1|
MDMTLFIGLFAAFFTTFAFVPQSIKTLKTRNTEGISLIMYIMFLIGVISWVVYGFKKSDLAVLVANVTTFVLAAPVLIMTVISRIRKR

SEQ ID NO: 10186 - protein, 49 aa, Xenorhabdus bovienii
  Coding DNA sequence: Name=SeqID_4078
VILPIPILPNTALSGRYSSKKHNLFYIHRISSQYHAIIQKNSHLGSLFS

SEQ ID NO: 10187 - protein, 96 aa, Xenorhabdus bovienii
  Coding DNA sequence: Name=SeqID_4079
MEMIISSYAHITTTTEKFILDRLEQAKKELKEDELQEISHTELLAFHSEAKGAYDLWCKIVFSPEVLSREKLLNDSLYLKTLMDEFFDFIWSITSK

SEQ ID NO: 10188 - protein, 78 aa, Xenorhabdus bovienii
  Coding DNA sequence: Name=SeqID_4080
VFSPLAQLLKLSNRLISNVLFKSLTNRESSTFEKLFFTSPYDMNNIRQLVQFASLFSISTNEFSVQALEKIIISLPKK

SEQ ID NO: 10189 - protein, 91 aa, Xenorhabdus bovienii
  Coding DNA sequence: Name=SeqID_4081
  Gene classification: Function=Transposase; Function class=L DNA replication, recombination and repair
  Homolog annotation: Query=1..87bp; Hit=1..87bp; Blast score=82; Percent Identity=44.0; E value=8e-17; Homolog= insA_g5 COG3677
MAKVDVKCPFCQQTPPVKKQGLGSTGHQRYRCQECCRSFQLDYEYRACHPGTKDKILDLTMNNAGIRDTARALHISINAVVRTLKNSRLDT

SEQ ID NO: 10190 - protein, 133 aa, Xenorhabdus bovienii
  Coding DNA sequence: Name=SeqID_4082
  Gene classification: Gene name=InsB; Function=Insertion element IS1 protein InsB, putative transposase; Function class=L DNA replication, recombination and repair
  Homolog annotation: Query=3..131bp; Hit=37..166bp; Blast score=119; Percent Identity=48.0; E value=9e-28; Homolog= insB_g4 COG1662
LQVELLCEVDEQGSFVANKKQQRWLWYAWEPRLKRIIAHTFGRRNKRTLRKLLALLSGFNVAFGCTDKFRVYEILPGEKHIASKLYTQRIERENLNLRNRLKRLNRKTLGYSKCPEMHDKIMGTFIEREHYLF

SEQ ID NO: 10191 - protein, 67 aa, Xenorhabdus bovienii
  Coding DNA sequence: Name=SeqID_4083
MPILSVIIERFVMTGWDTILSELQDYATKWQWFYHHERPNMALGGYTPKGSVFNIEIIVKIDNAHAQ

SEQ ID NO: 10192 - protein, 113 aa, Xenorhabdus bovienii
  Coding DNA sequence: Name=SeqID_4084
  Gene classification: Gene name=Tra5; Function=Putative transposase; Function class=L DNA replication, recombination and repair
  Homolog annotation: Query=1..108bp; Hit=122..229bp; Blast score=92; Percent Identity=41.0; E value=7e-20; Homolog= CC0515 COG2801
MDFMHDQLSDGRSVRLLNIIDGFNREALTIEVDFSLPSRRVIRTLEHLMGWRRKPASIRCDNGPEYTRHEFQAWAKTHEIVLSFIQPGKPQQNAYIERYNRTVRYDWLGHYFE

SEQ ID NO: 10193 - protein, 51 aa, Xenorhabdus bovienii
  Coding DNA sequence: Name=SeqID_4085
MNADSLSHCVSVNIVRGMMVKSGYFLAKTIIPNHHAVQIPFTKRQQPLGNG

SEQ ID NO: 10194 - protein, 78 aa, Xenorhabdus bovienii
  Coding DNA sequence: Name=SeqID_4086
  Gene classification: Function=Predicted transposase; Function class=L DNA replication, recombination and repair
  Homolog annotation: Query=1..77bp; Hit=1..79bp; Blast score=63; Percent Identity=44.0; E value=5e-11; Homolog= CC0928 COG3293
MPRTMLTDTQWDKLSAFMQHTGLIYHKTKHRQTFEGILYRMRTGIPWRDLPSEFGKGNSVFQRFNAWSKKGVLHLIFN

SEQ ID NO: 10195 - protein, 45 aa, Xenorhabdus bovienii
  Coding DNA sequence: Name=SeqID_4087
MDFGSTSSTTLTHCLILFRRRSCTMLMGSNNTSVNEQPFCIRESR

SEQ ID NO: 10196 - protein, 128 aa, Xenorhabdus bovienii
  Coding DNA sequence: Name=SeqID_4088
  Gene classification: Function=Predicted transposase; Function class=L DNA replication, recombination and repair
  Homolog annotation: Query=1..123bp; Hit=126..247bp; Blast score=100; Percent Identity=42.0; E value=4e-22; Homolog= mll8100 COG3293
LAVDSYGLPVHFELSGGQVNDIVHAESFVSQSPLSDFVIADKGYDSQRLRSVIEEQKSVPVIPYRKNSRKLDQKIDKCLYRYRHLVENAFARIKHFRAIATKYDKLERNYASMLALAFIIVWLSMWAE

SEQ ID NO: 10197 - protein, 112 aa, Xenorhabdus bovienii
  Coding DNA sequence: Name=SeqID_4089
  Homolog annotation: Query=32..112bp; Hit=21..101bp; Blast score=90; Percent Identity=54.0; E value=5e-18; Homolog= ref|NP_644778.1|
MGFSTYTIFPDCAANRVYSLCVEGGVAMYIASISGSLTSDSASEYHFGTLCRLSAENEQISAWLLNITGQQCNWEFGFCYLYLHNVKGFQWNHKRVYRIYCELALNKRIKPK

SEQ ID NO: 10198 - protein, 37 aa, Xenorhabdus bovienii
  Coding DNA sequence: Name=SeqID_4090
MALTFEECNEMIAACQSQNVPLFVAYYRRALPRLRIN

SEQ ID NO: 10199 - protein, 179 aa, Xenorhabdus bovienii
  Coding DNA sequence: Name=SeqID_4091
  Homolog annotation: Query=10..164bp; Hit=168..322bp; Blast score=154; Percent Identity=48.0; E value=8e-37; Homolog= ref|NP_694183.1|
MESRYQDPDNLPWFVKPEISGGGLFVDLACHTLDILDFLLGKIISVKGHANSQAKAYPAEDCVSMSFMFENHIQGVGIWNFAAGTREDKVEIIGTKGKIAFATFGDAAISYYDENNQLHQFHFENPKHIQMPFIQTVIHQLQRNNISSSNGEAAARTSWVIDEVLKEYRTALYIENKEQ

SEQ ID NO: 10200 - protein, 51 aa, Xenorhabdus bovienii
  Coding DNA sequence: Name=SeqID_4092
  Homolog annotation: Query=2..48bp; Hit=69..115bp; Blast score=61; Percent Identity=59.0; E value=4e-09; Homolog= ref|ZP_00080825.1|
MLLCHGEWVVRSRTIEGMNHRIKVIKRMAYGYRDTDYFFLRIRAASPGKVR

SEQ ID NO: 10201 - protein, 428 aa, Xenorhabdus bovienii
  Coding DNA sequence: Name=SeqID_4093
  Gene classification: Gene name=ProP; Function=77 Permeases of the major facilitator superfamily; Function class=G Carbohydrate transport and metabolism
  Homolog annotation: Query=9..395bp; Hit=5..392bp; Blast score=118; Percent Identity=30.0; E value=1e-26; Homolog= Zbcr COG0477
VHSKDFSWRYSLTATILLLSPFDLLASLGMDMYLPVVPFIAGVLGAGAGTIQLTLTAYLVLLGAGQLLFGPLSDWLGRRPVLLSGGIAYIVASFGLTVASSPEVFLSFRVIQACGASACLVATFATIRDIYSGREESNIIYGLLSSMLAMVPAVGPLLGVLVDTWLGWRAIFGLLGGAMTVAVIAAWQLWPETRWQRKSDLQWSQLLLPVKRLNFWLYTLCYSAGMGSFFVFLSTAPWLMMGRQGLSQLTFSLLFATVAIAMMVTSRIVGGLVVRWGSLNMLRAGMCCLMAGALLLAVGETLIPKSVFGFIVPMWLVGVGIATAVSVAPNGALRGFDHMAGTATAVYFCLGGLLLGGSGTLAITLLSSATAWPIIAYCLILATAALCLSCFNSNRRDISSEEHDALVPRGMGSSQSDNRGHEPSDKSH

SEQ ID NO: 10202 - protein, 32 aa, Xenorhabdus bovienii
  Coding DNA sequence: Name=SeqID_4094
MWFLRTPQQPKNYGCRGLFLCFLGSAHMRVIS

SEQ ID NO: 10203 - protein, 44 aa, Xenorhabdus bovienii
  Coding DNA sequence: Name=SeqID_4095
MKKWAQENNYSHLELTVLSHNVEAIRFYEREGYNEINKLMAITL

SEQ ID NO: 10204 - protein, 79 aa, Xenorhabdus bovienii
  Coding DNA sequence: Name=SeqID_4096
MRIIIFLRPFFHSNQQSLANSLASGILTDDQIKNITIISWYQTIKRRCILLLRNGKNRRVVPQNPLPVQSLLFDYTLHN

SEQ ID NO: 10205 - protein, 296 aa, Xenorhabdus bovienii
  Coding DNA sequence: Name=SeqID_4097
  Gene classification: Gene name=RhaT; Function=7 Permeases of the drug/metabolite transporter (DMT) superfamily; Function class=G Carbohydrate transport and metabolism
  Homolog annotation: Query=14..296bp; Hit=12..293bp; Blast score=290; Percent Identity=62.0; E value=1e-78; Homolog= ybiF COG0697
MSLSKHRAASFPLLPVVLLLLSMTSIQAGASLAKTVFHVIGAPGVTALRLALGTIILFLIFKPWRLKFQRESLIPLFAYGISLGAMNYLFYMALSRIPLGVAVALEFTGPLAVAMFSSRRPLDFLWIALVIAGLGFLLPVGDGVSTLDPIGVLYALGAGVFWALYIIFGQRAGAGYGAATVSIGSSIAAMIFFPVGLIQTGPELLFDPSLLPIALGIAILSTAFPYTLEMIALTRLPAKTFGTLMSLEPALGALSGIIFLNEHLTMTQWIALFCIIFASIGSTSTIKRKAKIEKVE

SEQ ID NO: 10206 - protein, 61 aa, Xenorhabdus bovienii
  Coding DNA sequence: Name=SeqID_4098
MKGISTINVIETSNMTPGELSTNLISSNEITHYSALREHHYEYSKINQPQHFPPDLYPQQH

SEQ ID NO: 10207 - protein, 168 aa, Xenorhabdus bovienii
  Coding DNA sequence: Name=SeqID_4099
  Gene classification: Gene name=Dps; Function=Starvation-inducible DNA- binding protein; Function class=L DNA replication, recombination and repair
  Homolog annotation: Query=1..167bp; Hit=1..167bp; Blast score=226; Percent Identity=68.0; E value=8e-60; Homolog= dps COG0783
MSTAKLISPNTSHLIYTRNNINEDVKQRSITALNHMVIHFIDLSMMTKQAHWNMRGRNFIAIHEMLDGFRTALTDHLDTFAERAVQLGGTALGTVQEVHSRTRLENYPTGIHDVQDHLKALADRYAVVANDIRQAIVDAEDEDTADMFTAASRDLDKFLWFIEANIEQ

SEQ ID NO: 10208 - protein, 36 aa, Xenorhabdus bovienii
  Coding DNA sequence: Name=SeqID_4100
MIFLKVSLIFDIVAAIFRCFFLLEIIRDVERPQMRP

SEQ ID NO: 10209 - protein, 73 aa, Xenorhabdus bovienii
  Coding DNA sequence: Name=SeqID_4101
  Gene classification: Gene name=PhnA; Function=Uncharacterized Zn -ribbon-containing protein involved in phosphonate metabolism; Function class=P Inorganic ion transport and metabolism
  Homolog annotation: Query=1..71bp; Hit=1..72bp; Blast score=72; Percent Identity=63.0; E value=9e-14; Homolog= CC3005 COG2824
MDTEVKDSNGALLNDGDTVQVIKDLKVKGTSKTLKRGTLIKNIRLTHREDEVECNSDKIKGLVLKTCFLKKIG

SEQ ID NO: 10210 - protein, 36 aa, Xenorhabdus bovienii
  Coding DNA sequence: Name=SeqID_4102
LIITSRITRLCFFVYFESITHLITKKIQVIINFNFS

SEQ ID NO: 10211 - protein, 112 aa, Xenorhabdus bovienii
  Coding DNA sequence: Name=SeqID_4103
MNIKEINIYLSKLISNPKYSIKMYENPNKFMEIYHISQSSRGILIDFFRRNGSKFVNSSILQKTKRMDGLIMSLPNLYNYLNKDNFELEFEKYLINIDFNNEVKKNPIIESK

SEQ ID NO: 10212 - protein, 178 aa, Xenorhabdus bovienii; identical to SEQ ID NO: 8288
  Coding DNA sequence: Name=SeqID_4104
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 10213 - protein, 146 aa, Xenorhabdus bovienii; identical to SEQ ID NO: 8316
  Coding DNA sequence: Name=SeqID_4105

SEQ ID NO: 10214 - protein, 91 aa, Xenorhabdus bovienii
  Coding DNA sequence: Name=SeqID_4106
MFVFTFSIFLFNSSLKFSFSINDNSDLIFVSNSLILIVGLETINIFSIASYLISFDNSTSILNVFSCKSINRLFFSFSYKAIVLKRSSPVF

SEQ ID NO: 10215 - protein, 51 aa, Xenorhabdus bovienii
  Coding DNA sequence: Name=SeqID_4107
MLSPLLLSEIKFFELRIFRVLLNDYLSKIYCLFIFSNNLHAEIGVLHVNIM

SEQ ID NO: 10216 - protein, 127 aa, Xenorhabdus bovienii
  Coding DNA sequence: Name=SeqID_4108
  Gene classification: Function=Uncharacterized BCR; Function class=S Function unknown
  Homolog annotation: Query=1..116bp; Hit=12..128bp; Blast score=55; Percent Identity=28.0; E value=8e-09; Homolog= CC2906 COG3220
MSKYGKFGIGVNYKSSFSKEIYNNLQYIDILEVHSEKFFLDEEDNYLEKCCEEIPIIFHGLDMSLGTDDNLDTEYLENLKNVIINKKPMWYSDHLSATRHGNIEVGHLMPIQFSIENSYNIINKIKK

SEQ ID NO: 10217 - protein, 129 aa, Xenorhabdus bovienii
  Coding DNA sequence: Name=SeqID_4109
  Gene classification: Function=Uncharacterized BCR; Function class=S Function unknown
  Homolog annotation: Query=2..128bp; Hit=148..275bp; Blast score=89; Percent Identity=34.0; E value=6e-19; Homolog= PA4106 COG3220
MPGSDMAEIDFINSIVKNSDCGILLDINNLYINAMNHNYDPEEFLLKLPLNHIVEIHLAGGSYKFDMIVDTHANKIWDDVWKLYEYSLSKTDVCGVIIERDSNIENYTTVIDEVTIAREIYKKTYRKHS

SEQ ID NO: 10218 - protein, 237 aa, Xenorhabdus bovienii
  Coding DNA sequence: Name=SeqID_4110
  Gene classification: Gene name=WcaA; Function=Glycosyltransferases involved in cell wall biogenesis; Function class=M Cell envelope biogenesis, outer membrane
  Homolog annotation: Query=1..229bp; Hit=383..618bp; Blast score=107; Percent Identity=32.0; E value=8e-24; Homolog= PM0414 COG0463
MNTLTNNENLKIASLASIPKRKNNLYYTVKSIFSQIDELNVYLNGYKSIPDFLIKDKINIYMSSKSGDFGDASKFYPLKDKIGYLFTLDDDLIYPKDYIKKLVSKIDMYNRKNFICVHGNIIDRTSLSSYYDNKKGIHFLKSLDNDIFVNIPGTGTLAYHSSLHSFSMKSFPIKNMSDIWVAVIAKRNNIKIVAINRKKYWIRTSIKNKDPYSIYSNKNKLDQIICQIIKREELYNI

SEQ ID NO: 10219 - protein, 88 aa, Xenorhabdus bovienii
  Coding DNA sequence: Name=SeqID_4111
MNNEYKITLNKNGYILIKNFLCDEEKKSLNIDIEFLYNKKDIPGKIMKYYEESVIDSKKILNRIENFIDYKEIDHINKIEKKYLNYYQ

SEQ ID NO: 10220 - protein, 30 aa, Xenorhabdus bovienii
  Coding DNA sequence: Name=SeqID_4112
MILMWKKSTTTTQFKINFILKENMFFFCYY

SEQ ID NO: 10221 - protein, 39 aa, Xenorhabdus bovienii
  Coding DNA sequence: Name=SeqID_4113
MISVDDMNIANGCLYISKIPFKKKSIPHNSGQALKSSYK

SEQ ID NO: 10222 - protein, 251 aa, Xenorhabdus bovienii
  Coding DNA sequence: Name=SeqID_4114
  Homolog annotation: Query=3..249bp; Hit=142..386bp; Blast score=255; Percent Identity=52.0; E value=5e-67; Homolog= ref|NP_287328.1|
MPGQLVRLLNIPMERAKTLHGSENGKAHADALKRGCREHYGAAGREWIGYLSSHHEEARQAYIEAQSRWGKLIPESYGEQVQRVSDRFAVLEAALMLGRVITGWKAQDCRDVLQYIFNVWVAEFGTGNKEFEQIVEQAVSFLNAHGMSRYAPLPYDERDLPIRDLAGYREKKGLHDNDPMIFYTLPATFKQEIARGFNVDMFADTLVKSDILKKPASGRSYQGKTPRLKHLGGIQQRAYIMVLVPESDEEA

SEQ ID NO: 10223 - protein, 50 aa, Xenorhabdus bovienii
  Coding DNA sequence: Name=SeqID_4115
MRKLRKLYRQKINGFTGMLLELRTLSEERFHDRELTDKIILNLVGECADA

SEQ ID NO: 10224 - protein, 132 aa, Xenorhabdus bovienii
  Coding DNA sequence: Name=SeqID_4116
  Homolog annotation: Query=1..127bp; Hit=1..127bp; Blast score=126; Percent Identity=46.0; E value=6e-29; Homolog= ref|NP_851976.1|
MRDIQMVLNQWGAWASEGNSDVDWAPIAAGFKGLVPSTRKTRAQCCDDDGFAIDAAVLRLKKYNPYYFQLIVMHYIKASALRAMGTKLGISHNEVSKRLQAAEGFIEGVLAVSGVTLELDKCVQKEIINRVA

SEQ ID NO: 10225 - protein, 104 aa, Xenorhabdus bovienii
  Coding DNA sequence: Name=SeqID_4117
VDVIDLAEAFEHQIEKRVKKINLDREFKDELFFTSGYDKSVVYKDPGTQLLWEIFVAGLEKGQKSARIRLPQSKENPDNFYDAGYNEGIKDCRKHLQAQKIKVI

SEQ ID NO: 10226 - protein, 119 aa, Xenorhabdus bovienii
  Coding DNA sequence: Name=SeqID_4118
MINKKVSILAGLLLPLIAGTGMAAEKATTGQGVIAPSNFQCDKFMSSGYYMGKLDYVISIDNLNSTYYWFVSSEQDNQTGCVNVDESKVKHAKIIHDAFLQGKIVKIRLNGSVIERISF

SEQ ID NO: 10227 - protein, 84 aa, Xenorhabdus bovienii
  Coding DNA sequence: Name=SeqID_4119
MYALKLITERNGRSVEESWILGDMYRLEFCPKDVADNVIARVEHSQNGNLINHDIKKTDQAYITTLTGDTVRTVCRGRSVSQAA

SEQ ID NO: 10228 - protein, 34 aa, Xenorhabdus bovienii
  Coding DNA sequence: Name=SeqID_4120
MGVRGVSYGRPCELVNRMLTAIGDTEVLRVIAAA

SEQ ID NO: 10229 - protein, 104 aa, Xenorhabdus bovienii
  Coding DNA sequence: Name=SeqID_4121
  Homolog annotation: Query=1..104bp; Hit=7..110bp; Blast score=166; Percent Identity=75.0; E value=8e-41; Homolog= emb|CAB58444.1|
MKENPDVWAELLNGLQNSWPQISGSALAIAICYGRLIYDGVERKNRWVEALLCGALSWSVSSGLEMFGVPSSFAPAIGGVIGFIGVEKIREFAIRAINKRLGDK

SEQ ID NO: 10230 - protein, 136 aa, Xenorhabdus bovienii
  Coding DNA sequence: Name=SeqID_4122
  Homolog annotation: Query=1..136bp; Hit=1..136bp; Blast score=212; Percent Identity=79.0; E value=8e-55; Homolog= ref|NP_930141.1|
MTRGIRNNNPGNIDHNSANKWQGQLLHDPSIEKRFCRFESAEYGIRALFKLLRNYQNKHQLHSIRKIINRYAPPVENNTESYIQFAAEKVGVSADEKISTQDKKVLFALAEGIIKMENSNQQPYSEETLERAFNLL

SEQ ID NO: 10231 - protein, 41 aa, Xenorhabdus bovienii
  Coding DNA sequence: Name=SeqID_4123
MKGRHPAISLRLYFYKLMIGFRARQYADKKKPRDCEAQDSE

SEQ ID NO: 10232 - protein, 191 aa, Xenorhabdus bovienii
  Coding DNA sequence: Name=SeqID_4124
  Homolog annotation: Query=1..189bp; Hit=1..187bp; Blast score=246; Percent Identity=61.0; E value=2e-64; Homolog= ref|NP_049506.1|
MHTITVPFYDDELYVVEYNNEPYVPMRPIVEGMGMNWASQYTKIKQRFNTCVVNITMQLPGDKQHRDVVCLALRKLVGWLATISPNKVKSGIKDNVIRYQNECDDVLYDYWTKGIAVNPRKRSVMEELNQACADLKRDKQLASVFGTGLNEWKKVRPEHESKINKLVGQATDLLLDFVLAETGKGKTTRTQ

SEQ ID NO: 10233 - protein, 142 aa, Xenorhabdus bovienii
  Coding DNA sequence: Name=SeqID_4125
  Homolog annotation: Query=26..132bp; Hit=17..120bp; Blast score=71; Percent Identity=36.0; E value=3e-12; Homolog= ref|NP_456403.1|
MYINRLGLVFLSGDVAMKFNSQHFTLGALVIISGLLWFYYSEYREKDKAYTELDTKYKNQQAITDNAFQSIRIINDISRINRESRDRSAVDSEQAKTAIKTVVANNDCANRLVPDGAVIRLQQHTNRIRSGATDTYSGTSAR

SEQ ID NO: 10234 - protein, 82 aa, Xenorhabdus bovienii
  Coding DNA sequence: Name=SeqID_4126
  Homolog annotation: Query=3..80bp; Hit=26..103bp; Blast score=82; Percent Identity=64.0; E value=1e-15; Homolog= ref|NP_050977.1|
MIAPIALCLMGLLSGCSSTRTEYVPVPPIPIPAHLLADCLPPVIPDTMTWSDSLILNEQLLTVIEQCNLDKQAIREIEEKGK

SEQ ID NO: 10235 - protein, 96 aa, Xenorhabdus bovienii
  Coding DNA sequence: Name=SeqID_4127
MNGLSKGEYKTNRKMHNRIFKYRQLKFYQYSKVAVGDTTTLNIYVYKWFIVLIAIPMLLYGSFVIGFIPTFKELIDLWEEPVSFDSLRQIPDGLLN

SEQ ID NO: 10236 - protein, 133 aa, Xenorhabdus bovienii
  Coding DNA sequence: Name=SeqID_4128
MNSPEIRLSYRSSIKDLSITILHAIFFPLYAAWRWWKLHMASKKEILDDLSRYREKSDKLAENVYSISMKSLEILSEVERLLKQGGEHQELITQIHEFSEIVLLSSNDTYEYSSSLMKDYIPAIKKISNSSED

SEQ ID NO: 10237 - protein, 125 aa, Xenorhabdus bovienii
  Coding DNA sequence: Name=SeqID_4129
MPSLLSEIQQKINKSNELYSVNKKAVASEELELKEKREQDDKARHSLTFHFVWGFFGLIVGCFLFVLWYNSHAIDWIKTLNTQGLSDAAASVKLLELDKVLSVIIGALGTSLGFIIGYYFKEKKG

SEQ ID NO: 10238 - protein, 340 aa, Xenorhabdus bovienii
  Coding DNA sequence: Name=SeqID_4130
  Homolog annotation: Query=35..325bp; Hit=6..263bp; Blast score=273; Percent Identity=50.0; E value=5e-72; Homolog= ref|NP_597905.1|
MPSVNAGGIFVSEFRALTAHINKTQPYRKSNLRNPLMGISAGGFLREQVRFSIRKYPMSNIIPFEYDGHPIRFNEEGWINATDIAMKFDKEPTAWLRQIDVLEYISALSFRVFGISGTVPEINEIKRLAISSGAARAKILRFAKKSGLVKVKSGPTGGTWLHPKLAIRFARWLSVDFEIWCDEQIDVLIRGIQPTFTDQRINAIFLLDKPATWEKRFQQPFYQALSRMSGLPYKGHVGGTPSLFGMITSKWVYQVVLPDSVYAEAKEAAKSSGDKIHQYLKPEARKLVQEQLKAVTILANGCVDYKDFEARCVQSFGKSGEQGLLILPIEREFSYSAVRH

SEQ ID NO: 10239 - protein, 151 aa, Xenorhabdus bovienii
  Coding DNA sequence: Name=SeqID_4131
MEIRINEDGSARVTTAGYIAFYDKEGRLKMVIGRLVHTTGELDPVPQRLTDILPVKLITELVFKQKAEKEQASKTYDAGMTLAVDTGNKAGITSDSFKAFDVAGNVYVKEAGIDAKAIRASHDDHIRQIVREEIRQFVNRESRGNGLFSRR

SEQ ID NO: 10240 - protein, 120 aa, Xenorhabdus bovienii
  Coding DNA sequence: Name=SeqID_4132
  Homolog annotation: Query=12..109bp; Hit=4..101bp; Blast score=155; Percent Identity=73.0; E value=2e-37; Homolog= ref|NP_037756.1|
MVYSQGGDAMSQPRIYGSKWNKARLAFLQQHPLCVMCHQQGRVTGATVVDHIIPHKLKGALDSGNKPEIAKAQKLFWDTKNWQPLCDSHHNSTKQRMEKRGKVVGCDINGLPLDPHSHWN

SEQ ID NO: 10241 - protein, 70 aa, Xenorhabdus bovienii
  Coding DNA sequence: Name=SeqID_4133
MTEDEQTLLMFKGLMASLNEQQQRHVDNCLNTIRQLMDDYPEGEALIALGYIGAEQQMKGNWGQGETVDR

SEQ ID NO: 10242 - protein, 36 aa, Xenorhabdus bovienii
  Coding DNA sequence: Name=SeqID_4134
MMTPADRRQPSKITLTRFFSFNRSPLWPKNGIAQTV

SEQ ID NO: 10243 - protein, 158 aa, Xenorhabdus bovienii
  Coding DNA sequence: Name=SeqID_4135
  Homolog annotation: Query=1..158bp; Hit=1..160bp; Blast score=199; Percent Identity=78.0; E value=1e-50; Homolog= ref|NP_037662.1|
MAEKRDRSDSVSAEIQAMKNAAADTIEPPIHAGLEKKAEPFWHDNIRSKALDSWTPSDLLAAVELANNQLEITLLRKELRKKERVQGEGRDEDVIKTLRKQIVELQRTILAQRRDLQIHSHATNGESRDQRKRNQNDAEARRVRDEMQGDDLLASPVH

SEQ ID NO: 10244 - protein, 505 aa, Xenorhabdus bovienii
  Coding DNA sequence: Name=SeqID_4136
  Homolog annotation: Query=1..501bp; Hit=1..502bp; Blast score=742; Percent Identity=72.0; E value=0; Homolog= ref|NP_037663.1|
MTRGERVIAFIERYCIVPEGELIGQPMRLDAFQQKFLLETYDNPVGTDKAYLSIARKNGKTGLIAGILLAHLVGPEALQNTQIVSGAMSREQAGIVFNLAVKMVNLNPKLQEIVHIIPSGKKLIGKPRNVEYKALAAEGKTTHGLSPVLAILDEVGQIVGPRSDFVDAIITSQGAHKSPLLIAISTQAANDADLLSLWLDDAKHSHDPHIVSHVYEADKEADILDPAAWQAANPALGNFRSLKDMQRLAEMASRMPSQENMFRNLNLNQRVSMSSPFISRNVWEAGAKPLKPLVGRCYAGLDLSESKDLTALVIIGQSEDGMWNVHPYFWTPKKTLLDRAKTDRVPYDVWEKQGFLRTTPGSMVDYDFVVQDIAEIIGDFAIEVITFDRWRIDIFKKAAEHIGLTLPLVEFGQGYKDMAPALDKMEQLLLNGQVNHGNHPVMNMCAANAITVKDAASNRKLAKDKSTGRMDGMVAFAMAVGASHEMETEQGDIDGFFDDPIIVGI

SEQ ID NO: 10245 - protein, 443 aa, Xenorhabdus bovienii
  Coding DNA sequence: Name=SeqID_4137
  Homolog annotation: Query=6..421bp; Hit=5..422bp; Blast score=366; Percent Identity=46.0; E value=1e-100; Homolog= ref|NP_743722.1|
MKTEKQPGRVKSALLNWLGVPLSLTNGTFWQEWIGTSSSGKVVTADKAMQLSAVWACVRLLSESISTLPLKIYRTKTNGSRELAKDHPVYRVLCRQPNAEMTPSRFMLMIVASLCLRGNAFVEKRYIGSKLVALLPLLPQNMVVKRLENGQLEYTYTELKGRKRVIPLKHMMHIRGFGLDGVSGLIPVQVGRDVFGTAMSIDEATGKIFENGLQSTGFLSAKTALDKDQRERLRKNLQQFAGSKNAGKLMVLETDLSYQSVTMNPEAAQMLESRTFSTEEICRWFRVPPFMVGHITKQSSWGASVEGMNMQFLTNTLRPLLINIEQEISRCLLNDDEDFYAEFSVEGLLRADSAGRSAYYTTALQNGWMSRNDVRRLENLPPIDGGDIHTVQLNLTPIEQLGKAGNGSESEKVRAQIVDWLFPERSEPPPTSSNTNVKPHSEE

SEQ ID NO: 10246 - protein, 274 aa, Xenorhabdus bovienii
  Coding DNA sequence: Name=SeqID_4138
  Gene classification: Gene name=ClpP; Function=Protease subunit of ATP- dependent Clp proteases; Function class=N Cell motility and secretion
  Homolog annotation: Query=1..252bp; Hit=1..260bp; Blast score=198; Percent Identity=46.0; E value=6e-51; Homolog= mlr8523 COG0740
MSKKQLPVAPEGRPCASISCELKPKALDSWHSGIKAASTDNTIAILDVIGEDFWGEGVTVKRISAALRAVGGGDVVVNINSPGGDMFEGLAIYNVLRAYEGKVTVKVLGIAASAASIIAMAGDEIQMGRGAFLMIHNCWALGIGNRHDFAKLARDLEPFDNAMGDIYRARSGLDENTIVQMMDNETYIGASEAIDRGLADSLMSAEVIESGDESHQAALRKIDALLAKTNTPRAERRKLIQSLTGSPPGATPEINPETLAALQQAVNAFAPAHL

SEQ ID NO: 10247 - protein, 404 aa, Xenorhabdus bovienii
  Coding DNA sequence: Name=SeqID_4139
  Homolog annotation: Query=1..398bp; Hit=1..393bp; Blast score=325; Percent Identity=46.0; E value=9e-88; Homolog= ref|NP_061502.1|
MSDTNELLKGLSAKIEEANGKFNAKAEEALNEAKKVGGLSAETKAAVDKMATELNALRESEKTLKASLGELEQHVAQMPLQNAVQAAKTIGQQLISAEVLKDINASIPASKRISVPVQAALTSSGVAEGVVEPQRLPGVDVAPKQRLFIRDLIAPGKTTSSAIFWVQQTGFTNKAAVVPENTAKPYSDIQFETKITAVTTVAHMFKASKQILDDFAQLQSLVDAEMRYGLKFVEEQEILFGDGSGAHLHGIIPQASKFKAEFKVDKQNGIDDLRLAMLQAQLARFPASAHVLHFIDWASIELAKDSLGRYILGNPAGLIGPTLWGLPVVATEAAAFRGKFLTGAFNAGAQIFDREETNVVISTENTDDFEKNMISLRCEERLALAVKRPEAFVYGDFTVPKSGE

SEQ ID NO: 10248 - protein, 67 aa, Xenorhabdus bovienii
  Coding DNA sequence: Name=SeqID_4140
MKLTVLRAIYFEGQVITEGHVIDTVEQHGRELIQKGYAAETAETHTLTEPTEPTEPTEPTEPEDKGE

SEQ ID NO: 10249 - protein, 106 aa, Xenorhabdus bovienii
  Coding DNA sequence: Name=SeqID_4141
MLSLELVKAQCKVEYPDDDDLLNTYIGASVKYVENYTRRSLYPDKEAKGYADDPDHLLLTADVQAAMLLLIAQWYENRSAASVGQSVSSLPFSVAALLQPYRIYGL

SEQ ID NO: 10250 - protein, 106 aa, Xenorhabdus bovienii
  Coding DNA sequence: Name=SeqID_4142
  Homolog annotation: Query=1..104bp; Hit=1..107bp; Blast score=91; Percent Identity=47.0; E value=3e-18; Homolog= ref|NP_037670.1|
MHIGKMRHRITLQNFTPVRLPSGQKVQEWQDIATVWAEVKHISGRELLASGAALSEATVRIWLRYRADVTSASRLVFKGQVYDIQAVIPDGKCTQLELLCKQGVRS

SEQ ID NO: 10251 - protein, 148 aa, Xenorhabdus bovienii
  Coding DNA sequence: Name=SeqID_4143
  Homolog annotation: Query=1..148bp; Hit=1..148bp; Blast score=163; Percent Identity=55.0; E value=5e-40; Homolog= ref|NP_309574.1|
MIVTDLDFSGLQEIARDLEILSKAENSKVLRQATYAAASVLRDEARVKAPKRTGKLSRNIVASNRKSRNGDVLAGVYVRGSNAKGTNSDPKMKKSDPRNAYYWRFLEYGTSKLAPRPFARPAFDAKSDEAAKFALKRLNQAIDEVLSK

SEQ ID NO: 10252 - protein, 111 aa, Xenorhabdus bovienii
  Coding DNA sequence: Name=SeqID_4144
  Homolog annotation: Query=1..109bp; Hit=1..112bp; Blast score=93; Percent Identity=48.0; E value=7e-19; Homolog= ref|NP_286891.1|
MTEADIFPLLAPVLPDQVFPYVAPQSAPSVSPPWCVFSLYSIDQDVLNGQAGQLNNLQIDVYALTIDAAREIRDKARIALMPLKPTQLSETNSYESDTGLYRATLECQIWQ

SEQ ID NO: 10253 - protein, 157 aa, Xenorhabdus bovienii
  Coding DNA sequence: Name=SeqID_4145
  Homolog annotation: Query=1..153bp; Hit=1..152bp; Blast score=154; Percent Identity=53.0; E value=4e-37; Homolog= ref|NP_037706.1|
MSSKYEKAQGTKVSISATAAKEANPVTAVWQDIDCTTKEVSYTGGQKSDIEVTTLCSTEQEMTNGLAAPGEITLSGNWSADEAGQNTLRNAYDTDELHAFKVQFPTGNGYAFLAEVRQNSWSVSASGLVTASFTLRLKGKPVPLKQAATLTKDTSQG

SEQ ID NO: 10254 - protein, 128 aa, Xenorhabdus bovienii
  Coding DNA sequence: Name=SeqID_4146
  Homolog annotation: Query=5..128bp; Hit=18..140bp; Blast score=137; Percent Identity=58.0; E value=4e-32; Homolog= ref|NP_287973.1|
MAKAKKDLRSLALAPGAGFRSKTVTVPEWGDVAVILREPSAGAWALWQAVISPTEDEEAQPLSVAEKTRRNVRGDVVLFIDVLWDEDGEQVFSPDDDDTVAGIYGPVHARLLHQALDLMTSQADAEKK

SEQ ID NO: 10255 - protein, 91 aa, Xenorhabdus bovienii
  Coding DNA sequence: Name=SeqID_4147
  Homolog annotation: Query=1..88bp; Hit=132..220bp; Blast score=102; Percent Identity=56.0; E value=1e-21; Homolog= ref|NP_037707.1|
MMTLALRLGKTLHELQRDMSASELLCWMAYDRRSPLSDRRGDIQAAQIASAVYQSQGGKVKLEDTLLQWGADPQQDEQELSGLEGFLSNLS

SEQ ID NO: 10256 - protein, 1125 aa, Xenorhabdus bovienii
  Coding DNA sequence: Name=SeqID_4148
  Homolog annotation: Query=1..1083bp; Hit=1..1047bp; Blast score=565; Percent Identity=40.0; E value=1e-159; Homolog= ref|NP_287971.1|
MAKLRELIIKISANSASFQSEIARASRMGAGYYRTMEKGGRQAASASRNSQQAMRELNGQLASVRDTAKGMAGAFAGMFATGRLISMADSYNSLNARIKLATTSTEDFKNAQQGLLRISQYTGSTFESNASLFTRVSSSLREYGYSTKDILSLTDSLATGLQVSGASAEETASLITQLSQALGRGVLRGQDFNSVAQSGQRIMKALSDGLGVAQKDLKQLADAGELTTPKIVPALVSQLETLHKEFDSMPNSVSAASTRVMNAFQQWVGEANQTTSATATLSGVLDGVAKNIDTVAAAGAILVAVGAARFFGGMMSGAKTATGRILETRLAEVALAETQVRGTQISTARARAAVYRAQQALVAAKGTDKQTQAEERLSRAQATLKRNTDARTAAQNRLNGVTSVGSRLMGGALGLIGGMPGLAILAGSALYFMHQKQEQAKQSALELRNSTELLTESLKEMSSLEVNKRVFDTQDQITAQNEAIEKQEKLVEARKADMVRIRIVAEKGVKTLYSADPVTQLTEATRVYNNEVNNLALMQEGLSNKQKELNLLQFRQTGLLRDNYVEMLNTSDILPILTLAGSDFNRILSVGNRLLQERTTLTPVPFALPQTPLSDEQQDFLKKSARDLELSALQGAAKVKRQAEFAAEDQKLNTPQYQNHYQKYINDSVAIYQNGEKAREAQAAAAKATSEAAKVAREAASAQENYRNKVADLNREIQVEQVRMKDGETAAALFASSLDVSAKYTGKQREELIRLSQASILAKQRTQDLQDAIESDPYRKAAAARKEAEEQVQRQIAAKDIQSVEESARRKQEINLNYLNAVAEANQRYAVSPSAELVGNVDPLQDIQNQLERRKALIQTYATEGLITEQRKNELIIAADNETNERRYEAAMQLYASQGRIQKMTVDLFSTTKERMTNMLTGMLTGTQSFKEGMIGLFSSLTQSIIQNLMDMTAEAILTSNTLKSIMGVAGGFFGGAGGGGTTLANGQAVPMLPQNISVNAKGGVYDSPSLSAYSGQVVSTPTFFAFAKGAGLMGEAGPEAIMPLARTGNGNLGVRLVGGNLPSSNSAPNIQVYITDSGGRSQTANGADAGFGENLARAFAQVYYAERDKDLRPGGTINRAIRGR

SEQ ID NO: 10257 - protein, 110 aa, Xenorhabdus bovienii
  Coding DNA sequence: Name=SeqID_4149
  Homolog annotation: Query=1..108bp; Hit=3..110bp; Blast score=142; Percent Identity=57.0; E value=1e-33; Homolog= ref|NP_037711.1|
METFNWSPRTSTSATVDFKIRKAAFGDGYTQVSGDGIHPRSQKWALDFVGNEKYIRAILEFLDRHQGHKSFIWKPPLSDTGLYRCEGYKTSALGGKNYSLSAEFVQAYHS

SEQ ID NO: 10258 - protein, 249 aa, Xenorhabdus bovienii
  Coding DNA sequence: Name=SeqID_4150
  Homolog annotation: Query=2..249bp; Hit=3..250bp; Blast score=380; Percent Identity=71.0; E value=1e-104; Homolog= ref|NP_405670.1|
MISADVQKLEPGNVIRLYEVDGTAFGADTLRFHAYGIPHTPAEIEAAKRDPDKFKPKSVWWQGEEYGAWPVKIEGLDMSSDGQSARPKLKVANLDGLITALCLRFEDMVQAKVTVHDTFVHYLDAVNFPEGNPTADPEQERKQVFYVDRKESETDEMVTFELASPADLEGLKIPTRQIHSVCTWCSRGWYRTGKGCDYAGSRYFDENDNPVDDPSKDKCPGRLKSCKLRFGEDEPLPFGGFPGAALIRR

SEQ ID NO: 10259 - protein, 234 aa, Xenorhabdus bovienii
  Coding DNA sequence: Name=SeqID_4151
  Gene classification: Function=Uncharacterized ACR, PAD1/JAB1-related; Function class=S Function unknown
  Homolog annotation: Query=4..123bp; Hit=6..126bp; Blast score=106; Percent Identity=44.0; E value=2e-23; Homolog= PA0639_1 COG1310
MRDSTLQAIFEHTKAEYPKEACGVIAQKSRVEKYFPCRNLAPDPSEQFHLDPLGYAAADEWGAITAIVHSHPDATTQPSELDAAQCDATELPWHIVSWPEGDLRTIYPRGELPLTGRPFVLGIYDCWGLIMSYYRQEHAIELPDYRVDYPWWEQGENRYMDNWQACGFGEFSDTPQIGDVVIMQVQADVPNHAGVLLAGNFLLHHLYGQLSQKVPYGGYWKDRAIKILRHKNLF

SEQ ID NO: 10260 - protein, 121 aa, Xenorhabdus bovienii
  Coding DNA sequence: Name=SeqID_4152
MRKILLLLTLLILVGCGVTPKELRSMKPYAEFSSTKSPDFLSKCIASGLETRSYDGIGAQVYFRPMNNGMSISTFGNIVLIDIFSEGSKTLVKYYSAYTHTWTWGKEDRINAAVQDIKSCI

SEQ ID NO: 10261 - protein, 204 aa, Xenorhabdus bovienii
  Coding DNA sequence: Name=SeqID_4153
  Homolog annotation: Query=8..203bp; Hit=9..205bp; Blast score=200; Percent Identity=58.0; E value=1e-50; Homolog= ref|NP_405677.1|
MAYIDIPMRTVRLHGPLISRFGKEFKYKARDARHAISAMHCLLPGFEKYMAEAHKKGLTFAIFVGGRNIGQDEIDMTKGTETIHLLPVIIGSKRAGLFQTILGVALVAIATIATNGFAGGLAASGWWGTAAMAGASMALGGVVQMLSPQMSGLRMRESPDNKPSYAFGGPVNTTAQGNPVPVLYGTREIGGAIISAGVYTEDQQ

SEQ ID NO: 10262 - protein, 1060 aa, Xenorhabdus bovienii
  Coding DNA sequence: Name=SeqID_4154
  Homolog annotation: Query=1..1060bp; Hit=1..1067bp; Blast score=1284; Percent Identity=59.0; E value=0; Homolog= ref|NP_405679.1|
MGHHLIQGRKGGGGGGYTPVESPDSIQSIAKAKVLLALGEGEWGSNLDATHIYLNGTPLANPDGEMNFTGAKWEYRAGTQSQEYIKGLPVAENEIRLGVELKSGTPWIRSVSNTKLSAVRLRLGWPVLQQQHDNGDITGYRVDYAIDLATDGGAYKEVLKAVVDDKTTTLYERSHRIDLPTASTGWQIRVRKLTPDTKNSRIADKMNIMAFTEVIDAKLRYPNTALLYVEFDAQQFPNIPQISCKPQGRIIRVPDNYDPVSRTYSGIWSGQFKWAHSDNPAWVFYDIIVSEMFGLGNRINSTQINEAELYRIAQYCDQPVPDGKGGSGTEPRFTCNVYIQSREEAWTVLADLAAIFRGTTYWGANEFVTLADMPADVSYIFNQSNVIGGDFSYSAASVRTRYSVAMVSWSDPDNHYADTLEAISDDELVRRYDINQTELTAIGCTRQSEAQRRGRWALLTNARDSVVSFKVGLEGQIPLPGHIIGVAHKNRAGRVIGGRISAVSERNITLDRKPEAKAGDRLLVNLPSGVSQGRTIQAINGSIVTVTTAYSEIPRAEAGWAIDANDLFIQQYRVTSIRDSGDGTFEISAVYHDPDKYERIDTGTRIDARPISVIPPGVQPPPKNVGISSYSVVNQGIAVTTLRVTWNAAESAIAYEAEWRRDNGNWISAPRTSTQGFEVPNIYAGRYQARVRAINAAEISSLWANAPETHLKGKEGNPPAPLGFKATPIIFGIQLDWGFAPQTDDTLKTEIQYSKTNDGEGLMLLADIPYPQRTHTMQGLAAGVAFYFRARLVDKSGNQSPWTAFIRGESSSDTNWIIDAASKEFLSNKAGQRLQSQIDFNSEAIMENAALTGAVVQRQLKENGNIKAEILEVKTTQVTDRQAFAEDMKKVQAEVGENAAAVQTKATAVFDIDGNGYAINYVGAGVKYNNQFYKAGMVIGAEVKNGQVTTSIGFNAENFGWFNPASGKMEPFMMAKNGQLFVREAFFDKTTIQKLLIGAEIKSVNYIPGKSGFYWNMQTGQMENIGSDSQGKMKQTNTTISIADEKGRLRGQFGKITGVF

SEQ ID NO: 10263 - protein, 102 aa, Xenorhabdus bovienii
  Coding DNA sequence: Name=SeqID_4155
  Homolog annotation: Query=2..101bp; Hit=3..99bp; Blast score=60; Percent Identity=36.0; E value=6e-09; Homolog= ref|NP_597886.1|
MWGFQTWDEKGKPNNSGVIPFLIAGTITVPKGQTSFSYSYVLPDGYKLDYTIMDNGGDIMANLDDRQKYEIRVHGNTISAHPSSLGIPSASGKKVLVFYRRV

SEQ ID NO: 10264 - protein, 203 aa, Xenorhabdus bovienii
  Coding DNA sequence: Name=SeqID_4156
MFGALLTAPDGTPWLLPQSTPMCLKEIVTDYRQITKVPDSVNRMIFTQRNLDNDEYKYYVFTDEPQTPPIGKWAVCFWDENGKCIVHSLSKTLSVMGSMEDISSTSWYWQTRDYKETVKGSAAVLSTVAGYGFFLVHSHGSDGSSMPLPIHVRWEPYAHKKGNTTTIGYASGDEFLLNKSTINSERFTGIHSRIVYIDTAIYD

SEQ ID NO: 10265 - protein, 482 aa, Xenorhabdus bovienii
  Coding DNA sequence: Name=SeqID_4157
  Homolog annotation: Query=317..479bp; Hit=262..424bp; Blast score =184; Percent Identity=57.0; E value=2e-45; Homolog= ref|NP_929297.1|
MIYSDGTTNLVSGSAIVRGTGTKWKSNINGIAAGQVILIQSGNGNLLHMIQAVNSDTELVLADNARATLNNAKYQIQTTVPDTVSDGVRHMCAINAAIILFLQNMDRWMSENGKVEVEMPNGQKVTLDSIRALQAAMDGKLVKEQNGADIPNKPKFVNNLGLARTVELAKNALPKAGGWIDGDVAVRSRDAALRLWADGDSGLYMTYHQNSKRSAWMGYGSDGSKTFTISNEKAGSTISLDKNHAAIYGAQSFIISSGYEYSGINITKPSGTFFRLETDTDQSVSIVNFVDRNPDNSNRSVQSLPKGNGTLLSLGANCWRDDNGFIRLSSPIIIIHPDGTFVTNDESEGATVTKLGLGHYRISGILGYNADGAWGVHGGISVPRDVNGNELVYVEDKVLPDGAIEIRVTHRQNAHMPARLQNRRIKSQDEQTHYTDDEPCDLPAGTRLDVRVQMPEDSIWNQKQVLVSDPQQEHGATSAINK

SEQ ID NO: 10266 - protein, 227 aa, Xenorhabdus bovienii
  Coding DNA sequence: Name=SeqID_4158
  Homolog annotation: Query=5..224bp; Hit=47..262bp; Blast score=95; Percent Identity=28.0; E value=9e-19; Homolog= ref|ZP_00042241.1|
MSSSSEKIEIKAGVKVPFVQASTGHADGLTKSQEQLFDSSYGLPFELLSTLQEKGLLKQELKGKALGELVLISGGISIFDVNIVVESFPTMKKIMQMTGYGPKGKQEKKDFDTGSEFLKLAPKSTQIDFTDTEGNSVWMSVNSSNLTISTGDIALKYGSIIPGTWHVVGVIDAHPDALTDNSDTPYQPIVSEFKTSFSAVFSMIREKMGRPPEAYGITPIMIFRAVS

SEQ ID NO: 10267 - protein, 58 aa, Xenorhabdus bovienii
  Coding DNA sequence: Name=SeqID_4159
MLKFTLKDKRSLEQNHESDVQNAFDYVNSKQKEFMEKKEKFDEDIKRGSRLTKHKFTL

SEQ ID NO: 10268 - protein, 172 aa, Xenorhabdus bovienii
  Coding DNA sequence: Name=SeqID_4160
  Homolog annotation: Query=28..172bp; Hit=230..375bp; Blast score=201; Percent Identity=62.0; E value=3e-51; Homolog= ref|NP_927397.1|
MQDKKPDISELKDTTLAQQSYEDFGYTVIPIGVPVPWPSEIPPDGWLKCNGEVFDTEQYPKLALAYPSGRLPDLRGEFIRGWDDERGVDSDRNVLSWQEGSYLVQDVNDKTDTVVNFSLDERSALKWDPPSSNVQVRAKAVTGASWEWNTDSTHIGVSRPRNVAFNYIVRAA

SEQ ID NO: 10269 - protein, 78 aa, Xenorhabdus bovienii
  Coding DNA sequence: Name=SeqID_4161
LAQFQSDKFLADRANWDLKAHLSGNAYFGDNPLIFNQAAYLQFAYNLSVSDTDSQTLCGSFSDAQKEKVLRIILRASF

SEQ ID NO: 10270 - protein, 57 aa, Xenorhabdus bovienii
  Coding DNA sequence: Name=SeqID_4162
MVSVLAGKSHRRTVRREATVAIGQKLALKMIRNTFSFCASLNDPHKVCESVSLTLKL

SEQ ID NO: 10271 - protein, 45 aa, Xenorhabdus bovienii
  Coding DNA sequence: Name=SeqID_4163
MIKISMLRLKMLFRSYRFTSDEIRRQSFTHFCTKNSKRYRPLKTW

SEQ ID NO: 10272 - protein, 34 aa, Xenorhabdus bovienii
  Coding DNA sequence: Name=SeqID_4164
MKAKGMVEITIPSPAYINQDVISHLEMIRFFVHE

SEQ ID NO: 10273 - protein, 96 aa, Xenorhabdus bovienii
  Coding DNA sequence: Name=SeqID_4165
MGRSGFNQGRFSHVPDKGFMADERRATIDILALVVTFFGLGGMFKTAAGVGNMIAQGAFHHNMSALLKRTASSVRQWRDYSKSGAHVSIRNFHFQL

SEQ ID NO: 10274 - protein, 249 aa, Xenorhabdus bovienii
  Coding DNA sequence: Name=SeqID_4166
  Gene classification: Function=Phage protein D; Function class=R General function prediction only
  Homolog annotation: Query=31..237bp; Hit=135..320bp; Blast score=77; Percent Identity=27.0; E value=2e-14; Homolog= PA0628 COG3500
MADINVNAICLGASPVNQFARPVRIDKTLAEINLSHIDQTNESDGSFLTRLAKQEGAIATVKNGCLLFIRQGQNKVASGQPLPAVILTRQSGDGYRFSLADRGAYTGVSASWLNTREPKKKENITVKRRRRKPSKANPQKKDEKKGDYLIGSEGNVLVLKHTYANKTNAERAAKAEWEKIQRGVASFSIQLAKGRPELFPEMKVQVSGFKPQIDAADWTLVTVTHTLNDSGLISALELEVKISDADMSA

SEQ ID NO: 10275 - protein, 309 aa, Xenorhabdus bovienii
  Coding DNA sequence: Name=SeqID_4167
  Homolog annotation: Query=12..309bp; Hit=291..588bp; Blast score=522; Percent Identity=79.0; E value=1e-147; Homolog= ref|NP_457866.1|
MAEVNLSQRFVYPYWSGKLINRGRAKADRIDIDVSHDVLGGGLRCADGQWRQIVTIEDAVKGGCTLFDLDQLRLEYSPDEYQNLLMCEFMDDIESIFSLPLMQGCMVDSWEIWNDVQPLMLRPYGYNPVWIGYDPAKGGEKGDSAGCVVIAPPLVPGGKFRILERHQWRGMDFRAQSDAIQRLTEQYNVEYIGIDSTGVGHGVYQNVKEFFPAAREFVYNPSVKNALVLKAWDIINHRRLEFDAGHTDIAQSFMAIRRSTTASGNRPTYEASRSEEASHADLAWATMHALFNEPITGDTPQHRNIVEVY

SEQ ID NO: 10276 - protein, 342 aa, Xenorhabdus bovienii
  Coding DNA sequence: Name=SeqID_4168
  Homolog annotation: Query=21..339bp; Hit=26..344bp; Blast score=507; Percent Identity=73.0; E value=1e-142; Homolog= ref|NP_461651.1|
MSRKSKKRQPVKTPAPTQSMEAFTFGDPIPVLDKREVFDYLECALIDNWYEPPISFNGLARSFRAAPHHSSAVYVKRNILTSTFVSHRLLSRQAFDSWALDFMLFGNAYLELRKNRLGQPLSLHHCPAKFTRRGEDLDTYWFVRYGYQSQPYAFETGQVFHLIEPDINQELYGLPEYLAALPSALLNESATLFRRKYYLNGSHAGYILYISDASQNISDVNNIRDALKNSKGPGNFRNLFLYAPGGKKDGIQTIPLSEAAAKDEFLNIKNVSRDDMLAAHRVPPQMMGIIPQNTGGFGDVEKAAKVFVRNELMPLQSKMKQLNDWLGEEVIRFERYSLEDEE

SEQ ID NO: 10277 - protein, 139 aa, Xenorhabdus bovienii
  Coding DNA sequence: Name=SeqID_4169
MTHQRTYISHINDFLEQERRQGRHWRPHRAINEFYYAGPAIITGHPGNHYPLLHLVFSFNGFTESLIYFTGPSPRPISSFVPSIVPNFDLHFGFDIDVNHSMCVVLYRNSFWFESRVDQLPRDMQNATRALMAHWFRYG

SEQ ID NO: 10278 - protein, 100 aa, Xenorhabdus bovienii
  Coding DNA sequence: Name=SeqID_4170
  Homolog annotation: Query=1..100bp; Hit=1..110bp; Blast score=94; Percent Identity=54.0; E value=4e-19; Homolog= ref|NP_848257.1|
MAKSPAERKAAQRQRQQEAGVTKIELLLDNQELDMLKRNCVLKRPRRNPYEVVEYLASLICKDEADLRQKKCGDNLPVAECCFSGEATCWNTLGWHELKL

SEQ ID NO: 10279 - protein, 229 aa, Xenorhabdus bovienii
  Coding DNA sequence: Name=SeqID_4171
  Homolog annotation: Query=18..222bp; Hit=159..386bp; Blast score=89; Percent Identity=31.0; E value=6e-17; Homolog= ref|NP_043485.1|
MITLQLNTEIIYNINRKFVLDLFVWQKRWKANQHHRNRFLHKCRQVGADHYFVLEALSDACRTGRNKIFMSDKDWLRNFVYNVAQYFPEQQTHLTENAEDIRLLTLSNGAEIYFLHGDSSVAGICGDVYVSEWAYSDDPIKLIRLALMISMHTKWRRTFYSSRDSGDNGEAAYKEFFTRNCVKGESAFFDTVTLFDDVENRLDEERIRNMWSPQAFEELFLCRLPHPRW

SEQ ID NO: 10280 - protein, 52 aa, Xenorhabdus bovienii
  Coding DNA sequence: Name=SeqID_4172
MGALQPLVSQIVRLPDRGIRGAPDLGASFLAGLGSGKGNASASATTLAEHTR

SEQ ID NO: 10281 - protein, 163 aa, Xenorhabdus bovienii
  Coding DNA sequence: Name=SeqID_4173
  Homolog annotation: Query=1..154bp; Hit=71..226bp; Blast score=149; Percent Identity=52.0; E value=2e-35; Homolog= ref|NP_670563.1|
MQALDGTVAGAQTIKPNGEKRLVSGSQKKGSFISLSEITGMPDTFIITEGYATALTVSQLHDGVILAAIDEGNLPTVAEQVRERWPTAKIILAADNDMKSGHKNVGKISAEKAAKSVRGWVTLPPTEEKADWDDYRQRHDIEAAKQAFSNGLYQVGKKNQCQW

SEQ ID NO: 10282 - protein, 582 aa, Xenorhabdus bovienii
  Coding DNA sequence: Name=SeqID_4174
  Homolog annotation: Query=193..580bp; Hit=1..386bp; Blast score=466; Percent Identity=59.0; E value=1e-130; Homolog= ref|NP_287328.1|
MSVVINLAEHREKERDPLIPFIDVRNTGVFYATPKLDKETGEIIKPEQWLCSPIDVIGTGIDENDEQYLIVRWKTKGNKDPVIKGVASADIGEREGWRILKAGGVQVTTKSNLRAILADWLIRSHTKEIWSMTAKSGWHKGAYIMPDGSVIGVPQQPVLFNGGSAAAHAYTVSGTTASWREQVARLANNNPFMMLGIATALAAPMIGIVGADGFGVHLYAQSTAGKTTTADIATSLYGKPDEQRLTWYGTALGIANEALAHNDGLLSLDEVGQGANPKHVHTSAYTLFNGKGKIQGAKEGGNRPLASWRTVVISTGEKDIPTFLMEAGIKINAGQLVRLLNIPMERAKTLHGSENGKAHADALKRGCREHYGAAGREWIGYLSSHHEEARQAYIEAQSRWGKLIPESYGEQVQRVSDRFAVLEAALMLGRVITGWKAQDCRDVLQYIFNVWVAEFGTGNKEFEQIVEQAVSFFNAHGMSRYAPLPYDERDLPIRDLAGYREKKGLHDNDPMIFYTLPATFKQEIARGFNVGMFADTLVKSDILKKPASGRSYQGKTPRLKHLGGIQQRAYIMVLVPESDEEA

SEQ ID NO: 10283 - protein, 52 aa, Xenorhabdus bovienii
  Coding DNA sequence: Name=SeqID_4175
MRKLRKLYRQKINGFTGMRLELHTLSEERFHDHELTDKIILNLVGGCARGYA

SEQ ID NO: 10284 - protein, 373 aa, Xenorhabdus bovienii
  Coding DNA sequence: Name=SeqID_4176
  Homolog annotation: Query=1..369bp; Hit=3..372bp; Blast score=249; Percent Identity=36.0; E value=8e-65; Homolog= ref|NP_415977.1|
MKELVDVFSDFPDPRCQGKVKHRVIDILVIAVCAVIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDGHGRTVRRRGWVLPLTSETKHLRSWPDIQALLVTETIRQEHYSDTVTSDFRYYLSSCHDSPAFQLGAIRKHWAIENSLHWVLDVTFREDDSRMRERVATRIFAQLRKMALNIVKRDINSKLSLSARRKSAGWDNGYMEALLFNQF

SEQ ID NO: 10285 - protein, 259 aa, Xenorhabdus bovienii
  Coding DNA sequence: Name=SeqID_4177
  Homolog annotation: Query=1..258bp; Hit=1..269bp; Blast score=210; Percent Identity=43.0; E value=2e-53; Homolog= ref|NP_459880.1|
MKLESALKHFYPKTPTFSDASTSTAPDRMKGMDTAAALGMAGSQAKFGMAAFFAKNEVSEEDKFSTVEELTRYARRTIPKLISKAAGNKLGPCLVILSKMAFEDYARSAASTCQCSECRGKGLIYGMKEVERHPGIIRADGEVIIAPWIEKEQVGELCQKCHGKGVLSSRCRCKGRGVVVDEEKTALQGVPVDKICPRCSGRGYSRVPSSVAYAAIKALIPALTQSSWSRNWKPFYEKLVGKCYAEESSAEAMFSKVTK

SEQ ID NO: 10286 - protein, 150 aa, Xenorhabdus bovienii; identical to SEQ ID NO: 8646
  Coding DNA sequence: Name=SeqID_4178
  Homolog annotation: Query=3..150bp; Hit=250..397bp; Blast score=218; Percent Identity=72.0; E value=3e-56; Homolog= emb|CAC83041.1|

SEQ ID NO: 10287 - protein, 71 aa, Xenorhabdus bovienii; identical to SEQ ID NO: 8647
  Coding DNA sequence: Name=SeqID_4179
  Homolog annotation: Query=1..71bp; Hit=122..192bp; Blast score=108; Percent Identity=74.0; E value=3e-23; Homolog= emb|CAC83041.1|

SEQ ID NO: 10288 - protein, 47 aa, Xenorhabdus bovienii
  Coding DNA sequence: Name=SeqID_4180
MHFGWLHFVVHMRELFDLTKELSVHHKFNSHGVHDVLVRDIHSNQQL

SEQ ID NO: 10289 - protein, 112 aa, Xenorhabdus bovienii; identical to SEQ ID NO: 8648
  Coding DNA sequence: Name=SeqID_4181
  Homolog annotation: Query=1..112bp; Hit=11..122bp; Blast score=199; Percent Identity=83.0; E value=9e-51; Homolog= ref|NP_085189.1|

SEQ ID NO: 10290 - protein, 136 aa, Xenorhabdus bovienii
  Coding DNA sequence: Name=SeqID_4182
MTYFTYRHSSDLIDLVEQSVDHTTLCLSIFWGFLSPNGGFLLPEKQIRVAIPFGWNCMCSILVLLICSHLECGMLITLVDINKDNYEAVCDLSVTDEQLDAVVMIFSAKEQGNGFALRQEKTRYFLHSEWLYHASA

SEQ ID NO: 10291 - protein, 117 aa, Xenorhabdus bovienii; identical to SEQ ID NO: 7232
  Coding DNA sequence: Name=SeqID_4183
  Gene classification: Function=Predicted transposase; Function class=L DNA replication, recombination and repair
  Homolog annotation: Query=1..115bp; Hit=133..248bp; Blast score=81; Percent Identity=39.0; E value=1e-16; Homolog= mll8100 COG3293

SEQ ID NO: 10292 - protein, 158 aa, Xenorhabdus bovienii; identical to SEQ ID NO: 7173
  Coding DNA sequence: Name=SeqID_4184
  Gene classification: Function=Predicted transposase; Function class=L DNA replication, recombination and repair
  Homolog annotation: Query=11..115bp; Hit=6..110bp; Blast score=103; Percent Identity=45.0; E value=6e-23; Homolog= CC0928 COG3293

SEQ ID NO: 10293 - protein, 86 aa, Xenorhabdus bovienii
  Coding DNA sequence: Name=SeqID_4185
  Gene classification: Gene name=WecD; Function=Histone acetyltransferase HPA2 and related acetyltransferases; Function class=K Transcription
  Homolog annotation: Query=1..82bp; Hit=54..134bp; Blast score=58; Percent Identity=35.0; E value=1e-09; Homolog= mlr1969 COG0454
MWVPSDTGQKTTIWRFMVDKSHQNKGIGRKALSLAIEEIRRTEQLEEIEISYVPSNLVAKNFYASFGFIEVGIDEEVKEMLAVIRV

SEQ ID NO: 10294 - protein, 64 aa, Xenorhabdus bovienii
  Coding DNA sequence: Name=SeqID_4186
MQPNDKNPLKQKSFKFILAGMILLFTAGIRLIQYDDLLLGTVESLLAIGLVLFGLKLKKGENKK

SEQ ID NO: 10295 - protein, 42 aa, Xenorhabdus bovienii
  Coding DNA sequence: Name=SeqID_4187
MLKSSMSITCSVILNNSTYRSDRLVQIQGCAPAWPFSYLLAS

SEQ ID NO: 10296 - protein, 67 aa, Xenorhabdus bovienii
  Coding DNA sequence: Name=SeqID_4188
MKYYVHTKTDKQGDHEVHSEGCNHTPLDENRVHLGDFTSCQSAVKEAKRRGYSADGCYWCSSECHTS

SEQ ID NO: 10297 - protein, 47 aa, Xenorhabdus bovienii
  Coding DNA sequence: Name=SeqID_4189
MVVTGVHRNVTHPDISHMNIIKGHLGGLFYYLRNEEIISGRSILIIT

SEQ ID NO: 10298 - protein, 110 aa, Xenorhabdus bovienii
  Coding DNA sequence: Name=SeqID_4190
  Homolog annotation: Query=1..102bp; Hit=4..105bp; Blast score=114; Percent Identity=61.0; E value=3e-25; Homolog= gb|AAO18060.1|
MKENPDFWMHLGDWLISVREQGIWATLAGTMAFFRGRYNGGGWVKVSIDAFMCAMFAWFIRDVLNFMGLNPDLAYIGSVVIGYLGTDFIGQLLRKAAEKRAGGSNDTSDQ

SEQ ID NO: 10299 - protein, 74 aa, Xenorhabdus bovienii
  Coding DNA sequence: Name=SeqID_4191
MTHQISKSACGVDTLLRIRRWWALRRLRNHWRDDMRFLRFARQYKGMSDHFNFYKRYRFLRLLTEYEQQRGTIL

SEQ ID NO: 10300 - protein, 133 aa, Xenorhabdus bovienii
  Coding DNA sequence: Name=SeqID_4192
  Homolog annotation: Query=1..133bp; Hit=1..136bp; Blast score=157; Percent Identity=61.0; E value=3e-38; Homolog= ref|NP_930141.1|
MTRGIRNNNPGNIDHNSANKWQGQLPHDPSIEKRFCRFESPEYGIRALMKLLCNYHKKGYQTVAKMIDRWAPTNENNTSAYIKGVAKALGVDPHQVISVDKVTLIVLAKSIIQHENGKQPYSDDIFTRAFELL

SEQ ID NO: 10301 - protein, 156 aa, Xenorhabdus bovienii
  Coding DNA sequence: Name=SeqID_4193
  Homolog annotation: Query=11..152bp; Hit=10..148bp; Blast score=70; Percent Identity=30.0; E value=8e-12; Homolog= ref|NP_930631.1|
MKWQLKIGAVIVALALIGAAVHSIYSVYAENGRLTQDIETLNKSLSEQVAINATRQEHIRHLAELDAKHMEKLANAESKITQLSDNLRTNVKRVYVKAQCPVSETAAGSGMDGSRPARLEKDAEQDYVRLLGELETLESQFLGLRDYVNTECGRKE

SEQ ID NO: 10302 - protein, 70 aa, Xenorhabdus bovienii
  Coding DNA sequence: Name=SeqID_4194
MWEKRVTDKLKPCPFCGSEAHHYPDGDMEGYSIHCSNYSCVINTFGYLAAKEAEDAWNKRANNTLPPQSK

SEQ ID NO: 10303 - protein, 82 aa, Xenorhabdus bovienii
  Coding DNA sequence: Name=SeqID_4195
MLNKKYSPILIQGIEYAIHIYENTDGEVNIEAVDLDNNNNKINVTTSYDTISDYNRGNDEGLIEFVKKFVIEELQIKATKHN

SEQ ID NO: 10304 - protein, 340 aa, Xenorhabdus bovienii
  Coding DNA sequence: Name=SeqID_4196
  Homolog annotation: Query=35..325bp; Hit=6..263bp; Blast score=269; Percent Identity=49.0; E value=5e-71; Homolog= ref|NP_597905.1|
MPSVNAGGFFVSEFRALTAHINKTQPYRKSNLRNPLMGISAGGFLREQVRFSIRKYPMSNIIPFEYDGHPIRFNEEGWINATDIAMKFDKEPTAWLRQIDVLEYISALSFRVFGISGTVPEINEIKRLAISSGAARAKILRFAKKSGFVKVKSGPTGGTWLHPKLAIRFARWLSVDFEIWCDEQIDVLIRGIQPTFTDQRINAIFLLDKPATWEKRFQQPSYQALSRMSGLPYKGHVGGTPSLFGMITSKWVYQVVLPDSVYAEAKEAAKSSGDKIHQYLKPEARKLVQEQLKAVTILANGCVDYKDFEARCVQSFGKSGEQGLLILPIEREFSYSAVRH

SEQ ID NO: 10305 - protein, 121 aa, Xenorhabdus bovienii
  Coding DNA sequence: Name=SeqID_4197
  Homolog annotation: Query=1..94bp; Hit=1..96bp; Blast score=78; Percent Identity=43.0; E value=2e-14; Homolog= ref|NP_700428.1|
MTELNYEAIGRCKVLREKIEALRTRRHQHVYKLRDETSRLTFSDGHLIPEIAEFDMGLMQSQLKDIALVDSDLMHAVREFNIWCQDAGEPSIKLNPSTKKDLEKLKPLSFDGFPGSALLGQ

SEQ ID NO: 10306 - protein, 247 aa, Xenorhabdus bovienii
  Coding DNA sequence: Name=SeqID_4198
  Gene classification: Gene name=Hcp; Function=Hemolysin-coregulated protein (uncharacterized); Function class=R General function prediction only
  Homolog annotation: Query=1..153bp; Hit=1..153bp; Blast score=150; Percent Identity=49.0; E value=1e-36; Homolog= Z0248 COG3157
MTQSIYLSLKGKKQGLISAGCSTPESIGNRYQTGREDEIQVLSVSHSVSRDQNAHHHPVSFTKPIDKSSPLLAMAIDGNELLEARFMHYRTSPMGQLEFFYEIKLTGATIVDLAYNYPHSINDNGAIPHEVVMLDYKSISCQHIAAGTSGYSITQLSGREEGRPLLSGFSNVIPMKKPLVEETPAKPAKHHARYRCVDDDGNLLTAHKYRVCLPDGQIKEGKTDKQGYSQWHLTDDKNKLEFHLLKD

SEQ ID NO: 10307 - protein, 389 aa, Xenorhabdus bovienii
  Coding DNA sequence: Name=SeqID_4199
  Homolog annotation: Query=274..380bp; Hit=1..120bp; Blast score=128; Percent Identity=55.0; E value=2e-28; Homolog= emb|CAC38405.1|
MPTYTVYTQVKSNVPAEKLLYDLIISRQDEGGNHHILLDVEKAQLQSNYETQKHVTQETDDDLSVMYIMQIMLYRKHGSNTIQALQAPFKKMYTLGEFVAGKACSDNKRENACYFESTAETKPVSDGDNTIELKITIPERPFIAKEYPIGHPDDPFEKNKIESEIQNRISKKNFPDQNGASLCGPAALFYCLQMDRPDIYEQAARELWQYGRTKIGQLEIKPGDGCRHPKGTFYDKYGARISGLDWLTLASLRDSENMIFSYDEVDDKAAGVTMWGKLTEWFEKAGYEKVFSNIGLTHSNKEDIETLNNYIEQGFHVVSLISAGMLQNMEETSGKNHWIVWVDKVEESENGTNVKAFSWGRVKTWVKEDATYEYFIKHTFGGLVFKPLK

SEQ ID NO: 10308 - protein, 155 aa, Xenorhabdus bovienii
  Coding DNA sequence: Name=SeqID_4200
MSILSNTHLEDWFSSHLNKMKKIIFLFFIILTSSCSTISVSVQPKGNYLPDAMVGKNYHTSISIVGGPVIVSDEKKPTKFVIIEPNDSGIEWKPSKKSLIYSGKEEIWDDYNHLVISGKPSKSGEIYITVIGRVYGTMLNGSGEFQKKYTIKVNE

SEQ ID NO: 10309 - protein, 62 aa, Xenorhabdus bovienii
  Coding DNA sequence: Name=SeqID_4201
MVFFGIAIFFKTLFNTIKNNKKASGIQRLNKGKHEDETFTKDFILNGELNRHSVIFIIHLLL

SEQ ID NO: 10310 - protein, 96 aa, Xenorhabdus bovienii
  Coding DNA sequence: Name=SeqID_4202
  Homolog annotation: Query=18..88bp; Hit=10..81bp; Blast score=70; Percent Identity=55.0; E value=7e-12; Homolog= gb|AAF27364.1|AF198256_18
MVLNSVLKKIAIPKNTMKKLLELRQQKATFTDQMRSLLTKAEDEKRSLNTDEAKQFDELRNQSDALNAEIARYEALSDEERNQAKNQPASKNLTAW

SEQ ID NO: 10311 - protein, 208 aa, Xenorhabdus bovienii
  Coding DNA sequence: Name=SeqID_4203
  Homolog annotation: Query=8..174bp; Hit=9..188bp; Blast score=112; Percent Identity=35.0; E value=5e-24; Homolog= ref|NP_759080.1|
MKKARFSYSDEMKQWMKEHYKLTRHELTDAFNGRFNTNRSRENISDLRKSLGLRTRQSAKWQKGDKPVHAGTQGVLKASLGSFKKGHLTWNKQPVGTERINGHGYVDVKLSDPGIWKPKHYLIWEKHHGKRPENSVITFKDCNRLNCDIDNLILITRAEHTIVNNTNRKLKGTATEFKPVLINLAKIKHAIATKTTNDQRPKRGKTHA

SEQ ID NO: 10312 - protein, 199 aa, Xenorhabdus bovienii
  Coding DNA sequence: Name=SeqID_4204
  Homolog annotation: Query=6..186bp; Hit=8..197bp; Blast score=128; Percent Identity=38.0; E value=5e-29; Homolog= ref|NP_759080.1|
MIQRFEYTAEMESWMKANYLRPLGKLTARFNQHFAVNRSNEAINGLRKRLGLRTGRSGQFCKGHRPFNAGTKGLSKPNAGSFKKDQAAWNKRDVGAERVNVYGYTELKVAEPNIWRPKHHVIWEKHHGKRPKGTILTFKDGNTQNCQIDNLLMLTHKEHGVINNYYHAVSVEHKPTAINLARIKIAVASRIKLASEGQK

SEQ ID NO: 10313 - protein, 75 aa, Xenorhabdus bovienii
  Coding DNA sequence: Name=SeqID_4205
  Homolog annotation: Query=1..74bp; Hit=1..76bp; Blast score=70; Percent Identity=57.0; E value=7e-12; Homolog= ref|NP_831647.1|
MKNTLEDLNNHLFAQLERLSDEDLSGEQLETEIRRAKATSGVATQIIGNGKLAFDVQKALGNQEIKSAPKYLEGR

SEQ ID NO: 10314 - protein, 59 aa, Xenorhabdus bovienii
  Coding DNA sequence: Name=SeqID_4206
MAAKLETILFYNEEINRFEVTWSSDLSADPAPKEKIELEKLKNTLKGVLESGIPHGQVH

SEQ ID NO: 10315 - protein, 104 aa, Xenorhabdus bovienii
  Coding DNA sequence: Name=SeqID_4207
MRTRNGFTAFDSVLYRFLVRGDKGLNVHQLIGQQHFVIDNDLGYTRAHTKGIFSGLKAIQISLQQTIQRIFLEVFGGSVALTELQVNFPVFARVPNDAPEPKRL

SEQ ID NO: 10316 - protein, 77 aa, Xenorhabdus bovienii
  Coding DNA sequence: Name=SeqID_4208
  Gene classification: Function=Putative transposase; Function class=L DNA replication, recombination and repair
  Homolog annotation: Query=7..77bp; Hit=27..97bp; Blast score=98; Percent Identity=71.0; E value=1e-21; Homolog= XF2303 COG3316
MPLSRNAFKRLHYPVDIIAQCVRWYLAYALSLRNLEEMMVERGIAVDHSTLSRWVHRLVPLLVKRYRRCKPDVGHRW

SEQ ID NO: 10317 - protein, 153 aa, Xenorhabdus bovienii
  Coding DNA sequence: Name=SeqID_4209
  Gene classification: Function=Putative transposase; Function class=L DNA replication, recombination and repair
  Homolog annotation: Query=1..133bp; Hit=73..212bp; Blast score=129; Percent Identity=50.0; E value=1e-30; Homolog= mll9070 COG3316
MDETDIKIKGQWKYLYRAVDSDGKTVDFLLTARRDKSSALRFFKKAMRQHGQPDVVTMDKSGANKAAVDELNQGKPKEEAIVIRQNKYLNNLIEQDHRNIKRRIHPMLGFKHFRRAQTLLSGIELVSMLRKGQYPQEPECFLSPADFFYQLAA

SEQ ID NO: 10318 - protein, 46 aa, Xenorhabdus bovienii
  Coding DNA sequence: Name=SeqID_4210
MRWFLNSYSNDIEKEIMSHFDACIPLAKQPRYIVHTKCGSVALTER

SEQ ID NO: 10319 - protein, 194 aa, Xenorhabdus bovienii
  Coding DNA sequence: Name=SeqID_4211
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=19..176bp; Hit=73..231bp; Blast score=85; Percent Identity=30.0; E value=3e-17; Homolog= PA2411 COG3208
MSHLVEDIYVNIKSLLNKPYLFFGHSLGSRVAFELIRKINAASLPLPIEFIASGSKGPQVPAIREPLSGLPDKDFINGLQTFGRVDKQVIDNAELLSLILPAIKADFKISEEYHYVGTESFSCTLTVFGGKNDAIVTEQELYSWLDLFEQEKKVIIFEGTHFFIDDNNEPVIDTVQNIIKSKSSQQYNRYPPTI

SEQ ID NO: 10320 - protein, 115 aa, Xenorhabdus bovienii
  Coding DNA sequence: Name=SeqID_4212
MKYTPLGDLTKWELKKIDYSGALLINFPAENKRSVVYIENSKIIALDDKCPHRGGPIHLCRKHSDGKLECLWHGNTIKKPSISKDVSAIYHRTTGKVTLVSVTKTNREWPVKTFS

SEQ ID NO: 10321 - protein, 47 aa, Xenorhabdus bovienii
  Coding DNA sequence: Name=SeqID_4213
MEFLNGFEKSTILNAGEGIIIEHNRLHGALIKSESCDYEIYTIRRLN

SEQ ID NO: 10322 - protein, 180 aa, Xenorhabdus bovienii
  Coding DNA sequence: Name=SeqID_4214
  Homolog annotation: Query=1..171bp; Hit=216..386bp; Blast score=65; Percent Identity=24.0; E value=3e-10; Homolog= ref|NP_484762.1|
MARYASGSYGEIASSLFKIIIDELGYGDFSKHHATLYRDTLNSVNLNSTPHYYWQYYLNGSLLLANYYNMVTKDKRQSFRYIGATYQAETSFITSCKIWKNALKEALPNINVKYFNEHCHIDIDHSRMVFEGLVSPAIDKYGQIAATEIIRGFEEACLISDISEQDFIRQIEWKDNAETI

SEQ ID NO: 10323 - protein, 172 aa, Xenorhabdus bovienii
  Coding DNA sequence: Name=SeqID_4215
MDRWNVTENSYLRSFKMNKKLIRDYKKIENFNDINIGRDAILAFADSEQCIDNGNRYEEQFYGRRIRPHVLKYIDLSSPLTRDNILTYSAFAANRTLFTMNEMDFLMLPEMDKFIWEDYQKFYSDERFITSNAGIRLLEKYLFSFLNDEIIITENWNKERVKEYFSHSQMNH

SEQ ID NO: 10324 - protein, 288 aa, Xenorhabdus bovienii
  Coding DNA sequence: Name=SeqID_4216
  Homolog annotation: Query=10..261bp; Hit=150..439bp; Blast score=80; Percent Identity=24.0; E value=3e-14; Homolog= ref|XP_134425.2|
MLNSSVRSFDTWHYSMLNDNARTIALESAIKELNLNGKNVFEIGTGAGLISMMFAKYGAKKVLTCEINEQLSKEAIAIFKLNNLDKCITLINKSSSKVIDDGDLDFTPDIIFTETIDCGVIGEGFYSISEDIKKIAQPQTIIMPYKIEQYGYLVESKEIYSLNNVAIIKGLDLSPLNRYSTKNFFPVRSHLYENKLLTPLTNIKNYDYLTEISTTETSTFSINEEGICYGMLSFFVAKFGSFYVSNKAGLQSHWHQAFHPLNTPKKVLKYKQYYGSLERDGKFILEEF

SEQ ID NO: 10325 - protein, 323 aa, Xenorhabdus bovienii
  Coding DNA sequence: Name=SeqID_4217
  Gene classification: Gene name=Aes; Function=Esterase/lipase; Function class=I Lipid metabolism
  Homolog annotation: Query=87..302bp; Hit=86..303bp; Blast score=110; Percent Identity=34.0; E value=3e-24; Homolog= mll7218 COG0657
MRAKLTQSMKDYEYTCSNVMDTDFYFKSIDYVRSSYKALFSRFPPKPRDGTVSEDLQFKSSVTDKILDMRIHSPNEQLESKQILPCIIYAHGSGFVSGDLSVVDAMGRDLALDLNVRVVAFNYRLAPEHPYPAALEDCCDVYLFIRQIAKQKGINIDQIYFAGESCGGNWAIALPLWLRDNNLPQLAGSIAINPVLDVHRWAQKKVSDVSKAFCDEMHFFTTSYLGQNEKKLIQYASPLLADNLSGLPPAVFWSAAIDPLSDDVRTLSDRMKQNGINVYVNIEDEAIHGCLRARYHYLFAKKGYENLLLLITNLISLKMKNKN

SEQ ID NO: 10326 - protein, 357 aa, Xenorhabdus bovienii
  Coding DNA sequence: Name=SeqID_4218
  Gene classification: Gene name=Ada; Function=Methylated DNA-protein cysteine methyltransferase; Function class=L DNA replication, recombination and repair
  Homolog annotation: Query=202..354bp; Hit=1..153bp; Blast score=210; Percent Identity=63.0; E value=2e-54; Homolog= PA2118_2 COG0350
MSWSKDNTLLTELDPRWLDIKAKNIKADGHFVYAVKTTGIYCRPSCPTRIPKLHHIEIFDNCEFAENKNYRACKRCNPNGESISTKNERLVTKACRIIENRRGDIKLEELSMQVEISAYFFHRLFKKIIGVTPKQYSTAIRIKNMHNELINKNESITNAIYNSGFNSCSRFYAATDNSLGMTPSVYRKGGKDTLIQFSITECSLGTILVARSLKGICAISFGDNPTELLNSLQDKFSKAEFIGGDLDFENVVAKVIELVEKPGILFNLPLDIQGTVFQQRVWKMLLTIPTGTTISYTQLAEMIGNPGAVRAVANACGQNSIAVAIPCHRVVKLDGDISGYRWGIERKRLLLDREAAE

SEQ ID NO: 10327 - protein, 757 aa, Xenorhabdus bovienii
  Coding DNA sequence: Name=SeqID_4219
  Gene classification: Gene name=LdcC; Function =Arginine/lysine/ornithine decarboxylases; Function class=E Amino acid transport and metabolism
  Homolog annotation: Query=1..756bp; Hit=2..755bp; Blast score=1214; Percent Identity=73.0; E value=0; Homolog= adiA COG1982
MKVLIAKNEVGTRYHSHYIENAVHRLADKLTDRDVEVVIADSFDDSYTIIASNEPFDCLMVSCALMDDDLYREIQRLLNKLFERQENVPVFLLSDREKTVFLLNHELLEQLTEFAWILEDSADFIAGRAIAAMQRYRQQLLPPLMAALMKYSQIYEYSWAAPGHQGGVGFNKTPVGRLYHDYYGENLFRTDMGIERASLGSLLDHSGAFGESEKNAARVFGADHSYSVVVGTSGSNRTIMQACMTEDDVVIIDRNCHKSIEQGLILTGAKPVYLLPSRNRYGIIGPIYPQEMQTKTLQKKLKQNPLTQDMASRKPAYSVVTNCTYDGVCYNAKHVQELLAKSVDRIHFDEAWYGYARFNPIYHDHYAMRGNPKDHAGPTVFATHSSHKLLNALSQASFIHVRDGRNPVDFSRFNQAYMMHATTSPLYAICASNDIAVSMMDGNSGYSLTQEVIEEAVDFRQALARLHRDFNEKGDWFFKPWNQEKVTDPATGKKIAFEDAPRDLLTKEQSCWTMRPGDSWHGFEDLPDDWSMLDPIKVSILVPGMGDNGQLLKRGVPAALVTAWLSQHGIVPTRTTDFQIMFLFSMGITKGKWGTLLNTLLSFKHHYDANTPLSKVLPELVNQHQEVYGNLGLQELGDKMFAYLHQNNPGDKLNHAYSGLPEMAMTPRTAYQAIVTNNVEMVAIDDLPHRIAANSIIPYPPGIPMLLSGENFGDKTSPQIGYLHALQKWDHEFPGFEHETEGTEVINGIYHVMCIKK

SEQ ID NO: 10328 - protein, 442 aa, Xenorhabdus bovienii
  Coding DNA sequence: Name=SeqID_4220
  Gene classification: Gene name=PotE; Function=Amino acid transporters; Function class=E Amino acid transport and metabolism
  Homolog annotation: Query=1..439bp; Hit=1..439bp; Blast score=633; Percent Identity=80.0; E value=0; Homolog= aniC COG0531
MTTVSEMKKVGLIPVTLMVAGNIMGSGVFLLPASLASTGGIAILGWLVTIIGAVGLSMVYAKISSLDDSPGGSYAYARRAFGPFLGYQTNVLYWLACWIGNIAMVVIGVGYLSYFFAILKDPIILTMTCIAILWVFVFLNIIGPHVITRVQAVATTLALIPIVATAVFGWFWFSGKTYMDAWNVSGLNTFGAIQSILNVTLWSFIGVESASVAAGVVKNPKRNVPIATIGGVLIAAVCYILSSSVIMGMIPNAALKLSSSPFGDAARLALGDTAGAIVVFCAAVGCLGSLGGWTLLAGQTAKAAADDGLFPAIFGKVNKEGTPVAGLLILGVLMTLFQFSSISPNAAKEFGLVSSVSVIFTLIPYLYTCAALLLLGHGHFRQEKPRYIVITFIAFAYCIWAVMGTGAEQVVWTLVVMMIVTAMYTFNYNTKHPAPFPLEKND

SEQ ID NO: 10329 - protein, 39 aa, Xenorhabdus bovienii
  Coding DNA sequence: Name=SeqID_4221
MASLAGSKVHLHYLLSLWERDRKSHERLFTLDKFDINHV

SEQ ID NO: 10330 - protein, 363 aa, Xenorhabdus bovienii
  Coding DNA sequence: Name=SeqID_4222
  Gene classification: Gene name=RbsK; Function=Sugar kinases, ribokinase family; Function class=G Carbohydrate transport and metabolism
  Homolog annotation: Query=54..360bp; Hit=1..307bp; Blast score=343; Percent Identity=53.0; E value=1e-94; Homolog= ZyeiC COG0524
MANREKQILHLLRRDPFIQQQEIADILGISRSCVAGHIMNLSKKGHIKGKGYILSDNRYSVTVGAANMDVTSYAFAELIYEDSNPGKIQSTAGGVGRNIAHNIALLGSESYLISVIGNDFYGKTLFEQTKLAGVYVDYFHKLYGETTSTYNSVIDDSGEMRLAINDMNILEKLTPALLSQSKALIQNAGVLIIDCNLTEESLEWLFSHAGNIPIFVDTVSTFKATKIRHWLSHIHTLKPNRFEAEILSGIKIVTLADAADTATWFHQQGVQRLALSMGTAGVYYSEIAGIADCSPAISINIVNANGAGDAMMAGLAHCWLEGMTLEDSIRFAQGCSALTLSSELTNHPNLSLGRVKKLLELKS

SEQ ID NO: 10331 - protein, 314 aa, Xenorhabdus bovienii
  Coding DNA sequence: Name=SeqID_4223
  Gene classification: Gene name=IndA; Function=Uncharacterized enzyme involved in pigment biosynthesis; Function class=Q Secondary metabolites biosynthesis, transport and catabolism
  Homolog annotation: Query=9..310bp; Hit=9..310bp; Blast score=428; Percent Identity=75.0; E value=1e-120; Homolog= yeiN COG2313
MKNNLVLNEYLDISPEVAHALADNRPVVALESTIIAHGMPYPQNVETALEVENCIREHGAVPATIAIINGRMKAGLFQEDIELLGKERHLVAKVSRRDLPFVVAEGKHGATTVASTMIIAEMAGIAVFATGGIGGVHRGAEHTFDISADLQELAITNVAVVCAGAKSILDLGLTTEYLETHGVPLVGYQTEKLPAFFCRTSPFPVSVTLENPQQIAHAMKAKWNSGLRGGLVIANPTPEPFAMPEAQINAAIEQAVREAQEQGIHGKESTPFLLTRVSELTGGESLQANIELVFNNAKLAAQIAIAYQAINKHQ

SEQ ID NO: 10332 - protein, 418 aa, Xenorhabdus bovienii
  Coding DNA sequence: Name=SeqID_4224
  Gene classification: Gene name=NupC; Function=Nucleoside permease; Function class=F Nucleotide transport and metabolism
  Homolog annotation: Query=1..417bp; Hit=1..416bp; Blast score=483; Percent Identity=71.0; E value=1e-136; Homolog= yeiJ COG1972
MDILRSLMGIVILLLVGYLFSVNKKRISLRTVGAALLFQVSLGAIMLYIPAGKWLINNIANGVNAVISYSSAGSSFIFGSLVGPKMNELFDGAGFVFAFQVLPAIIFITSLISILYYIGIMKWVINILGYAFQKAMRISKVEAFAAVTTIFLGQNELPAVLKPFVNKMNRNELFTVICSGMASIAGSMLVGYAGLGVPIEYLLAASLMAIPGGILFARLLSPATEPSQVQFEQISFSETRPASIIEAAAGGAMLGLKIAVGVATVVMTFVALIALINGMIGSIGELFGLTGLSMQSLLGYLFSPLAYIMGVNWEHTDLAGSLIGQKLAINEFVAYVNFSPYLKDPTVLLDTKTIAVISFALCGFANFGSIAVVVGAFTAVVPERASDIARLGLRALLAATLSNLMSATIAGLFINLAG

SEQ ID NO: 10333 - protein, 142 aa, Xenorhabdus bovienii
  Coding DNA sequence: Name=SeqID_4225
  Gene classification: Gene name=UspA; Function=Universal stress protein UspA and related nucleotide-binding proteins; Function class= T Signal transduction mechanisms
  Homolog annotation: Query=1..142bp; Hit=1..142bp; Blast score=113; Percent Identity=44.0; E value=6e-26; Homolog= ZybdQ COG0589
MYRTILVPVDISEEELTSKAVRCALDIARETGAKLHILHVLPISSAIINAYALGYMEIKDKATVKAEEELAMLVDSIDLPNDRISYSISFGSPRDEITSTADEIEADLIVIGSRRPNITTHLLGSNSAGIVRYAKTSVLVVR

SEQ ID NO: 10334 - protein, 145 aa, Xenorhabdus bovienii
  Coding DNA sequence: Name=SeqID_4226
  Gene classification: Gene name=UspA; Function=Universal stress protein UspA and related nucleotide-binding proteins; Function class= T Signal transduction mechanisms
  Homolog annotation: Query=1..145bp; Hit=1..142bp; Blast score=116; Percent Identity=44.0; E value=6e-27; Homolog= ZybdQ COG0589
MYKTILVPIDIPEDQLTDNAIKHAEFLAKISGAKIHLFHAVPDISRFSVNYSYHYDLLSAFAKKAVTNSEEELKKVVEKINLPKDRVSFSVAFGSPRDKVLSTAREIGADLIIVGSRWPDISTHLLGSNASGIVSYANISVLVVR

SEQ ID NO: 10335 - protein, 62 aa, Xenorhabdus bovienii
  Coding DNA sequence: Name=SeqID_4227
MTISTKIEQLEQELLAVVRKYSGNEEVTVITTNSSENNLQIQVIIAGKNQLDITLNSFTDQA

SEQ ID NO: 10336 - protein, 334 aa, Xenorhabdus bovienii
  Coding DNA sequence: Name=SeqID_4228
  Gene classification: Gene name=EndA; Function=Endonuclease I; Function class=L DNA replication, recombination and repair
  Homolog annotation: Query=23..236bp; Hit=15..226bp; Blast score=238; Percent Identity=57.0; E value=5e-63; Homolog= ZendA COG2356
LNSKISLWASYLLFFGLTVSFHALSAPASFEQAKIESRKNVYSGQTKSAIGTLYCGCDWQWVGKSGGRVDLASCGYQVRSQQSRAERIEWEHMVPAWVFGHQRQCWQNGGRKNCVENDPFFRVIESDMHNLAPSIGEVNGDRSNFSYGMVPGNMANMYGACSSKVDFKSRLFEPRDRVKGVVARVYFYMHDRYNLAMSRQQQQLMMAWDRQYPVDGWERERDNKIARIMGHHNPFVTGSQKWELGHKNSGQGLSTQNGVQKQNSFQAAGNQALARNPTVKTAQSEKIKGNKNSQIYHLAHCSGYKTIADKNAVYFGTEAEAKKAGYRLASHCKK

SEQ ID NO: 10337 - protein, 262 aa, Xenorhabdus bovienii
  Coding DNA sequence: Name=SeqID_4229
  Gene classification: Gene name=PhoH; Function=Phosphate starvation -inducible protein PhoH, predicted ATPase; Function class=T Signal transduction mechanisms
  Homolog annotation: Query=1..261bp; Hit=93..353bp; Blast score=390; Percent Identity=71.0; E value=1e-108; Homolog= phoH COG1702
MGRQKTVIKSRREVRRMLKKDLRQSRYRNDDNVTSLVPIGGVEAIGMARENRDTSEIRPHNEMQHRYMWAINNKQLVIANGAAGCGKTFISTVMAADALINKEIDKIIVTRPVLQAEEDLGFLPGDMAEKFAPYFRPVYDVLLKRMGASFLQYCLRPEIGKVEIAPFAYMRGRTFENAFVILDEAQNVTVNQMKMFLTRLGENVTVIVNGDVSQCDLPECITSGLMDALERFSDDEAISVIHFSQEDCVRSRLCQKALLAYR

SEQ ID NO: 10338 - protein, 416 aa, Xenorhabdus bovienii
  Coding DNA sequence: Name=SeqID_4230
  Gene classification: Function=Signal transduction histidine kinase, nitrate/nitrite-specific; Function class=T Signal transduction mechanisms
  Homolog annotation: Query=76..405bp; Hit=235..583bp; Blast score=144; Percent Identity=28.0; E value=1e-34; Homolog= ZnarX COG3850
MKTFSDSPIAATGWLCGAAITINLSVLLFLGLNTPLTLPGKLWVIFDILSILCLLSLLYKADMISLQVASFCKIKQRKITVLKRDRQYLRFLISVHSQLNLNTSLSDNFYRVFFRLNQFIPFGEVRITLYHPPRKYHFEYPRSPFDVNLPRIQKWDLYDRHTFHGIIQIKINQTQILSSYERDLIQSVTDALAKHLSLKNTVHQQIQQGLINERENISRELHDTVAQSFLFLKIQINSLHVRHDKFSRQALIALRIIKEEITLASQQLREMLATLRAEKNHYDLYESLQSLIKGFNHRLGFQIEFYYRLTHQIIPIGHRRHLAQIIREALNNCYKHADASWISIRIYPIGKNIITVISDNGRGIHQEQIKAQFGLAIMRERVTLISGQIKIKKRKKGGTEIEIQFPLQDELSNIKK

SEQ ID NO: 10339 - protein, 52 aa, Xenorhabdus bovienii
  Coding DNA sequence: Name=SeqID_4231
MNKVITESDPPRPSLWKRLGWLVTIWLGSVLALYAASSLFRVLMTTAGMKVK

SEQ ID NO: 10340 - protein, 335 aa, Xenorhabdus bovienii
  Coding DNA sequence: Name=SeqID_4232
  Gene classification: Gene name=AppB; Function=Cytochrome bd-type quinol oxidase, subunit 2; Function class=C Energy production and conversion
  Homolog annotation: Query=1..335bp; Hit=1..335bp; Blast score=432; Percent Identity=69.0; E value=1e-121; Homolog= PA3929 COG1294
MGIDLPLIWFLIIIFSTMMYIVMDGFDLGIGILYPMMKGQSDRDLMMNSVAPVWDGNETWLVLGGAALFGAFPLAYAVILDALAIPLTIMLLGLIFRGVAFEFRFKATPEHQHIWDKAFISGSIIATFTQGMVVGAVIEGFPVENRTYIGGAFDWFAPFPLFCGFGLVVAYALLGCGWLVMKTEGHLQQQMYRILRPLTRLMLAVISIISLWTPIAHQAIAERWFSLPNLLFFIPVPLLVIGSSWKLLQANENTSHYTPFLAALLLIFMGFSGLGISIWPNIIPPMIGYQEAAAPPQSLGFMLVGALFIIPIILVYTFWSYYVFRGKITHEQGYH

SEQ ID NO: 10341 - protein, 445 aa, Xenorhabdus bovienii
  Coding DNA sequence: Name=SeqID_4233
  Gene classification: Gene name=CydA; Function=Cytochrome bd-type quinol oxidase, subunit 1; Function class=C Energy production and conversion
  Homolog annotation: Query=1..437bp; Hit=1..439bp; Blast score=627; Percent Identity=73.0; E value=1e-180; Homolog= PA3930 COG1271
MFGLSALELARIQFAFTISFHIIFPAITIGLASFLALLEGLWLKTRNTDYKTLYHFWSKIFAVNFGMGVVSGLVMAYQFGTNWSFFSEFAGSITGPLLVYEVLTAFFLEAGFLGVMLFGWSRVGERLHFFATCMVALGTIISTFWILASNSWMQTPQGHEIINNQIVPVDWFAVIFNPSFPYRLLHMGTAAFLASAFFIAASAAWHLLKGNDSSAMKKMLSMAMWLILIIAPLQAIIGDFHGLNTLKYQPAKVAAMEGHWENRPGEATPLILFGIPNQEAEETRYAVKIPYLASLILTHSTDKQVPALKEFAPEDRPNVFMMFWSFRVMVGLGILMIVAGVWGLLLRYKKRLYENRTFLRFIFLMAPSGLIAILAGWFTTEIGRQPWVVYGLMRTKDAVSAHGEIHMSISLLIFFVVYAAVFGVGYAYMMKLIRKGPNKELTNGH

SEQ ID NO: 10342 - protein, 473 aa, Xenorhabdus bovienii
  Coding DNA sequence: Name=SeqID_4234
  Gene classification: Gene name=ARO8; Function=Transcriptional regulators containing a DNA-binding HTH domain and an aminotransferase domain (MocR family) and their eukaryotic orthologs; Function class=K Transcription
  Homolog annotation: Query=1..464bp; Hit=1..463bp; Blast score=523; Percent Identity=55.0; E value=1e-148; Homolog= ydcR COG1167
MTRYEQLAGAIRQQIEDDIWQVGDKLPSLRESVKSSGLSLMTVLQAYQLLESQGWIVARPQSGYYVATRLTQFAAAKGGKGLHLSESVEISASIFDVLQACKDPKIVPFGSAFPDPSLLNEPKLSKILASVARRFVPHSSLENLPPGNEKLRRNISRRYAAHGIHVSPDEIVITAGAMESLSFSLQSVTSPGDWVVIESPAFYGALQAIERLRLKAIAIKTDPRTGIDLDALEEIVQKYPIKACWLMSRFQNPLCNTMPSENKQRLVEILNSSHIALIEDDVYGELYFDQEPPMPIKAWDKENNFMHCSSFSKCLAPGYRVGWVAAGKHAGKIQQLQMMSTVSASAPTQLAVAEYLAHGGYDNHLRRLRRQLEQRQSQVLRAISEYFPDSVKVNSARGGYFLWLEFEPPFNANRLYRLALAKGISIAPGSMFSTSSQFDHAFRLNTSFAWNDVQASAMKTLADLCHTLLRECG

SEQ ID NO: 10343 - protein, 63 aa, Xenorhabdus bovienii
  Coding DNA sequence: Name=SeqID_4235
LFRLSRLTIAFLVTLHNRNISFSCHLLTTLKPCVYSQKTVNVELLTPTFANNSAYDNIEIIEM

SEQ ID NO: 10344 - protein, 189 aa, Xenorhabdus bovienii
  Coding DNA sequence: Name=SeqID_4236
  Gene classification: Function=Uncharacterized BCR; Function class=S Function unknown
  Homolog annotation: Query=3..162bp; Hit=22..179bp; Blast score=82; Percent Identity=32.0; E value=3e-16; Homolog= Z2774 COG3758
MKMKYFDYATLPRTQWSGGTGETRDIVCWPVSDDFAWRACFTSIYESEVLGQFPDIDRSIVLLKGKGIRLTSPGFLEHELVKKMTPFHFSGDIRGHAELLDGSVQCFNIMTRRSCWASEISVISHEHLLPTSHSGVLYVLKGRWEMTGSDCVQLAFGQGAWWLPDIREGSIKPLVADSQLLWVDLRPIG

SEQ ID NO: 10345 - protein, 79 aa, Xenorhabdus bovienii
  Coding DNA sequence: Name=SeqID_4237
MTEWNFILHEKYPGMDLAYIPIYLSSSGLTLHQAASGKYFNNHPIGRKSTHNNWLSATSGLIEPSRISGSHQAPCPKAS

SEQ ID NO: 10346 - protein, 349 aa, Xenorhabdus bovienii; identical to SEQ ID NO: 8654
  Coding DNA sequence: Name=SeqID_4238
  Gene classification: Function=Predicted transposase; Function class=L DNA replication, recombination and repair
  Homolog annotation: Query=183..336bp; Hit=34..184bp; Blast score=70; Percent Identity=29.0; E value=2e-12; Homolog= BH2520 COG3335

SEQ ID NO: 10347 - protein, 87 aa, Xenorhabdus bovienii
  Coding DNA sequence: Name=SeqID_4239
MNMIKYLIKQKAKVLIFVLIIFSPYVYSKNKTEIIDLTGLELTESNDKDIINECKKWNLSKENVDKIFKISKEYKDYPYISVVIEDA

SEQ ID NO: 10348 - protein, 51 aa, Xenorhabdus bovienii
  Coding DNA sequence: Name=SeqID_4240
MIILILTKESIKKLVNLLKCNYNLGNSDIYEHDKISYKTEGESANLCSNNI

SEQ ID NO: 10349 - protein, 89 aa, Xenorhabdus bovienii
  Coding DNA sequence: Name=SeqID_4241
  Homolog annotation: Query=1..89bp; Hit=1..89bp; Blast score=90; Percent Identity=76.0; E value=8e-18; Homolog= ref|NP_929197.1|
MENAVKIGDIGTEHGDCPATPVITGASSVKVDGAYLARQGDALQSHSSHSRAIAGGSGSVFIEEKPAARTGDAVNCGSVVIGGGSVNIG

SEQ ID NO: 10350 - protein, 318 aa, Xenorhabdus bovienii
  Coding DNA sequence: Name=SeqID_4242
  Homolog annotation: Query=46..232bp; Hit=1..187bp; Blast score=213; Percent Identity=54.0; E value=3e-54; Homolog= ref|NP_929194.1|
MTETVSELRRQSRRFTGPRQPRHSAGRRRRRFNVCRPLPDEGEAGMSQEILYAIVDGTAEPNLSLMLERYDPPSTCLYSEPLQPELAEIAPYLVQVNEEVKIWLECRKTPWGIYLHSTADLKTLRHHLRKYLQVLLPGQEKPVFFRFYDPRNIWDFLEVLSDWEMHCLLGPIHKITTDYKGEYKQDNFLKVREKYPDNAKGRYKIFKISEEQYELIEIKQKEKYLQKLDLFLLSELAELRKSISIVNSISFLAFFYDYLLAEKITDTRSMEGILKKVIREDDFDIDIDIDHFDKSLLSNLVDDGTPGWYRANNFIEDI

SEQ ID NO: 10351 - protein, 320 aa, Xenorhabdus bovienii
  Coding DNA sequence: Name=SeqID_4243
  Gene classification: Function=Transposase; Function class=L DNA replication, recombination and repair
  Homolog annotation: Query=7..315bp; Hit=3..313bp; Blast score=158; Percent Identity=34.0; E value=6e-39; Homolog= NMB1750 COG3547
MSDNIVVGIDIAKHKFDVAVWAGENHYKMKHFPNDLKGFDAFINWLKPASNYHFCMEATGIYGDPLALYLSDKGLLISVVNPVQIHAFGKAELLRNKTDKIDAKLIARYCASQHPPAWQPAPLCERQLLALVRHRNKLNEMLLTEENRLSVADEVVCDSHAKIITLLKQELKDTELKLKKHIDDSPSLKKNKGLLESIPGIGERLSATLLAYIGDGSRFHHSGQVVAYAGLNPKLHESGQLKGRAHLSKQGSAELRKALYMPGLAAISCNKVVKKQWEQLTARHKGGKVGVCAVMRKLLRLAYGVMKSGTLFNAEIPLAV

SEQ ID NO: 10352 - protein, 631 aa, Xenorhabdus bovienii
  Coding DNA sequence: Name=SeqID_4244
  Gene classification: Gene name=VgrG; Function=Uncharacterized BCR; Function class=S Function unknown
  Homolog annotation: Query=13..629bp; Hit=4..622bp; Blast score=457; Percent Identity=40.0; E value=1e-128; Homolog= VCA0018 COG3501
MDKINQLLDRSGLIFTLITENLPEQTFAVVDFSLNEALSTPFRLEATLTCKTSEINFADVLDRNAAFAVYRNGQAERQITGIVTHFSLLSTGRHRSHYHITIQPPLWRASLRVNSRIFQNQSVMDIVEILLRENGVSSFFFALGYKHPPREFCVQYDESDLTFIQRLLADEGIFYYFTFDQEQHEQRIVFHDSCLSLNQVITVPYRPETDATGETTCIRQFSWSEQVGVANITTKDRTFKNPRWNREFWYEGRNLEHQRLLNSYHYYDFPSRYKDDALGQRASQYRLEYLRRDTQLGNGQGDCFALWPGQLFSLTDHPRDAFNDQWQLIQITHSGQQLQADETHSGGSGTWLSNQFTFTRRKNSYRPSSYPKPKMEGPHIATVVGPEGEAEGEEIFCDEHGRVRIQFDWDRYGEFNDRSSCWVRVSQAWAGQLMGMIAIPRIGHEVLVDFVHGDPDQPIIVGRAYHANNIPPNRLPMAKTQMSIRSKTHKGEGFNELRFEDEKDREEIFIHAQKNLAIKVLNSRGERINYDRTTSIGHDDELVIANNRKVTVEGQQDHKTTGNYIEQTDGDRSLQVKGDLIEKIQGVLSVDIQGDITLQSGSKVTLSVGGSFIVLHAGGIDIKGTAINLIS

SEQ ID NO: 10353 - protein, 66 aa, Xenorhabdus bovienii
  Coding DNA sequence: Name=SeqID_4245
MIFKSGMRCGMTDIKVDNNIPHIKTIPAPFPKSDLNKDHYNERPEKTPEQKLLTQTDNNETDIKIS

SEQ ID NO: 10354 - protein, 538 aa, Xenorhabdus bovienii; identical to SEQ ID NO: 8321
  Coding DNA sequence: Name=SeqID_4246
  Homolog annotation: Query=1..538bp; Hit=1..538bp; Blast score=821; Percent Identity=74.0; E value=0; Homolog= ref|NP_927678.1|

SEQ ID NO: 10355 - protein, 235 aa, Xenorhabdus bovienii
  Coding DNA sequence: Name=SeqID_4247
  Homolog annotation: Query=70..200bp; Hit=9..126bp; Blast score=113; Percent Identity=45.0; E value=2e-24; Homolog= ref|NP_637267.1|
MTPINSTEELLLNITNDSNFSKENKTNLINSTAYPNQEVNYAAGKPCTTCPPPQARPEFVENLIRSLGIRYTITIYAAHPGTPLNEDNGEPKFKNGERVTSFAGHMWYEISDGKSDNAYGFAPIESGMHGDGIVTEKDTIHYEKPRYKRTLEITEEQYNQLRNYGTSAVKNSNPDFNLYYNGAWNSCIDFTWKALRSAGLKPGMTWNDFSNINRINKALGTFDGDITDIPHHFQE

SEQ ID NO: 10356 - protein, 126 aa, Xenorhabdus bovienii
  Coding DNA sequence: Name=SeqID_4248
MVKILRRDTFFGYKRIDLKVESRPDYTPDLFKNDGPLAKPKDAPILSIKLHKINEDLTETLVFKKTYSEPDSIAGTADGILFRFVSLGERYKYGQYRLNLEILGNWPELKNDNVSYYLFIPSFSGK

SEQ ID NO: 10357 - protein, 110 aa, Xenorhabdus bovienii
  Coding DNA sequence: Name=SeqID_4249
MVKKIMLLVFAAFLGAGIVLLVQWMRPPTEDPYFFLTPKPTTGHPIEVPIKLYKKGEKIELVFWNVPQPPPKILYLFPGHTPEPRVMLKTKGYKEDELTYYTPRAGFYFA

SEQ ID NO: 10358 - protein, 348 aa, Xenorhabdus bovienii
  Coding DNA sequence: Name=SeqID_4250
  Homolog annotation: Query=64..339bp; Hit=109..375bp; Blast score=209; Percent Identity=46.0; E value=8e-53; Homolog= ref|NP_821845.1|
MLNVRIAGNWLNGWGKVPPMGFNICWNALIGMSIWPAISCGIMSLNIWAMNRVFSSLIKPVLSKKGHILPGYSVSNSGTAGRVENSQIGVFLCYAGNGGHAFVDRALYLPRQWTDARSRCEAAGIPASVTFATKPPLARQMLERTWDAGVPCRWVTADEVYGRDRRLRVWLESRYPPFVLAIPCNTPLGWRGPEYIRADRIADTLTAADWKTRSAGTGTKGEREYDWAVVPLWRLQLSEEDRHYGHYLLVRRSRDSRQERAYYVVYALREQVDLNTLVQVAGCRWEIESGFEETKGECGLDHYEVRRWQSWHRHITLSLLAHAVLAVLRVQEKKNTGRPGSAQCSGTP

SEQ ID NO: 10359 - protein, 77 aa, Xenorhabdus bovienii; identical to SEQ ID NO: 9681
  Coding DNA sequence: Name=SeqID_4251

SEQ ID NO: 10360 - protein, 86 aa, Xenorhabdus bovienii
  Coding DNA sequence: Name=SeqID_4252
VRRAVQKPGHTAKSADVGYLLLRQSYDPGTADITRSKVRCIRAVQPSEVVQSFSENDKGRTGIICITWLPDIMGDLLPVISVNNRQ

SEQ ID NO: 10361 - protein, 46 aa, Xenorhabdus bovienii
  Coding DNA sequence: Name=SeqID_4253
MGVYFPPFRKKRRAFVTGSVGRGDLFYCMPFADLFCDLVSIYKRNR

SEQ ID NO: 10362 - protein, 252 aa, Xenorhabdus bovienii
  Coding DNA sequence: Name=SeqID_4254
  Homolog annotation: Query=1..243bp; Hit=1..250bp; Blast score=185; Percent Identity=54.0; E value=5e-46; Homolog= ref|NP_929715.1|
MPITANILYRDSFNFFKNQLLNIFILSVLAALVAALLEHLLMPDGEQLKLLVEIQNAFKESGNTGVKNFVAQLTPEEQLMFLRTAFGILFSNIFGSTLLTANVLLLINAISNGHQTNALHASKSSIGSLPKMFLLMFICTLLIQLGYALMFIPGILLSIAFAFAPVFLLEKGRGVFSSMQESWKLAFANLRLLAPAILLWFAIKLIIALGFARMPDIVLSILNNLLSSILLIYLFRLYMLTKSQNKSANGMQ

SEQ ID NO: 10363 - protein, 218 aa, Xenorhabdus bovienii
  Coding DNA sequence: Name=SeqID_4255
  Gene classification: Gene name=OmpW; Function=Outer membrane protein W; Function class=M Cell envelope biogenesis, outer membrane
  Homolog annotation: Query=5..218bp; Hit=1..212bp; Blast score=246; Percent Identity=57.0; E value=1e-65; Homolog= ompW COG3047
MGWIMKKIFSLVLATAALAPSLTFAHEAGDFLFRAGTATVRPNAGSDNVLGQGSFGVNNNTQLGLTFGYMITDNIGVELLAATPFQHRVNLPKAGDVAKVRHLPPTLMAQYYFGSKENNLRPYVGIGVNYTTFFSEKFNDNNATVEAAKLNSLDLKDSWGVAGQVGLDYQLDKNWVLNTSLWWMNIETDVRFKAGDAEQKYKTRLDPWVFMFGVGYKF

SEQ ID NO: 10364 - protein, 391 aa, Xenorhabdus bovienii
  Coding DNA sequence: Name=SeqID_4256
  Gene classification: Function=Zn-dependent dipeptidase, microsomal dipeptidase homolog; Function class=E Amino acid transport and metabolism
  Homolog annotation: Query=182..391bp; Hit=95..311bp; Blast score=91; Percent Identity=30.0; E value=2e-18; Homolog= APE0337 COG2355
MTRRAKIILTGAGVGGVICACAMIFFFVLPRLIETRMNRVIGVTDVATQTAVDLHKRLQIADLHADTLLWGRDLLDRSTRGQVDIPRLIDGNVAVQIFAVVSKSPRGLNIEKNSAETDNVTLLALAQRWPWRTLFSLKERALYQAARLHEAAARSNGKLVVIKSRADLKAFLERRRSDPKIVGALLASEGAQVLEGDPANVDVLFEAGYRMMAPTHFFDTELGGSAHGIEKGGLTAAGADMVRRMEARSMIIDLAHASTKTIDDILAIATRPVVVSHTGVKGTCDNIRNLSDDQLRRIAAKGGLIGIGFWDKAVCDPTPTGIAKAQIYAANIAGDDHVALGSDFDGAVEMPFDATGLVSVTDALLKNGAQPERIAKLMGENQIRFLLENLP

SEQ ID NO: 10365 - protein, 104 aa, Xenorhabdus bovienii
  Coding DNA sequence: Name=SeqID_4257
  Gene classification: Gene name=OsmY; Function=Predicted periplasmic or secreted lipoprotein; Function class=R General function prediction only
  Homolog annotation: Query=3..104bp; Hit=12..122bp; Blast score=55; Percent Identity=37.0; E value=7e-09; Homolog= ZosmY COG2823
MKLLKVVSTFFVATVMAMTISACAPTATTESTGNYIDDTVITAKVKSALLEAKNLKSREISVETFKGRVQLSGFVSSPEDVTRAIQITKGIKGVNTVINSIKLR

SEQ ID NO: 10366 - protein, 49 aa, Xenorhabdus bovienii
  Coding DNA sequence: Name=SeqID_4258
MLIYRNIILVSTLGIMPLCNGRNQKVLLKTGKPTNDRGNIYSRMVIGWR

SEQ ID NO: 10367 - protein, 268 aa, Xenorhabdus bovienii
  Coding DNA sequence: Name=SeqID_4259
  Gene classification: Gene name=TrpA; Function=Tryptophan synthase alpha chain; Function class=E Amino acid transport and metabolism
  Homolog annotation: Query=1..267bp; Hit=1..267bp; Blast score=356; Percent Identity=69.0; E value=2e-98; Homolog= trpA COG0159
MERYEQLFKKLESQNQGVFVPFVTLGDPNPELSLEIIDALIAGGADALELGIPFSDPLADGPTIQNANLRALSSNVTPALCFELLSQIRAKYPDIPIGLLMYANLVFHNGIDEFYRRCKNAGVDSVLIADVPLSESHDFRSTALKYDIAPILICPPNADDDLLREIAVCGRGYTYLLSRAGVTGTQNRAEHPLTHLVNKLKEYHAAPALQGFGISEPAQVTSVLDSGAAGAISGSAVVKIIEDNLNQPQIILEKLVTFVRTMKTATQR

SEQ ID NO: 10368 - protein, 396 aa, Xenorhabdus bovienii
  Coding DNA sequence: Name=SeqID_4260
  Gene classification: Gene name=TrpB; Function=Tryptophan synthase beta chain; Function class=E Amino acid transport and metabolism
  Homolog annotation: Query=4..396bp; Hit=5..397bp; Blast score=694; Percent Identity=84.0; E value=0; Homolog= trpB COG0133
MSKLNPYFGDFGGQFVPQILIPALDQLEEVFIEAQNDPEFQQAFQDLLRNYAGRPTALTLCQNLTKGTKSRLYLKREDLLHGGAHKTNQVLGQALLAKRMGKNEIIAETGAGQHGVATALACALLGLKCRIYMGAKDIERQSPNVFRMRLMGAEVIPVHSGAATLKDACNEAMRDWSGCYDKAHYLLGTAAGPHPYPTIVREFQRMIGEEAKAQIMEKEGRLPDAVIACIGGGSNAIGLFAEFIPETNVRLIGVEPAGHGIETGEHGAPLKHGKLGIYFGMKSPIMQTEDGQIEESYSISAGLDFPSVGPQHAYLNNIGRADYVSVTDDEAIDAFKALSRNEGIIPALESSHALAHALKMIHQAPDKEQLLIVNLSGRGDKDIFTVHDILQSKGEI

SEQ ID NO: 10369 - protein, 454 aa, Xenorhabdus bovienii
  Coding DNA sequence: Name=SeqID_4261
  Gene classification: Gene name=TrpC; Function=Indole-3-glycerol phosphate synthase; Function class=E Amino acid transport and metabolism
  Homolog annotation: Query=1..254bp; Hit=1..254bp; Blast score=332; Percent Identity=66.0; E value=5e-91; Homolog= trpC_1 COG0134
MKNNILQKIVDDKVAYLVERKAEQPLESVIDSIVPSHRQFYQALSHKQTVFILECKKASPSKGLIRTDFDPVRIAKTYQPYAAAISVLTDEKYFQGNYDFLRMVSSAVHQPVLCKDFIIDAYQVYLARYYQADAILLMLSVINDETYRELSALAHSLDMGVLTEVSTEDERRRAIVLGAKVIGINNRDLRDLSIDLDRTRRLATDLPEGTIIISESGINQHQQVRELSQFAHGFLIGSALMAQPDLDLALRRLILGDNKICGLTRPQDAKTALQAGAVYGGLIFAEKSPRKINLQHAQQIINEAPLQYVGVFQNQSLDFVSDIARQLSLNAVQLHGNEDKNYINALRPLLPESCEIWKAIDMSKATEFSEISNIDHLLLDNGAGGTGETFDWQLIDQRFQRNSMLAGGLNAENCQQAAALGCYGLDFNSGVETSVGIKSSQKIKLIFQQLRCYH

SEQ ID NO: 10370 - protein, 332 aa, Xenorhabdus bovienii
  Coding DNA sequence: Name=SeqID_4262
  Gene classification: Gene name=TrpD; Function=Anthranilate phosphoribosyltransferase; Function class=E Amino acid transport and metabolism
  Homolog annotation: Query=1..331bp; Hit=4..334bp; Blast score=438; Percent Identity=73.0; E value=1e-123; Homolog= trpD_2 COG0547
MQLIFEKLFSAQTLTQQESQQLFTAIVCGELSDAQLAAVLVSMKLHGEQPQEIAGAAQALLANASPFPRPDYTFCDIVGTGGDGTNSINISTTSAFVAAACGLKVAKHGNRSTSSRSGSSDLLTAFGIALDASAEDSRSALDEIGVCFLFAPQYHSGFRHVVQVRQQLKVRTLFNVLGPLINPARPPRTLIGVYSPELVVPIAHTLKVLGYQRAAVVHSGGMDEVALHAPTLVAELNHGEIIQYQLTAKDFGLPNHPISSLKGGTPEENCDMLSLLLQGRGQKAHVDAVAANVALLMKIHGQENLRENTQLALNTIYSGQAYEKVTALAARI

SEQ ID NO: 10371 - protein, 192 aa, Xenorhabdus bovienii
  Coding DNA sequence: Name=SeqID_4263
  Gene classification: Gene name=PabA; Function=Anthranilate/para -aminobenzoate synthases component II; Function class=E Amino acid transport and metabolism
  Homolog annotation: Query=1..192bp; Hit=1..192bp; Blast score=274; Percent Identity=67.0; E value=3e-74; Homolog= trpD_1 COG0512
MANILLLDNVDSFTYNLVDQLRASDHQVVIYRNTVSTETIMTQLSQMESPLLMLSPGPGKPADAGCMPQLLKRIISQIPVIGICLGHQAIIEAYGGTISAAREILHGKATLATHDGQAMFSGLINPLPVARYHSLTGMNIPDTLVVSASCGDTVMAVRHDRHKVCGFQFHPESILTTQGAKLLEQTLAWVQE

SEQ ID NO: 10372 - protein, 375 aa, Xenorhabdus bovienii
  Coding DNA sequence: Name=SeqID_4264
  Gene classification: Gene name=TrpE; Function=Anthranilate/para -aminobenzoate synthases component I; Function class=E Amino acid transport and metabolism
  Homolog annotation: Query=2..375bp; Hit=147..520bp; Blast score=559; Percent Identity=72.0; E value=1e-159; Homolog= trpE COG0147
VGGLFAYDLVAGFEPLPKVKTHQRCPDFCFYLAETLLVIDHRNKHAFLQTSLFGESDSEKQRLHDRLTALTAAISKPGQPLESVKLPDMTIACNQSDDQYADIVQQLQQSIRQGDIFQAVPSRRFTLPCPSPLNAYQTLKHQNPSPYMFFMQDQDFCLFGASPESALKYDASSRQIEIYPIAGTRPRGRNANGTLNADLDGRIELEMRTDAKELSEHLMLVDLARNDLARICEPGSRYVADLTKVDRYSFVMHLVSRVVGTLRHDLDVFHAYQACMNMGTLTGAPKVRAMQLIAQHEGERRGSYGGAIGYFTAKGDFDMCIVIRSAYVEDGTAAVQVGAGIVLDSIPESEVDETHSKARAVIRAIAQAHKAEVTF

SEQ ID NO: 10373 - protein, 156 aa, Xenorhabdus bovienii
  Coding DNA sequence: Name=SeqID_4265
  Gene classification: Gene name=TrpE; Function=Anthranilate/para -aminobenzoate synthases component I; Function class=E Amino acid transport and metabolism
  Homolog annotation: Query=16..145bp; Hit=17..147bp; Blast score=108; Percent Identity=42.0; E value=3e-24; Homolog= BUpT01 COG0147
MNKNFKISINQVDTVYQTDPTLLFNQLCGNRPATLLLESAEINSKRNLKSLLIIDSAMRITANERQVTFEALTENGRQLLPILTDLLSAKARLHVGLHILQAQFPATGHNLDEDSRLKADSIFDALRTLMTLSPFSGTPDAIFRGRTVCLRFSCRI

SEQ ID NO: 10374 - protein, 68 aa, Xenorhabdus bovienii
  Coding DNA sequence: Name=SeqID_4266
LIEILKFLFIIFAPLLPLATNFGYKKTRFWGGLRHFRICTYVRDSTALNGKLRHQRIACINTIIFSVP

SEQ ID NO: 10375 - protein, 117 aa, Xenorhabdus bovienii
  Coding DNA sequence: Name=SeqID_4267
MSMFMKSSKIILYFIFYILYFIFYILYFIFYILYFILFFIALIVFNNAGAIELMSDYIVLRGNYDELGKNKNRSNLLADYNMIFKNDSKHDNFEIKMLGYQCVYKVGDEYINLKPGG

SEQ ID NO: 10376 - protein, 73 aa, Xenorhabdus bovienii
  Coding DNA sequence: Name=SeqID_4268
MQNIEDADPYFLTNLIILARAILALNLLIGIELAIQKRLYPLNLKVKNYLVLEVMIAVLLCRMVIYFYLHNIL

SEQ ID NO: 10377 - protein, 286 aa, Xenorhabdus bovienii
  Coding DNA sequence: Name=SeqID_4269
LKYSLYRIEVVDKYHSLGLADIKKNWQGSSPDKSYFSIKTSNVEIKNLSEGGTEIVGTPSFLSGRSNVPGDEVNIKRRRIERSSELKENIQNLAQETVICSGAVVSDNGNWQCDRPIIFPVGTYELTAELIKEGKWTCPDNPALTVANKGTFFLYAAQYQKTGSAQLGELGDTYERTSQVTRKYEVTETKINIIAPNHGAKIIKLPFTISGTGEKGSQVYIEGFGGADDCNTTVDTSLGQWSCGPYRPEDGKYTLSADQFIDNQLDSTAQASFEVQTKTVRPVVIT

SEQ ID NO: 10378 - protein, 286 aa, Xenorhabdus bovienii
  Coding DNA sequence: Name=SeqID_4270
  Gene classification: Function=Predicted metal-dependent phosphoesterases (PHP family); Function class=R General function prediction only
  Homolog annotation: Query=12..286bp; Hit=10..284bp; Blast score=357; Percent Identity=63.0; E value=6e-99; Homolog= ZyciV COG0613
MTEAASELIRRYDLHSHTTASDGVLSPEQLVDRAVSMGINVLAITDHDTTDGIPPALNHIQQNNLPLTLVSGVEISTLWENFEIHIVALNIDTDCVFLTNFLSNQVTLRKQRGIEIGQRLAKAGIPNAWEGASRLANGGQVTRGHFARYLIEAGVEPTIPKVFKKYLAKGKIGYVPAQWCTIEQAIETIHQAGGQAVIAHPGRYDLSMKWLKRLIAWFQQHGGDAMEVAQCQQAPNERQQLGQLAKEYGLKVSLGSDFHQPCSWIELGRNLWLPSDVIPIWHDWSR

SEQ ID NO: 10379 - protein, 206 aa, Xenorhabdus bovienii
  Coding DNA sequence: Name=SeqID_4271
  Gene classification: Gene name=SUA5; Function=Putative translation factor (SUA5); Function class=J Translation, ribosomal structure and biogenesis
  Homolog annotation: Query=1..206bp; Hit=13..218bp; Blast score=325; Percent Identity=74.0; E value=3e-89; Homolog= yciO COG0009
VSQFFYIHPDNPQSRLIGQSVDVLKKGGVVIYPTDSGYAIGCCLENKDAMTHICRIRQLDGRHNFTLMCRDLSEIAAYAHVDNQAFRLIKNNTPGNYTFILQATKDVPRRLMNEKRKTIGLRVPSNPIALALLEGMREPLMSCSLILPGNDFAESDPEEIKDVLGKQVDLIIHGGYLGQQPTTVIDLTGDFPEVLREGEGDVTPFL

SEQ ID NO: 10380 - protein, 314 aa, Xenorhabdus bovienii
  Coding DNA sequence: Name=SeqID_4272
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=11..296bp; Hit=2..287bp; Blast score=445; Percent Identity=80.0; E value=1e-125; Homolog= yciL COG1187
MSDKTQKTERTEKLQKILARAGHGSRREIEGYIQEGRISIDGKTATLGDRIEVKPSIKIRLDGRILNIKEPQKTICRVLAYYKPEGELCTRHDPEGRPTVFDRLPKMQDARWIAVGRLDINTCGLLLFTTDGELANRLMHPSCEVEREYAVRVFGEVDNAKLRQLTQGVQLEDGPASFKTISFKGGEGINQWYNVTLTEGRNREVRRLWEAVGVQVSRLIRVRYGDIDLPKGLPRGGWTELGLEQTNYLRQLVDLNEETMSKVAVERDQRRIKANQIRRAVKRHSQVGSSRPAGKRPASSSRQNTGRKAVPKGR

SEQ ID NO: 10381 - protein, 198 aa, Xenorhabdus bovienii
  Coding DNA sequence: Name=SeqID_4273
  Gene classification: Gene name=BtuR; Function=ATP; Function class=H Coenzyme metabolism
  Homolog annotation: Query=7..198bp; Hit=5..196bp; Blast score=293; Percent Identity=72.0; E value=1e-79; Homolog= ZbtuR COG2109
MPTDNGQYKKRQQRLKEKVDARIEAAQQERGIVIVFTGNGKGKTTAAFGTVTRAIGHGQRAGVIQFIKGTWENGERNLLAQQGVEFHIMATGFTWETQNRETDIAACQAVWQHALTMLSDPSLQLVVLDELTYMVSYKYLDLTDVLTALKQRPIHQSVIITGRGCHRELLELADTITEMRPVKHAFDAGIKAQKGVDW

SEQ ID NO: 10382 - protein, 254 aa, Xenorhabdus bovienii
  Coding DNA sequence: Name=SeqID_4274
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=2..251bp; Hit=1..249bp; Blast score=328; Percent Identity=67.0; E value=3e-90; Homolog= yciK COG1028
MLDYQPNHDLLQQKIILVTGAGDGIGREAALTYARHGAQVILLGRTTAKLEAVKQQIENSGGLPVTIYTMDLLTVTAEECQAFADELTQHYPRLDGVLHNAGLLGVVAPVIEQPVQLWHEVMQVNVNATFMLTQVLIPLLLKSPNGSLVFTSSSVGREGRSGWGAYAVSKFATEGLMQVLAQEYQETALRINCINPGGTRTGMRASAFPDENATKLKIPAEIMPVYLYLMGDDSLSDSGISFDAQPGRKAGPAK

SEQ ID NO: 10383 - protein, 34 aa, Xenorhabdus bovienii
  Coding DNA sequence: Name=SeqID_4275
MASAILGGHMKSVIRTKLNAPVKFAQYRQKRTEL

SEQ ID NO: 10384 - protein, 44 aa, Xenorhabdus bovienii
  Coding DNA sequence: Name=SeqID_4276
MVLRTPNPIQNTARTTTANTTVTTLAKNSPYRDKYSTDPPYLQL

SEQ ID NO: 10385 - protein, 312 aa, Xenorhabdus bovienii
  Coding DNA sequence: Name=SeqID_4277
  Gene classification: Gene name=SppA; Function=Periplasmic serine proteases (ClpP class); Function class=N Cell motility and secretion
  Homolog annotation: Query=3..311bp; Hit=39..348bp; Blast score=371; Percent Identity=63.0; E value=1e-103; Homolog= ZsohB COG0616
MHKGELRLTNLGESYREKQRQMQQARMSDAEQKIWQKALKKQQKNDAKQKKAEAKASQKGLQKSNLYVLDFKGSMDAHEVDSLREEISAILAVADSKDEVLLRLESPGGMVHGYGLAASQLARLRQKGIRLTIAVDKVAASGGYMMACVADRIIAAPFAIIGSIGVVAQLPNIHRLLKKNDIDVELHTAGEYKRTLTVLGENTEQGRQKFQEDLNETHKLFKSFIYQHRPSLDVEKVATGEYWYGMQAKENGLIDDVGVSDDFLIGQIEHCEVIGVSYSRRKRVIERFMGSAMENVDKLFMRWWQRGEKPLF

SEQ ID NO: 10386 - protein, 83 aa, Xenorhabdus bovienii
  Coding DNA sequence: Name=SeqID_4278
  Homolog annotation: Query=1..83bp; Hit=1..83bp; Blast score=113; Percent Identity=66.0; E value=8e-25; Homolog= ref|NP_405758.1|
MQTETLPIKRKQLLEKANKIIRKHDDFIQGMYADNVEQKGEVLVFKGEYFLDSYNLPTTKSTAVFNMFKHLAHILSEKYHLAD

SEQ ID NO: 10387 - protein, 54 aa, Xenorhabdus bovienii
  Coding DNA sequence: Name=SeqID_4279
MILFAFSSNCLRLMGNVSVCIDYAPPKNKLLRIVFYQVECGLFVMQMEDFVYNC

SEQ ID NO: 10388 - protein, 863 aa, Xenorhabdus bovienii
  Coding DNA sequence: Name=SeqID_4280
  Gene classification: Gene name=TopA; Function=Topoisomerase IA; Function class=L DNA replication, recombination and repair
  Homolog annotation: Query=1..590bp; Hit=1..592bp; Blast score=976; Percent Identity=81.0; E value=0; Homolog= ZtopA_1 COG0550
MGKALVIVESPAKAKTINKYLGNDYVVKSSVGHIRDLPTSGAASQKSSNSSTDKNKKKKDEKTALVNRMGVDPYHGWEADYQILPGKEKVVAELKTLAEKADHIYLATDLDREGEAIAWHLREVIGGGEARFSRVVFNEITKNAITQAFDNPGELNIDRVNAQQARRFMDRVVGYMVSPLLWKKVARGLSAGRVQSVAVRLIVEREREIKVFVPEEYWQLHADLMAKGDIALQMEVTHEGGKPFKPVNAQQTQAAVSLLEKARYKVLDREDRPTSSKPGAPFITSTLQQAASTRLGFGVKKTMMMAQRLYEAGHITYMRTDSINLSQDALDMVRGYINDHFGDKYLPKTANIYSSKENSQEAHEAIRPSNVDVMAEELKDMEADAQKLYQLIWRQFVACQMMPAKYDSTTLTVQAGNFELRAKGRTLRFDGWTKVMPALRKGDEDHTLPVVEVGTELDLQQLSPSQHFTKPPARFSEASLVRELEKRGIGRPSTYASIISTIQDRGYVRGENRRFYAEKMGEIVNDRLEENFNELMSYDFTARMEDQLDHVANNEANWKGVLDEFFTNFSEQLDVASKDPDEGGMRPNPMVITSIDCPTCSRPMGIRTATTGVFLGCSGYVLSPKERCKQTINLIPENEILNILEGDDAETNALRARHRCKECGTAMDSYLIDNQRKLHVCGNNPACDGYEVEEGEFRIKGYDGPIVECDKCGSEMHLKMGRFGKYMGCTSEECKNTRKILRSGEVAPPKEDPVPLPELPCEKSDAYFVLRDGAAGVFLAANTFPKSRETRAPLVEELVKFKDRLPEKLCYLAKAPVADPEGHKTVVRFSRKTKQQYVSSEKNGKATGWAAFFVDGAWVTKEK

SEQ ID NO: 10389 - protein, 324 aa, Xenorhabdus bovienii
  Coding DNA sequence: Name=SeqID_4281
  Gene classification: Gene name=LysR; Function=Transcriptional regulator; Function class=K Transcription
  Homolog annotation: Query=1..322bp; Hit=1..322bp; Blast score=560; Percent Identity=84.0; E value=1e-159; Homolog= cysB COG0583
MKLQQLRYIVEVVNHNLNVSSTAEGLYTSQPGISKQVRMLEDELGIQIFARSGKHLTHVTPAGEEVIRISREVLSKIDSIRSVASEHTYPDRGSLYIATTHTQARYALPPVIKGFIERYPNVSLHMHQGSPTQIAEEVCKGNSDFAIATEALHLYSDLIMLPCYHWNRSVVVTKDHPLAARQNVTIEELAEYPIVTYTFGFTGRSELDVAFDQAGLKPKIVFTATDADVIKTYVRLGLGVGVIASMAIEPVQDSDLVRIDMRDKFSYSTTKIGFRRSSFLRSYMYDFIWRFAPHLTRDVVDKAIALRSNEEIEEMFKDIELPIA

SEQ ID NO: 10390 - protein, 273 aa, Xenorhabdus bovienii
  Coding DNA sequence: Name=SeqID_4282
  Homolog annotation: Query=1..271bp; Hit=1..272bp; Blast score=235; Percent Identity=48.0; E value=5e-61; Homolog= ref|NP_929672.1|
MDIKVDKNRQHYLNHIAQAEQFFSSGIEDNFSLSNHQFSDMGGLVQFVITSQINDKSSVIQRLNEIKKTQISLSSIATDYIIKYANTHGQQYRTDVQFWGDIIEKLPLMSVRNIESQTYSHVMKGFSIATNLLQLIMDIVLNTNSSSMKSFSQFLQKQGDAIRIGLKKNNEHYSTLTLASIIEAVGAEDQVIYIPKMKLYKVNFDRSNSEIASNCASNENINVEFTYSSCISLFDYQALEDPEIKASFDLFIRNNKKSSIENSNNFFNGEFKV

SEQ ID NO: 10391 - protein, 891 aa, Xenorhabdus bovienii
  Coding DNA sequence: Name=SeqID_4283
  Gene classification: Gene name=AcnA; Function=Aconitase A; Function class=C Energy production and conversion
  Homolog annotation: Query=1..891bp; Hit=1..891bp; Blast score=1372; Percent Identity=74.0; E value=0; Homolog= acnA COG1048
MSFKLKTDCASTLSIGSKTYHYYSLSLLSEQLGEIARLPKSMKVLLENLLRNIDGDSVVEEDLKALVEWQKNGHADREIAYRPARVLMQDFTGVPAVVDLAAMREAVLRLGGNVEQVNPLSPVDLVIDHSVMVDKFGTEQAFEENVQIEMERNYERYLFLRWGQKAFNRFRVVPPGTGICHQVNLEYLGKSVWYENQNGKDFAYPDTLVGTDSHTTMINGLGVLGWGVGGIEAEAAMLGQPVSMLIPDVVGFKLAGKLREGITATDLVLTVTQMLRKHGVVGKFVEFYGDGLSDLPLADRATIANMSPEYGATCGFFPVDDITLGYLRLTGRNEDEIALVEAYCKKQGLWRNAGDEPIFTNNLELDMSTVEVSLAGPKRPQDRVALGDVPHAFQAAMELDIHKIQEHRADTIVTLDNQTFALQDGAVVIAAITSCTNTSNPSVLMTAGLLAKKAIEKGLQRQPWVKTSLAPGSKVVTDYLELAGLMPYLEKLGFNLVGYGCTTCIGNSGPLPEPIEVAIKQSDLMVGAVLSGNRNFEGRIHPLVKTNWLASPPLVVAYALSGNMKKDLTREPLGQDQQGHDIYLQDIWPDSQEVAEAVGKVRTEMFHKEYNAVFDGDENWQSLEVERSETYSWQQDSTYIRLPPFFSDMTIEPKPITDIHQANILAILGDSVTTDHISPAGNIKADSPAGRYLQEHGVSPKDFNSYGSRRGNHEVMMRGTFANIRIRNEMMPGVEGGYTRHIPSQAQLAIYDAAMLYQEDKTPLAIIAGKEYGSGSSRDWAAKGTRLLGARVVIAESFERIHRSNLIGMGVLPLEFPQGVSRKTLNLTGDERIDIVGLGHIEPGQTIAVKINYINGKETVIDVRCRIDTNTELAYFYNDGILHYVIRNMLK

SEQ ID NO: 10392 - protein, 202 aa, Xenorhabdus bovienii
  Coding DNA sequence: Name=SeqID_4284
  Gene classification: Gene name=RibA; Function=GTP cyclohydrolase II; Function class=H Coenzyme metabolism
  Homolog annotation: Query=5..200bp; Hit=1..196bp; Blast score=357; Percent Identity=83.0; E value=5e-99; Homolog= ribA COG0807
MNTKIQLKRVAEAKLPTPWGEFLMIGFEEIKTGRDHVALVFGDISGDEPVLSRIHSECLTGDALFSLRCDCGFQLEAAFSQISKEGKGVLLYHRQEGRNIGLLNKIRAYALQDKGVDTVEANHQLGFAADERDFTLCSDMYKLLGINAIRLLTNNPKKVEIMVEAGINIVERVPLVVGRNPKNAYYLDTKASRMGHLLSKSN

SEQ ID NO: 10393 - protein, 104 aa, Xenorhabdus bovienii
  Coding DNA sequence: Name=SeqID_4285
  Gene classification: Function=Predicted membrane protein; Function class=S Function unknown
  Homolog annotation: Query=1..93bp; Hit=1..93bp; Blast score=110; Percent Identity=67.0; E value=2e-25; Homolog= yciS COG3771
VKYFLILLLALVVFVISVTLGANNDQVVTFNYLIAKGDYSISTLLSVLFAIGFMLGWGICGGFYLRVCVSLRRAKRKIKRLEAQLEQPAESSVKTASPVVLTKE

SEQ ID NO: 10394 - protein, 389 aa, Xenorhabdus bovienii
  Coding DNA sequence: Name=SeqID_4286
  Gene classification: Function=Predicted N-acetylglucosaminyl transferase; Function class=G Carbohydrate transport and metabolism
  Homolog annotation: Query=1..388bp; Hit=1..388bp; Blast score=540; Percent Identity=72.0; E value=1e-153; Homolog= yciM COG2956
MLELLFLLLPIAAAYGWYMGRRSAQQDKQQSADRLSRGYVDGVNFLLSNQQDKAVDLFLDMLKEDSSAFEAHLTLGNLFRSRGEVERAIRIHQSLMESASLTFEQRLLAIQQLGRDYMAAGVYDRAENMFIQLVDEADFRENAFNSLLTIYQSTSDWNKAIDVSEKLVKLGKHHFREEIAHFYCELALQCMGSDDSTEAVGHLNKAAQADKNCARVSIMFGRIYIAQKEYTKAAELLKRILEQDKQLVSESLPMLEECYQNLSQPEEWEAFVQCCVEEKCGAIAELYLADIIEKKEGRDIAQNYINRQLERHPTMRLFYRLMDYHLADAEEGRAKESLLLLRNMVGEQIRTKPDYRCHKCGFTSLSLYWHCPSCRSWDTIKPIRGLDGQ

SEQ ID NO: 10395 - protein, 246 aa, Xenorhabdus bovienii
  Coding DNA sequence: Name=SeqID_4287
  Gene classification: Gene name=PyrF; Function=Orotidine-5'-phosphate decarboxylase; Function class=F Nucleotide transport and metabolism
  Homolog annotation: Query=14..194bp; Hit=14..194bp; Blast score=275; Percent Identity=77.0; E value=3e-74; Homolog= ZpyrF COG0284
MTSHTAQTLGKQIDSPVIVALDYDNQDAALAFVDKIDPQSCRLKVGKEMFTLNGPQFIQVLHQRGFEVFLDLKFHDIPNTTARAVAAAAELGVWMVNVHASGGARMMTAAKEALLPYGKDAPLLIAVTVLTSMEQSDLLGVGIDVTPAQHAERLATLAKQCGLDGVVCSAHEAQQLKAVCGQEFQLVTPGIRPERRRGWRSAPHHDTSSGSSGWCGLYGDRASDYPGRNPALALQQINHSIGIVHG

SEQ ID NO: 10396 - protein, 147 aa, Xenorhabdus bovienii
  Coding DNA sequence: Name=SeqID_4288
  Gene classification: Gene name=SUI1; Function=Translation initiation factor (SUI1); Function class=J Translation, ribosomal structure and biogenesis
  Homolog annotation: Query=42..147bp; Hit=4..109bp; Blast score=152; Percent Identity=79.0; E value=2e-37; Homolog= ZyciH COG0023
MTPPQAVQVGVDYMVIGRPITRAEIQHWHYSRLITLLGSFMDNNSRLVYSTDIGRVQEEKVELSRHKGDGIVRIQRQTSGRKGKGVCIITGIDADDQTLAKLAAELKKKCGCGGSVKEGEIEIQGDKRDLLKQLLEAKGMTVKLAGG

SEQ ID NO: 10397 - protein, 37 aa, Xenorhabdus bovienii
  Coding DNA sequence: Name=SeqID_4289
MTKSWRLSQLPDHYPIYYILLNRLYNPVIHSLLKDRN

SEQ ID NO: 10398 - protein, 139 aa, Xenorhabdus bovienii
  Coding DNA sequence: Name=SeqID_4290
  Homolog annotation: Query=1..132bp; Hit=1..132bp; Blast score=148; Percent Identity=65.0; E value=2e-35; Homolog= ref|NP_928011.1|
MLNNKAVILSILLSIANITGSSGLTIWIDNVLKEGGGILNTYIPLFSYLIGLSIGCMTISFFIRNIKNIFLKENIFICSLLLATTNCLLFSKEWITISVLADSIHRVIWGIMSGFTVILGRNILITEGNEKKQIKIFLF

SEQ ID NO: 10399 - protein, 44 aa, Xenorhabdus bovienii
  Coding DNA sequence: Name=SeqID_4291
MPAMRVIYFNYIDMTQMYIILLTLWFPCAIFSIKIIKSANLEKK

SEQ ID NO: 10400 - protein, 111 aa, Xenorhabdus bovienii
  Coding DNA sequence: Name=SeqID_4292
MQLISFGLCLISISIGSRILYIFFMLLMFLANMIMQPVFFSYLGLYSKNSLYTLGMQSGIYVFITTIILAYTVFINIEMEKIMIGFASLLILSVINSITFVLIVNRGKNNK

SEQ ID NO: 10401 - protein, 117 aa, Xenorhabdus bovienii; identical to SEQ ID NO: 7849
  Coding DNA sequence: Name=SeqID_4293
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 10402 - protein, 163 aa, Xenorhabdus bovienii
  Coding DNA sequence: Name=SeqID_4294
  Gene classification: Function=Predicted transposase; Function class=L DNA replication, recombination and repair
  Homolog annotation: Query=16..120bp; Hit=6..110bp; Blast score=100; Percent Identity=44.0; E value=8e-22; Homolog= CC0928 COG3293
MDDLTMSTPVHRRHDISDHIWSLLEPHLPGRKGAWGRVAYDNRLFINAVFWILRTGAPWRDLPPDYGDWKNTHRRFCWWRDKGVWEELLEELIFEPDFEWLMIDASHIKVHPHAAGAAGGNQDMGRTKGGSIQRYIWPWMRMVCRSEHLLQAVPQRIAHKLRP

SEQ ID NO: 10403 - protein, 191 aa, Xenorhabdus bovienii
  Coding DNA sequence: Name=SeqID_4295
  Homolog annotation: Query=1..190bp; Hit=1..189bp; Blast score=223; Percent Identity=59.0; E value=2e-57; Homolog= dbj|BAA94418.1|
MTTQNIFFPKQQILSILSSRKMTLEQLVGIADIHHDNVVFPSPQVLRDFSDHIAVPLSVFYQEDPCSDLDDGVKIARRNGTFSRDEIRDGVHYYTYHHLVTTKADPGLMALRLDLHSNETQPLRLNSGHSTREVVYVTRGTVRVQWLDDAQQLHEEILNEGDSIFVTPLVPHSFTNHSTQEKSEIIAINYE

SEQ ID NO: 10404 - protein, 55 aa, Xenorhabdus bovienii
  Coding DNA sequence: Name=SeqID_4296
MNNIVAIATSSCAPNRLEALYIIKLGDSISINKDDRYELHWENLQLIADITAQRK

SEQ ID NO: 10405 - protein, 31 aa, Xenorhabdus bovienii
  Coding DNA sequence: Name=SeqID_4297
MPLRKVNIGIRYTVRSFDLEMATCITSDLLA

SEQ ID NO: 10406 - protein, 294 aa, Xenorhabdus bovienii
  Coding DNA sequence: Name=SeqID_4298
  Gene classification: Gene name=MmsB; Function=3-hydroxyisobutyrate dehydrogenase and related proteins; Function class=I Lipid metabolism
  Homolog annotation: Query=4..230bp; Hit=5..231bp; Blast score=101; Percent Identity=29.0; E value=1e-21; Homolog= BS_ykwC COG2084
MYNIGFIGLGRMGQAICLRLLSHDIILRVYNRTPEKATKLLDKGAVWCNSPAELGAACDIIMLCLSGEQVTEALLTDSENGLLRHCHPGCMIIDTGTISPESATYNAHLTETQGQEYISCPVSGGVEGANNGTLAAIVAAQPAVRTIIESVISRFADRITWLTSHADAQKLKIINNLAESINLLGAFEVLNIGLTHGITLDELHSVLTTCRGRSAYMDVALRFLNSNLKPSDVSLAVRCKDLCLAGSLADISRHYPISDAAIELFSRVREKYGDEQDQCEYFNFINEEKKLNDN

SEQ ID NO: 10407 - protein, 380 aa, Xenorhabdus bovienii
  Coding DNA sequence: Name=SeqID_4299
  Gene classification: Gene name=LeuA; Function =Isopropylmalate/homocitrate/citramalatesynthases; Function class=E Amino acid transport and metabolism
  Homolog annotation: Query=11..360bp; Hit=7..354bp; Blast score=261; Percent Identity=39.0; E value=6e-70; Homolog= MJ1392 COG0119
MTINHNIILEDTTLRDGEQAPGVAFTGEEKLAIIDSLISSGVKWIEAGINAMGGSESRTLHMMLERVEGSDIHLIGWNRGVKEDIAASLDLGFNHIHIGLPTSSIHLDNSLAKSRSWLVNQACQLVDYAKQRGAFVSISAEDVGRSDLDFVIEYATAIKEAGADRLRLSDTVGILTPQQYGHIIEQLTQKVAIDTQCHTHNDFGYGVANTIAGLHAGARYFHTTVNGIGERAGMPDMAQTVMTLRVHYGVDLGIDTTHLKALSHQVANAAGITMYPWQPITGSNVFSHESGIHANGTLKNSSAFEPIAPEMVNGERRIVIGKHSGKASLKYALGCQGHSWDEERLGDLLALVREVATLKKGDLSYQAVCLLYDSLVQRGV

SEQ ID NO: 10408 - protein, 188 aa, Xenorhabdus bovienii
  Coding DNA sequence: Name=SeqID_4300
  Homolog annotation: Query=11..187bp; Hit=13..189bp; Blast score=77; Percent Identity=32.0; E value=1e-13; Homolog= dbj|BAA94418.1|
MVSLTFYRKTIEQLLARRKMVLTDIRHLVCVSDDSVEVEDFDQLFALSQHTSLSASEYIAAHHRENAAQNELVTITRKDRLYTRIKGDALRGGYHYRHVLTTTLDPDLLVLRTTPLSTRHQARPNTGHQVKEIVYVLSGRVGIVWQNTGGNERHSNLGSGDSVYIDSWVPHAFYAIEPESQILAVDYL

SEQ ID NO: 10409 - protein, 59 aa, Xenorhabdus bovienii
  Coding DNA sequence: Name=SeqID_4301
MGTACFLCHRAGVTDSGCRLPLTQGLTSAETEMAQPASPAVLCPVRLLTERFFRESLGR

SEQ ID NO: 10410 - protein, 296 aa, Xenorhabdus bovienii
  Coding DNA sequence: Name=SeqID_4302
  Gene classification: Gene name=PenP (BS); Function=Beta-lactamase class A; Function class=M Cell envelope biogenesis, outer membrane
  Homolog annotation: Query=27..295bp; Hit=32..304bp; Blast score=218; Percent Identity=44.0; E value=4e-57; Homolog= BS_penP COG2367
MPFSSLRLTRISATIFPLLGALIPFPTHATTQQNQITNQLSALEKNANGRLGVVLIDTADHSIITYRGHERFPLCSTSKMMTVSALLKKSETDKDLLNQRIHYQQSDIVEYSPITEKHLKDGMTLAELSAATIQYSDNTAMNLLLDQLGGAHSVTRFARSIGDNAFRLDRKEPELNMVTPGDERDTTTPQAMADSLYKLALGNTLAATQRTQLVEWLKGNTTGGTSISAGVPDNWIVGDKTGRCDYGSTNDIAVIWPDKDKAPLILVTYFTQPSDKDAKAHNDVLAAAARIMTQER

SEQ ID NO: 10411 - protein, 50 aa, Xenorhabdus bovienii
  Coding DNA sequence: Name=SeqID_4303
MTLLMYALKKSEWKPVILWHALLPDITNSLKKTVNKLPPITSGSFIISTR

SEQ ID NO: 10412 - protein, 646 aa, Xenorhabdus bovienii
  Coding DNA sequence: Name=SeqID_4304
  Gene classification: Gene name=VacB; Function=Exoribonucleases; Function class=K Transcription
  Homolog annotation: Query=1..646bp; Hit=1..644bp; Blast score=915; Percent Identity=68.0; E value=0; Homolog= rnb COG0557
MFQDNPLLAQLKQQLHAQTLRVEGLVKGTEKGFGFLEVDGQKSYFIPPPQMKKVMHGDRITAAIHTDKEKEIAEPEALIEPFLTRFVGRVQKKENDNRLWIIPDHPLLKDTILCRPANQVTHNFENGDWAVAEMRRHPLKGDRGFQAEITGYITKGDDHYAPWWVTLTRHNLQREAPTMPDCQLDDGSLERIDLTALDFVTIDSATTEDMDDALHIVKNGDGSLKLSIAIADPTAYIKADSELDKIAYQRSFTNYLPGFNIPMLPRELSDDLCSLRPNVRRPALVCQVSILEDGQLGDDMQFFAAWVESKFKLAYDDVSDWLEHQAGWKPESEAVTTQITLLQEMCERRNQWRHQYALVFKERPDYRFVLDKGGNVVDIVIDQRRSANRIVEEAMITANLCAAKILRDKLGFGIYNVHTGFEPTQIDQVVDVLKENGIETEANALLELDGFCQLRRELDQQPTQFLDSRIRRFQTFAEIKPEPGPHFGLGFDAYATWTSPIRKYSDIINHRLLKAIIQQTEEEKPSEEVCLQLTDRRRANRMAERDVGDWLYARFLHPHAGTDKTFSSEIVDITRGGLRIRLVDNGAIAFVPGPFLHAVRDELQCSQETGSVLIKGEAVHRLNDIINVRIEEVRMETRNIVARPVA

SEQ ID NO: 10413 - protein, 72 aa, Xenorhabdus bovienii
  Coding DNA sequence: Name=SeqID_4305
MSSNFVVGRSFLQFMVKCAIDGWLGDGEWFGQIADRGFSYTIYELMDNLFISLFYLGIFITRFYQHTHTDPQ

SEQ ID NO: 10414 - protein, 210 aa, Xenorhabdus bovienii
  Coding DNA sequence: Name=SeqID_4306
  Gene classification: Gene name=Nth; Function=Predicted EndoIII -related endonuclease; Function class=L DNA replication, recombination and repair
  Homolog annotation: Query=1..210bp; Hit=1..210bp; Blast score=371; Percent Identity=84.0; E value=1e-103; Homolog= nth COG0177
MNQQKRIAILTRLQNNNPQPTTELAFNSPFELLISVLLSAQATDVSVNKATTKLYPVANTPQTILNLGVDSLKEYIKTIGLYNTKAENVIKTCRILLEKHQGEVPEDRAALEALPGVGRKTANVVLNTAFGWPTIAVDTHIFRVCNRTQFAPGKNVDEVERKLLKVVPDEFKLDCHHWLILHGRYTCIARKPRCGSCIIEDLCEYADKTE

SEQ ID NO: 10415 - protein, 235 aa, Xenorhabdus bovienii
  Coding DNA sequence: Name=SeqID_4307
  Gene classification: Gene name=NqrD; Function=Na+-transporting NADH; Function class=C Energy production and conversion
  Homolog annotation: Query=1..227bp; Hit=1..229bp; Blast score=295; Percent Identity=74.0; E value=2e-80; Homolog= ZydgQ COG1347
MSETKKLFSQGLWKNNSALVQLLGLCPLLAVSSTATNALGLGLATTLVLLSTNIAVSALRRWVPHEIRIPIYVMIIASVVSAVQMLINAFAFGLYESLGIFIPLIVTNCIVIGRAEAYASKNSIYNSTIDGLAMGLGATFSLFVLGTIREILGNGTIFDGADLLLGSWAKSLRIEIMHMDSPFLLAILPPGAFIGLGLMLAGKYIIDERIKNRADNQARRYDNVEKGCGSHITKS

SEQ ID NO: 10416 - protein, 208 aa, Xenorhabdus bovienii
  Coding DNA sequence: Name=SeqID_4308
  Gene classification: Gene name=NqrC; Function=Na+-transporting NADH; Function class=C Energy production and conversion
  Homolog annotation: Query=1..206bp; Hit=1..205bp; Blast score=276; Percent Identity=65.0; E value=1e-74; Homolog= ydgP COG2869
MLETMRRHGITLAIFAACTTGLTAIVYSLTKDRIAEQAALQHKILLDQVVPPTLYNNNMQDECYVVTADALGNKQPHRLYLARKNGSPVAAAIESTAPDGYSGAIQLLVGADFSGNVFGVRVTEHHETPGLGDKIDTRISNWIYSLSDKKVVSNNDPHWAVKKDGGEFDQFTGATITPRAVVNAAKWTTLYLKTIPAQLSSLPTCGVE

SEQ ID NO: 10417 - protein, 359 aa, Xenorhabdus bovienii
  Coding DNA sequence: Name=SeqID_4309
  Gene classification: Gene name=NqrB; Function=Na+-transporting NADH; Function class=C Energy production and conversion
  Homolog annotation: Query=14..359bp; Hit=4..350bp; Blast score=405; Percent Identity=61.0; E value=1e-113; Homolog= ydgO COG1805
MKFRPVKTDNNQLKVASSPFTHNQKSTSQLMLWVVLAAVPGIAVQTYLFGYGTLFQILLAVITALLAESVAIAMKKQVIAPFLKDNSALVTGLLLGISLPPLAPWWLIVLGTFFAIIIAKHLYGGLGQNPFNPAMVGYVVLLISFPVQMTSWLPPVSFQALTLTPWDCLMVIFTGHTLDGSTLLHLQQGIDGLSQATPLDSFKTGRLTHNIDEVLQQPILQGTLVGIGWQWVNVAYLIGGLIMLNRKVISWQIPTAFILALCTCALLSWLIDPTSYSPPLLQIFSGATMLGAFFIATDPVSASTTAKGRLIYGAIIGVLIWIIRVYGGYPDAIAFAVLLANICVPLIDHYTQPRAYGHK

SEQ ID NO: 10418 - protein, 747 aa, Xenorhabdus bovienii
  Coding DNA sequence: Name=SeqID_4310
  Gene classification: Gene name=NqrA; Function=Na+-transporting NADH; Function class=C Energy production and conversion
  Homolog annotation: Query=1..477bp; Hit=1..477bp; Blast score=645; Percent Identity=66.0; E value=0; Homolog= Z2636_1 COG1726
MFNLFNLLNKNKIWDFEGGIHPPEMKLQSSRTPLRHAPLPDELIIPLQQHLGPEGELLVKVGDKVLKGQPLTVGTGRTVPVHASTSGTITAIEPCVTTHPSGLKELCVRLYPDGEDKWCERIQTTDYTSLNTSTLLQRIQQAGIAGLGGAGFPTASKLQGSRHDLKTLIINAAECEPYITADDRLMQEHANEVIEGIRILMHLLNPERVLIGIEDNKTEAIDALNTALNGDDSIVVRVIPTKYPSGGAKQLTKILTGKEVPSGGRSSDIGVLMQNVGTVMAIKRAIIDGEPLIERIVTLTGEAVTAPGNFWARLGTPVQFLLQQAGFKAKPEQMVIMGGPLMGFTLPDLNVPVVKISNCILAPSIQEMEPKTVEEACIRCGLCVEACPAGLLPQQLYWFSRGQEHKKAKNHHLFDCIECGACAYVCPSNIPLVQYYRQEKAEIRAIDAETRRSAEAKIRFEAKQTRMEQEKLAREERHKKSAVQVDSKDQSAIQAALSRVKEKQKNAGEAINVQAGQLPDNEAAIAARKARKEQLRIRQEEKPAAITVNTEPATPTESDDPRKAALAAAIARAKAKKATQSEKVTTSQKDSPNNADDKQDPRKAAVSAAIARAKAKKATQNQSEPTPQQEDITAVPEEADPRKAAVAAAIARAKAKKATQSQSKPTPQQEDVTAVSEETDPLKAAVAAAIARAKAKKAAQNQSKPTLQQEDVTAVPEEADPRKAAVAAAIARVKAKKAALEKQKSSA

SEQ ID NO: 10419 - protein, 205 aa, Xenorhabdus bovienii
  Coding DNA sequence: Name=SeqID_4311
  Gene classification: Function=Predicted alternative beta subunit of Na+-transporting NADH; Function class=C Energy production and conversion
  Homolog annotation: Query=1..188bp; Hit=1..188bp; Blast score=275; Percent Identity=72.0; E value=2e-74; Homolog= ydgM COG2878
MMSLWIAIGVLSLLGLAFGLILGFAARRFKVEEDPIVEKIDNLLPQSQCGQCSYPGCRPYAEAIANNGEMINKCAPGGEQVMLKMSELLGVDPQPLDGDDSVQNPARKVAFIDEENCIGCTKCIQACPVDAIIGANRAIHTVVEDLCTGCDLCVAPCPTDCITMIPVATTTSNWKWDLNSIPVRNIPINPIFVSPTKPVEVKANV

SEQ ID NO: 10420 - protein, 218 aa, Xenorhabdus bovienii
  Coding DNA sequence: Name=SeqID_4312
  Gene classification: Gene name=NqrE; Function=Na+-transporting NADH; Function class=C Energy production and conversion
  Homolog annotation: Query=26..217bp; Hit=1..192bp; Blast score=249; Percent Identity=88.0; E value=1e-66; Homolog= ydgL COG2209
MGQSLSFSLTINSTLLSNILFSGIAMTEYLLLFIGTVLVNNFVLVKFLGLCPFMGVSKKLETAIGMGLATTFVLTLASISSWLINTFILVPLDLVYLRTLSFILVIAVVVQFTELVVRKTSPTLYRLLGIFLPLITTNCAVLGVALLNVNQSHNFLQSAIYGFSAAVGFSLVMVLFAAIRERLAVANIPAPFRGSSIGLITAGLMSLAFMGFSGLVKF

SEQ ID NO: 10421 - protein, 146 aa, Xenorhabdus bovienii
  Coding DNA sequence: Name=SeqID_4313
  Homolog annotation: Query=1..146bp; Hit=1..146bp; Blast score=158; Percent Identity=71.0; E value=1e-38; Homolog= ref|NP_929621.1|
MYQSNDYYRINGWLLAPAAYLIMTLIAASLMLLLYLITLIYRNEAVHQVDGNFTTMWYISLLTTAMMWCFTLWVLKLLFIRSKRFPRIFIIWLMVSVLIAIKTFAFSPISDEMAIRSLLWPLLAAAVFVPYIKRSHRVKMTFTQDR

SEQ ID NO: 10422 - protein, 348 aa, Xenorhabdus bovienii
  Coding DNA sequence: Name=SeqID_4314
  Gene classification: Gene name=MviM; Function=Predicted dehydrogenases and related proteins; Function class=R General function prediction only
  Homolog annotation: Query=1..345bp; Hit=14..358bp; Blast score=449; Percent Identity=62.0; E value=1e-126; Homolog= Z2629 COG0673
MSDFLKVGLVGYGYASKTFHAPLIAGTSNVELVAISSSDTEKVRKDWPTVTVVSSPEALFSDPDIDLIVIPTPNDTHYPLAQKALAAGKHVVVDKPFTITVEEAEALKKQAEEANLLLSVFHNRRWDAGFLTVKSLIQENRLGKLKYYESHFDRYRPVVRQRWREAAGAGGGIWYDLGPHLLDQAVQLFGKPHAITVDLGMIRPNAEAVDYFHTQLNYPDLKVVLHATTVAAAESPIYILHGMEGSYVKYGLDTQEERLKAGERPPRTDWGYDVRDGSVTLSQGDDLITQIIPTLPGNYGTYYAAIRDAIVAGKPNPVTANEAILIMKLIESGEKSAKEQRTILIDWE

SEQ ID NO: 10423 - protein, 327 aa, Xenorhabdus bovienii
  Coding DNA sequence: Name=SeqID_4315
  Gene classification: Function=Predicted Na+-dependent transporter; Function class=R General function prediction only
  Homolog annotation: Query=9..325bp; Hit=7..320bp; Blast score=344; Percent Identity=64.0; E value=9e-95; Homolog= ZyfeH COG0385
MSWWQKLRIDPFLVTLITVVIIATLFPCEGESKKWFQYLTTAAIALLFFMHGAKLSRSAILAGIGHWRLHLVIFLSTFVLFPILGMGLYFIVPEWLSPTVYMGFLYLCALPATVQSAIAFTSVAKGNVAAAICSASASSLLGVFISPLLVGLLIQTNDGGGHTDTWKAIKDIILQLMVPFIAGHLPRPLIASWVEKHKKLVNTTDRSSILLVVYVAFSEAVVEGIWHKIDAYSLMMIGVVCCILLVMVLMINVYSSRLFGFSKEDEITIVFCGSKKSLANGVPMANVLFPASMVGVMLLPLMIFHQIQLMVCAVLAQRYARRPKKAD

SEQ ID NO: 10424 - protein, 333 aa, Xenorhabdus bovienii
  Coding DNA sequence: Name=SeqID_4316
  Gene classification: Gene name=Add; Function=Adenosine deaminase; Function class=F Nucleotide transport and metabolism
  Homolog annotation: Query=1..331bp; Hit=1..331bp; Blast score=474; Percent Identity=72.0; E value=1e-134; Homolog= add COG1816
MIDIRLPLTDLHRHLDGNIRPETILELARQHNIPLPAYELEALRPHVQITENEPNLISFLQKLDWGVAVLADLDACRRVAIENVEDAVNAELDYAELRFSPYYMAMKHQLPVEGVVEAVIDGIHSASQQLDVQIRLIGILSRTFGEKACSQELASLLVHKQHITALDLAGDELGFPGHLFEQHFIQARDAGWNISVHAGEAAGAESIWHAIRDLGATRIGHGVKAITDPALMDYLAKHGIGIESCLTSNLQTSTVNSLSAHPLKQFLAHGILASINTDDPAVEGIEIRHEYNVAAPAAGLSPEQIRQAQINGLKTAFLSETEKQALKAKAANR

SEQ ID NO: 10425 - protein, 483 aa, Xenorhabdus bovienii
  Coding DNA sequence: Name=SeqID_4317
  Homolog annotation: Query=1..480bp; Hit=1..481bp; Blast score=463; Percent Identity=50.0; E value=1e-129; Homolog= ref|NP_929607.1|
MKKSLVAVGVIVALGAAWIGASWYTGKQIEGRLNNIIKTVNTQLAKSFPESAIEWQTKDFQRGVFSSDVRLILKIKDGVKNTDIKPNEEIIFKSSIGHGPLPISDLKKLHLVPKMASIHSELEQSEATKALFEATKGKSLLTMETKIGYSSSLSTDIDFIPVDYTAKNGNKLVFSGAKIDAEIARDLSNFKFDVKSDRLIFSSPSKHEELTLKGIGFKGDNKKGKFDLYLGDQNYNIDEITLSSTSDDSFSLKGMKITSKVGETDKNLNLNVSYGIDGLKLKNMDLGSGQLVIGMSNLDGQSVRKFSQAYNDATAKVLTSEALSTDSVSNKVIENAHLLFNNSPQFSLEPIKWKNSKGESSVNFKLALKNIPENKDSLILMGPEEMIRTLLQELSLDVKIPKPMLIESITQAKILDGKTKEAAEAEATQEVQMIASQGVSFKILTDENNVIGLKLHYANDKVELNNKKSDLHQFLLDNHLIGS

SEQ ID NO: 10426 - protein, 392 aa, Xenorhabdus bovienii
  Coding DNA sequence: Name=SeqID_4318
  Gene classification: Gene name=ManA; Function=Phosphomannose isomerase; Function class=G Carbohydrate transport and metabolism
  Homolog annotation: Query=1..392bp; Hit=1..389bp; Blast score=466; Percent Identity=58.0; E value=1e-131; Homolog= ZmanA COG1482
MLKMTNQIQHYDWGSKTALTDIYGIKNPNNQPMAELWMGAHPKCSSQVTDPKTGETIALNALIAQEPEKYLGEKVVEQFQRLPFLFKVLCAAQPLSIQVHPDKSSAETGFDRENAAGIPLNSLQRNYKDDNHKPELVYALTPFKAMNAFRPLSDIAQLLGPVSAAHPDIQAFIQNPTESHLSFLFSQLLTMQGEQKRLAIAVLKSVLNNREGEPWDTIRKVAGFYPDDNGLFTPLLLNIVELKPGQAMFLYARTPHAYLEGVALEVMANSDNVLRAGLTSKHIDVAELMANLDFVSKPADTLLTLPKQEKDALNYPVPVNDFYFSVYDVSEQPITLKNDSASVLFCFEGQIIISSDEQQQQLRLFSGESVFLSAIEKNLTVHGNGKIAKVSN

SEQ ID NO: 10427 - protein, 487 aa, Xenorhabdus bovienii
  Coding DNA sequence: Name=SeqID_4319
  Gene classification: Gene name=FumC; Function=Fumarase; Function class=C Energy production and conversion
  Homolog annotation: Query=24..487bp; Hit=1..464bp; Blast score=759; Percent Identity=82.0; E value=0; Homolog= ZfumC COG0114
MPTNLSANFDPAYSIILCAKEIVMAATRIEKDSMGPIEVPADQLWGAQTQRSLEHFRISQEKMPVALIHALALTKQAAASVNMDLGLLPKERSDAIIAAAKEVLEGKHPTEFPLAIWQTGSGTQSNMNMNEVLANRGSEILGGQRGNERLIHPNDDVNKSQSSNDVFPTAMHVAAVIGLSEQLLPELKALQKTLADKAVAFKDIVKIGRTHLQDATPLTLGQEISGWAAMLTHNLKHIEDSIPHVCELALGGTAVGTGLNTHPEYAVRVAKKIAELSGQPFVTSPNKFEALATCDALVHSHGSLKGLAASLMKIANDVRWLASGPRCGIGEISIPENEPGSSIMPGKVNPTQCEAMTMLCAQVMGNDVAINIGGASGNFELNVFRPMVIDNFLQSIRLLADGMRSFNEHCAVGIEPNRDRITQLLNESLMLVTALNTHIGYDKAAEIAKKAHKDGLTLKQSAMQLGYLTDAEFDAWVRPEDMVGSMK

SEQ ID NO: 10428 - protein, 320 aa, Xenorhabdus bovienii
  Coding DNA sequence: Name=SeqID_4320
  Homolog annotation: Query=13..320bp; Hit=1..308bp; Blast score=437; Percent Identity=71.0; E value=1e-121; Homolog= ref|NP_929602.1|
MKKPHHLSLRVLMNKYFSIESLTSSFKKQEEKLAELVGLLMDYPLIDARVFELPQIEKGEEHEQITEIAVNPLQGNDALNLGLHFYQKLFIHHNHPNISSKAASRLPGALCFAVSHQQYKTAMNVINEVNQLKAELENIVTKESGVSKEQRFEFVHDHLRGLITLNAYRTITPLMNPDSINFGWANKNIINKVTKQQVLEQLEKSYNSGRAVPPYSSDQWAALVALEITDIKKLPDDAILKIKRPVKVQPITRVWYSELQKQVQYACPLPIIVFYTDDCEIKPKIGTLSNYNANAIKHRYKPKAKPLELVIPRLHLYREI

SEQ ID NO: 10429 - protein, 210 aa, Xenorhabdus bovienii
  Coding DNA sequence: Name=SeqID_4321
  Homolog annotation: Query=1..205bp; Hit=16..219bp; Blast score=84; Percent Identity=29.0; E value=2e-15; Homolog= ref|NP_286113.1|
MKKLVKPVNSFEKVVDTLLPYSELIASDLPTQGKLLKVENEFAKFFLLQQGYVNIRRVDDSLIIATVFSPYIIGLSFYSGSDVYYSIELGPHCRLYQLPRINALNAIKKHDLYREWMRIISYKMAFLYARDVSIFRPGAKEVVCSLLSRLITLPAEFHENTSVIKYIEQRCTLSRSCIQRVLSSLKRENYIEMIDGHLVKINSLPIHSYY

SEQ ID NO: 10430 - protein, 426 aa, Xenorhabdus bovienii
  Coding DNA sequence: Name=SeqID_4322
  Gene classification: Gene name=ProP; Function=77 Permeases of the major facilitator superfamily; Function class=G Carbohydrate transport and metabolism
  Homolog annotation: Query=35..423bp; Hit=25..413bp; Blast score=461; Percent Identity=62.0; E value=1e-130; Homolog= ynfM COG0477
VNTAPSVGEESAVPDVESDVESDVEINRRHENEQRYIQRDDAVYLRVTLSFFAVGLATFALLYFVQPILPILSEEFNVSPASSSLALSLSTGMLSLGLLITGPLSDALGRKNVMVVSLAAAAIFTLLSTVVTSWNGLLVVRALIGVSLSGVAAVAMTYLSEEIHPSYVALSIGLYVSGNSLGGMSGRLITGVIADHFPWRFAVILLGSFALIAAIAFWKMLPPSKNFRASSLKPNTLFINLKLHFRDQGLPLLFAEAFLLMGCFVTMFNYIGYRLLGAPYHFNQTIIGLLSIVYLTGTYSATKAGALTNKHGRGKVLLVAISMMLIGGFITICSSIWAIMLGMMVLTTGFFAAHSVASGWVGWRAKRAKAQASSLYLFCYYAGSSVAGTLGGIFWLHFQWNGVVIFMSLLTIIALYLGLKLNKSEE

SEQ ID NO: 10431 - protein, 305 aa, Xenorhabdus bovienii
  Coding DNA sequence: Name=SeqID_4323
  Gene classification: Gene name=LysR; Function=Transcriptional regulator; Function class=K Transcription
  Homolog annotation: Query=3..288bp; Hit=1..284bp; Blast score=300; Percent Identity=54.0; E value=2e-81; Homolog= ynfL COG0583
MSINIELRHLRYFIAVAEELHFGRAAERLNISQPPLSQQIQALETSIKAQLLARNNRNVSLTPAGNMFLKEAYQILAQVDAAATKAARMQQGELGEISIGFTSTTPFMRKVTLSLRQFRERYPDVAIHMHQMNTKQQIAPLQTGRIDIGVMRNTLLPDNLEHRLLFRERFMLAVYDGHPLLNYANEGISLEMLSGYPLVFFERDVGTALYDEIISLLANAGVTPMISQEAGEAMTILGLVAAGLGISIITESFTRMKIDGVQYLHLANAPACSEVWLVNHKNRQNSAAVDRLTNLLISNIVDESC

SEQ ID NO: 10432 - protein, 406 aa, Xenorhabdus bovienii
  Coding DNA sequence: Name=SeqID_4324
  Gene classification: Gene name=NagC; Function=Transcriptional regulators; Function class=K Transcription
  Homolog annotation: Query=6..406bp; Hit=6..406bp; Blast score=453; Percent Identity=54.0; E value=1e-127; Homolog= Zmlc COG1940
VSVDIQPSHVDQIKQTNIGLVYRLIDQYGPISRIALSKKSQLAPASITKITRELIDAHLVKEAEFPDLSFRGRPAVGLKIDSKGWQFLCIRINKESVVFGLRDLSNNLRVEEELPFSFSLNQSFLDCIVDEIDDFFFRHQSCLERLTAISITTNAIIDPNNGIIHSSPYYDIQDIPLGTFLHQRTGLPTFLQHSITAWTIAESLYGAGENCQNIIQIVIDDNVGAGVMTAGQMLHAGNHSVVEIGHTQVDPDGEHCYCGNTGCLETVVGIKNILVKAHRLAESHPDSLLYSISPLTIDSLCQAANQGDLLATNIIHDVGERIGRIMAIMVNIFNPEKILIGSPLNGAQNILYPAIQQQIAQLSLPGYSQQVNIVATRFDNTGTLPAASLIKQSLYSGELLIELMQG

SEQ ID NO: 10433 - protein, 222 aa, Xenorhabdus bovienii
  Coding DNA sequence: Name=SeqID_4325
  Gene classification: Gene name=BioD; Function=Dethiobiotin synthetase; Function class=H Coenzyme metabolism
  Homolog annotation: Query=1..217bp; Hit=5..224bp; Blast score=256; Percent Identity=54.0; E value=1e-68; Homolog= ynfK COG0132
MLTRLFVTGTDTNIGKTVVTRALLQVFNREGTTAVGYKPIATEKRETPEGIRNHDALVIHKSSPVQVTYEEINPIIWESNYEEGNQINFVQMTKSLKNLSQKADRVIIEGNGGWRILLQDDSFYSDWVVQEKLPVILVVGIQAGCVSHAILTAQSIINDGVPLIGWVANRINPGLAHYAKTLDRLRYHIPAPQLGEIPYLLRPEERDLSCYLDISAISKFDN

SEQ ID NO: 10434 - protein, 99 aa, Xenorhabdus bovienii
  Coding DNA sequence: Name=SeqID_4326
  Homolog annotation: Query=2..81bp; Hit=3..80bp; Blast score=75; Percent Identity=50.0; E value=1e-13; Homolog= ref|NP_929488.1|
MVKKILLTGALFFALAPFAVQASQKTTCESLKEIISQKIIDNHVSKEDFRLEVVPNDQVVEGTGKVVGSCDYGKQKIVYIRLSHTTGSHATSDAKEAQK

SEQ ID NO: 10435 - protein, 139 aa, Xenorhabdus bovienii
  Coding DNA sequence: Name=SeqID_4327
MLSFVRLVLQREQAQKTRHQSVGSFSPSSPYLLMSMFGLSGFDRKTCIEIQTTFCIGFPISIHVGAFQTGISIINVHLILIKLFFFTFVNFFAKASLFIPFFFLLTSHFFAHRILTTPIDGYASTTRCTRRRKCWSLPQ

SEQ ID NO: 10436 - protein, 249 aa, Xenorhabdus bovienii
  Coding DNA sequence: Name=SeqID_4328
  Gene classification: Gene name=DltE (BS); Function=Short-chain dehydrogenases of various substrate specificities; Function class=R General function prediction only
  Homolog annotation: Query=1..247bp; Hit=1..247bp; Blast score=363; Percent Identity=70.0; E value=1e-101; Homolog= ydfG COG0300
MIVFVTGVTSGFGEAIARKFIKHGSVVIATGRRKERLDRLKAELGENFHPIQLDVRDRNAIEKVVQELPDALRNVDVLVNNAGLALGLEPAHQANPDDWETMIDTNTKGLVNMTRALLPKMVQINHGHVINIGSTAANWPYAGGNVYGATKAFVKQFSLGLRADLQGKNIRVTDIEPGLVGGTEFSQVRFKGNDEKVNKTYDGAEALTPDDIAEAVFWVATLPSRVNINTLEMMPVCQSFAGLSVHRNP

SEQ ID NO: 10437 - protein, 55 aa, Xenorhabdus bovienii
  Coding DNA sequence: Name=SeqID_4329
MNSLSTINIVFFKCYFLLINISVRLTMTKILKLCNYRGIPIMSLKLPPVSCYPFY

SEQ ID NO: 10438 - protein, 243 aa, Xenorhabdus bovienii
  Coding DNA sequence: Name=SeqID_4330
  Gene classification: Function=Gluconolactonase; Function class=G Carbohydrate transport and metabolism
  Homolog annotation: Query=1..238bp; Hit=55..291bp; Blast score=257; Percent Identity=51.0; E value=7e-69; Homolog= PM1248 COG3386
MFRWSEGDDVSLWRQNSNYVNGNALDNEERVVSCEHGRRGISRTEKDGSVIMLVDKIDGKRFNSPNDVVVRSDGTIWFTDPPYGIISDEEGYKSESQIIGCYVYCYDPNDNKISIATSDVQRPNGLAFSPDEKWLYVADMSIADFPLHGRHELRIYPVQGKTLGAGKHFVTVSPGFPDGFCVDKFGNIYCSCLDGILIFNKFGKKIHKIAVPERTSNCTFGGINGDQLYITATTSLYRASFRW

SEQ ID NO: 10439 - protein, 175 aa, Xenorhabdus bovienii
  Coding DNA sequence: Name=SeqID_4331
  Gene classification: Gene name=GrpB; Function=Uncharacterized ACR; Function class=S Function unknown
  Homolog annotation: Query=24..165bp; Hit=1..142bp; Blast score=128; Percent Identity=48.0; E value=3e-30; Homolog= BS_yqkA_2 COG2320
MSRVITIEPYNSHWVNAYNDEMVKLKDDFPEEILFVHHIGSTSVLGLAAKPIIDILLEIKNMGKFDENHSVIESLGYTARGEYGIPGRRYFIKGGDNRTHHIHAFETGCFHITRHLVFRDYLRRHNDIAHQYAEIKYQAARACGNSSEIYCQLKNEFILLHEKLALKELSPNENQ

SEQ ID NO: 10440 - protein, 75 aa, Xenorhabdus bovienii
  Coding DNA sequence: Name=SeqID_4332
  Homolog annotation: Query=19..61bp; Hit=337..379bp; Blast score=78; Percent Identity=81.0; E value=3e-14; Homolog= ref|NP_569402.1|
VRTNVVWMITTAVLPKFLDMVLMLIEDSEISRKAIGKYIDVWHYPDGRKELRLNSVILPYSNIWLWFLRIMWHFH

SEQ ID NO: 10441 - protein, 290 aa, Xenorhabdus bovienii
  Coding DNA sequence: Name=SeqID_4333
  Homolog annotation: Query=27..187bp; Hit=1..165bp; Blast score=85; Percent Identity=34.0; E value=1e-15; Homolog= ref|NP_561592.1|
MRRKLSLFICGIFPIADFNIFLGFFVMPWTFSHPAAVFPLKSLPGGRLLNLPALITGSLSPDFFYSVGLYDVATVAHHLPGWFYTAFPLCLLIFLIVRLLSYPLSVLFPISFARYKKPDYKDRVLFVLSLFIGAVTHIGWDAFTHDKGFFVELIPLLQFRIFHSITNGQGISIYKILQHLSSLSGLLYLAMKYWRYQKKLDLSIQKTNKRKLYYLIVIGFISGFLTCPVALFLSWEVSGINMGRFIFKELTLSVPVFFIILVLIALWIRYYSSKTKLVQSKSIDIQIDNT

SEQ ID NO: 10442 - protein, 304 aa, Xenorhabdus bovienii
  Coding DNA sequence: Name=SeqID_4334
  Gene classification: Gene name=LysR; Function=Transcriptional regulator; Function class=K Transcription
  Homolog annotation: Query=9..294bp; Hit=8..293bp; Blast score=254; Percent Identity=46.0; E value=1e-67; Homolog= mlr2579 COG0583
MRKNDHFSGIVAFVATAQLGSFTAAAERLGLTKSAVGKSLNRLEERLGLKLFQRSTRSLSLTPEGDVFLQSCQNAIAILEQAEAGIASHITSPIGRLRIDLPAAFGRQRILPILLNITKEYPELTLSVSFSERFVDVIEDGIDLVIRIGELADSSGLVARRLTTQKLVICAAPDYLQRRGIPTSSDELNQHHCVVGFRRHQPFHWCLRTTNGNNKNITPPPTYELADGDAMLTAVLAGCGLAQLPLWMVNRYLKNGELKTVLPEYSGVEVPISALWPKSRQLLPKIRYVVDTLVAAAENGLLDE

SEQ ID NO: 10443 - protein, 392 aa, Xenorhabdus bovienii
  Coding DNA sequence: Name=SeqID_4335
  Gene classification: Gene name=AraJ; Function=Arabinose efflux permease; Function class=G Carbohydrate transport and metabolism
  Homolog annotation: Query=9..353bp; Hit=5..349bp; Blast score=148; Percent Identity=30.0; E value=8e-36; Homolog= PA4355 COG2814
MTNKSFFLLMTLTISVFGVITTEVSVIGLLPQLELQLNTTPIQVGYLVSVYAIVVAIAGPVITLLLFKYNRKYVLLCILFIFIVSNIIYATENIFNIILIFRILPALTHALFFAVALVIAANSVPKEKSADAVATVFSGVALGMVLGMPLSSFIAEYVSLSAAFYFGSVTCLIAFIGVFYFIPSLPVSQKINILEQVTILKKPNLWLSIATVTLIFSAMFSSFSYISDYLTKITHLSNNMIAIFLILFGASGYMGNFIFSRLLQKNTVRTTYAYTFLFILVYCLVWILGFSPFVMVLLIIFWGIFHSSGLIVSQTWLMHEASEAPEFANSLYIAFSNLGITLGAMAGGFVISHYGVHSIVLTGILFLILSFFSIYIKNRATVAKQTSDKTII

SEQ ID NO: 10444 - protein, 46 aa, Xenorhabdus bovienii
  Coding DNA sequence: Name=SeqID_4336
MSYAVREFADDDKIDFKREAYFCLLFVEKKLSVSPVIVPIFGLTFI

SEQ ID NO: 10445 - protein, 31 aa, Xenorhabdus bovienii
  Coding DNA sequence: Name=SeqID_4337
MIRLALGSIELTPLRTELEKVRYIVEMYSCL

SEQ ID NO: 10446 - protein, 84 aa, Xenorhabdus bovienii
  Coding DNA sequence: Name=SeqID_4338
  Gene classification: Gene name=RhaT; Function=7 Permeases of the drug/metabolite transporter (DMT) superfamily; Function class=G Carbohydrate transport and metabolism
  Homolog annotation: Query=11..81bp; Hit=8..77bp; Blast score=73; Percent Identity=71.0; E value=3e-14; Homolog= mll1137 COG0697
MRYEHRLTKSTASGWFNGFIGVLIFSGSLPATKVAVMDFEPFFLTVARASIAGLLAFVMLLAFKEKRSGLLGEPVSLIMVACNH

SEQ ID NO: 10447 - protein, 135 aa, Xenorhabdus bovienii
  Coding DNA sequence: Name=SeqID_4339
  Gene classification: Gene name=DapA; Function=Dihydrodipicolinate synthase/N-acetylneuraminate lyase; Function class=E Amino acid transport and metabolism
  Homolog annotation: Query=1..128bp; Hit=4..133bp; Blast score=113; Percent Identity=50.0; E value=4e-26; Homolog= mll6376 COG0329
MFSGLSAFPLTPTNENGIDEAAFVRLIERLVVANVDSIGALGSTGNYAYFTLAERLRVTQLAVQHAGNTPVIIGIGALRTRDVLDLAEGAQTAGASAVLLAPISYQRLSADEVFGLYETVTRNLSVPLAYMTTQI

SEQ ID NO: 10448 - protein, 157 aa, Xenorhabdus bovienii
  Coding DNA sequence: Name=SeqID_4340
  Gene classification: Gene name=DapA; Function=Dihydrodipicolinate synthase/N-acetylneuraminate lyase; Function class=E Amino acid transport and metabolism
  Homolog annotation: Query=2..157bp; Hit=142..296bp; Blast score=114; Percent Identity=45.0; E value=6e-26; Homolog= mll6376 COG0329
MTHFEFSDELHGRIAHLPNVCSIKIPSVTVDPVAAKARVGRLRALIPSHVTIGISGDGFAATGLNAGCEVWYSVIDGLFPKAALAITRAAQAGDIQEVTRLSERLQPLWTFFRQYGGSLRVVASAAVLLGLVEQDCLPLPLKALEAADLQQLAELLD

SEQ ID NO: 10449 - protein, 152 aa, Xenorhabdus bovienii
  Coding DNA sequence: Name=SeqID_4341
  Gene classification: Gene name=WecD; Function=Histone acetyltransferase HPA2 and related acetyltransferases; Function class=K Transcription
  Homolog annotation: Query=1..142bp; Hit=1..140bp; Blast score=135; Percent Identity=49.0; E value=1e-32; Homolog= VCA0382 COG0454
MEITVFCPEHIEVLRILYLESRKVTFTWLNTDNYQLTDFDKDTEGEVIYIAVENGKVLGFISVWAQNHFIHHLYVSTESHRSGIGTQLLDFVKSKYPHQLSLKCLVKNHKAVNFYEFNGFIKKAKSSDELAGNYYLMVFSDQIRKKNQNIHS

SEQ ID NO: 10450 - protein, 139 aa, Xenorhabdus bovienii
  Coding DNA sequence: Name=SeqID_4342
  Homolog annotation: Query=11..138bp; Hit=6..133bp; Blast score=118; Percent Identity=46.0; E value=2e-26; Homolog= ref|NP_463051.1|
MKIHELMEVIENKYPAAESWVFGDSIEMYDKLSALVAEGTKTATSCSYHAYKQVDEDIEIGNEYIVLNGKNLPVCVVRVTAVHLTQFSAMTTELAWKEGEGDRSLHRWRMEHKCFFEREGTFSPDMEVVVIEFEVIEVL

SEQ ID NO: 10451 - protein, 443 aa, Xenorhabdus bovienii
  Coding DNA sequence: Name=SeqID_4343
  Gene classification: Gene name=BioA; Function=Adenosylmethionine-8 -amino-7-oxononanoateaminotransferase; Function class=H Coenzyme metabolism
  Homolog annotation: Query=10..442bp; Hit=15..447bp; Blast score=712; Percent Identity=76.0; E value=0; Homolog= PA0132 COG0161
MSDINSFQSLNLNAHWMPLSANRHFQQDPRLIVSADGNWLVDNQGRRIYDSLSGLWTCGAGHSRTEIRQAVSEQLGTLDYSPGFQYGHPWSFKLADKIANLMPGDLNHVFFTGSGSETADTAVKMARAYWRIKGKSAKTKFIGRARGYHGVNIAGTSLGGIGGNRKMFGQFMDVDHLSHTLQPGMAFTKGMPTAGGPELADELLKLIELHDASNIAAVIVEPVCGSAGAIVPPQGYLQRLREICTQHDILLIFDEVITGFGRLGRWTGADYFGVTPDILNFAKQITNGAIPLGGVVASSEIYNAFMAQRLPEHMIEFSHGYTYSAHPVACAAGLATLELLEKENLIQQSAELAQYFEQALHGLNHCPNVVDIRNCGLVGAIQIAPRDGDEAVRPFEAGIALWKAGFYVRFSGDTLQFGPMFNAKTDDLDRVFNAVGDILHQIK

SEQ ID NO: 10452 - protein, 50 aa, Xenorhabdus bovienii
  Coding DNA sequence: Name=SeqID_4344
MLSRRCSRVFDTTGPMNNIKIASEAIKAGIRRCDRRKSDNKLMIQINSHD

SEQ ID NO: 10453 - protein, 121 aa, Xenorhabdus bovienii
  Coding DNA sequence: Name=SeqID_4345
  Homolog annotation: Query=1..119bp; Hit=24..162bp; Blast score=65; Percent Identity=30.0; E value=2e-10; Homolog= ref|NP_930737.1|
MLFIGPVVSKTLEHRRDSIKSEVYHNMPMSGMQNSNNHHYASPAHGHDMHHGASHIHTGLMDDIACGYCQLLINLPLLTWVFVPFIWLALTISRTPPVRLFWGSAIQLFYGESQPRAPPLN

SEQ ID NO: 10454 - protein, 680 aa, Xenorhabdus bovienii
  Coding DNA sequence: Name=SeqID_4346
  Gene classification: Gene name=CirA; Function=Outer membrane receptor proteins, mostly Fe transport; Function class=P Inorganic ion transport and metabolism
  Homolog annotation: Query=14..680bp; Hit=39..723bp; Blast score=764; Percent Identity=55.0; E value=0; Homolog= PA3790 COG1629
MSTTQLFRVSPLTAALAVILFMPASSLAATGENNNDKEIKDTQTVNDRESVIIVTAPAISPLTIITSPKTPRQPVPASDGSDYLKTIPGFSQIRNGGTNGDPVFRGMFGSRLRMLVDDGEILGSCPSRMDAPSSYISPESYDVLSLVKGPQTVLWGAGNSAGTVRFERTRPQFDKLGAQGNISTVAASNGRWDGNADLSFGNELGYVRLSGNKSRSNDYKDGDGNRVPSRWDKWNTDIAVGWTPDDDTLLELTAGQGDGKARYAGRSMDGSKFKRESFGVRFEKSNISDVFDKFETNFYYNYTNHIMDNYSLRTPSPMSMGGHGGHGMGAMELDRRTMGGRMMGTWIWEDFKLQSGVDTQSNTHRNKYDTVWVKDARYRNYGIFSELTWDATEQSKVIGGARLDRVLVDNYVKAAERTATLPSGFIRLEHNLTEVPLMFYAGVGYTERFPDYWELFDYWELISSKPESKAFRDLKTEKTTQLDIGAQYHGQYFSGWVSAYVGKVNDFILFRYSPTDRTKSQANNVDATIMGGEMGASYQLSDHWKTDASLAYSWAKNTSDHRPLPQTPPLEARFGLTWEHGDWTSSGLLRVVSSQNRVSINEGNVVGKDFDRSAGFAILSANTAYKVTKNVQVSAGIDNIFDRTYSEHLNLAGSNSFGYSSNTPVNEPGRTYWARVNVKF

SEQ ID NO: 10455 - protein, 163 aa, Xenorhabdus bovienii
  Coding DNA sequence: Name=SeqID_4347
  Gene classification: Gene name=MarR; Function=Transcriptional regulators; Function class=K Transcription
  Homolog annotation: Query=4..152bp; Hit=5..156bp; Blast score=121; Percent Identity=44.0; E value=3e-28; Homolog= mlr3448 COG1846
MKYDHVDRLLIQWEQQRPDLDPSPMGVIGRLVRVNKIIEQRLQHAFKAHGLSAIEFDILATLRRYNTPITPTEMYQSVMLTSGAMSTRIEHMVQRGLIERIANEEDRRSCKVFLTPEGKTLIDNAVESHLENERAILQPLTEEQQEQIAILLRHWLLTNESAT

SEQ ID NO: 10456 - protein, 295 aa, Xenorhabdus bovienii
  Coding DNA sequence: Name=SeqID_4348
  Gene classification: Gene name=RhaT; Function=7 Permeases of the drug/metabolite transporter (DMT) superfamily; Function class=G Carbohydrate transport and metabolism
  Homolog annotation: Query=12..286bp; Hit=15..311bp; Blast score=71; Percent Identity=29.0; E value=1e-12; Homolog= sll0355 COG0697
MQETRILSNILLTALAPIVWGSTYIVATEILPPNMPLLASTVRALPAGILLLLVCRTVPKGVWWLRLTVLGLLNIGAFFYFLFVAAGYLPGGTASLIMSCQPVIVIFLSAYLLRTSLTKKHFFSAMLGIAGIALLVMNSATSLNWQGVIAGFAGCSCMALGVVLTKYWNRPANLSLLSFTGWQLTLGGLMLLPIAIYTEGVPQQLTPTNIIGYGYLCLIGAIFSYIIWFRGIEKLPVVSISFLGFLSALSACVLGFVFLKQTFSLLQFFGACTIIVSVWLSIPRNQTQKSNNSTI

SEQ ID NO: 10457 - protein, 203 aa, Xenorhabdus bovienii
  Coding DNA sequence: Name=SeqID_4349
  Homolog annotation: Query=6..203bp; Hit=1..200bp; Blast score=156; Percent Identity=39.0; E value=2e-37; Homolog= ref|NP_714572.1|
MKKSSMKLTIISGSQRPDSRSQRVASYLQELSREYGFTDIHLLELSNVELPFHDGYTTDISAESHPWQALAPNLRESDAFIFITPEWHGMATPALKNFLLYCSVTELGHKPALLASVSASMNGVYPLSELRMTGFKNNHVCFLPDHLIFRHSEGLISTDLACSNAEFEARAKYTLKLLKAYAEALKQVREVVGEESKNYPYGM

SEQ ID NO: 10458 - protein, 463 aa, Xenorhabdus bovienii
  Coding DNA sequence: Name=SeqID_4350
  Gene classification: Gene name=ProP; Function=77 Permeases of the major facilitator superfamily; Function class=G Carbohydrate transport and metabolism
  Homolog annotation: Query=9..424bp; Hit=15..432bp; Blast score=161; Percent Identity=32.0; E value=1e-39; Homolog= PA1262 COG0477
MTKKDYLALSVLLLAGFVTIFDLFVVNIAITNIQTHLQASIFQITLVIVAYEIGFGLLLITGGRLGDLFGRRRLFQLGILAFTLTSLFCGFAPTANFLIAARFLQGLAAALLFPQVYASIRVNFEGENSRRAFGLLGMTLGFAAIAGQTLGGWIVSANVWDLQWRSIFLINAPVGILAFVCSGYINESIARKKTELDWVGVVLSSISIFALLLPLLIGPVFGWPIWCWLLLLLAGVVLLQFIRHEIHYVSQGKTPLFDFDLLKNKQFSLGCLLVLFVYSTASSFFLVFALFLQNGLGFTPLDSGLIFAPASVGFVLSSLNASYWVKRFGSQAIVMGALLYSVSFIALIVTVATLPVATNLLLIVPILILLGYGQGFVMTPLLNIVLAFIHVRFAGMAAGIIATLQQIGAALGVAVVSVLVQWQLNNADALSFITYRNAFVSSMLYNVVAAFITFYLLKKLHQK

SEQ ID NO: 10459 - protein, 260 aa, Xenorhabdus bovienii
  Coding DNA sequence: Name=SeqID_4351
  Gene classification: Gene name=HipB; Function=Predicted transcriptional regulators; Function class=K Transcription
  Homolog annotation: Query=8..260bp; Hit=13..267bp; Blast score=167; Percent Identity=38.0; E value=1e-41; Homolog= mll1636 COG1396
MTKLKRTRTELASFLRIKRESLNPESVGLPHIGRRRTPGLRREEVAALAGVGLTWYTWLEQGREIGVSAIFLDNLAKVLKLNAAERRHLYLLAHMREPVETGQTWCVVSPIIKRIMNDLSPHLTYVLNLHWDVLAFNQPADEYFHFSQVKDEQRNFLWLLFTNDYYRELLCHWNQDAYRLLASFRRDYALAAEDGYIQNLVNKLLKTSPDFYDMWHKHEIYEPCNGVRQLNVNGEAISFEYTSMVIDLEKHLRLIVYAEI

SEQ ID NO: 10460 - protein, 232 aa, Xenorhabdus bovienii
  Coding DNA sequence: Name=SeqID_4352
  Homolog annotation: Query=2..204bp; Hit=3..206bp; Blast score=85; Percent Identity=27.0; E value=4e-16; Homolog= gb|AAO17200.1|
MSQWKEKDIFKLFSQYDNILEEQYGFTAIYNFIKQHSSIKKVLDLGCGSGELIPFLTSIASQVVGADISEHALENAREKHKNSGATFIYASELPNYINNNSKFDAVISSFLLCTLNTENLIKLLLCQVNNALIEHGYYILLNFNLNAMGVDFGTFKTGEEGKIYHDGEALPVSMRTKSGEQFTFNDTFWSFSKLITLSEEMGFSLYQQSTLTLPQFTISPFTIFVLKKQNEV

SEQ ID NO: 10461 - protein, 1018 aa, Xenorhabdus bovienii
  Coding DNA sequence: Name=SeqID_4353
  Gene classification: Gene name=AprE (BS); Function=Subtilisin-like serine proteases; Function class=O Posttranslational modification, protein turnover, chaperones
  Homolog annotation: Query=8..574bp; Hit=10..556bp; Blast score=205; Percent Identity=31.0; E value=2e-52; Homolog= PA3535_1 COG1404
MKKNNPARPIFLGMTLLFGLLPTGSLIAATEYHEQGKKGIPDSWLSDEFKNQWGLASIGAHYAYARGYTGKGINVGVLDEAVTNHPEFADKLKIIAPSDIWNYSYDSYSDLISFGAHGNHVSGTIAANRDGKEMHGVAFDAGLITAKFLQNDYNRTEAMIQSDARIINNSWGVRPRYYVGSDGRPIRLPNGTIAYYKVTLKQLINYVSPIKEKLNELSQAPLAVTGEPLASDAGMLRAARQGKLMVFAAGNANNYNVTWLHAGMPYFFPDVLKNYLSVTNLKEDGLIAPSSTSCGYTASWCLAAPGTKVYSSTGDFVSKNGGEINEDALKKGELEIDPTYDTYTGTSMAAPHVAGAAAVLMQRFPYMTAAQIADVIKTTATDLGTPGLDDLYGWGKLNLKDAINGPKMFITKQDIPAKYYIEGSYTETQFIANIDGIGSLIEPGTTVQRVCNSIECVYDYWSNDISGHGGLTKTGSGALLLTGASTYSGPTWVNKGLLLVNGSITSDVTVQSDATLSGKGTVGSLTAYNGANIAPGNTNTDAALNVDREVIFKTGSRYQVTLTPDGKNDRILSNGMAGLEGGEVQVTLENRGNLLSQQKVRSLLGQQYNILQASNGIYGQFDTVSQGHLFLDIPLNYQFDRALLDIKRNTTEFASLATTANGRSVAKAADMLNSDHPVHESILMVNSAAQASQAFSQLSGQVHADIAAAQINSSRYLRDTLNTRLRQANGVATSQEIKADTDGAWVQIMGNWQRASGNNEVSGYRMSNYGVLLGVDKDLSSDWRLGVATGYTRSSLHGGDSASARSDNYHLALYGSKQIDALALRAGVAYSWHRFDTERSVAFGDQSDDLKAKYGARTGQLFTEAGYGIKTSWLNLEPFANLAHVNFHNNSINEQGGAAALHGDKKSQNATFSTLGLRADQKWKIERESQRELHVGVYGELGWQHRFGNINRGTKLGFSNSNTMFTVNSVSAGRDAAVVKVGTELDIGKNTTLALGYNGVLSSSHKDNGVFLNANWRF

SEQ ID NO: 10462 - protein, 401 aa, Xenorhabdus bovienii
  Coding DNA sequence: Name=SeqID_4354
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=5..401bp; Hit=1..397bp; Blast score=623; Percent Identity=75.0; E value=1e-179; Homolog= Z3390 COG0654
MERMMSKTQSAIIVGGGIGGAAAALSLAKVGIKALLLEQANEIGEIGAGIQLGPNAFSALDSLGIGEIARERAVFTDYIAMMDAMDANEVVRIDTGQVFRDYFGGPYAVIHRADIHDTVWQAALKNSLVSYRTATKVVEVNITQNDVEVIDEKGNSYKADVLIGCDGGKSIIRDSTLNDKPRVTGHVVYRAVIEREDMPEDLRINAPILWGGPHCHLVHYPLRGGSQYNLVVTFHSRQQEEWGVTDGSKEEVMSYFDTIHPRPRQMLDKTTSWRRWATADREPVESWGTGRVTLLGDAAHPVAQYMAQGACMALEDAVTLGEAVKACNGNAIEAFKLYQAVRIPRTARIVWSTREMGRLYHAKGVEREVRNLLWKGKTQQDYYKALEWLYGWKEENCLQPR

SEQ ID NO: 10463 - protein, 214 aa, Xenorhabdus bovienii
  Coding DNA sequence: Name=SeqID_4355
  Gene classification: Gene name=Gst; Function=Glutathione-S -transferases; Function class=O Posttranslational modification, protein turnover, chaperones
  Homolog annotation: Query=1..213bp; Hit=2..214bp; Blast score=293; Percent Identity=66.0; E value=9e-80; Homolog= Z3391 COG0625
MKLFSFFNSSASYRVRIALALKGIDYQTEPVNIRLGEQYDTEYLQLNPVGAVPTLIDDEGNSMGQSLAIIDYLERCFPVPQLLPQGAQIRTQVLEIASIIACDIHPVNNMRVLRYLTDELQISDSQKKNWYAHWIKVGLGAVERLLEKNNSGNYCVGDQVTLADCFLIPQWANALRMECELSHYPRCQKVYQHCSALPEFIVAAPENQPGLIAP

SEQ ID NO: 10464 - protein, 233 aa, Xenorhabdus bovienii
  Coding DNA sequence: Name=SeqID_4356
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=1..233bp; Hit=1..233bp; Blast score=343; Percent Identity=71.0; E value=1e-94; Homolog= Z3392 COG0179
MSKFVFSPAPQVAVPVVGTDEFFPVHRVYCVGRNYAAHAREMGFDPEREPPFFFCKPADAVVPVKAGEILELAYPEQTENYHYEIELVAAIGKGGKNISVEEALNHVYGYATGLDMTRRDRQIEMRKMGRPWEIGKAFDLSAPISPIHPSVSCPDMNKAAIWLHVNGTEYQSSSIDFLIWSVAETISYLSTFFELQPGDLIYTGTPEGVGAVVKGDTIICGVEGLTDLTVAII

SEQ ID NO: 10465 - protein, 109 aa, Xenorhabdus bovienii
  Coding DNA sequence: Name=SeqID_4357
  Gene classification: Function=Gentisate 1,2-dioxygenase; Function class=Q Secondary metabolites biosynthesis, transport and catabolism
  Homolog annotation: Query=5..108bp; Hit=238..341bp; Blast score=159; Percent Identity=72.0; E value=4e-40; Homolog= Z3393 COG3435
MNMKGFKLRYVNPANGGYTMPTMAAFLQLLPKGFKGENSRSTDSTIYHVAEGQGQVTIGGENFMFGPKDIFVVPSWLPVSFETQSDTVLFSFSDRPVQEVLGLFREARG

SEQ ID NO: 10466 - protein, 233 aa, Xenorhabdus bovienii
  Coding DNA sequence: Name=SeqID_4358
  Gene classification: Function=Gentisate 1,2-dioxygenase; Function class=Q Secondary metabolites biosynthesis, transport and catabolism
  Homolog annotation: Query=12..231bp; Hit=9..228bp; Blast score=363; Percent Identity=77.0; E value=1e-100; Homolog= Z3393 COG3435
MQKINTSQLDRRKSFYQDIAKLNLSPLWEELHRLVPDVPHSSISAALWRYQDIRPFLMESGELIGAREAIRRVLVLENPALIGKSSITSSLYAGLQLIMPGEVAPSHRHSQSALRFIVEGSGAFTAVNGERTTMEAGDFILTPQWQWHDHGNPGTEPVIWLDGLDLPLVNYLGCGFAEDYPEEQQPVLRPNDDYLPRYAANMLPVRYQSGNSSPIFNYRYDRSREALEQLSPQ

SEQ ID NO: 10467 - protein, 450 aa, Xenorhabdus bovienii
  Coding DNA sequence: Name=SeqID_4359
  Gene classification: Gene name=ProP; Function=77 Permeases of the major facilitator superfamily; Function class=G Carbohydrate transport and metabolism
  Homolog annotation: Query=9..441bp; Hit=7..440bp; Blast score=480; Percent Identity=62.0; E value=1e-135; Homolog= Z3394 COG0477
MALKRSMTVQEVIDAAPVSRYQWQVLICCFLVVTFDGFDTASIGFIAPAIRQQWQLDAAHLAPLFASGLFGLTLGALIFGPMADRFGRKNIMQFSVALFGLMCLLSAFATDMTTLTILRFLTGLGLGGAMPNAITLTSEFMPARRRAGLVTLMFCGFTLGSALGGIVSAQWVPSIGWEGILILGGVMPLALSVLLWKILPESPRYRVLKQYQPEKIPDVLNKITGKNYDDVTFYLDEKPAEKSAVSALFSREILPTTLLLWCVFFMSLLIIYSLSSWLPTLLNNSGIDLQHASWVTTAFQVGGTAGAILIGVVMDRLNPYWTLAVSYALGAVFIVLISFSEGSLWMMALVVLGTGVGISGSQVGLNALSAALYPTQCRATGVSWANAVGRCGAIVGSLSGGLMLSWNISFSTIFIVIALPAVVAALAMVILRTQHRTARIVVSHMTIQEK

SEQ ID NO: 10468 - protein, 315 aa, Xenorhabdus bovienii
  Coding DNA sequence: Name=SeqID_4360
  Gene classification: Gene name=LysR; Function=Transcriptional regulator; Function class=K Transcription
  Homolog annotation: Query=1..298bp; Hit=17..315bp; Blast score=411; Percent Identity=65.0; E value=1e-115; Homolog= Z3395 COG0583
MSNWTQKLKIQHLRLLICIGEQGNLSKVAEIMGITQPALSKWLGGLEEDIGITLFERHSKGLRPSEGGRLLLEHAQRILNDLERSQEDIEQFKMGIKGSLIIGSSPVATDCVSLALLSLVNDYPSIHVKVVENVMTSLLQSLISGKIDVVVGRVGGKALQLPLNYQTLYTEPVCFVGRCNHPLANRESINWQDLLEYNWIVWPTGTPIRTSIDNAIVDQGVMLPNNYLESSSMNVTINMIQASDIVSILSWRLAHRYVEKGQLAILPLPRIEQKGSVGVFWRKDTTPSDALQCFLSHLTKTSAESENDGVFVISN

SEQ ID NO: 10469 - protein, 104 aa, Xenorhabdus bovienii
  Coding DNA sequence: Name=SeqID_4361
  Gene classification: Gene name=WecD; Function=Histone acetyltransferase HPA2 and related acetyltransferases; Function class=K Transcription
  Homolog annotation: Query=6..82bp; Hit=53..129bp; Blast score=75; Percent Identity=44.0; E value=9e-15; Homolog= CC3561 COG0454
MFKVREGEYVSLIELSLRFDYVNGCETSPVAFLEGIYTTSSHRQKGIANMLISHACLWAKEHNCQEIASDTHISNLISQKLHHFLILPMSSLNAIRSTAMHQMG

SEQ ID NO: 10470 - protein, 389 aa, Xenorhabdus bovienii
  Coding DNA sequence: Name=SeqID_4362
  Gene classification: Gene name=AraJ; Function=Arabinose efflux permease; Function class=G Carbohydrate transport and metabolism
  Homolog annotation: Query=7..384bp; Hit=17..388bp; Blast score=285; Percent Identity=50.0; E value=5e-77; Homolog= PA5548 COG2814
MPPRFILPVLALTVFFIGTTEFMLSPMLKPLASAFRTTLDNVAWLVSGYALSYALAAPFFGWLSDRVNRRRLLLISLLFLMVDGLALTFAPNLSTAIGLRIFGGIASAALIPTTFALIAELFPRQKQVSAMGLVMLGMTAGIAGGPIFAGVLTELFDWRAPFLVNAAGCLLVFVLGRKCIPIQAPVERIKHQMVTFKSMFQWVRQKNLMIPLIAKGFWNGTAVSALILAGEVLRQHYEIGTGTIGISISTFGIGLGLGNLSVGMVKRLGLRDELILLLAIVLLSSATTAFMLMPLSLPFSLSCLIVWGSALGLAAPISTVILANRAKQHKGQVLAVSESLNNLVILLLIPIATMLMTHHGIAVTMLMLGFSLIISIVLTIRDFFGDTVT

SEQ ID NO: 10471 - protein, 654 aa, Xenorhabdus bovienii
  Coding DNA sequence: Name=SeqID_4363
  Gene classification: Gene name=GadB; Function=Glutamate decarboxylase and related PLP-dependent proteins; Function class=E Amino acid transport and metabolism
  Homolog annotation: Query=10..435bp; Hit=6..353bp; Blast score=102; Percent Identity=24.0; E value=2e-21; Homolog= BH2623 COG0076
MTKPLYTNLNVDALFLGPKSENAVFFREMMDYAVSEHMHWRSGFHPEDAALVTSVDRYEHNYRETLYRTEGILNQLSAKLKNTSIPFFSPRYLGHISGDTLMVSNLAYVMAMMYNPNNCSYESSPTTTELELESGLDLCRMFGYDPQHAWGHITSGGTVANYEGLWVARNLKTLPFAVSQHPDTKELVSHKSPKQLMNMPTTEVLDLISELQERGIFDEIRNMTCRGTGSKTEILGKLLVPQSKHYSWMKAADIFGIGQENIIPLPVNEHYQTDIGKMREITFDLIEKGEPILAMIGVVGTTEVGAIDRIDEVIALRQECEERYGGSFYIHVDAAYAGYACSMLLNEQGEFMEYDDLVNYHHTLGIVPENISWPKPEVYQSFKALRYVDSITVDPHKVGFIQYSAGAICMKDKRILDLISSRALYVFEENDNQSNSPASNRGVLGASIMEGSKSGATAAALWAAHRLLPLNISGYGKVIAAGIVTANQLLDKMANMPPIEVGEYRFKMHIMPTPDFHMINFTFKEVGNASLINHNALNKRIYELCSYSSGRAYSNDFLTSSTILDYKEYGDTPWYYAEKCGFSRSEWEKTRCVYVLRAAVMTHCLRNEEHFEEHWNQLQAIFVRKLTQLVDEEEKKLRQMLNREESFLIIDKNN

SEQ ID NO: 10472 - protein, 97 aa, Xenorhabdus bovienii
  Coding DNA sequence: Name=SeqID_4364
MRLIEQPAYMEWLIETTTVDENIIFPLHPELNFKSAFGLRIVSWCLYIIAMAIWAYSLWKGRNRALIRLGFPILSGTVIMFIAEMVNQYTFFIICNM

SEQ ID NO: 10473 - protein, 251 aa, Xenorhabdus bovienii
  Coding DNA sequence: Name=SeqID_4365
  Gene classification: Gene name=Crp; Function=cAMP-binding domains - Catabolite gene activator and regulatory subunit of cAMP-dependent protein kinases; Function class=T Signal transduction mechanisms
  Homolog annotation: Query=1..244bp; Hit=1..244bp; Blast score=454; Percent Identity=93.0; E value=1e-128; Homolog= fnr COG0664
MIPEKRIIRRIQSGGCAIHCQDCSISQLCIPFTLNEHELDQLDNIIERKKPIQKGQTLFKAGDALKSLYAIRSGTIKSYTITEEGDEQITGFHLAGDLVGFDAIINTEHPSFAQALETSMVCEIPFETLDDLSGKMPNLRQQMMRLMSGEIKGDQEMILLLSKKNAEERLAAFIYNLSRRFAQRGFSPREFRLTMTRGDIGNYLGLTVETISRLLGRFQKNGILGVKGKYIAVENMEKLTELAGKAPVCVS

SEQ ID NO: 10474 - protein, 314 aa, Xenorhabdus bovienii
  Coding DNA sequence: Name=SeqID_4366
  Gene classification: Gene name=UspA; Function=Universal stress protein UspA and related nucleotide-binding proteins; Function class= T Signal transduction mechanisms
  Homolog annotation: Query=1..314bp; Hit=1..313bp; Blast score=456; Percent Identity=70.0; E value=1e-128; Homolog= ydaA COG0589
MANYQNLLVAIDPNQDDQPALRRAVYIVQRNGGRIKAFLPIYDLSYEMTTLLSPEERNAMRKGVIGQRIAWIKQQAHYYLESGIDIEIKVVWHGRPYEAIIQEVITGKHDLLLKMAHQHSLLESMIFTPLDWHLLRKCPCPVWMVKDQVWPEKDSAVVAVNLSNEESYHTALNLKLVKETQDLANRIVKEPLIHLVSAYPTAPLNIAMELPDFDPNVYNQALRGQHLVAMKELRQKFYIDEQQTHVHEGLPEKVIPEICDELNTGVVVLGILGRTGLSAAFLGNTAEHVIDKLKCDLLAIKPDGFVCPISVDEE

SEQ ID NO: 10475 - protein, 318 aa, Xenorhabdus bovienii
  Coding DNA sequence: Name=SeqID_4367
  Gene classification: Gene name=XerC; Function=Integrase; Function class=L DNA replication, recombination and repair
  Homolog annotation: Query=65..317bp; Hit=46..293bp; Blast score=99; Percent Identity=29.0; E value=3e-21; Homolog= BS_ripX COG0582
MVISRDQQKQGMIMSLSASGQQIHNNPAIAYLVSLGSKRSRQTMKSFLNIVAKMLGYQNVQDCTWNALRRHHVQAIMEMLSDSGKAPATINTYLAALKGVALEAWTMKQIDTDSFQHIKQVRSVRGNRLPKGRALDRYEIKTLFFTCENDFSTKGLRDAAIIGVLVGCGLRRSEIISLDLKNVIRREQALRVMGKGNKERLSYMPEGTWERLNRWIDEIRGDYAGPLFTRIRRDDDVTDNRLSDQAIYHILETRRIESGLEKFAPHDLRRTFASAMLDNGEDIVTVKDAMGHSSITTTQKYDRRGDERLKNAAKNLNF

SEQ ID NO: 10476 - protein, 71 aa, Xenorhabdus bovienii
  Coding DNA sequence: Name=SeqID_4368
MTINDFVSSSLPSLNSSRFWWFKISSLLLISMSSVQTSSNRIVTKQVCPLRSDNGTYLISSIFDHNHDCAV

SEQ ID NO: 10477 - protein, 2513 aa, Xenorhabdus bovienii
  Coding DNA sequence: Name=SeqID_4369
  Homolog annotation: Query=9..2513bp; Hit=1..2523bp; Blast score=3997; Percent Identity=80.0; E value=0; Homolog= emb|CAC38401.1|
MDNNLRSYMNTINELLNKINKEKSGDTLSLADIISMSFSEFRHRSSEALTWRETNLLYKQAHHESKQSKLAELRILSRANPQLANTTNLDISPSSQNSSYNNWFYGRAHRFVKPGSVASMFSPAAYLTELYRESKNLHPETSQYHLNKRRPDIAALALTQDNMDEELSTLSLSNELLLHNIQTLEKTDYNGVMEMLSAYRQTGLTPYHLPYESARQAILLQDKNLSAFSRNTDVAKLMDPTSLLAIKANISPELYQILVEEITEENAAELMKENFGTDDILIFKNYAALARYYDLSYDELSLFVNLSFGKKNTNQQYKNDQLITLVNDGNNTAKARLIKRTRKDYYDSRLNYAELIPVKGNEYKYNFSIKKTEHDCIDFRLQNGDDEYVYRDTNFVPIANTHYSIPIKLTTEQVINGITLRLWRVNPDPWKAINANTFFKMVEFPGDIFLLKLNKAIRLYKAMGIAPEDIWQVVESINDDLTIDSNVLGKLFYVQYYMQHYNINVSDALVLCNSNISQYPTKQQASQFTTLFNTPLLNGQEFSADNTELDLTPGASENHFHLGVMKRAFRVNDTELYTLWKLVNKGTNSAFICSMKNLSVLYRVHLLAEIHNLTVNEFSMLLSVSPYADKKIADFSDTELTQLISFLFQCTQWLATQKWSVSDVFLMTTDNYSTILTPDIENLITTLSHGLSTPSLGSDELIRAAAPLIAASIQLDSAKTAEAILLWINQIKPQGLTFDNFMILVTKNDRSENETQKMVAFCQVLGQLSLIVRNIGLSESELTLLVTKPERFQLETTVLQHDLLTLQALTRFHTVIMRCGSYATEILTALDMGRLTAEQLAIALKFDVQEMAQALQQAGSGESIFTNWKTMDATLQWLDVATTLGITPDGVAALIKLKYAGEPETPLPAFDDWQAASILLQAGLNNQQSNYLQALLDEATATAVSAYYINNGAPQQIQSRDELYSYLLIDNQVSAKVKTTRVAEAIASIQLYVNRALNNVESKISKQVKARQFFCDWETYNRRYSTWAGVSELVYYPENYIDPTMRIGQTGMMNNLLQQLSQSQLNTDTVEDGFKNYLTAFEDVANLQVISGYHDNINVNEGLTYLIGHSQTEPKLYYWRNVEHQKCEHGKFSANAWGEWKKIETPINVWQENIRPVVCKSRLYLLWLEKKELKNEDGSLNVIDYILKLSHIRYDGSWISPFSFNVSDKINNNSIVGIYCSYDYEKEVIIVYFYEKKDAYSSNNLPANKGITINPDMTFSILTENDLNAIVKSTLSELDTKTDYKVNNQFTIDYLVEYKDKTTDKNKIISLTGNIVDLSYESSTSGHIKLSFKPSMEISFSKGGIYNDEIKYLLSMVEDEEVLLFDYDRHDEILGKDDEIVHYGTLDFIITIDFIITIDLKNPEYFRVLMHGRTEEKISRESGGILIHMSNGTELSLEVNMVSNWKDSAGVWHTICEAFIDDILNINEPEIIFVGFERNDPCQYFYLIATDIEFVSPMIQQIPDKYIGFLLKNGNDILVELNANDHVISKPSPESNPMVYDFNQVTVDVEGYDIPLIGEFTINKPEVGYNGMVAESPIHIKLKSKDKSNIISLHKMPSGAQYMQIGPYRTRLNTLFSRKLAERANIGIDNVLSMETQNLPELQLGKGFYASFVLPPYNKAEHGDERWFKLNLKHVVDNTPRVYYSGMLQDKELSVTLFIPLDEKPLDERFIAEILLSTSKNHGDVPWSGPHFIYVNKEQNEFGINSNSKLGMFKLVTVLNNKNTEPMDFSGANALYFWELFYYTPMLVAQRLLHEQNFTGATRWLQYIWNPAGYLVQGDIQDYYWNIRPLEEDISWNANPLDSVDPDAVAQNDPMHYKVTTFMKALDLLIARGDSAYRQLERDTLNEAKMWYVQALTLLGDEPYFSLDNDWSEPRLEEAASQTIRDHYQHKMRQLRQRAALPAKRTANSLTALFLPQINKKLQSYWQTLAQRLYNLRHNLTIDGQPLSLPIYATPADPSVLLSAAVTASQGGGDLPRAVMPMYRFPIILENAKWGVAQLIQFGNTLLNITERQDAEALAELLQTQGSELALQSIKMQDKMIAEIDADEVALKESRHSAQSRFDSFSTLYDEDVNSGEKQAMDLYLSSSILSTSSTALHMAAAAADLVPNIYGFAVGGSRFGALFNATAIGIEISSSATRIAADKISQSEIYRRRRQEWEIQRNNAETELKQIDAQLAALAIRREAAVLQKNYLETQQAQTQAQLACLQNKFSNTALYNWLRGRLAAIYYQFYDLAVSLCLMAEQTYQYELNDKAVRFIKPGAWHGTYAGLLAGETLMLNLAQMEKNYLEKDERALEVTRTVSLAEVYIGLSDNSFTFTDKIIELVNAGKGSAGTDLNGLKVEGTQLQANLKLSDLDIAADYPEGLGKTRRIKQISVTLPAFLGPYQDVRAILSYGGSTIMPRGCKAIAISHGMNDSGQFQMDFNDAKYLPFEGLPVDDTGTLTLSFPDINDKQKNLLLSLNDIILHIRYTIRS

SEQ ID NO: 10478 - protein, 125 aa, Xenorhabdus bovienii
  Coding DNA sequence: Name=SeqID_4370
MGSQVAESQETLEGVGDVAATAAIEGALAGRKLAKTLGLRSIAARVVQAVADIDISPAAVVENSSTAIYAHGKTFLHVRTKDTNDFEAFRNIEETLPADGNAGWMNDALETALGWFNRSNQESFA

SEQ ID NO: 10479 - protein, 63 aa, Xenorhabdus bovienii
  Coding DNA sequence: Name=SeqID_4371
MRLLSPLLQQRHPLPPEFPETQPPESPLQSRLRQYLISGNCTGGNSYLSASYTSVFIRPPLLF

SEQ ID NO: 10480 - protein, 168 aa, Xenorhabdus bovienii
  Coding DNA sequence: Name=SeqID_4372
MSNAITLIGGLFNNGLSLPSFSRPSLSMPSLFDFDLSFDISPVGIIKKTVGPAIKFVYKKTYKKLLNYALSKAKTEQQKRNIIRGFRGVSIGVGVAVAIAGVVSTAGLAIPVAVGAVAAGGAIAGAVGFFSGPISRSLSKIYARLFSGRICLRLQVMLWPVEVVAVRL

SEQ ID NO: 10481 - protein, 240 aa, Xenorhabdus bovienii
  Coding DNA sequence: Name=SeqID_4373
  Homolog annotation: Query=33..237bp; Hit=472..681bp; Blast score=241; Percent Identity=60.0; E value=9e-63; Homolog= gb|AAC38630.1|
MIWTLTGRGNTPNDWNAPLSGDSFTTRMTTDVLTYNRRGELSRVNPVSRDTEMDEEGYRYNEDSQRLVKVSKYLNGNTQRKSRTVYLPGLELRTMFRGNTLNEELHIITVGHVRLLHWVSGQPAAIQGDPLRYSYSNFTGSSVMEVDEAGKIISQEEYYPYGGTAIWTVRNQTEADYKFHRYSGKERDSTGLYYYGLRYYLPWAGRWLSADPGGIVDGLNMFSMVHNNPVNGTDSDGGHH

SEQ ID NO: 10482 - protein, 208 aa, Xenorhabdus bovienii
  Coding DNA sequence: Name=SeqID_4374
  Homolog annotation: Query=1..204bp; Hit=1..207bp; Blast score=179; Percent Identity=44.0; E value=4e-44; Homolog= emb|CAC38402.1|
MSQTLYSGTPSVVVMDNRGLNVRTVQYYRHPDTLDLTDERISFSQYTQAGFPARIFSPRQHDLWKNDNRIKPDRASIQSLSGMALRTEGADDGVAAALNDIAGRPVISIDAMGVKRRYLYEAHHLAGRLLSISEQASGQEPSIVERFIWSGNSQQEKAYNLIGACASRYDTAGREACQGISLLGSPIRITRQLLPNDMDANWQGKHAQ

SEQ ID NO: 10483 - protein, 603 aa, Xenorhabdus bovienii
  Coding DNA sequence: Name=SeqID_4375
  Homolog annotation: Query=2..507bp; Hit=883..1396bp; Blast score=560; Percent Identity=56.0; E value=1e-158; Homolog= emb|CAC38403.1|
MYWLSRALKGMPLRSEIYGDDDTELAGTPYSVSESRPQIRLLAGMMAEAPSAWPSMLESRSYQYERIAVDPQCSQQIVLKSDALGFPADILSIAYPRRQKPAVSPYPDTLPETLFDSSYDDQQMLLRLTRQRYEYHHVIDETLWLLGLPAVSRSDTRVLSQNVVPDGGLSLEGFSTVFGTPGAGQLPNTEDDYLGHVTVNYTGAGGKPDFPPRVAYTETAEFNKASLKTFEGIMSPDEREKELENAGWQSVPVPLQDNGGFNVWVGHQGYTDFAGAEGFYRPLAQRQTLMTGKNLIGWDTHFCAVIREQSATGSVAYAQYDYRFNVANRVTDANDNISTSTFDALGRVTSVRFCGLEEGVMQGYTQPEDEVTPFIVPALIHEALELKPRIPVAGLAVYAPLSWMPRVTPETTEFKNVSPEDNRMGRLALRRYLRRNSAASFSSNSCLPPHTLNISTDRYDRDPEQQLRQSLSFSDGFGRTLQTAARHEAGQAWRLSDDGTIIADEAGLPINEHTDFRWVVSGRTEYDGKGQPVRTYLPYFLNNWRYVKDDSARRDLFADTSCYDPLGRVWQVVTAAGYLRRTLMTPWFVVSEDENDTAAEVSQ

SEQ ID NO: 10484 - protein, 409 aa, Xenorhabdus bovienii
  Coding DNA sequence: Name=SeqID_4376
  Homolog annotation: Query=11..367bp; Hit=302..658bp; Blast score=530; Percent Identity=68.0; E value=1e-149; Homolog= emb|CAC38403.1|
MVNVPLPFTLCRPDCFSRYQFGFEVRTRRLCQQVLMFHRLQALAGGNVTNEVPALVSRLILDYDLNNRVSLLLSARHLAHEAEGTPVTLAPLEVDYQRFDNELNLNWQKMPELEKFNAFQPYQLVDLYGEGIPGILYQDAPGAWWYRAPMRDGASDNADAATYDTAKPLPSIPAQQDSAMLIDFNGDGRLDWVVTAAGLRGYHTMTPEGEWTPFIPLSSIPVEYFHPQAQLADITGSGLPDLALIGPHSVRFWADTPGGWDKAQDVGCQGSIPLPIPGRDARKLVAFSDMTGSGQPHLVEVSADGVRCWPNLGRGRFGEPLTLPGFRITGEAFNPNRLYMADMDGSGTTDLIYVRSTYLELYINESGCRANTGKGMNRLLQALHPVLPATTPPQAVRSPSPLMKRKCTG

SEQ ID NO: 10485 - protein, 293 aa, Xenorhabdus bovienii
  Coding DNA sequence: Name=SeqID_4377
  Homolog annotation: Query=1..282bp; Hit=1..283bp; Blast score=393; Percent Identity=68.0; E value=1e-108; Homolog= gb|AAM77230.2|
MQSSKNLKLEMPSLPKGGGSLYGMGESLGAVDPDGLASLSLPLPVSGGRGVAPSLGLSYSSAAGNGAFGMGWQCGLGSISLRTSQGVPQYMGEDIFLGPSGEALSIVPDLKGQPDRRTATSLLGTALKQPHIVTRYQPRIVSDFSKLEYWQPQQSGQDKPFWVMFSTDGQVHLLGKHRHAQIADPKETTKIACWLLEETVTPTGEHIYYHYRAEDDAGCDSSELNQHPGMHAQRYLAQVCYGNIFPEAAFIAVKSGIPADDAWLFHLVFGYGERSSSLYTVPAGLFFPLSVWF

SEQ ID NO: 10486 - protein, 92 aa, Xenorhabdus bovienii
  Coding DNA sequence: Name=SeqID_4378
  Homolog annotation: Query=5..92bp; Hit=2451..2538bp; Blast score=171; Percent Identity=89.0; E value=3e-42; Homolog= emb|CAC38404.1|
LPAGEDIRAVLNYGGSVVMPRGCSAIALSHGMNDSGQFVLDFNDTRYLPFEGIPVNDGGSLTLSFPDATDRQKAILQSLNDIILHIRYTIRS

SEQ ID NO: 10487 - protein, 1002 aa, Xenorhabdus bovienii
  Coding DNA sequence: Name=SeqID_4379
  Homolog annotation: Query=1..974bp; Hit=1184..2168bp; Blast score =1315; Percent Identity=68.0; E value=0; Homolog= gb|AAM77229.2|
VETYDRFTLKLAFLRHDGSWSAPWSYDITAQVKAVTDDQPDVERLGLAASGFQGEDTLLVFVYKTGESYNDFGDSNKEVEGLFVYADGTCNPMNAKQLNRYSLIKNTFDIISSDRGHIVKRANYKFAQDYDIPSSLALDSAPSQNSFIAIDNALIPQISHVHSSEDLIITLNNPGFTLNYRANDDLRRHQLIAMKVCGKPDHTFILADKVSKYLPFPKMYGPIPVYNTTNNTIGVAQNSPFYLGGEDNYIALNSGSSREFLFPINSFENTTNFHVGSNRQEKFKKCETTFYVLRLRSYLYWPMFMSQSKGWYYFDSNIDAKNIFFSVRKSTKNQVFNAKDAANNLPKPSFEGMNYVFNPVILNASDLTFINNIESIDVYFEIKDNDGKSIGKASFTLTIKKVDYSQNNILHLYNTDAGVQYMQLGVYRIRLNTLLAPQLVSRANIGIDTILTMATQQLPEPQLGKGFYATFTLAPYNPATHGTSRAFQLNLKHVVDDNAHIIYSGLLQDTELAVRLFIPLDDKPLRSYVAKVFLTTQKNPNDGTWNGPHFTDDSGKIGIHDSSNVSMFAGVQPHNGITTEPLDFNGACALYYWELFYYTPMMCFQRLLQEKQFDDATKWMNYVYNPAGYIVDGEITPWTWNCRPLEETTSWHANPLDAIDPDAVAQSDPTHYKVATFMRLLDQLILRGDMAYRELTRDALNEAKMWYVRTLELLGDEPEDYGSSQWAAPSLSVAASQTVQAVYQQDLAALDRGDVSTQSQPRTANSLVGLFLPEYNPALTDYWKTLRLRLFNLRNNLSIDGQPLSLAIYAEPTDPKALLTSMVQASQGGSVLPTGTLALYRFPVMLERARNLVAQLTQFGASLLSMAEHDDADELTTLLLQQGMELATQSIRIQQRTVDEVDADITVLAESRRSAQNRLEKYQQLYDEDINHGEQRAMSLFDAAAGQSLAGQVLTTAEGVADLLPNVFGFACGGRYPGGTELWRQRGDATRLQRHCPIPRDE

SEQ ID NO: 10488 - protein, 1002 aa, Xenorhabdus bovienii
  Coding DNA sequence: Name=SeqID_4380
  Homolog annotation: Query=1..854bp; Hit=95..947bp; Blast score=1344; Percent Identity=79.0; E value=0; Homolog= gb|AAM77229.2|
MFGSRSSSFVNPGSVASMFSPAGYLTELYREAKELHFTSSAYHLDNRRPDLADLTLSQNNMDSEISTLALSNELLLAHITRQTESDAEALMESLSTYRQAVDTPYHQPYEAVRQVIMAHDRTLSALSRNPDVMGQAEGASLLAILANISPELYNILTEEITEKNADALFAKNFGENITPENFASQAWIAQHYGLELSDVQKYLGMLQNDFSDNVSVYIDNISTGLLTDQEDKLEAYKITRVPGGDYTKHLNFWDLLYQGDNHFIIRASFKKSGGALTIRKSNVGTTNGSKAIGSISAPTDANTVYQSGVLSPLTADELKKGATIFDFNRSGNGQIGWTAVFTFESYPLSIFALKLNKAIRLCLASGLSPNELQTILLSDNSQGIINDSVLTRVFYTLFYSHSYALSFDEALVLSGAIINQCVDDDSVSHFNRLFNTPALSGKIFEADGSTVSIDPGEEQATFACSALMRGLGVNGGELYQLAKLAGVMDIKNNITLSVPVITSLYRLTLLARAHQLTVNELCMLYGFSPFRGKTTTSLSSGELSRLVIWLYQMTQWLVEAGISTEALWLLCTPEFSRNISPEISNLLNTLRPRLSEEMAQSDNRELQAEILAPFIAATLNLASPDMARYILLWTDNLRPGGLNIAGFMMLVLKETLSDDETTQLVQFCHVMAQLSLSVQVLRLSEAELSVLVISGFTVLETKNQPAGQHNIDTLLSLYRFHQWINALGNPSSDTLDMLRQQTLTADRLASVMGLDISMVTQAMACAGVSRLQCWQDIDTVLQWIDVASALHTMPSVIRTLVNIRYVTVPNKAEPELPSWEEWQTLAENMEAGLSAQQAQALADHTAERLSSVLCLDPTQRIGQTRMMDELLENISQSKLSRDTVEEAFKTYLTRFETVADLKVVSAYHDNVNSDTGLTWFVGQTRENLPEYYWRNVDISRMQAGKLAANAWKEWTKIDTALNPYGDAVRPVMFRERLHLIWVEKRKSRKMAPIRWKLMTVLR

SEQ ID NO: 10489 - protein, 103 aa, Xenorhabdus bovienii
  Coding DNA sequence: Name=SeqID_4381
  Homolog annotation: Query=1..57bp; Hit=1..57bp; Blast score=102; Percent Identity=82.0; E value=2e-21; Homolog= emb|CAC38404.1|
MYSADVLLNKISPTRDGRTMTLADLQHLSFSELRKTFDDQLSWGESHYLYRETVEQKNVIACWKPVFSPAPTRNYPAPSVGVLNETVLHAVTMKCLAPALLPL

SEQ ID NO: 10490 - protein, 582 aa, Xenorhabdus bovienii
  Coding DNA sequence: Name=SeqID_4382
  Gene classification: Gene name=CaiA; Function=Acyl-CoA dehydrogenases; Function class=I Lipid metabolism
  Homolog annotation: Query=56..494bp; Hit=123..589bp; Blast score=73; Percent Identity=23.0; E value=8e-13; Homolog= YGL205w COG1960
MNKSLCNSALKLNGYLGIENDESSDNIFNILKTPCNDYQSSVKKFIKLLNYIQDNNIDITSFNELVALHELVAPHDAAVVSMMSIHFNLAIGTIANLGAQTPYIENLYQQLCSGSAIGVYLATELAYGNNLIAIETQADYLPEKGVFILNSPNPGAYKFMPNTLPCELPKVAVILAQLNVSGKKYGIFPFVLPLSVSGQLTVGVKITSLGDKPGFYLDNAITSFDNVEIPFEGLLAGNMITLTRNGQVSLHTKRLKERFSLITNRIHTGKLCMAVSSVAGAKSALHITSTYGNKRQTFGYSGAMPIINYFHFREGVAWDTLSTVTHALYLRELTKKVSVMLSGSVKNFKFSDEVLIEIITAKSLCTWRTQEILINCCERCGAHGLFSINKIPHYLMGNFGAITAEGDNVVLSLKAGEMIFIGGIKNNKENVQHDLFFILNDYMDFLLQKLNKLIVSGSKKTNFDAVNKYSGDFLELSQTYAVLSVVTTIIDAYHTDDIDMIIEGYLLDWVHRTMSNLLIGEVIDFQEAKKIDERRIEYIRKYAEKINDYISEFAVDKSGIETPISSDDYISWYAGNHNQLKN

SEQ ID NO: 10491 - protein, 462 aa, Xenorhabdus bovienii
  Coding DNA sequence: Name=SeqID_4383
  Gene classification: Gene name=PntB; Function=NAD/NADP transhydrogenase beta subunit; Function class=C Energy production and conversion
  Homolog annotation: Query=1..462bp; Hit=1..462bp; Blast score=740; Percent Identity=86.0; E value=0; Homolog= pntB COG1282
MSNGVVTAAYIVAAILFIFSLAGLSRHESSRRGNIFGIAGMAIALIATILGPDAGKVGWIILAMIIGAVIGIRLAKKVEMTEMPELVAILHSFVGLAAVLVGFNSFIAHDIFVAPIMENIHLTEVFLGIFIGAVTFTGSIVAFGKLRGKISSKPLMLPHRHKLNLAALIVSFVLMVIFIKTQSVGLQVFTMLVMTAIALAFGWHLVSSIGGADMPVVVSMLNSYSGWAAAAAGFMLSNDLLIVTGALVGSSGAILSYIMCKAMNRSFISVIAGGFGTDGTSTGDEQEMGEYRETNAEDVAELLKNSTSVIITPGYGMAVAQAQYPVHDITAKLREKGVKVRFGIHPVAGRLPGHMNVLLAEAKVPYDIVLEMDEINNDFTETDTVLVIGANDTVNPAAQEDPHSPIAGMPVLEVWKAQNVIVFKRSMNTGYAGVQNPLFFKENTQMLFGDAKASVEAILRAL

SEQ ID NO: 10492 - protein, 510 aa, Xenorhabdus bovienii
  Coding DNA sequence: Name=SeqID_4384
  Gene classification: Gene name=PntA; Function=NAD/NADP transhydrogenase alpha subunit; Function class=C Energy production and conversion
  Homolog annotation: Query=1..509bp; Hit=1..509bp; Blast score=806; Percent Identity=82.0; E value=0; Homolog= ZpntA COG3288
MHIGVPKERLSNEARVAATPSTVEQLRKLGFSVRVETRAGHLASFDDIAYQKAGADIAEHHEVWQSDIIFTVNAPEDKEIALMKEGATLVSFIWPAQNPELMTKLSERKVTVLAMDAVPRISRAQSLDVLSSMANIAGYRAIVEAAHEFGRFFTGQITAAGKVPPAKVMIIGAGVAGLAAIGAAGSLGAIVRAFDTRPEVKEQVQSMGAEFLELNFKEEAGSGDGYAKIMSEAFIKAEMELFSAQAKEVDIIVTTALIPGKPAPRLITKEMVESMKPGSVIVDLAAQNGGNCELTEADKLVVTPNGVKIIGYTDLPSRLPTQSSQLYGTNLVNLAKLLCKEKNGEITIDFEDVVVRGVTVIKEGEVTWPAPPIQVSAPPTKLATLKKKEDKPAAKPRSPWLKYGLFALAIILFGWLANVAPKEFLSHFTVFALSCVVGYYVVWNVSHSLHTPLMSVTNAISGIIVVGAVLQIGEGGWVSFFSFIAVLIASINIFGGFTVTQRMLKMFRKG

SEQ ID NO: 10493 - protein, 325 aa, Xenorhabdus bovienii
  Coding DNA sequence: Name=SeqID_4385
  Homolog annotation: Query=9..325bp; Hit=1..317bp; Blast score=423; Percent Identity=75.0; E value=1e-117; Homolog= ref|NP_929426.1|
MRKAKGFFMKLKTTIIATAMLSLTTITAAHAAKELTPEQAVELKPFERISVTGRFNAIYEAADAISRQADKKGAYSFYIQSLDDFNGGGNLRVVADLYHKDAEKSDKTTNYRIYRGIKELPKTEAITLEPFDTVTVNGYFATAPDLKEAIAKAAKKKDAASFFIVRDISPNNGGNQIVTAYVYKTDAPKRQIQSNNAVIPADSETGRQALAQGGEEAEKVEIPGVASSTSTSNLVGRFFETQSSKGGRYTVTLSDGTKMEELNKASAAQMVPFDSITFSGYYTTDPEISYQVAKRAAKKGAKYYHVTREWQSNGGNITVSADLFK

SEQ ID NO: 10494 - protein, 41 aa, Xenorhabdus bovienii
  Coding DNA sequence: Name=SeqID_4386
MHKIYIFLHSHPLHTILSLRRIALFLDLTTESSLQSRAWMQ

SEQ ID NO: 10495 - protein, 489 aa, Xenorhabdus bovienii
  Coding DNA sequence: Name=SeqID_4387
  Gene classification: Gene name=PotE; Function=Amino acid transporters; Function class=E Amino acid transport and metabolism
  Homolog annotation: Query=27..488bp; Hit=1..459bp; Blast score=579; Percent Identity=70.0; E value=1e-165; Homolog= ydgI COG0531
MSNMCSIFRTSVLTNRVDYITFRNLSLEKKLGLTSLTALVLSSMVGAGVFSLPQNMAQVGSPAALMIGWGITGVGILFLATSLLLLSRLRPDLDSGIFTYAREGFGELVGFCSAWGYWFCAIIANVSYLVIVFAALSFFTDTEHSVIFGDGNTWQSLIGESILLWFVHWLVLRGVQTAASINQLATVAKLLPLGMFIILAVISFKMDVFTFDFTGIEMGIPVWQQVKDTMLITLWVFIGVEGAVVVSARAKKRKDIGIATVLAVVSALGVYILVTLLSLGLVARPELAAMRNPSMANLMVGLIGSVGEIVIIAGLIISVCGAYLSWTIMAAEVPFIASLHGSFPKVFNKQNAKKAPESSLWITNGAVQISLILIWLSGSNYNMLLSIASEMILVPYFLVGAFLVKVAFQRSNRVLLLIAVGACTYGVWLLYASGLMHLLLSVVLYAPGLLVFLYARKQNQGQKPLNILEKSTIVLLILMTIPSTWLLIH

SEQ ID NO: 10496 - protein, 152 aa, Xenorhabdus bovienii; identical to SEQ ID NO: 8262
  Coding DNA sequence: Name=SeqID_4388
  Gene classification: Function=Predicted transposase; Function class=L DNA replication, recombination and repair
  Homolog annotation: Query=1..126bp; Hit=1..117bp; Blast score=104; Percent Identity=46.0; E value=3e-23; Homolog= mll8100 COG3293

SEQ ID NO: 10497 - protein, 101 aa, Xenorhabdus bovienii; identical to SEQ ID NO: 8261
  Coding DNA sequence: Name=SeqID_4389
  Gene classification: Function=Predicted transposase; Function class=L DNA replication, recombination and repair
  Homolog annotation: Query=8..97bp; Hit=163..248bp; Blast score=61; Percent Identity=41.0; E value=1e-10; Homolog= mll8100 COG3293

SEQ ID NO: 10498 - protein, 44 aa, Xenorhabdus bovienii
  Coding DNA sequence: Name=SeqID_4390
MVKYSITKINTFKIAFIFTEFHQLIINLIKQNKRSSAVEKHSIF

SEQ ID NO: 10499 - protein, 45 aa, Xenorhabdus bovienii
  Coding DNA sequence: Name=SeqID_4391
MASYYFYLCQLIATIFFEISVDKETLTNVSLLCFGINSDKSLAVS

SEQ ID NO: 10500 - protein, 177 aa, Xenorhabdus bovienii
  Coding DNA sequence: Name=SeqID_4392
  Gene classification: Gene name=FimA; Function=Pilin; Function class=N Cell motility and secretion
  Homolog annotation: Query=1..176bp; Hit=1..198bp; Blast score=105; Percent Identity=34.0; E value=2e-23; Homolog= Z5225 COG3539
MKTNLIISSLFVSSVFVSAAYAADGQIKFTGDITATACKIDPSSANQTVNMGTISSSSFNGVNSASAATRFSITLTDCPTEVNYAQVKFDGNPDSRNNNLLALNNDNPKKKAADGVALGLYEADSATLISLAQPSKSQKLTNKSKQELNFIAKYIATNSTVNPGSGDAVANFTIVYN

SEQ ID NO: 10501 - protein, 234 aa, Xenorhabdus bovienii
  Coding DNA sequence: Name=SeqID_4393
  Gene classification: Gene name=FimC; Function=PapD-like chaperone involved in fimbrial biogenesis; Function class=N Cell motility and secretion
  Homolog annotation: Query=11..232bp; Hit=4..228bp; Blast score=174; Percent Identity=41.0; E value=5e-44; Homolog= yraI COG3121
LFGATTLKYFRVFIFIIIYIFSTNISFAGIVIGGTRVVYISDRKEASISVSNPETDVSYLIQSWVQDENNETKVPFIITPPLFKLTAGNENILRIVKTGENLPNDKESLFWLNVKSIPGTVKSDQNQLQITVKSRFKLFYRPVGLADNASIAYKALRFKTVGHKLIAENPTPYYISFSDLTTENNSINHEIKPAGMISPYGQLSWDIPVKNINYVTWKTINDFGGVTPEEKRMF

SEQ ID NO: 10502 - protein, 849 aa, Xenorhabdus bovienii
  Coding DNA sequence: Name=SeqID_4394
  Gene classification: Gene name=FimD; Function=PapC-like porin protein involved in fimbrial biogenesis; Function class=N Cell motility and secretion
  Homolog annotation: Query=48..849bp; Hit=33..857bp; Blast score=636; Percent Identity=41.0; E value=0; Homolog= Z4968m COG3188
MDNYRHYLQHNISDNWVLFIKPSKVFLYAVTITWLFTHYNEAYGEEYFNINALETHSGFPEDIDLSIFTQDNQQLPGRYWVDIYLNREKVDTGNVDFSIVNHKLSPKIKLQRLKKMGVSIDSFPSLRDLPQETEIADLGQYIPSASSFFDFNKQRLDISIPQAALNSQVRDYVSSHLWEQGLTSLLVNYNYSGSINWLNNQPGSTSNNFLNLRTGANWGAWRLRNYSTYSSQNHKWQSLNTYLQRDIHALKSQLVFGDSYTPSTIFDGFQFRGMQLASDDNMLPDSLKGFAPTIRGIAQSNAQVTIKQNGYIIYETYVSAGPFVISDLYPTTSSGNLEIIIKEADGREHRSVQPFSAVPIMLRENSWRHSLTLGKYQSFTHRGKEPYFMQGMVIYGISNRVTVYGGTTLSKDYQSAAFGTGYSFSDWGSLSFDVTHAKSDLAENFSDSGQSYRFQYAKDLSQTGTNLTLAGYRYSTHRFYDFKDANEIDITDNKDNRSNTNKRSKLQLHVNQSLGNLGSVYLSAFQQNYWYQQGYERNISAGYNTSYHSINYNLNYTYSEFPGSKHNEQILSFSVQIPLDRWLKNSWVNYNLTNSKNRDTSHQISLNGTALEDNNLIYSIQQNYTHHDKDIGGNISAEYKGAYGQINAGYNYDKQSNQLNYGLNGGVVAHPYGVTLSQSLGDTLALVRAHGAKGVKVQNHTGISTDWNGYAIVPYVSSYRKNRIALDTYSMGNNVDIDINTQTIIPTQGSLALANFQTRIGYRVLMVLSHEGKVIPFGATATLEKQHDIDDANNTIVSNDGQAYFSGVPKTGRLWVKWGYKDIQECHVDYQLPDEIPTSGLYMVNAACE

SEQ ID NO: 10503 - protein, 333 aa, Xenorhabdus bovienii
  Coding DNA sequence: Name=SeqID_4395
  Gene classification: Gene name=FimA; Function=Pilin; Function class=N Cell motility and secretion
  Homolog annotation: Query=3..333bp; Hit=18..356bp; Blast score=80; Percent Identity=27.0; E value=2e-15; Homolog= XF0077 COG3539
MVNGLKLLLASTFIAGIMSSFNALANYDCQYSPSFSAGTTYVSFGTIVIPRDYPIGTTIKEIRLDEVNEKGNIALCNTTTPTSWERPDFDPAHYNYDAIYESGVPGVGIRINTWGPGYGIDWLPRTVTYPVTCSPPSQFPNKKQYCGRTWGYLTVQLIKITPTTGSGPTHQRLLTRAKLGLDLPIHAFFLTNTYIMTQGCSLKQKTTFVNMGEVRTSAFRGMNSTAGMRNFELNLDCDANVKVGVTLDGRPAKSNANNIWALDYNSDNVTATGIGLQILYQNQPLSMGSPLIIHSGQVIGNFAIPLHARYIQTEGRVTPGKADATATITLTYQ

SEQ ID NO: 10504 - protein, 98 aa, Xenorhabdus bovienii
  Coding DNA sequence: Name=SeqID_4396
LYDNYSFNCYRPLGNEVKLQPFGQSSHQKNSPRSEKAFGLCLADRLGDLHLLIGQRNRCRCICLAWCHPSFCLDITSVQWNSKIAYYLAGVNYKRRTH

SEQ ID NO: 10505 - protein, 31 aa, Xenorhabdus bovienii
  Coding DNA sequence: Name=SeqID_4397
MHPNILAYDVSARNKVSTSRYNLVNLPTITH

SEQ ID NO: 10506 - protein, 3845 aa, Xenorhabdus bovienii
  Coding DNA sequence: Name=SeqID_4398
  Gene classification: Gene name=EntF; Function=Non-ribosomal peptide synthetase modules and related proteins; Function class=Q Secondary metabolites biosynthesis, transport and catabolism
  Homolog annotation: Query=1923..3236bp; Hit=1..1278bp; Blast score =884; Percent Identity=42.0; E value=0; Homolog= PA2400 COG1020
MSHSQNRSSEISLAVDNNNSLLPHAHPLSSPQQVIWLDQVIHPGSPNYNIGLFTCIDGELDEALFARAFEAVVYRHDTLRLQLINTHTLPLQKVTDTLPVFMDIHDFSPHIDAEAQTKQHIDAEFMRPFHLDGVLWRSELLRVSHTRRYWQFCCHHLIMDGIGLSILSEDVVDTYNRLMRGETLNRTAPSYLNFITDDRDYLASQRYSHDLQFWVKRYESLPPPLLPTANPNKAASHGQAKPIFWQIDKALFQRIEDTVARQGLSVLHFMYTVLASYFSRTTGADEIVIGIPVHNRKNAQQKNTMGMFASVIPIGVTISPEDTFLDVMHKAATELRRCYKHQRFPIAEINRQTHIQQKTGRVQLFDITLSLEPFKANLHMAGEDTNIQFFDIHHGVPYPLSIIIKQYTTGLGDDLQPITIEFDFSTDYLSTSEVMALQSRFAVLIDAAITALDTPIVNLPILPEAERQQILVDFNATQANFPQNALIHQLFEAQVQRNPDAIAVVFEGQSLSYDELNRRANRLAHHLIALNVRPDDRVAMCVERSLDMVVGLLGILKAGGAYVPLDPAYPAERLAYMLDDAAPVALLTQTVLLDTLVSRIIPTLVLNKPESTIATQPTHNPDAQALGLTSHHLAYVIYTSGSTGLPKGVMVEHRGLSNLISTQQDALAIEPSSHILQFASNSFDACIWECCMALLGGACLHLAQRTHLLPGAALLDTLESHAITHVLLSPTALAALDSVPVTLQTLIVGGEACPSSLIKRWATGRRMLNAYGPTESTICSTIYLCDNQKEGTPPIGSPISNTRIYILDPHGQPVPLGVAGEIHIAGVGIARGYLNRPELTAERFLPDPFSGMPAARMYKTGDRGRWLADGNIEYLGRNDFQVKLRGFRIELGEIESQLVQCHGVREAVVLAREDISDENTPGEKRLIAYLLAEPNVKLVPAELRQQLARHLTEYMLPSAFVTLDTFPLTSNGKLDRQALPAPDQMAVVARGYEAPADEMETALAEIWQMLLGLEKVGRYDHFFELGGHSLMAVNLIERLRRRGWVLDIRTVFSTPVLAEMAQAMLLTQDSAAAFTVPPNLIPDGCTTITPDMLSLISLSQREIDTIAANIPGGAANIQDIYPLAPLQEGILFHHLLQPQGDTYLLRSLLAFDTHERLTAFLTALQQVINRHDILRTAACWQGLAQPVQVVWRQAPLRTDTFVPTSDKDVQSQFLAHTDPHQRRLDLRQAPLFSIDIAHDPIQNEWLLVLCFHHLVSDHITLELIIAEISELLQNRAENLPAAQPYRNFVAQSLSVPASEHETYFREVLASVDAPTTPFGILDVHSGDRQVTEATHLLDAVLARAIRTQARRQGISPGVLFHVAWAQVLAKTSGRDDVVFGTVLLGRMQGSAGIARSLGLFINTLPVRVRLAGNSVQTTVQTVYRNLTRLLEHEQAPLTLAQRCSGVAPPLPLFSALLNYRHSQPETTFAAWEGKGIRLLAEQERTNYPLTLSVDDLGEGFRLVAQTVPGIDPARLAAYMTTALTGLVEALETEPQRPIVNLSILPATEHQQLLVDFNATQVDFPQYTLIHQLFEAQVQRTPDATAVVFEDQSMSYNELNHRANRLAHHLMTLGIRPDDRVALYVERSLAMVVGLLGVLKAGGAYVPLDPAYPDERLAYMLEDATPKVVLTQKMLADRLASTVPTVMPIIILDNPEPLIEAMPTDNPDARSLGLTSRHLAYVIYTSGSTGLPKGVAIEHRNTVNFLTWVQQAFRPEELAHTLFATSLNFDLAVYECFAPFISGGTVHLVSDALSLVTKKPSVSLINTVPSAITHLIDTNAIPAATRTVNLAGEALKPHVVEQLFACSSVQEVCNLYGPSETTTYSTWVRMNRMTGFVAHIGRPIANTQIYILDADSQPVPLGVTGEIHIAGAGVARGYLNRPELTAERFLPNPFATIAGARMYKTGDLGRWLPDGNIEYLGRNDFQVKLRGFRIELGEIEARLVQCHGVSEAVVIAREDISDEISDENSAGQKRLVAYLLPQAGVELEPMALRQQLAQHLAEYMLPSAFVTLDAFPLTPNGKLDRQALPVPDSSAVVTRGYEAPVSEMEIALAEIWQVLLGLERVSRYDHFFELGGHSLLAIQLAARVRQRLALELPLPQLFAYPVLADLAAVLIGASVAAQTVILTADRRQSLPLSFAQQRLWFLAQLNPKASLAYHIPTVLRLHGQLDHTAFTAALDNLVARQESLRTRFVLIDEQPYQQIDDADIGFTLICQDLRGLDEASRLTRIDELMELETQTLFNFANEPLVRGQLLQLADEEHVLILTQHHLITDGWSVGVLIHELRALYCAALGEHGDPLPPLSIQYADYAVWQREWLQGDILTAQRDFWREQLQGAPSLLALPTDRPRSPEQRYAGSHVPIHLDADLLTALKALGQRQGTTLFMTLLTAWGIVLTRLSGQDDIVIGTPVANRPRSELEGLIGFFVNTLPLRIELGQCNAVAELSVAELLAHVRERALAAYTHQDLPFEQIVETLQPERSLSYSPIFQVMLALNNTPTQSFELPGLSVSLVEQTHRSAHFDLTLSLIETVDDLNGYLEYASDLFDRATVERMVGYLTQVLTAMAADETQAIARLPMLSVAERQQLLVDFNATQVDFPQHGLIHQLFEAQVQRTPNAAAVIFEKHSLSYSELNRRANQLAHSLIAFGVRPDDRVAICVERGLDMIIGLFGILKAGAGYIPLDPEYPTERLVYQLSDSKPVILLTQKHLQTRFSIQDLSIWLLDDEIHQNSVAKQPAHNPDSEQMGLQPHHLAYIIYTSGSTGHPKGVMLEHHNAVSLIHAQCQISEPRLGDRILQFVTIAFDISVSDIFPTLASGATLVLRPPHIKIPNITFVDFLRDQKITIINIPTAFWHHWVQEIMAGRGGFSPYLHTVIVGGDKVEYRYLMDWLSCPETQSCRWFNAYGPTEITVTATALMIDDKHTPSITDNVPIGRPLSNTRIYILDALGQPVPVGVSGEIHIGGMGVARGYSNQPELTAEKFVVDPFSDHPNARMYKTGDLGRWRTDGNIEYLGRNDFQVKIRGFRIELGEIETRLVQCHGVREAIVLHREVSTGKEMPGDKRLVAYLLAEPNTELVPAELVPAELRQQLAQHLAEYMLPSAFVTLDAFPLAPNGKLDRQALPMPDQAAVVTRTYEAPVGDMEIALAEIWQALLGLEKVSRYDHFFELGGHSLMVVSLIERLRSQGWIIDIRTVFATPVLTEIAKVMQIAGGNTATFTTPPNLIPDGYTAITPDMLPLVSLTQSEIDAITATLPGGAANIQDIYPLAPLQEGMLFHHLLQTQGDIYLLHILLTFDTRERLDAFLTALQQVIDRHDILRTAFCWQKLPQPMQVVWRQAPLRIDTFVPDSDKDIPSQLLAHTDPYRHRLDISQAPLFSTDIVHDPRQGKWLLALCCHHILNDHMSLDLIIDEINELLHHRTGHLPPALPYRHFISQSLRVPMSDHEACFREMLADIDAPTAPFGILDVYSGDRPVTEVTKPLNAALTRAIRTQARRQGVSPGVLFHVAWAQVLAKISGRDDVVFGTVLLGRMQGSANIERILGLFINTLPVRIQLAGNSVQETVKAAYRSLTRLLEHEQAPLALAQHCSGVAPPLPLFSSLLNYRHSQSDVTRTLWEGIHLTAAQERTNYPLYLAVDDLGKGFLLAAQAVPGIDPACLITYMTTALAGLVEALETEPQRPIVNLSILPATEHRQLQDTLIQHFTQSHGVREETVVTRGYESPIGDMETALAQIWQKLLKLEKVGRHDNFFELGGHSLTAIQLLARMYEQNMEIPLAAVFTHPTLCELASTVGKPTSPLVAELWTKLAKNFYPK

SEQ ID NO: 10507 - protein, 1301 aa, Xenorhabdus bovienii
  Coding DNA sequence: Name=SeqID_4399
  Gene classification: Gene name=HrpA; Function=HrpA-like helicases; Function class=L DNA replication, recombination and repair
  Homolog annotation: Query=21..1300bp; Hit=2..1280bp; Blast score =2024; Percent Identity=77.0; E value=0; Homolog= ZhrpA COG1643
VESPLTASFAALFAELEHTPLRDQFRLKKRLHGAAKIKNQASLQAVAKSISEDIATAKQKVINRQVSCPPLKYPEKLPVSQKKDDIYKAIRDNQVVIIAGETGSGKTTQIPKICLELGRGVKGLIGHTQPRRLAARSVASRIADELETLLGSTVGYKVRFNDHVSENTLVKLMTDGILLAELQQDRLLLQYDTLIIDEAHERSLNIDFILGYLRQLLLKRPDLKIIITSATIDPERFSRHFNNAPIIEVSGRTYPVEVRYRPVAGDDSDSDRDQLEAIIDAVDELGHESSGDILVFMSGEREIRDTADALDKHNFPHTEILPLFARLSNSEQNRIFQPHVGRRIILATNVAETSLTVPGIKYVIDTGFARISRYSYRTKVQRLPIEPISQASANQRKGRCGRVSDGICIRLYSEDDYLSRPEFTDPEILRTNLASVILQMTSIGLGDVSAFPFVEAPDKRNVQDGVRLLEELGAIDPESLSGGTYRLTPMGRQLAQLPIDPRLARMVLEARAHGCVREVMVITSALSIQDPRERPLEKQQASDEKHRRFADKDSDFIAFLKLWDFLVEQQKALSSSQFRKLCRQDYLNYLRVREWQDVYTQLRQVVKEIGLLINSQEADYRSIHIALLTGLLSHVGQKDTDKQEYTGARNARFSVFPGSGLFKKPPKWGMVAELVETSRLWGRIAARIEPEWIEPLAAHLIKHHYSEPHWQKSQGAVMVTEKVTLYGLPVVAGRLVNYSQIDPMLCRELFIRHALVEGDWQTRHSFFRANLKLREEVEELEHKSRRRDILVDDETLFSFYDQRIGQEVVSSRHFDRWWQVASKDQPELLNFEKSMLIKGDADKVSALDYPNYWHQDNLKFRLSYQFEPGTDADGVTIHIPLPILNQVKDEGFDWQIPGIRHDLVVALIKSLPKPVRRNFVPAPNYAQAFLERVTQPQATLLDSFEKELRRMTGVTVSRDDWQLDQVPDHLKITFRIIGEKNKPLAEGKDLSALKLQLKGKVQETLSAVADDGIEQSGLHIWSFGELPERYEQKRGGYSVKAFPALVDEKDSIGIKLFETESEQQNAMWEGTRRLLLMNIPSPIKYLHEKLPNKSKLGLYFNPYGKVLDLIDDCISCGVDRLIAENGGPAWNEEAFASLQNKVRADLNDAVVDIAKQVEQILTTVFSINKRLKGRVDIALALALSDIKEQISSLVFNGFVTSHGWKRLADVLRYLNGIERRLEKLAIDPNRDRVHMSRIENIQRQWQQWLAKLSIQQKQLPEVKEIRWMIEELRISLFAQQLGTAYPISDKRILQVMENIAM

SEQ ID NO: 10508 - protein, 204 aa, Xenorhabdus bovienii
  Coding DNA sequence: Name=SeqID_4400
  Gene classification: Gene name=AcpD; Function=Acyl carrier protein phosphodiesterase; Function class=I Lipid metabolism
  Homolog annotation: Query=1..200bp; Hit=1..200bp; Blast score=280; Percent Identity=70.0; E value=7e-76; Homolog= acpD COG1182
MNKVLVLKSSILAQHSQSNKMADYFVEKWLANHVDDSITVRDLAENPVPVLDGELVGALRPSDAEMTVRQKATLALSDELIAELKVHDVIVLTAPMYNFAIPIQLKAYFDLIARAGTTFRYTETGSEGLLKNKRAIVLTSRGGIHKDNPTDLITPYLRTFLGFIGINNVEFVFAEGFGLGAESAELAHQSAQNAINDMMTKISA

SEQ ID NO: 10509 - protein, 106 aa, Xenorhabdus bovienii
  Coding DNA sequence: Name=SeqID_4401
  Gene classification: Function=Uncharacterized BCR; Function class=S Function unknown
  Homolog annotation: Query=1..106bp; Hit=3..109bp; Blast score=89; Percent Identity=47.0; E value=5e-19; Homolog= ydbL COG3784
MKKAGVIFLASLLFSSFAVGMTLSEAKQQGLVGETFSGYLAPVKKTRDAQSVIQKVNEEREKKYAAIAVQNNMTTNQVAKMAGEKLVNRAGAGEYVLGINGNWVKK

SEQ ID NO: 10510 - protein, 69 aa, Xenorhabdus bovienii
  Coding DNA sequence: Name=SeqID_4402
  Homolog annotation: Query=1..69bp; Hit=1..65bp; Blast score=77; Percent Identity=62.0; E value=5e-14; Homolog= ref|NP_929407.1|
MITKTGLRLSVGMASLMLASIVLTGCIRLEVATPDKPIKIDMNVKIEHEIHIKVDRQIEDMLKNNSNLF

SEQ ID NO: 10511 - protein, 874 aa, Xenorhabdus bovienii
  Coding DNA sequence: Name=SeqID_4403
  Homolog annotation: Query=1..874bp; Hit=2..875bp; Blast score=1082; Percent Identity=59.0; E value=0; Homolog= ref|NP_929406.1|
MTKIFKVFAVMITLLVLLVLTGWYTLPCWLPLIVSHWLPQGVTLSLSQPKWEKNTLRLDDLALQAKGCEWVNMSGLFVGYPRREKTKERYWNIHAASVHSNSPCLGQLPVTENPSEPLSIEDTLSSISAVKLVVDHFELTPWQEFAGKLQFDSSRQGQTFSYQGKQLKLNVHTADKKTLVIHQFFVKLPEQEISLNGDISLPLGIDALPVQGQITGRLSISQYPDPLQVILKWQGQGGTLTIREEKQKRILAELPWSFNQSQFLITDGKWQWMDTGQPLSGGVNLTFDHWRKGVDGMLISGRVNLITQNERGRGNIVLSIKPTLINMANAHIPFQLTGQMNRGQMVMTMSLPAIVTGPLVAPKITFQPGALFRAWGKVSETFTVKEARLPLAGTYLTRDGFTGRLQAIVTAQDNYWGKFKLHLDGDAEDFIPDQGNWRWRYWGNGHLAPLQAKWDIAGTGSWERSQITVNALNTGFDVIQYGLVQMEAPRLQLIKPLVWERSATQPTFMGDLQLSALRTDFRSGGFLPPFDFKATVTGQSPDNFILNGKLSPKGIEPIPFYGRWDGTRLRGDARWPSQSLLALQPLIPGDLGMTVRGGNLYAQAAFSAAKGQGLRAGGHWVVKNASVWLKDGEIDGLNFVLPWRLQEHTWQLGVISPVQLRVNEIKGLFGMQNVTADLLGFYPPTETQPLTLSNVNVDMLDGKLGLDKLQLPQKQAAVLRFDKLNLSKLFGVLKVKQIAMSGRISGELPLLLNDKNWIIQQGWVSNDGSLTLRLDKDTVGSIGKNDLTAGMTMDWLSYLEISHLKAHVTLDNLGILILNSEISGVNPMVDKKREVRLNYRHEENIFQLWRSLRFGSNLEEWLQKNISVMNGSDK

SEQ ID NO: 10512 - protein, 36 aa, Xenorhabdus bovienii
  Coding DNA sequence: Name=SeqID_4404
MTFTEIGSKRYLSLYSNKPTNKLFMIIARIINQLRA

SEQ ID NO: 10513 - protein, 331 aa, Xenorhabdus bovienii
  Coding DNA sequence: Name=SeqID_4405
  Gene classification: Gene name=LdhA; Function=2 Lactate dehydrogenase and related dehydrogenases; Function class=C Energy production and conversion
  Homolog annotation: Query=1..328bp; Hit=1..326bp; Blast score=521; Percent Identity=76.0; E value=1e-148; Homolog= ZldhA COG1052
MKLVVYSTKQYDRKHLEMLNQRLGLDYHIEFFDFSLSPHTAKNAIGADAICIFVNDDGGREVLEELAAMNIKILALRCAGFNNVDLDAAKELGIQVVRVPAYSPESVAEHAVGLMLCLNRRIHRAYQRTRDANFSLEGLTGFNMYKRTAGIIGTGKIGLAILRILKGFGMRLLAHDPYPNQEVLELGVKYVDLDTLYAESDVISLHCPMTPENHHLLDETAFNKMKDGVMIINTSRGALIDSIAAINALKQQKIGALGMDVYENERDLFFEDKSNDVIQDDIFRRLSSCHNVLFTGHQAFLTEEALTSISETTLQNIQQLTSGKPCPNLVG

SEQ ID NO: 10514 - protein, 144 aa, Xenorhabdus bovienii
  Coding DNA sequence: Name=SeqID_4406
  Gene classification: Gene name=HslJ; Function=Heat shock protein; Function class=O Posttranslational modification, protein turnover, chaperones
  Homolog annotation: Query=1..142bp; Hit=1..138bp; Blast score=100; Percent Identity=43.0; E value=4e-22; Homolog= hslJ COG3187
MKKAISFAIATLLLTACQSSGVSATGNVTVRDLQHRNFALISVNGATVSNKEDSKLSIAFGEKMFVSATMCNHFMGVGKLKQRVLTVSILEKSQMFCVNEQLHQWDQVIYDVLTEGATVRLKSKQLTLTNDKNTLVYVLRDITQ

SEQ ID NO: 10515 - protein, 67 aa, Xenorhabdus bovienii
  Coding DNA sequence: Name=SeqID_4407
MAFTRLTKYIWGTVGEDLKSDHQRLSHAAMQVCLIMRGEKMNSEWLVYIKFVGLWIALMLMIGVMLS

SEQ ID NO: 10516 - protein, 97 aa, Xenorhabdus bovienii
  Coding DNA sequence: Name=SeqID_4408
  Homolog annotation: Query=1..92bp; Hit=3..94bp; Blast score=65; Percent Identity=35.0; E value=3e-10; Homolog= ref|NP_456430.1|
MASYLVRVELYGTGSDGYEKLHNRMTANKFNKSIQFPNGKWHRLPSGTYIGNSSLESLQLAEKIKSIATPFSSKEPSIFVCIYSNWSAALYPDTGAG

SEQ ID NO: 10517 - protein, 59 aa, Xenorhabdus bovienii
  Coding DNA sequence: Name=SeqID_4409
MQLLIAIRTRAIKFHTNQITCHLSFLVLTVEQTSYQFFLADKSKKNERKIRYSWQSGVW

SEQ ID NO: 10518 - protein, 50 aa, Xenorhabdus bovienii
  Coding DNA sequence: Name=SeqID_4410
MITLYFLKMVIHSIGIFLRKVSVDSGWLNFAMTCNSRDESDIKNWSQIIV

SEQ ID NO: 10519 - protein, 214 aa, Xenorhabdus bovienii
  Coding DNA sequence: Name=SeqID_4411
  Homolog annotation: Query=1..214bp; Hit=1..212bp; Blast score=265; Percent Identity=76.0; E value=5e-70; Homolog= ref|NP_930197.1|
MSIENINININEQKIGKDSVVLGHAEASAVHAVAIGASPRNSKAISEAAIAIGQNQLAGKQGDANVVFPIAIGADSVSNGLASIALGQKVTASASQAIAIGQNSSATEKGSVALGADSIANKPNVISVGKSGHERKIVHVAAGDISNHSTEAVNGHQLYSELAKTNVLLDEKNKQLENKIETLESNIANLNLLNKNNADDIALLKQRLFDALNY

SEQ ID NO: 10520 - protein, 148 aa, Xenorhabdus bovienii
  Coding DNA sequence: Name=SeqID_4412
  Gene classification: Function=Uncharacterized ACR; Function class=S Function unknown
  Homolog annotation: Query=4..148bp; Hit=10..155bp; Blast score=241; Percent Identity=78.0; E value=2e-64; Homolog= ycgN COG2983
MTELMSQPFWQGKTLEQMTDQEWEALCDGCGQCCLHKLMDEDTDAIYFTNVACNQLNIKTCQCKNYEDRFRYEPDCIKLTRENMVTFEWLPMTCAYRLIGEGKKLLPWHPLVSGSKSAMHAERISVRHIAVREADVVDWEDHIMNKPE

SEQ ID NO: 10521 - protein, 218 aa, Xenorhabdus bovienii
  Coding DNA sequence: Name=SeqID_4413
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=1..218bp; Hit=1..219bp; Blast score=320; Percent Identity=67.0; E value=7e-88; Homolog= ycgM COG0179
MYQHRDWQGVLLDFPASKVVCVGSNYERHMKEMGSKVTEEPVIFLKPETALCDLCQSVSIPQGLGAVHHEIELAVLIGSTLKNASEERVGKAIAGFAVALDLTLRDLQHKFKQSGQPWEKSKAFDGSCPISGFIPVKALSEPQNAQLSLTVNGESRQNGNTSDMRMPIIPLISYMSRFFTLRPGDIILTGTPEGVGPLQPGDVLNVSLNEHVLTTRVI

SEQ ID NO: 10522 - protein, 361 aa, Xenorhabdus bovienii
  Coding DNA sequence: Name=SeqID_4414
  Gene classification: Gene name=MltB; Function=Membrane-bound lytic murein transglycosylase B; Function class=M Cell envelope biogenesis, outer membrane
  Homolog annotation: Query=48..352bp; Hit=16..321bp; Blast score=304; Percent Identity=49.0; E value=1e-82; Homolog= VC1956 COG2951
MKLISGVTLLTATLLAGCTSSNGKVLQDQSRQAVVIQKEIRALDEQFPIASREPSQFPAYVVLLKQQAREKGFSEKTRDRAFADIHFISRVIQSDRNQPEKKITLDDYLNRVLSARKIEQGVIQYQNNLPQLERISRKYGVSKDYIVALWGLESGFGKVQGKEDVISALSTLAFEGRREDLFIKQLMAALEIIEKKYIDENQTLKGSWAGAMGQSQFMPTSYLTYAADGNGDGKIDIWNSKEDVFASIANYLAKEGWQQGLPWGYGVSLPAGFNQNLEGIKLEQGKTIAQWQALGVSSPDFASLPVNTKGWIVIPNDTEQRAFWVTQNFRTIMHWNRSYNFALSVGMMAESIGQKTHFLTH

SEQ ID NO: 10523 - protein, 89 aa, Xenorhabdus bovienii
  Coding DNA sequence: Name=SeqID_4415
  Gene classification: Function=Uncharacterized BCR; Function class=S Function unknown
  Homolog annotation: Query=1..87bp; Hit=12..98bp; Blast score=119; Percent Identity=66.0; E value=7e-28; Homolog= ycgL COG3100
MICVIYRSPKRDQTFLYVEKKGDFSRIPEALLKTFGEPQYSMMISLSGRKKLANADIVKVRTMLSEQGFYLQVPPPVESLMSEHLAVNK

SEQ ID NO: 10524 - protein, 227 aa, Xenorhabdus bovienii
  Coding DNA sequence: Name=SeqID_4416
  Gene classification: Gene name=MinC; Function=Septum formation inhibitor; Function class=D Cell division and chromosome partitioning
  Homolog annotation: Query=1..226bp; Hit=1..230bp; Blast score=275; Percent Identity=59.0; E value=3e-74; Homolog= minC COG0850
MSQSPIELKGSNFTLSVVHLHDGQPEVIQRAMQEKMEQAPEFLKNAPVVINISDLPAGADLLALYRAVESVGLRIVGISGCQDEEQRKIVLKSGLPLLKEGKSQKIPTQENKPTEPIFKKTRIINTPVRSGQRIYAPNSDLIVTSNVSAGAELIADGNILIYGVLRGRVLAGASGDKESQIFCTHLNAELCSIAGQYWLSENIPENFVGKAAKLRLVNNELTIETLV

SEQ ID NO: 10525 - protein, 270 aa, Xenorhabdus bovienii
  Coding DNA sequence: Name=SeqID_4417
  Gene classification: Gene name=MinD; Function=Septum formation inhibitor-activating ATPase; Function class=D Cell division and chromosome partitioning
  Homolog annotation: Query=1..270bp; Hit=1..270bp; Blast score=461; Percent Identity=90.0; E value=1e-130; Homolog= minD COG2894
MARIIVVTSGKGGVGKTTSSAAIATGLAQSGKKTVVIDFDIGLRNLDLIMGCERRVVFDFVNVIQGDAALNQALIKDKRTENLYILPASQTRDKEALTREGVEKILNELDQQGFEFIICDSPAGIESGALMALYFADEAIITTNPEVSSVRDSDRILGILASKSRRAEKANEPIKEHLLLTRYNPGRVNRGDMLSMEDVLEILCIPLLGVIPEDQSVLRSSNQGEPVILDKESDAGKAYEDTVLRLLGEERPFRFIEEEKKGFLKRLFGG

SEQ ID NO: 10526 - protein, 89 aa, Xenorhabdus bovienii
  Coding DNA sequence: Name=SeqID_4418
  Gene classification: Gene name=MinE; Function=Septum formation topological specificity factor; Function class=D Cell division and chromosome partitioning
  Homolog annotation: Query=1..87bp; Hit=1..87bp; Blast score=126; Percent Identity=82.0; E value=3e-30; Homolog= minE COG0851
MALLDFFLSRKKPTANIAKERLQIIVAERRRGDSEPAYLPEMKRDILAVICKYVQIDPEMLSVQFEQKDDDISVLELNVTLPETEELPK

SEQ ID NO: 10527 - protein, 42 aa, Xenorhabdus bovienii
  Coding DNA sequence: Name=SeqID_4419
MNRGVLTSRFQIFNKSINAFFSFFSNSRHPPILAITLSIFII

SEQ ID NO: 10528 - protein, 180 aa, Xenorhabdus bovienii
  Coding DNA sequence: Name=SeqID_4420
  Gene classification: Function=Transposase; Function class=L DNA replication, recombination and repair
  Homolog annotation: Query=6..175bp; Hit=144..312bp; Blast score=82; Percent Identity=31.0; E value=2e-16; Homolog= NMB1552 COG3547
MLLTEENRLSVADEVVCDSHAKIITLLKQELKDTELKLKKHIDDSPSLKKNKGLLESIPGIGERLSATLLAYIGDGSRFHHSGQVVAYAGLNPKLHESGQLKGRAHLSKQGSAELRKALYMPGLAAISCNKVVKKQWEQLTARHKGGKVGVCAVMRKLLRLAYGVMKSGTLFNAEIPLAV

SEQ ID NO: 10529 - protein, 37 aa, Xenorhabdus bovienii
  Coding DNA sequence: Name=SeqID_4421
MPEDADWRNNVLSVWRQFYRFYCGVIPLYQRHGFVPD

SEQ ID NO: 10530 - protein, 373 aa, Xenorhabdus bovienii
  Coding DNA sequence: Name=SeqID_4422
  Homolog annotation: Query=1..369bp; Hit=3..372bp; Blast score=250; Percent Identity=37.0; E value=3e-65; Homolog= ref|NP_415977.1|
MKELVDVFSDFPDPRCQGKVKHRVIDILVIAVCAVIAGANAWTDIEQYGQLKKDWLSSFLPLKGGIPSHDTFRRCFSLLNPSLFEHHFYQWVSRDLSSEKRAIIAIDGKSLRHSFDKKIDQSALHMVSAFTVEKGLSLCQCAVDGKSNEIKAIPALLSMLSLKGHLVTMDAMGCQRTIAQQLRESEADYILSLKGNQGKTFSEAVNYFQQQQITQKPYLKPDHDEFDDSHGRTVRRRGWVLPLTSETKHLRSWPDIQALLVTETIRQEHYSDTVTSDFRYYLSSCHDSPAFQLGAIRKHWAIENSLHWVLDVTFREDDSRMRERVATRIFAQLRKMALNIVKRDINSKLSLSARRKSAGWDNGYMEALLFNQF

SEQ ID NO: 10531 - protein, 122 aa, Xenorhabdus bovienii
  Coding DNA sequence: Name=SeqID_4423
  Homolog annotation: Query=3..97bp; Hit=146..228bp; Blast score=84; Percent Identity=51.0; E value=3e-16; Homolog= ref|NP_927397.1|
VPTREYVKGAIAEHAQSRNHPYATQVEPGFVTLSNDVDSDSEKTVATSKAVKAAYDLANTANQNALNNNSNLYLEKKLNGADIPDKAEFVKNLGLSELVYRAIGNGPNQVPDINSFDSCYNW

SEQ ID NO: 10532 - protein, 41 aa, Xenorhabdus bovienii
  Coding DNA sequence: Name=SeqID_4424
VQNISPISAELAAALQEPMKFRRILVRHPCLDWYVIDSSDI

SEQ ID NO: 10533 - protein, 229 aa, Xenorhabdus bovienii
  Coding DNA sequence: Name=SeqID_4425
MCAAATARRQARQQKRMGSQKECLLRHPGLADQVVNIGDYPAQAGVKVGTRLNYLPYLERHTASRNVMPWLASSADLEALDWEVIVKTPEIHKQVEYRLVLDKYTCSSSRNADPEYEKWTVSEPHQSMLIDSNLDFNVPRFDWVDNHAAKPNEFSVHFSNQSPEAREKLSAITDKKLTITVKGIEYPLGHHTPDSDYHHPRYQGSEAEKIGGLVKAQFGTLRFHFKWHD

SEQ ID NO: 10534 - protein, 140 aa, Xenorhabdus bovienii
  Coding DNA sequence: Name=SeqID_4426
  Homolog annotation: Query=1..139bp; Hit=1..139bp; Blast score=157; Percent Identity=57.0; E value=2e-38; Homolog= ref|NP_930192.1|
MYVYCAKNNMFYPEVLKQDYLNVGKWPADGIEVGESVYLEFVASRPPEGKRRVVGENGLPAWGDIPPPTPEEQQQRAERKKQYLMSQASNAIAPLQDAVELEMATGAEKSALTEWRKYRVLLNRVDCTTAPDVKWPEQPT

SEQ ID NO: 10535 - protein, 393 aa, Xenorhabdus bovienii
  Coding DNA sequence: Name=SeqID_4427
  Homolog annotation: Query=1..195bp; Hit=1..233bp; Blast score=160; Percent Identity=43.0; E value=3e-38; Homolog= ref|NP_930257.1|
MAKNEFLPFGIADGASILTNEEYGNLAARTNGFSSGVAKSQELNKVWRQASVIASVVAQFIAETNKQDVLDDGNTEALRAGLLNALRATVGANIPVASQTLAGITKLSNATNSNSEVDAATPRAVKATYDLANTANQNAGNAINNANTAIQNAANANNNANSRLEKSKNGADIPNENEFVKNLGLADTVERAKNAASLTEWTPQIFNSDVYAKTIISGLPGADRTYLEIVKGAVMWQAYEGERNYTLRHPAKSGTVAIIEELYKKSELYTKDDLYKKSELYTVTESNNRFGYKNDAKLDQNGWWKCGDTGVIFQWGYTEKTLAESSETITFSTEFPRRCFGGLASPSYPHASSSNSSAYFFNLNDGKRAIITCDQSAGAPDDRSYIFWWAVGI

SEQ ID NO: 10536 - protein, 217 aa, Xenorhabdus bovienii
  Coding DNA sequence: Name=SeqID_4428
  Homolog annotation: Query=5..217bp; Hit=4..226bp; Blast score=183; Percent Identity=43.0; E value=2e-45; Homolog= ref|NP_455549.1|
MRRDYLKLITAQHRTAPKFVDHLDLITRTLSDIATVAQTLNTEFSIDHGVGVQLDAVGEWIGLSRYVRVPIVGVYFSLDMEEIGFDRGSWKRKFDSDTGFTELDDETYRTLLRVKIQANHWDGTSEMLEAIYQQILPDSNTKILFIDNQDMTMDVFLTGGVVLEVIKAVIRQGYLNVKPEAVRVNNYINSARKGLFGFDINNEFVAGFGTGGWAVKL

SEQ ID NO: 10537 - protein, 395 aa, Xenorhabdus bovienii
  Coding DNA sequence: Name=SeqID_4429
  Gene classification: Gene name=XkdT; Function=Uncharacterized homolog of phage Mu protein gp47; Function class=S Function unknown
  Homolog annotation: Query=12..394bp; Hit=9..386bp; Blast score=138; Percent Identity=30.0; E value=1e-32; Homolog= XF1704 COG3299
MLNLDTLGLAAKITASGITAPDYPTILERLNGYFRQIYGEDAYLEPDSKDGQMIAIYALAIHDANNMVVASYNTYSPRTSSGAALSNNVAINGLSRHAATRSTADITLVGQVGTVVKNGLVRDRNNHPWTLPDIVTIGTQGTVTVTATCQKLGAITAAPGDIYIIGTPTRGWQSVTNSYSATAGAPIEPDGALRIRQHKSVALPSRTVLDGMHGAISLIPGVVRLRGFENDTHKTDVNGIPPHSVAMIVDGGDATEIAKTIALKKTPGSGTFGDTTINVRNHYGLSTPVRFSRPVDVPVYVELSITAFEGYTTLVGDRIKTAIAKYINTIVIGDNVYLARLYSPANLPGDEEGKTYDINTLKIGRSAHALAESNLKIAFNEAPVCNIDNINVVVT

SEQ ID NO: 10538 - protein, 115 aa, Xenorhabdus bovienii
  Coding DNA sequence: Name=SeqID_4430
  Homolog annotation: Query=1..114bp; Hit=1..116bp; Blast score=118; Percent Identity=57.0; E value=2e-26; Homolog= ref|NP_455547.1|
MRYRREDSNGDYSFGQGDSTFLTNSPEAVAQAVKTRLNLWRGDWFLDTAAGTPYREAVLDKSYASAMAIREHILGTEGVTEIISLDAKRDPDTRKMTLTATINTRYGKTTVTSER

SEQ ID NO: 10539 - protein, 251 aa, Xenorhabdus bovienii
  Coding DNA sequence: Name=SeqID_4431
  Homolog annotation: Query=1..251bp; Hit=1..251bp; Blast score=372; Percent Identity=74.0; E value=1e-102; Homolog= ref|NP_930261.1|
MITHHERVNQPETPFLVMQTAISSGLYVALPCIIQSFNADAVTVTAQPAIRWKVTNSEGKTESVALPLLVDVPVIFPRGGGVTLTFPVKAGDECLVVFADRCIDYWWQSGGVQEPVDPRQHNLSDGFAIVGPQSQAKKISGISTSAAQLRTDDGAAYIELSPGSHNITVKTPGKLTATADGGTEITSPEIVLNGNVIINGNLSQGMGASGGMAMMNGPINVKNDVIAGGVSQMKHKHSGVETGGGTTGGPQ

SEQ ID NO: 10540 - protein, 100 aa, Xenorhabdus bovienii
  Coding DNA sequence: Name=SeqID_4432
  Gene classification: Function=Putative transposase; Function class=L DNA replication, recombination and repair
  Homolog annotation: Query=1..58bp; Hit=99..156bp; Blast score=93; Percent Identity=77.0; E value=5e-20; Homolog= XF2303 COG3316
MDETDIKIKGQWKYLYRAVDSNGQTIDFLLTTKRDAAAALRFFRKAIRYHDEPEVVNLRGLSPLATVIKRCLRPLTPMVTTWLSTSTISVIPVKTRGTWN

SEQ ID NO: 10541 - protein, 85 aa, Xenorhabdus bovienii
  Coding DNA sequence: Name=SeqID_4433
  Gene classification: Function=Putative transposase; Function class=L DNA replication, recombination and repair
  Homolog annotation: Query=13..84bp; Hit=23..94bp; Blast score=111; Percent Identity=76.0; E value=2e-25; Homolog= XF2303 COG3316
MLFFLRCYLTMPLIRKAFKRLHYPVDIIAQCVRWYLAYALSLRNLEEIMAESGVVVDHSTLHRWVIRLIPLLDKAFRRHKRTVGR

SEQ ID NO: 10542 - protein, 326 aa, Xenorhabdus bovienii
  Coding DNA sequence: Name=SeqID_4434
  Gene classification: Function=Chitinase; Function class=G Carbohydrate transport and metabolism
  Homolog annotation: Query=12..320bp; Hit=27..336bp; Blast score=375; Percent Identity=60.0; E value=1e-104; Homolog= PA2300 COG3469
MKTPTLQNSENKIVMGFWHNWAPEPGQGYKQGRFTEMDLSEIPVAYNVIAVAFMKVLENSDRIPDFKPYKGTETEFRRQIDLVHAQGRKVLISLGGADAHIELISGDEVALANRIIALTEQYDFDGLDIDLEQAAITAANNQTVIPAALKVVKNHFRPLGKNFTISMAPEFPYLAQGREYNAYINGLEGYYDYIAPQFYNQGGDGVYVDGVGWIAQNNDAQKEDFLYYLTESLVTGIRGFIKIPHGKFIIGLPANNDAAATGYVIDPQDVYNALARLKAAGLDILGLMTWSVNWDAGFSRSGEAYAWEFINRYGYLANDGTVPEPE

SEQ ID NO: 10543 - protein, 40 aa, Xenorhabdus bovienii
  Coding DNA sequence: Name=SeqID_4435
MNTIVSVAIVGMANKLARTVWTLVAHQREYQKNYVSVRPY

SEQ ID NO: 10544 - protein, 39 aa, Xenorhabdus bovienii
  Coding DNA sequence: Name=SeqID_4436
MIQVQFFRRAVSCYSRHLSRQRNLWSLYERIPFARQKLL

SEQ ID NO: 10545 - protein, 33 aa, Xenorhabdus bovienii
  Coding DNA sequence: Name=SeqID_4437
MCNMRLTLFLMMVANHHNYYDTSAIFQKGGQLL

SEQ ID NO: 10546 - protein, 54 aa, Xenorhabdus bovienii
  Coding DNA sequence: Name=SeqID_4438
MPSRQFHLYIQSRCSWLPFNIGAGVEGETRGLRLLTKSRLNVQYEAHLVSYDGS

SEQ ID NO: 10547 - protein, 328 aa, Xenorhabdus bovienii
  Coding DNA sequence: Name=SeqID_4439
  Gene classification: Function=Transposase; Function class=L DNA replication, recombination and repair
  Homolog annotation: Query=3..320bp; Hit=2..310bp; Blast score=137; Percent Identity=31.0; E value=2e-32; Homolog= NMB1750 COG3547
MYYVGIDVSKNKLDICLLYDGVKGKRKTKSLLNNEHLACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELAELEALIAEHINQHPNLKKDFELLTSIKGVGTQIGLNMLIILRTNTFTRATQVAAYLGVIPIAKQSGTSVHGRVRLSKTGPAKIRAKLFMSALTAVRFNPHINDLYNRLVNKGKAKMLALGAAMRKLVHLCYGVLNTQQSYDENYAIRT

SEQ ID NO: 10548 - protein, 60 aa, Xenorhabdus bovienii
  Coding DNA sequence: Name=SeqID_4440
MFLIITYIVSEDMNEHWVYFLGAVACPQKTISLGAYTNKVKFSYLINYRSGINCNVDEYD

SEQ ID NO: 10549 - protein, 197 aa, Xenorhabdus bovienii
  Coding DNA sequence: Name=SeqID_4441
  Gene classification: Function=Putative transposase; Function class=L DNA replication, recombination and repair
  Homolog annotation: Query=20..180bp; Hit=14..173bp; Blast score=192; Percent Identity=60.0; E value=2e-49; Homolog= XF2303 COG3316
MKKNTSRGSVALTEHQVSSLFFSESRTMSLIRNVFKRLHYPVDIIAQCVRGYLTYALSLRNLEEMMAERGIAVDHSTLSRWVHRWVSLIVKRYRRGRPEVERRWRMDETYIKIKGQWRYLYRAIDSDGNTVEFLLTAHRDKKAALRFFKKAMRQHGQPDGVTLDKSGANKAALDEMNKEKLKNITTTNHSIHDLIFK

SEQ ID NO: 10550 - protein, 65 aa, Xenorhabdus bovienii
  Coding DNA sequence: Name=SeqID_4442
VYREVRVVFIYSGAFSTYTPDVALYRSCDRTGVGEKGSVKQLVDLIGQLHKLFLGFQEQRNSKRR

SEQ ID NO: 10551 - protein, 2541 aa, Xenorhabdus bovienii
  Coding DNA sequence: Name=SeqID_4443
  Gene classification: Function=RTX toxins and related Ca2+-binding proteins; Function class=Q Secondary metabolites biosynthesis, transport and catabolism
  Homolog annotation: Query=928..1117bp; Hit=3452..3652bp; Blast score =134; Percent Identity=38.0; E value=2e-30; Homolog= VC1451 COG2931
MVYMSKDFKKLLNTLIDRQIEVAGRQTEWFNMNANARADYIRQVNERLQEMQQSTLSVLAAQHFQMQDNPVSVGDQLQTLQQRRQQMDGKSDTPAIKAYKQQLDRDIRLYSRQQAAITHFNSSRKKALDMLSPSGSKTLNAMTLREDAAVKQAKLDTEIKNLEQQLTIQVTDSTFSPKYVRLFSKLQAYKDVKARYIALLETSSKEETKEAKVFSKLIEVPLASDDLPVNVSLLMMEERPGYIRMNVALVNASPDGRFKDFFLKDGRLVVPKDGVFNFSFGTPARSLAWQQQYRLKSEPPSFRSPTYAPIRSVLVKIEFVEKYFANYLVSESTEREGFKEHFLDNDRKILLISVDRKVPNQIGIKVSGHTHEVPLAGTLSDLINQNADITSFQTIGLEDFRQNSYDPDRDGLFINIHELERSVGFGNRQYLLEMPQGKIPSKTYLSATPFGVMSVDGDKVSSGHLSKAQTAELYQYNAAFFETLDRLRDDGAKASRLFEGSSERKVFEQQLVRLLERNHITPAGVLESEYTDNRMRDIKGNNLNKVLWEQAFATSVWENIDNDPLLSKLANKLNSLVFSSTTVDKVLKNSYVQSDIAQVKGLLALQYEQWRIRATEEETQRINRANAEQHPNNPKIQVFNQTEVERSLDRKLLALLLVGPENFERTDEQLYPAVKAALLSNEGRSLRKQVLFHVLRPVADSFSKLAVPVNPHAELMSERGDNKVIINNRLNQPDPFLILNTSPEEQVYHDGSNLIKDDKYRSYNQFRPDPENKATLYMNDLDTPFVGGISGTTQTVSNVLPELFGDTLSVKEYWNFQMANAAFMIRNGYHSFFETFYVAARYEPKSADSIGKGMLQMFDEYRAEGREKALQGELYDGVMARVLPIINQGLPEAKKFHSPRFMPTLLDQEEGRYRHEPEGIAPFDEKPVSNWEKPVVEAHHEGGMSRFDGQLIIQLENDPVVREAAAKLAGKHTDSVLVQLDAQSQYQVVHGDLTILKDKGKIRWQLVGHSRDGGDKLNHQTLAKRTPEALASQLSQFYTDSGVKTSPEHISMVSCSLAGEDQQESYALKFAQSLDQRIRPLSVKAYTTQITVSPEGRKQLIENGNKAALVFNPENSVWEITVTPGKSVPAGGMVNPPLGNKTAPIPDNVQIDIRLLEMLNRAEDFQQATEQLYSKNALSAEEWLPVLGSLREGVSQPGSYSLQFINTARSELPPQTFITDDRRIIDFIHSYDKDLETVSKTHAYTKGKLTLRTGIPEADAVHGLNTAFIVKTLIPWFADRNRTTVASDKVPNTMPNTLETALRVHTYVNLAQMAHGTLEDGAKLASLYRAVVSEGRGVTSSLFSSLSHVSTGVGAGLNILSVALDGIELAHAQNESQKAVYGTQLAFDSAGLVTTGVGIGAGIFGAPIVAGFASSLAVPLAGLGIGFTALAEAFGRVASDAQAVGNYFADLEAAYQQGGYRQTEKVAADGSRYTVMEPIPGAVIRQLDLRHGHLTFDSQYLYRNDPTYSWGSGRSNYFFWWPGRAADTDKKHAINIREGIGHKQAQSNFHFRSRSSDILILPVTMKSYINYEYMILPFVTARNDRGFDVLRRLEEDGRFDFDFYAFPGERVVRRIKPEFVATPIDIILDDEDRDIVIQQLPEKDYGILSYQLTGGKGKYRISLQEGVSLSLQENTGTHWILDARHIGSNVNTSFSKKDNRQLLHIGSIKITLPEKSDNISLINNAGIFSVKQNKENQWQITESVTNAMQFNSLQALHDHLRQLSNSEHHNRPYLVVEHYQHSPQSRPVGRAFYETGRDRMIYTNVPDAADFLSYAELAKVEGNKAWFYRDTTLWQVDIVSGEVLRQYLPIKFPGSDQEKISSHVMQSNDQLWFVVERQLDEGYISYTYQVAEEALKLVAVDGNTVMLAGLDKISEKNFVALPVPLDSSDGEFNGLLAPLAANQWFTGDLCAPERQVKGSPAEVISLSGRVAGVDRHYWLQTDGKQLRNVVRMNRINPDQEDAGILAELKKKNSDLLALTADFTRVFTTTGDKPGYYFYSHQRHSLYFQQDNGLSGTPASKVAVDDIRSVSIANKQLVALSSRGMLWLADDQGSIRLIGVTADWLQQPHQNGLTAALSQLARDNPDRFSTLLLLGLQDSNGKPISAWYDSTAGRVVQSGVGLITEHTLTYLGLAEDGSQAWIFDTDNHQLYRQPLSAEPDLKLSEKRVLSEEPAAAESWLRASHQYRSAVRQGNTLRLETPDGAVLLLSADAKMTDRPVLIAWHVQGRPDSQIASAIVALRNEAELPQAVRLFSERGYPAWYLPEEGKTLRSSIVDSNHVLHYLGQVAGQEASYVHDQTTGELWQVSEEKSTLEGNYCFVNRTPESLVLQVGQVPLGEKIRLPQLAGTDRLAITGRSKELYYWLSSPEALTHYRHITIDDRGQGSAIRFSDTCIANLSLWRSGQNLVLLHQASEDTSICIVSIEQAAQRYMRLESTGTPALKKMKIIHLLRKMDKLTVLNPDVSCFELESEEGELRIKPAECTEKLESFSSIPAHSVLIPRM

SEQ ID NO: 10552 - protein, 58 aa, Xenorhabdus bovienii
  Coding DNA sequence: Name=SeqID_4444
MMFVIYLFSFILLSGYDVKGFITIFASSDMTVCYLEHLVSSSFSDSGTGHEKTDVALL

SEQ ID NO: 10553 - protein, 178 aa, Xenorhabdus bovienii; identical to SEQ ID NO: 8288
  Coding DNA sequence: Name=SeqID_4445
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 10554 - protein, 146 aa, Xenorhabdus bovienii; identical to SEQ ID NO: 8316
  Coding DNA sequence: Name=SeqID_4446

SEQ ID NO: 10555 - protein, 570 aa, Xenorhabdus bovienii
  Coding DNA sequence: Name=SeqID_4447
  Gene classification: Gene name=SUL1; Function=Sulfate permease and related transporters (MFS superfamily); Function class=P Inorganic ion transport and metabolism
  Homolog annotation: Query=6..555bp; Hit=9..558bp; Blast score=536; Percent Identity=51.0; E value=1e-152; Homolog= VCA0103 COG0659
MLWKRLHRWMPGLENFCYYRKEYFSHDIRSGLSVAAVALPVAIAYAELMGISAIIGLYACILPMFAYALFGTSRQLIVGPDAATCAVIAAAVAPLALGNEHVRWQLAIIMTLMTGFWCILASHFRLGAFADFLSRPILKGFINGVAITIMADQLAKVFGLSGLPPELIERLIALPHKLLESHWPTVGMSVMTLLILLGVRFLHPGWPAPLIAMIVSTYVSWQFELNQYGIQIVGNMESGLPIVPMPEFQLGVMRDLVVPSINLAVISFVSFMMTARSFASKNGYQVDADLELRALGIANIASSLSLGFAVSAASSRTAVNDAIGGKTQMVSVIAAITILLVLLFMTEFLGYIPLSSLGIVLIFSTWSLLGLKNIWSYRKRNRRAFTLSIFTLVAVLLVGVIDGIGFAVLLGLLQFLRIIFRPSDQLLGVNEQGMIHSINQGNDIASVDGIMMYRFNSPLTYFNVGYFKKRVLQHVERASKYPTWLVVDAAVSFTHDDVSVFAVLDELITELKEKDVTLVLAGRRTELNYWIKQNRLSRSDEDLIVVPDLYFAIRLIQSKQQVEEKKEECA

SEQ ID NO: 10556 - protein, 46 aa, Xenorhabdus bovienii
  Coding DNA sequence: Name=SeqID_4448
MVFSPFVNGAHYNAVLNKNSQPYPWPLSFSVRYGKIRDKHVFSPDK

SEQ ID NO: 10557 - protein, 178 aa, Xenorhabdus bovienii
  Coding DNA sequence: Name=SeqID_4449
  Gene classification: Function=Intracellular septation protein A; Function class=D Cell division and chromosome partitioning
  Homolog annotation: Query=1..178bp; Hit=1..178bp; Blast score=198; Percent Identity=68.0; E value=3e-51; Homolog= yciB COG2917
MKQLLDFLPLVVFFIVYKMYDIFYASGALIAATGLAVVITYLIYRKVEKSSLITFIVVAIFGTLTLAFHSDLFIKWKVTVIYTIFALALLISQWFMKKTLIQRMLGKELELPDFIWKKLNISWAIFFIACALANIYVAFWLPQDVWVNFKVFGLTALTLVFTVLSVVYIYRHLPREQK

SEQ ID NO: 10558 - protein, 145 aa, Xenorhabdus bovienii
  Coding DNA sequence: Name=SeqID_4450
  Gene classification: Function=Acyl-CoA hydrolase; Function class=I Lipid metabolism
  Homolog annotation: Query=1..130bp; Hit=1..130bp; Blast score=208; Percent Identity=74.0; E value=2e-54; Homolog= ZyciA COG1607
MTQQQCLPNGELVLRTLAMPADTNANGDIFGGWLMSQMDIGGAILAKEIAEGRVVTVSVDGISFLKPVAVGDVVCCYARCLKTGNSSITIHIEVWVKKVASEPVGQRYRATDAVFTYVAVNKDNTSRRLPEGKTQFKLESSDSKQ

SEQ ID NO: 10559 - protein, 228 aa, Xenorhabdus bovienii
  Coding DNA sequence: Name=SeqID_4451
  Gene classification: Gene name=TonB; Function=Periplasmic protein TonB, links inner and outer membranes; Function class=M Cell envelope biogenesis, outer membrane
  Homolog annotation: Query=6..227bp; Hit=11..237bp; Blast score=94; Percent Identity=37.0; E value=1e-19; Homolog= tonB COG0810
MRWIHWPVLLSVCLHVSIAAALFHAIEPEKQLEATPISVAMIQLAAEEAPVSEPAMPESIPEPPEPEPEPEPIAKVALPKPEKKPEEKKVVKKEPKPMERKVEKTSEQPVKPVSDASQMVNNRNNQLKPTHPALNDKPKVQNGPKALSRSVPVYPSRAWQLGTEGMVKVKYDIDEDGRVKNIEIIAADPKNVFEREVKQAMRKWRYEKAPATGYVTTIEFKLTGISQS

SEQ ID NO: 10560 - protein, 59 aa, Xenorhabdus bovienii
  Coding DNA sequence: Name=SeqID_4452
MKHSRNEVGRWRMIRQNIRRRRRWLEGQSRRNLHIYSLRKTNGDRRRRSILFVQSGECL

SEQ ID NO: 10561 - protein, 64 aa, Xenorhabdus bovienii
  Coding DNA sequence: Name=SeqID_4453
METLTNHQLNVVNLAENNQNITNIIPDVVSQVLCNLIQLNHESIIYLLTNDLDSIQRCVKPSIG

SEQ ID NO: 10562 - protein, 486 aa, Xenorhabdus bovienii
  Coding DNA sequence: Name=SeqID_4454
  Gene classification: Gene name=Cls; Function =Phosphatidylserine/phosphatidylglycerophosphate/c ardiolipin synthases and related enzymes; Function class=I Lipid metabolism
  Homolog annotation: Query=1..486bp; Hit=1..486bp; Blast score=717; Percent Identity=70.0; E value=0; Homolog= cls COG1502
MTTFYSVLNWLAIFLYWLIIAGITIRVLMKRRPVTSAMTWVLIIYILPLVGIVAYLSFGELYLGKRRVEQAKQMRSSVAKWLSELRKSPHIFAHENSKVAEPLFQLCERRQRIKGVRGNKMQLMTSYDHSLKSIVNDIEKANHNIEMVFYIWQAGGLVDQVTGALMRAAKRGVKCRIMVDSAGSWQFFRSPYPDIMRKAGIEFVESLKVNIFRLFLRRMDLRQHRKIILIDNHISYTGSMNMVDPRFFKQDAGFGQWVDIMVRMEGPVTTTLGIIYAFDWEMETGQRHLPSPPDSTIMPFEQASGHTAQVIASGPGFPDELIQQSLMTAIFSAREQLILTTPYFVPSDDLMHAICTAAMRGVDVSIILPSQNNSFLVRWASRAFFMELLEAGVKIYQFEDGLLHTKSVLVDGQLSMVGSVNLDMRSLWLNFEITVVIDDKHFGNDLTFVQQGYIARSTLLDNEEWAKRPLWHRILERICYFFSPLL

SEQ ID NO: 10563 - protein, 117 aa, Xenorhabdus bovienii
  Coding DNA sequence: Name=SeqID_4455
  Gene classification: Function=Uncharacterized BCR; Function class=S Function unknown
  Homolog annotation: Query=2..117bp; Hit=20..135bp; Blast score=160; Percent Identity=68.0; E value=3e-40; Homolog= yciU COG3099
MENKPTHSLQLDFNNRMTEDETLEKAYDIFLEQAITNLDPADSLLFNLQFEERGGAELLEPSAIWLEHVDFDLHPDFFAEVIIGLAESDDAEIDDIFARVLICREKSHPICQILWKK

SEQ ID NO: 10564 - protein, 333 aa, Xenorhabdus bovienii
  Coding DNA sequence: Name=SeqID_4456
  Gene classification: Gene name=OppF; Function=ABC-type dipeptide/oligopeptide/nickel transport system, ATPase component; Function class=E Amino acid transport and metabolism
  Homolog annotation: Query=1..333bp; Hit=1..334bp; Blast score=591; Percent Identity=84.0; E value=1e-169; Homolog= ZoppF COG1124
MNAAAEKRVLLEVDDLKVYFDIKDGKQWFWQPAKTLKAVDGVTLRLYEGETLGVVGESGCGKSTLARAVIGLVKASGGTVTWLGQNLLDMSGNQWRNIRNDIQMIFQDPLASLNPRMTIGDIIAEPLRTYHPKMKSGEIKEKVKNMMMRVGLLPNLINRYPHEFSGGQCQRIGIARALILEPKLVICDEPVSALDVSIQAQVVNLLQELQREMGLSLIFIAHDLSIVKHISDRVLVMYLGNAVELGTYDEVYHNPLHPYTRALMSAVPIPDPDKERNKRIELLEGELPSPIDPPSGCVFRTRCPMADAECAKTRPLLEGSFKHAVSCLKVDPL

SEQ ID NO: 10565 - protein, 335 aa, Xenorhabdus bovienii
  Coding DNA sequence: Name=SeqID_4457
  Gene classification: Gene name=DppD; Function=ABC-type dipeptide/oligopeptide/nickel transport system, ATPase component; Function class=E Amino acid transport and metabolism
  Homolog annotation: Query=11..335bp; Hit=14..337bp; Blast score=532; Percent Identity=82.0; E value=1e-151; Homolog= ZoppD COG0444
MNSVEASKNAKSAEPLLTVKDLNVAFSTPDGSVIAVNKLNFDLKAGETLGIVGESGSGKSQTAFALMGLLASNGVVSGSAAFNGREILNLKEKDLNRMRAEEISMIFQDPMTSLNPYMRVGEQLTEVLMLHKRISKSEAVEESIRMLDAVKMPEARKRMKMYPHEFSGGMRQRVMIAMALLCQPKLLIADEPTTALDVTVQAQIMTLLNELKREFNTAIILITHDLGVVAGICDKVLVMYAGRTMEYGSARDIFYHPTHPYSIGLLDAVPRLDDDEESLTTIQGNPPNLLRLPKGCPFQPRCQFATERCANEEPQLEHFDLGRLRACFKPQEELV

SEQ ID NO: 10566 - protein, 302 aa, Xenorhabdus bovienii
  Coding DNA sequence: Name=SeqID_4458
  Gene classification: Gene name=DppC; Function=ABC-type dipeptide/oligopeptide/nickel transport systems, permease components; Function class=E Amino acid transport and metabolism
  Homolog annotation: Query=1..302bp; Hit=1..302bp; Blast score=450; Percent Identity=88.0; E value=1e-127; Homolog= oppC COG1173
MLLNKRNSEALENFSEQLEVEGRSLWQDARRRFIHNKAAITSLCVLLLITLFVIFAPVLSQFAYDDTDWNMMTMPPDSESSHYFGTDSSGRDLLVRVAIGGRISLMVGIAAALIAVIFGTLYGATSGYLGGKVDMIMMRLLEILNSFPFMFFVILLVTFFGQNILLIFVAIGMVSWLDMARIVRGQTLSLKRKEFIEAALVGGVSTRHIVLRHIVPNVLGVVVVYASLLVPSMILFESFLSFLGLGTQEPLSSWGALLSDGANSMEVAPWLLLFPAGFLVLTLFCFNFIGDGLRDALDPKDR

SEQ ID NO: 10567 - protein, 306 aa, Xenorhabdus bovienii
  Coding DNA sequence: Name=SeqID_4459
  Gene classification: Gene name=DppB; Function=ABC-type dipeptide/oligopeptide/nickel transport systems, permease components; Function class=E Amino acid transport and metabolism
  Homolog annotation: Query=1..306bp; Hit=1..306bp; Blast score=487; Percent Identity=89.0; E value=1e-138; Homolog= oppB COG0601
MFKFILRRCLEAIPTLLILITISFFMMRLAPGSPFTGERKLPPEVMANIEAKYHLNDPIYKQYFNYLVQLSKGDFGPSFKYKDYSVNDLVAEALPVSAKLGFAAFIMAVVLGVSAGTIAALNQNTKWDYTVMGFAMTGVVIPSFVVAPLLVLIFAIILKWLPGGGWNGGAPKYMILPMVALSLAYIASISRITRGSMIEILHSNFIRTARAKGLPLRAIIFRHALKPALLPVISYMGPAFVGIITGSMVIETIFGLPGLGQLFVNGALNRDYSLVLSLTILVGGLTILFNAIVDVLYAVIDPKIRY

SEQ ID NO: 10568 - protein, 545 aa, Xenorhabdus bovienii
  Coding DNA sequence: Name=SeqID_4460
  Gene classification: Gene name=OppA; Function=ABC-type dipeptide/oligopeptide/nickel transport systems, periplasmic components; Function class=E Amino acid transport and metabolism
  Homolog annotation: Query=1..545bp; Hit=1..543bp; Blast score=788; Percent Identity=69.0; E value=0; Homolog= ZoppA COG0747
MVNTTKKRLAAGITVALGMMTGWQAFAAQVPAGVQLAEKQVLVRNNSSEPQSLDPHKIEGVPESNIARDLFEGIVINGSNGEILPGVATHWENQEFKVWTFHLRKDAKWSNGDPVTAQDFVYSWRRLADPNTASPYASYLQYAHIINVDDVIKGKQKPESLGVKALDDHTLQVTLSEPVPYLVRLLIHSTMSPVHRATVEKYGDRWTQPQNFVGNGAYKLKSWSINERLVFERSPTYWDNKNTIINQVTFLPISSEVTDVNRYRSGEIDMTYSNLPIELFQKLKKEIPDQLRVNPYLCTYFYEINNQKPPFNDPRVRTALKLGMDRDLITNKVKNQGDTPAYGWVPPYIADFKDEKPDWYTKLNQQQRNEEAKKLLAEAGFSKDNPLKISLLYNTSDLHKKMAIAAAAIWKKNIGAEVSLENQEWKTFLDTRHQGNYDIARAGWCADYNEPTTFLNVKLSYSSNNTAHYKSEAFDALMKEALKVKTDAERVEIYKQANALIDKDSAVVPLYYYVSTRLVKPYVGGYTGKDPLDNIHTKDFYIIKH

SEQ ID NO: 10569 - protein, 547 aa, Xenorhabdus bovienii
  Coding DNA sequence: Name=SeqID_4461
  Gene classification: Gene name=OppA; Function=ABC-type dipeptide/oligopeptide/nickel transport systems, periplasmic components; Function class=E Amino acid transport and metabolism
  Homolog annotation: Query=16..544bp; Hit=17..542bp; Blast score=645; Percent Identity=58.0; E value=0; Homolog= oppA COG0747
MRKTPSKLGQLISTIALLSFPVAQGMAATVPAGVALAEKQEVTVNNGVEVASLDPHKVEGAPETTIIRNLLEGLVTTGPDGETVPGVAEKWENQDYKVWTFYLRDNAKWSDGKPVTAHDFVYSWRRLADPKVGSPYTSYLQYTYVQNAEDILKGKKAPEQLGVKALDDHRFQVTLSHSVPYLVDMLSHTAMKPVRQDVVEAFDKKWTLPENYIGNGAYVLKDWVVNERIVLTRNPQYWNNKETIIEKGTFLPVVSEVSDINRYRSGEIDITNGAITPYLYQKMKRDIPDQLHVSPFLCTFYYEINNKNPLFKDKRVRESIKLSLDRNIIAERIMGQGQIPAYGFTPTYIGDGGFTINPEWANWTQEQRNQRAKDLLKEAGFDARNPLKFTLLYNTSDQNKQQAIAAASMWQKNIGAQVTLQNQEWKTSLESRHQGNYDVARATWCGDYNEPSSFLNTLLSDSSNNTGFYQSAAFDNYLSQALAAKDEAARKAFYQQAEAQLDKDSGLIPVYYRVSVRLIRPTVVGLTGKDPLDYIDFKNLYIKKAND

SEQ ID NO: 10570 - protein, 32 aa, Xenorhabdus bovienii
  Coding DNA sequence: Name=SeqID_4462
MVFSSFFAPSYQQQINCFLIEQPYHLTHFVNK

SEQ ID NO: 10571 - protein, 57 aa, Xenorhabdus bovienii
  Coding DNA sequence: Name=SeqID_4463
LFLKNDTGTTLLINHISHWLFISSFLVNSFPISVKISLFYINFLNQYKRYHYLCISQ

SEQ ID NO: 10572 - protein, 203 aa, Xenorhabdus bovienii
  Coding DNA sequence: Name=SeqID_4464
  Gene classification: Gene name=MarC; Function=Integral membrane proteins of the MarC family; Function class=S Function unknown
  Homolog annotation: Query=1..195bp; Hit=16..210bp; Blast score=247; Percent Identity=73.0; E value=5e-66; Homolog= ychE COG2095
MGLFALVNPIGILPVFISMTNYQTPAGRNKTNLIANLSVAIILCISLLIGDSILHMFGIFIDSFRIAGGVLIVTIAMSMINGKLGEDKQNKQEKSETAVRVSIAVVPLALPLMAGPGAISSCIVWSACYQGWQNYLGLALTCLLFTFCCWLLFRSATLLVKFLGQTGINVITRIMGLLLMSLGIEFIVQEQKPCFLDYCDMHR

SEQ ID NO: 10573 - protein, 887 aa, Xenorhabdus bovienii
  Coding DNA sequence: Name=SeqID_4465
  Gene classification: Gene name=EutG; Function=Alcohol dehydrogenase IV; Function class=C Energy production and conversion
  Homolog annotation: Query=448..869bp; Hit=1..422bp; Blast score=782; Percent Identity=88.0; E value=0; Homolog= ZadhE_2 COG1454
MAVTQIAELNELVARVKKAQREFAHFSQEQIDRIFRAAALAAADARIPLAKLAVAESGMGIVEDKVIKNHFASEYIYNAYKDDKTCGILSEDNTFGTITIAEPIGLICGIVPTTNPTSTAIFKALISLKTRNGIIFSPHPRAKKATNRAAEIVLQAAVAAGAPKDIIGWIDEPSVELSNALMHHPDINLILATGGPGMVKAAYSSGKPAIGVGAGNTPVVIDESADIKRAVASILMSKTFDNGVICASEQSVIVVDSVYDQVRKRFSTHGGYLLQGEELKAVQDIILKNGSLNAAIVGQPATKIAEMAGICVPEETKILIGEVTLVDETEPFAHEKLSPLLAMYRGKNFEDAVEKAEKLVEMGGIGHTSSLYTDQDNQSERIKYFGDKMKTARILINTPASQGGIGDLYNFKLSPSLTLGCGSWGGNSISENVGPKHLINTKTVAKRAENMLWHKLPKSIYFRRGSLPVALEEVATDGAKRAFIVTDRFLFNNGYADQVINVFKSHGIETEVFFEVEADPTLSIVRKGAEQMHLFKPDVIIALGGGSPMDAAKIMWVMYEHPETHFEELALRFMDIRKRIYKFPKMGVKAKMVAITTTSGTGSEVTPFAVVTDDITGQKYPLADYALTPDMAIVDANLVMNMPKSLCAFGGLDAVTHALEAYVSVLANEYSDGQALQALKLLKDFLPASYHEGAKNPVARERVHNAATIAGIAFANAFLGVCHSMAHKLGSEFHIPHGLANALLICNVIRYNANDNPTKQTAFSQYDRPQARRRYAEIAEHLGLTASEDRTAAKIEKLLAWLEELKSQLGIPVSIHETGIQEADFLAKIDKLAEDAFDDQCTGANPRYPLISELKQLMLDSFYGRKFTEYAISQQAEKSNRKNNKKQ

SEQ ID NO: 10574 - protein, 203 aa, Xenorhabdus bovienii
  Coding DNA sequence: Name=SeqID_4466
  Gene classification: Gene name=Tdk; Function=Thymidine kinase; Function class=F Nucleotide transport and metabolism
  Homolog annotation: Query=5..195bp; Hit=1..191bp; Blast score=271; Percent Identity=69.0; E value=3e-73; Homolog= tdk COG1435
MDGPMAQLYFYHSAMNAGKSTSLLQSSYNYNERGMRTLIFTAEIDTRFGKGRVSSRIGLSADALLFSSETNIAELIRRENEVEKVHCVLIDECQFLTKKHVEQLCEIVDYDDIPVLCYGLRTDFQGELFSGSQYLLAWSDKLVELKTICHCGRKASRVLRFGSDGNVVYDGAQVDIGGNEKYVSVCRRHYTDVIREAQTKKVP

SEQ ID NO: 10575 - protein, 133 aa, Xenorhabdus bovienii
  Coding DNA sequence: Name=SeqID_4467
  Gene classification: Gene name=Hns; Function=DNA-binding protein H -NS; Function class=R General function prediction only
  Homolog annotation: Query=1..133bp; Hit=1..135bp; Blast score=139; Percent Identity=72.0; E value=7e-34; Homolog= hns COG2916
MSENLKSLNNIRTLRAQARECELTTLEEMLEKLTIVVEERRDEDSQARAQIEERSRKLQEYREMLEKDGIELSDLVDALSGKATSKSKRATRPAKYSYLDEGETKTWTGQGRTPAVIKKAIDEEGKKLDDFLI

SEQ ID NO: 10576 - protein, 338 aa, Xenorhabdus bovienii
  Coding DNA sequence: Name=SeqID_4468
  Gene classification: Gene name=WcaG; Function=Nucleoside-diphosphate -sugar epimerases; Function class=M Cell envelope biogenesis, outer membrane
  Homolog annotation: Query=1..333bp; Hit=1..333bp; Blast score=410; Percent Identity=59.0; E value=1e-115; Homolog= BH3709 COG0451
MKFLVTGSAGFIGFHVSQRLLGMGHEVVGIDNINDYYDVNLKQARLNLLLPHPSFQFEKLDLADRIAIPELFAKHQFQRVIHLGAQPGVRYSIQNPMAYIDANIVGHINILEGCRHNRVEHLLYASSSSVYGLNKKQPFSTNDSVDHPVSLYAATKKTDELMSHSYSHLYQLPTTGLRFFTVYGPWGRPDMALFKFTKAMLEGRSIDVYNHGNMVRDFTYIDDIVESIIRLQDIIPTPNKDWSVEDGAISSSSAPYRIYNIGNGQPTKLGDFIEAIEASLGINAKKNFMEIQDGDVLSTCADSSTLYDKIGFSPDTPVKEGVKRFVDWYLDFYQKSEQ

SEQ ID NO: 10577 - protein, 447 aa, Xenorhabdus bovienii
  Coding DNA sequence: Name=SeqID_4469
  Gene classification: Gene name=Ugd; Function=Predicted UDP-glucose 6 -dehydrogenase; Function class=M Cell envelope biogenesis, outer membrane
  Homolog annotation: Query=1..442bp; Hit=1..443bp; Blast score=628; Percent Identity=68.0; E value=1e-180; Homolog= mlr5265 COG1004
MKVTVFGIGYVGLVQATVFAEVGHDVLCVDVDAKKVENLKNGQIPIFEPGLVPLVKKNYTEGRLNFTTDAKAGVAHGKLQFIAVGTPPDEDGSADLQYVTAVARTIAENMDGYKVVVDKSTVPVGTADKVRAVMQTVLTQRSADFPFDVVSNPEFLKEGAAISDCMRPERIIIGCDNDNVIDVMRELYEPFNRNHDRMIVMDIRSAELTKYAANCMLATKISFMNEIANLAEMLGADIEHVRQGIGSDPRIGYHFIYPGCGYGGSCFPKDVQALIRTSEQIGYTPKILQAVELVNEKQKSKLPTFVKRHFGDDLSGKTFAIWGLSFKPNTDDMREASSRVLMEALWESGAKVQAYDPEAMQEAQRIYGQRDDLSLMGTKEAALKGADALIICTEWQNFRAPDFDIMKDSMKSPIIFDGRNLYDPERLQSRGFTYYGIGRGASINPVV

SEQ ID NO: 10578 - protein, 305 aa, Xenorhabdus bovienii
  Coding DNA sequence: Name=SeqID_4470
  Gene classification: Gene name=GalU; Function=UDP-glucose pyrophosphorylase; Function class=M Cell envelope biogenesis, outer membrane
  Homolog annotation: Query=1..296bp; Hit=1..294bp; Blast score=468; Percent Identity=79.0; E value=1e-132; Homolog= galU COG1210
MSVINKKVKKAVIPVAGLGTRMLPATKAIPKEMLPLVDKPLIQYVVNECIKAGINEIILVTHSSKNSIENHFDTSFELEAILERRVKRQLLDEVQSICPNHVTIMQTRQGIAKGLGHAVLCAKPLIGDEPFAVILPDVILDEYSTDLSKYNLSEMLSRFNSSGASQILVEPVPLESVADYGVVDCLGENLQPGDSKPIVRVVEKPKPEEAPSNLSIVGRYVLSEKIWPLLAKTAPGAGDEIQLTDAIAMLMEKEPVEAYHLQGRSHDCGNKLGYMQAFVEYGMKHKDLGAAFKDWIMTLQNQIEK

SEQ ID NO: 10579 - protein, 307 aa, Xenorhabdus bovienii
  Coding DNA sequence: Name=SeqID_4471
  Gene classification: Gene name=CheY; Function=CheY-like receiver domain; Function class=T Signal transduction mechanisms
  Homolog annotation: Query=3..79bp; Hit=54..129bp; Blast score=69; Percent Identity=42.0; E value=5e-12; Homolog= VC1050_1 COG0784
MCASNGEMALQTVDREIKPELIFCNLSMPIMGGIEFMGHMAIKGLTIPIIIVSATNKMTEIDDVLRLGAKDILLKPIANLNEVKKMALDYLHPKVFMSDAIEQNRLIQELSKLKQNTESVWCLLQQLQPPVSQIIANCRVNYRLLNTVGKMGLVFDITALSDNEMIFYCLDISRSKDNGAVSALLLRVVFNNLLKKRKFHKKSGLPDMQEIMNWVNRILNDTEISEPLPLLLGYYNTHNKTILMSSAGLSARIQSGNHQQQLGRGIPLGTLKIIHSHQVCEHSSLWQCRIWNNKNQIKLMFSPPFYQ

SEQ ID NO: 10580 - protein, 120 aa, Xenorhabdus bovienii
  Coding DNA sequence: Name=SeqID_4472
  Gene classification: Function=Uncharacterized BCR; Function class=S Function unknown
  Homolog annotation: Query=1..120bp; Hit=34..151bp; Blast score=134; Percent Identity=55.0; E value=2e-32; Homolog= ychJ COG3012
MRSRYSAYATKNADYLIATWHPECQAESWRSEIEQSFAGVQWLGLNVIETVEGQHNNESYVEFSACFIEQGKQDRQLIHERSRFLRIDQHWFYLDGIRPQTGRNSPCPCGSGKKYKKCCG

SEQ ID NO: 10581 - protein, 282 aa, Xenorhabdus bovienii
  Coding DNA sequence: Name=SeqID_4473
  Gene classification: Gene name=PurU; Function=Formyltetrahydrofolate hydrolase; Function class=F Nucleotide transport and metabolism
  Homolog annotation: Query=5..282bp; Hit=3..280bp; Blast score=456; Percent Identity=80.0; E value=1e-128; Homolog= purU COG0788
MQNANIQKKILRTICPDAKGLIAKITNICYKHQLNIVQNNEFVDHRTGRFFMRTELEGIFNDETFLADLDDALPAGSNRELNTAGRRRIVIMVTKEAHCIGDILVKSAYGGLDVEIAAVIGNHTILQHLVEQFDIPFHYISHDGLTREQHDEALMVQIDQYKPDYVVLAKYMRVLTPAFVQHYPNQIINIHHSFLPAFIGARPYHQAYERGVKIIGATAHYVNDNLDEGPIITQDVINVDHTYTAEEMKRAGLDVEKNVLSQALHWVFSQRVFVYGNRTVIL

SEQ ID NO: 10582 - protein, 43 aa, Xenorhabdus bovienii
  Coding DNA sequence: Name=SeqID_4474
MERDLSIKFKKTAFDTLFSIIYFTAAAYLILCRPLSTINSKIC

SEQ ID NO: 10583 - protein, 287 aa, Xenorhabdus bovienii
  Coding DNA sequence: Name=SeqID_4475
  Homolog annotation: Query=1..286bp; Hit=1..286bp; Blast score=470; Percent Identity=80.0; E value=1e-131; Homolog= ref|NP_929784.1|
MFFSRKLEAFMAVVEMGSLSKAARVMNRTTPPVAKSIKDFEATLGKRLFKREKFGMILTKDGVELYNDLKELYLKEKEITKKHISGSICNVVNIYHDWGKKKHLISLYKAADRNNAQVNILRFSYDNIDEIVDYEGNTIILSSEKVLSDRFSLVRKIEGPNLGICCRKELLDEVHGDFTQLLKKRTWLCDPVLYKGNLIKNLEEEMIRNGEKVNIRQMDSIECCLNFIQSTDYIFITDSHSGALEEGESLGFIPISRTDAVNQCYVYKSKSHSSVLNRFIDSVSDME

SEQ ID NO: 10584 - protein, 268 aa, Xenorhabdus bovienii
  Coding DNA sequence: Name=SeqID_4476
  Gene classification: Gene name=XthA; Function=Exonuclease III; Function class=L DNA replication, recombination and repair
  Homolog annotation: Query=1..267bp; Hit=1..267bp; Blast score=446; Percent Identity=77.0; E value=1e-125; Homolog= xthA COG0708
MKFVSFNINGLRARPHQLAAIVEQHQPDVIGLQETKVHDEMFPLEEVSKLGYHIFYHGQKSHYGVALLTRQQPVAVRKGFPTDDDEAQRRIIMADIETPQGLLTIINGYFPQGESREHPVKFPAKERFYQDLNRYLEKNQSPDSHILIMGDMNISPTDLDIGIGENNQKRWLKTGKCSFLPEEREWMGRLKDWGLIDTFRAQHPEASDQFSWFDYRSKGFDDNRGLRIDLLLASRPLAERCLSSGIDYAIRSMEKSSDHAPIWAEFRI

SEQ ID NO: 10585 - protein, 644 aa, Xenorhabdus bovienii
  Coding DNA sequence: Name=SeqID_4477
  Gene classification: Gene name=TopA; Function=Topoisomerase IA; Function class=L DNA replication, recombination and repair
  Homolog annotation: Query=1..643bp; Hit=1..641bp; Blast score=1046; Percent Identity=79.0; E value=0; Homolog= topB COG0550
MRLFIAEKPSLARAIADVLPKPHRRGDGFIECGNNQFVTWCVGHLLEQAEPDAYDSRYARWVLSDLPIIPEKWQLKPRVAVAKQLNTIKSLLEKADEVIHAGDPDREGQLLVDEVLDFLSLRDDKKQNVQRCLINDLNPQAVIKAIERLRSNREFIPLCVSALARARADWLYGINMTRAYTLLGQNAGYQGVLSVGRVQTPVLGLVVRRDEEIEHFVPKDFFEVKAHIVTPNEERFTTLWQPSESCIDFQDEEGRLIHQPLAEHVVARITGQPAYVTAYQDKRESETAPLPFSLSSLQIEAAKRFGLSAQNVLDICQRLYETHKLITYPRSDCRYLPEEHFVGRHAVLNAISIHSSDLLPQDALESDKKNRCWDDKKVDAHHAIVPTARSSQVNLTENERQIYGLIARQYLMQFLPDAVFRKCTIELDIAGGKFIAKARFLAEAGWRTLLGNKERDEENEGTPLPVVAKGDELLCEKGEVVERQTQPPRPFSDATLLSAMTGIARFVQDKSLKKVLRATDGLGTEATRAGIIELLFKREFLYKKGRNIHATPAGRALIHVLPDMAVLPDMTAHWESRLTQISEKQFRYQDFMLPLQETLQQLIGQAKQYRNLKAFRDLPPVPAKGKKGKTKQVKKGKEKVNKTE

SEQ ID NO: 10586 - protein, 347 aa, Xenorhabdus bovienii
  Coding DNA sequence: Name=SeqID_4478
  Gene classification: Gene name=SelD; Function=Selenophosphate synthase; Function class=E Amino acid transport and metabolism
  Homolog annotation: Query=5..345bp; Hit=6..346bp; Blast score=518; Percent Identity=75.0; E value=1e-147; Homolog= selD COG0709
MSTEIRLTQYSHGAGCGCKISPKVLETILHSEQAKFFDPNLLVGNETRDDAAVYDIGNGTGIISTTDFFMPIVDDPFDFGRIAATNAISDIYAMGGKPIMAIAILGWPIAKLSPEIAQKVIEGGRAVCKEAGISLAGGHSIDAPEPIFGLAVTGIINIDRVKRNSQAKAGSILFLTKPLGIGVLTTAEKKGLLQPGHQGIAKETMCQLNKAGADFAGIDGVTAMTDVTGFGLLGHLGEICEGSGVQATVNFSQVPRLPDVDDYIEKGCVPGGTGRNFDSYGHLIGELTARQRHLLCDPQTSGGLLLAVLPDAVEEAKAIARSHNIDLIAIGELTEPRSDRALIEVIE

SEQ ID NO: 10587 - protein, 183 aa, Xenorhabdus bovienii
  Coding DNA sequence: Name=SeqID_4479
  Gene classification: Gene name=NfnB; Function=Nitroreductase; Function class=C Energy production and conversion
  Homolog annotation: Query=1..183bp; Hit=1..183bp; Blast score=242; Percent Identity=64.0; E value=2e-64; Homolog= ydjA COG0778
MNALELLLNRRSASRLTTPAPEGNELEYILAAGMRAPDHGALRPWHFVVMQGEGIDKFSKLLEKSAIENALGQEIEEKARNAPYRAPMIITVIAKVVENTKIPAWEQIVAAGCAVHAMQMAAVAQGFGGIWRSGSWTEDPVVKAGLGCGENDKIVGFLYLGTPVLKAPEKVALPDLTNFVSYF

SEQ ID NO: 10588 - protein, 636 aa, Xenorhabdus bovienii
  Coding DNA sequence: Name=SeqID_4480
  Gene classification: Gene name=SppA; Function=Periplasmic serine proteases (ClpP class); Function class=N Cell motility and secretion
  Homolog annotation: Query=1..636bp; Hit=1..618bp; Blast score=707; Percent Identity=55.0; E value=0; Homolog= sppA COG0616
MRTLWKFIAALFKWSWKLLNFARQLISNLIFILLVIVVATGILVYQQQSKSGDDYRGALYVDLSGIVVDQVSARSPLDQFGRDLIGASSSSSQETSLFDIVDSIRRAKHDAKITGMVLKLDNFLGADQPSMQYIGKAINEFKAAGKTVIAISDNYSQPQYYLASYANKVYLSPQGAVSLHGFSTNHLYYKSLLDSLKVSTHIFRVGTYKSAVEPMTRDNMSEEARQADSLWLNELWNNYRNTIAVNRKIPADKVLPEPIQFIEKLRQTGGDSALYAAKNKLVDEIKPRNVIETELSNKFGWDEKNKHFNYISLYDYIAQQPIKNSDQSNSNIAVIIAEGAIMDGRQSEGIAGGDTIAEQLREARLNPNIKAIVLRVNSPGGSISASELIRSELVAIREGTTVKDKEGRTVKENQKPIVVSMGGLAASGGYWISTPANYIIADKNTLTGSIGVFGVLNTYEKGLNYLGVNTDGISTHPLADISVTKGINPMFSDVMQLSIESGYHKFIELVAQSRQKTPNEIKEIAQGRVWSGSDAKKNGLVDQLGDFDDAVNKAAQLAGIKTVSLNWMQPELSFSEKLMLEFSSSAQTLLPNALQSMLPAPIAQIAQDMKQQAVFYNRMNDPQNIYTFCLNCADIR

SEQ ID NO: 10589 - protein, 211 aa, Xenorhabdus bovienii
  Coding DNA sequence: Name=SeqID_4481
  Gene classification: Gene name=AnsB; Function=L-asparaginase/archaeal Glu-tRNAGln amidotransferase subunit D; Function class=E Amino acid transport and metabolism
  Homolog annotation: Query=1..208bp; Hit=1..208bp; Blast score=326; Percent Identity=77.0; E value=1e-89; Homolog= ansA COG0252
MQKKSIYVVYTGGTIGMQRSPNGYIPVSGHLQRQLAQMPEFHRPEMPTFTIREHQPLIDSSDMSPNDWGIIANDIYQNYHDYDGFVILHGTDTMAFTASALSFMFENLKKPVIVTGSQIPLEALRSDGQTNLLNALYLAANYPINEVGLFFSNKLFRGNRTIKAHADGFEAFTSPNCRPLIEAGINIRTFNTSPIPASHDEFTVHQITSPS

SEQ ID NO: 10590 - protein, 161 aa, Xenorhabdus bovienii
  Coding DNA sequence: Name=SeqID_4482
  Gene classification: Function=Transposase; Function class=L DNA replication, recombination and repair
  Homolog annotation: Query=3..157bp; Hit=2..153bp; Blast score=69; Percent Identity=31.0; E value=2e-12; Homolog= NMB1750 COG3547
MYYVGIDVSKNKLDICLLYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYKKSPDLCQD

SEQ ID NO: 10591 - protein, 188 aa, Xenorhabdus bovienii
  Coding DNA sequence: Name=SeqID_4483
  Gene classification: Gene name=HisB; Function=Histidinol phosphatase and related phosphatases; Function class=E Amino acid transport and metabolism
  Homolog annotation: Query=1..188bp; Hit=1..188bp; Blast score=291; Percent Identity=72.0; E value=4e-79; Homolog= yaeD COG0241
VTQGIPAVFLDRDGTVNIDHGYVHEIDNFQFIDGAIEAMLELKKMGYALVLITNQSGIAREMFTEDQFLQLTEWMDWSLADRGVDLDGIYYCPHHPEGSADAYKKNCHCRKPQPGMLLDAQEELSIDMSASYMVGDKIEDMLAANAANVGTKVLVRTGKAVTEAVEQTADLVINSLADLPDAIKNRQK

SEQ ID NO: 10592 - protein, 343 aa, Xenorhabdus bovienii
  Coding DNA sequence: Name=SeqID_4484
  Gene classification: Gene name=Abc; Function=Uncharacterized ABC-type transport system ATPase component; Function class=R General function prediction only
  Homolog annotation: Query=1..343bp; Hit=1..343bp; Blast score=528; Percent Identity=76.0; E value=1e-150; Homolog= Zabc COG1135
MIRLTQINKVFQQGARSIKALSDIDLHVPLGQIYGVIGSSGAGKSTLIRCVNMLERPTSGQVLVDGQDLTSLSERELTRARRHIGMIFQHFNLLSSRTVFDNVALPLELDNTPKAEINARVNELLELVGLSDKHDAYPANLSGGQKQRVAIARALANSPKVLLCDEATSALDPATTRSILELLKDINRRLGLTILLITHEMDVVKRICDQVAVISGGQLIEQDVVSAIFSHPKTPVAQQFIKSTLHLDIPEDYLQKLQPESAPDRCPLVKLEFTGKSVDAPLISMAVRRFNIDISILSSQMDYAGGVKFGVMLAELDGESSSIESTITFLEEHHVKIEVLGYV

SEQ ID NO: 10593 - protein, 217 aa, Xenorhabdus bovienii
  Coding DNA sequence: Name=SeqID_4485
  Gene classification: Function=Permease component of an uncharacterized ABC transporter; Function class=R General function prediction only
  Homolog annotation: Query=1..217bp; Hit=1..217bp; Blast score=267; Percent Identity=85.0; E value=7e-72; Homolog= yaeE COG2011
MSEGMILLLAKGVWETLVMTFVSGFFGFVIGLPAGVLLYVTRPGQIIENGALYRILSALVNITRSIPFIILLVWMIPFTRLIVGTSIGLQAAIVPLTVGAAPFIARMVENALLEIPSGLIEAARAMGATPLQIVKKILLPEALPGLINAATITLITLVGYSAMGGAVGAGGLGQIGYQYGYIGYNATVMNTVLALLVILVFLIQLSGDHLAKAANRK

SEQ ID NO: 10594 - protein, 36 aa, Xenorhabdus bovienii
  Coding DNA sequence: Name=SeqID_4486
MDFNFTDIFSPLLNTDLEPVLPGYCVLLMRLLGISP

SEQ ID NO: 10595 - protein, 271 aa, Xenorhabdus bovienii
  Coding DNA sequence: Name=SeqID_4487
  Gene classification: Gene name=NlpA; Function=ABC-type uncharacterized transport systems, periplasmic component; Function class=R General function prediction only
  Homolog annotation: Query=1..271bp; Hit=1..271bp; Blast score=426; Percent Identity=77.0; E value=1e-119; Homolog= ZyaeC COG1464
MSVKLKSIVAISALLGTLILAGCGQEPRDPNHIKVGVIVGPELEVAEVAKKVAKEKYGLDVELTTFNDYVLPNESLSKGDIDANVFQHKPYLDQQIKERNYKLAIVGNSFIYPIAAYSKKIKSLDELQDGAQIALPNDPTNLGRSLLLLQKQGLIKLKDGVGLLPTILDVTENPKHLDIVQLEAPQLPRSLDDQKIALAIINNTYAGQIGLTPEKDGLFVEDKDSPYVNIIVSREDNKDAENVQKFVKAYQSEEVEQAAQTIFKGGALKGW

SEQ ID NO: 10596 - protein, 32 aa, Xenorhabdus bovienii
  Coding DNA sequence: Name=SeqID_4488
MSMHETAIKSVWLPQSKWADNNTRPMILILID

SEQ ID NO: 10597 - protein, 130 aa, Xenorhabdus bovienii
  Coding DNA sequence: Name=SeqID_4489
  Homolog annotation: Query=1..130bp; Hit=1..132bp; Blast score=117; Percent Identity=53.0; E value=5e-26; Homolog= ref|NP_928039.1|
MRMLPICFMALFMVGCTSLSTQVEKPTQVGSKLKHQPAKKSKVSSYIELYTKTEELLGTPFKDLGIVFGESCRTTQQDPPASIAVARKNMLAKAASLKANAVLLHQCAILSNHNCYQTAICEGSALLTTK

SEQ ID NO: 10598 - protein, 242 aa, Xenorhabdus bovienii
  Coding DNA sequence: Name=SeqID_4490
  Gene classification: Function=Uncharacterized ACR; Function class=S Function unknown
  Homolog annotation: Query=8..242bp; Hit=1..235bp; Blast score=330; Percent Identity=68.0; E value=1e-90; Homolog= yaeB COG1720
MMTKKTLMADFHFTQIGTIHSPYKEKFAIPRQPGLVEDGTGQLELLAPYNQIDAVRGLEQFSHLWIIFVFHQTMNGGWNPLVRPPRLGGNAKMGVFATRSTFRPNPIGMSLVELKGIQCQNNRVILELGSLDLVDGTPVIDIKPYLPFAESRPEARAGFAQEAPDTGMEVSFLPIAEHQLSSHQANYPHLRRFISQILAQDPRPAYRKKEQENRIYAVHILDFNVRWQIRDAMTEVVSIEHR

SEQ ID NO: 10599 - protein, 573 aa, Xenorhabdus bovienii
  Coding DNA sequence: Name=SeqID_4491
  Gene classification: Gene name=ProS; Function=Prolyl-tRNA synthetase; Function class=J Translation, ribosomal structure and biogenesis
  Homolog annotation: Query=1..571bp; Hit=1..571bp; Blast score=978; Percent Identity=81.0; E value=0; Homolog= ZproS COG0442
MRTSQYLLSTLKETPADAEVVSHKLMLRAGMTRKLASGLYNWMPTGVRVLKKVENIVREEMNNAGAIEVSMPVVQPADLWQESGRWEQYGPELLRFEDRGARPFVLGPTHEEVITDLVRNEVTSYKQLPLNLFQIQTKFRDEVRPRFGVMRSREFIMKDAYSFHTNQESLQETYDKMYAAYSKIFTRIGLDFRAVLADTGSIGGSASHEFQVLADSGEDDIAFSTESNYAANIELAEAVMPSHERAVPSEDMHLVETPNAKTIAELVEQFNLPIEKTVKTLIVHAAKESGHQLVALLVRGDHELNEIKAGKLPLVASPLNFATEEEIRAVVQAGPGSLGPVNLPMPVIIDRSVSVMSDFGAGANVDDKHYFGINWERDLPLPEIADIRNVVEGDASPDGQGTLLIKRGIEVGHIFQLGTKYSDALKATVQNEDGHNQVVSMGCYGIGVTRIVAAAIEQNHDDRGIIWPDAIAPFQVALLPMNMHKSYRVKEVAEKLYADLHANGIDVIFDDRKERPGVMFADMELIGVPHTLVIGDRNLDNGEVEYKYRRNGDKQMLKLEGIVEYLKGQIQQH

SEQ ID NO: 10600 - protein, 229 aa, Xenorhabdus bovienii
  Coding DNA sequence: Name=SeqID_4492
  Gene classification: Gene name=CutF; Function=Uncharacterized lipoprotein NlpE involved in copper resistance; Function class=M Cell envelope biogenesis, outer membrane
  Homolog annotation: Query=1..205bp; Hit=1..211bp; Blast score=164; Percent Identity=38.0; E value=6e-41; Homolog= ZcutF COG3015
MMNKKILLALVAVGVLTAVGCQNKVASQDNATLQENALQTTESVFTGVVPCADCTGIETTLQLSSDGSYILGQIYLEAKNEENTFFETGHWIKNGKKIDLTHEDSKKSYYQMKGENLVMLDINGEPIQSNFNYELGKVTPKKMAGEYSYIADSATFTECRTGKLYDASENIDLERGYSATGVEGGEPVYVEVEGYYSLRPSMEDGVFDHALIQTGKIHFDKSASCQTRK

SEQ ID NO: 10601 - protein, 85 aa, Xenorhabdus bovienii
  Coding DNA sequence: Name=SeqID_4493
  Homolog annotation: Query=1..84bp; Hit=1..84bp; Blast score=122; Percent Identity=72.0; E value=2e-27; Homolog= ref|NP_928035.1|
MSIDTEYQPINCDDYDNLELACQHQLHLHIQLQGGDVFEGKANKLILRKKVEYILVESNEETRELRLDHIISFSNPEIGTIVIEH

SEQ ID NO: 10602 - protein, 38 aa, Xenorhabdus bovienii
  Coding DNA sequence: Name=SeqID_4494
MRIWIVLMLRQLNVGSTHCQLLQQLYFMMMIIIIWEIL

SEQ ID NO: 10603 - protein, 448 aa, Xenorhabdus bovienii
  Coding DNA sequence: Name=SeqID_4495
  Gene classification: Gene name=MesJ; Function=Predicted ATPase of the PP-loop superfamily implicated in cell cycle control; Function class =D Cell division and chromosome partitioning
  Homolog annotation: Query=15..443bp; Hit=8..429bp; Blast score=414; Percent Identity=54.0; E value=1e-116; Homolog= mesJ COG0037
MSNIHEPLLTMLIDQLGRYKKILIGFSGGLDSTVLLHLLVQLRYQSHKVIRDQIELRAIHIHHGLNPKADKWVEHCRQICADWKVDFRVEKVSLDIRQNGIEAAARDARYQAFQHELQQGEILVTAQHLDDQAETFLLALKRGSGPAGLSSMPFSMPFAGTTLIRPLLNASRAELETYAHTQRLQWIEDDSNQDDRYDRNFLRLHIMPLLNQRWPHFPQAASRSASLCGEQEQLLDELLNESLSELITPEGAIAISPLVDCSEAKRNALLRRWFNQHGVKMPAREQLQRIWSEVALSRQDAEPRFRLGQHDVRRYRQQLWLVPQCQSLAGTLLEWDIAQELRLPDGLGMLVLSEESGINVRMPGRNERVTIRFGVQGNISIVGRKHSRHSKKLWQELGIAPWLRERTPLLYYDETLIAALGVFVTREGQPLAGEEILSIKWDRMPYSA

SEQ ID NO: 10604 - protein, 305 aa, Xenorhabdus bovienii
  Coding DNA sequence: Name=SeqID_4496
  Gene classification: Gene name=RhaT; Function=7 Permeases of the drug/metabolite transporter (DMT) superfamily; Function class=G Carbohydrate transport and metabolism
  Homolog annotation: Query=8..280bp; Hit=5..270bp; Blast score=97; Percent Identity=28.0; E value=2e-20; Homolog= PAB0461 COG0697
MAKYKYIIYAFSCVLIWSFVPSISRLGQKGMDHFQYLFWSNILSVLAVFFVAILMGRNLKQLLFISFPVMLKVLILGALDCFFYLLLYYGYSIENGVAVLVVQYSWPLMIIGLSFFLFKEKLSIRQMIGITLGFIAVLITFTQGNITQIAVEHPQALLLVSSGAFCFALMSVLSKHFAIDPYISTFWVFTCSTLVSAVFLLAFSSFNWPVGDSLMPTLLNGIILNGVSYIIWFKAMNSPDSPKIASILFLSPVLSMIWLILFFGDAFVPAYAVGLALVIISGLLCISAKTKTATQNKLSDDLIED

SEQ ID NO: 10605 - protein, 319 aa, Xenorhabdus bovienii
  Coding DNA sequence: Name=SeqID_4497
  Gene classification: Gene name=AccA; Function=Acetyl-CoA carboxylase alpha subunit; Function class=I Lipid metabolism
  Homolog annotation: Query=1..318bp; Hit=1..318bp; Blast score=552; Percent Identity=86.0; E value=1e-157; Homolog= accA COG0825
MSLNFLDFEQPIAELEAKIDSLNAVSRQDEKLDINLDEEVQRLREKSLELTRKIFSDLGAWQISQLSRHPLRPYTLDYIQRVFTDFEELAGDRAYADDKAIVAGLARLDGRPVMVIGHQKGRETKEKIRRNFGMPSPEGYRKALRLMELAERFKLPIITFIDTPGAYPGVGAEERGQSEAIARNLREMSRLSVPVICTVIGEGGSGGALALSVGDKVNMLQYSTFSTISPEGCASILWKSADKAPLAAEAMGNTAPRLKELKLIDSVIPEPLGGAHRNYDAIAQALKAQLLADFADLDHLNSEELVNRRYERLMQYGYC

SEQ ID NO: 10606 - protein, 1160 aa, Xenorhabdus bovienii
  Coding DNA sequence: Name=SeqID_4498
  Gene classification: Gene name=DnaE; Function=DNA polymerase III alpha subunit; Function class=L DNA replication, recombination and repair
  Homolog annotation: Query=1..1160bp; Hit=1..1160bp; Blast score=2033; Percent Identity=83.0; E value=0; Homolog= ZdnaE COG0587
MTEPRFVHLRVHSDYSMIDGLAKTGSLVKQVAKLDMPAFAITDFTNLCGLVKFYGSAHSTGIKPIIGADFYVESDLLGDEYAHLTILARNNEGYQNLTFLISEAYQKGYGVIGPTIKQEWLIKYKAGLILLSGGRMGDVGKFLLRGNRAMVDQCLDFYQEHFPDSYYLELIRTGRQDEENYLHAVVEVAAEKNLPVVATNDVCFLESDDFEAHEIRVAIHDGYTMADPKRPKNYSLQQYLRSEQEMCELFSDIPEALQNSVEIAKRCNVTIRLGEYFLPQFPTGDMSTEDYLVEKSKQGLEDRLNFLYPDPQLRAEKRSEYDERLDIELEVINQMGFPGYFLIVMEFIQWSKDNGVPVGPGRGSGAGSLVAYALKITDIDPLAFDLLFERFLNPERISMPDFDVDFCMEKRDQVIDHVADMYGRDAVSQIITFGTMAAKAVIRDVGRVLGHPYGFVDRISKLVPPDPGMTLEKAFAAEPQLPEIYEADEEVRALIDMARKLEGVTRNAGKHAGGVVIAPTKITDFAPIYCDPEGLNPVTQFDKNDVEYAGLVKFDFLGLRTLTIINSALEMVNARRTHKNLEPIDITAIPLDDQISFDMLQRSETTAVFQLESRGMKDLIKRLRPDCFEDMIALVALFRPGPLQSGMVDNFIDRKHGREELSYPDVEWQHESLKPVLEPTYGIILYQEQVMQIAQVLAGYTLGGADMLRRAMGKKQPEEMAKQRSVFEEGAISQGINGELAIKIFDLVEKFAGYGFNKSHSAAYALVSYQTLWLKAHYPAEFMAAVMTADMDNTEKVVGLVDECWRMGLKVLPPDINSGLYHFHVNDEGEIVYGIGAIKGVGEGPIEAILEARQKEGHFKELFDLCARVDTKKLNRRVMEKLIMSGAFDRLGPHRAALMSSLEDALKAADQHAKAEAIGQTDMFGVLAEKPEQVELSYASTPKWPEQIVLDGERETLGLYLTGHPITSYLKEIERYTNGLRLKDVSPTPRGQVTTVVGLVLASKILTTKRGNRIGICTLDDRSGRLEIMLFSDALERYQHLLEQDKILIATGQVSFDDFNGGLKMTVRELMDISEAREKFARGIAISLSDRQINEQLFNRLRGVLEPHRSGTIPVHLYYQRVDASARLRFGATWRVTPTDTLLTDLRTLLGNEQVELEFD

SEQ ID NO: 10607 - protein, 196 aa, Xenorhabdus bovienii
  Coding DNA sequence: Name=SeqID_4499
  Gene classification: Gene name=RnhB; Function=Ribonuclease HII; Function class=L DNA replication, recombination and repair
  Homolog annotation: Query=1..195bp; Hit=2..196bp; Blast score=295; Percent Identity=80.0; E value=2e-80; Homolog= rnhB COG0164
MDFVYPQANLIAGVDEVGRGPLVGAVVTAAVILDPAKPITGLMDSKKLTEKRREALYLEIKEKALCWSLGRAEPEEIDQLNILHATMLAMQRAVEGLAITPDYVLIDGNRCPALPMSAQAVVKGDNLVAEISAASILAKVTRDREMAELGKQFPDYGFAKHKGYPTALHLEKLALLGATAHHRKSFAPVKRALGLG

SEQ ID NO: 10608 - protein, 394 aa, Xenorhabdus bovienii
  Coding DNA sequence: Name=SeqID_4500
  Gene classification: Gene name=LpxB; Function=Lipid A disaccharide synthetase; Function class=M Cell envelope biogenesis, outer membrane
  Homolog annotation: Query=12..393bp; Hit=1..382bp; Blast score=599; Percent Identity=80.0; E value=1e-171; Homolog= lpxB COG0763
MKDTPLATFSSVSNQRPLTIALVAGETSGDILGAGLIRALKAKIPDAHFVGVAGPLMQAEGCEAWYEMEELAVMGIVEVLGRLPRLLKIRKDLTARFTALKPDVFIGIDAPDFNITLEGRLKQRGIRTIHYVSPSVWAWRQKRVFKIGRATDLVLAFLPFEKAFYDRFSVPCRFIGHTMADSMPLQTDKVAAREALGVPLNAHCLAILPGSRHAEVEMLSADFLRTVQLLRKTLPDLHVLVPLVNAKRHQQFQRIKDEIAPDLSVHLLDGNAGKAMIASDATLLASGTAALECVLAKCPMVVGYRMKPFTFWLAKRLVKTPYVSLPNLLAGKELVKELLQDECEPQALSEALLPLLQGGADVEALKQTFLHLHESIRCDADEQAAQAVLELARR

SEQ ID NO: 10609 - protein, 265 aa, Xenorhabdus bovienii
  Coding DNA sequence: Name=SeqID_4501
  Gene classification: Gene name=LpxA; Function=Acyl-[acyl carrier protein]--UDP-N-acetylglucosamine O-acyltransferase; Function class =M Cell envelope biogenesis, outer membrane
  Homolog annotation: Query=1..265bp; Hit=1..262bp; Blast score=404; Percent Identity=76.0; E value=1e-113; Homolog= lpxA COG1043
MIDQTAVIHPSSIVEEGAVIGANVRIGPFCYIGSQVEIGEGTEVKSHVVINGITRIGRDNQIYQFASIGEVNQDLKYQGEPTRVEIGDRNRIRESVSIHRGTVQGGGLTKIGSDNLLMINTHIAHDCMLGDRCIIANNGTLGGHVILGDYVIIGGMTAVHQFCQIGAHVMVGGCSGVAQDVPPYVIAQGNHATPFGLNIEGLKRRGFDKESLHAIRNAYKVLYRSGKTLEEARIEIELQAANNPHVKAFSDFLENSAKSNRGIIR

SEQ ID NO: 10610 - protein, 150 aa, Xenorhabdus bovienii
  Coding DNA sequence: Name=SeqID_4502
  Gene classification: Gene name=FabA; Function=3-hydroxymyristoyl/3 -hydroxydecanoyl-(acyl carrier protein) dehydratases; Function class =I Lipid metabolism
  Homolog annotation: Query=2..150bp; Hit=3..151bp; Blast score=242; Percent Identity=83.0; E value=1e-64; Homolog= fabZ COG0764
MSDNRTLQIEEILDLLPHRYPFLLVDRVLDFEEGKFLRAVKNVSFNEPFFQGHFPGKPIFPGVLILEAMAQATGILAFKSVGSLAPGELYYFAAIDGARFKRPVLPGDQMILEVEFIKERRGVARFRGVAKVDGEVACEAEMMCARRREA

SEQ ID NO: 10611 - protein, 342 aa, Xenorhabdus bovienii
  Coding DNA sequence: Name=SeqID_4503
  Gene classification: Gene name=LpxD; Function=UDP-3-O-[3 -hydroxymyristoyl] glucosamine N-acyltransferase; Function class=M Cell envelope biogenesis, outer membrane
  Homolog annotation: Query=1..341bp; Hit=1..341bp; Blast score=523; Percent Identity=77.0; E value=1e-149; Homolog= ZlpxD COG1044
MVSIRLADLAQQLNAQLHGDGDIVITSIAPMYSANSEQITFLSDSRYTDKLAECQAAAVVLRESDLTHCKVAALVVDNPYLAYARMAQIMDTTPQPAQDIHPSAVIFSEVQLGKNVAVGANAVVESGVVLGDNVIVGAGCFIGKNTRIGAGTRLWANVSVYHNVEIGEQCLIQSGTVIGSDGFGYANDRGNWIKIPQLGSVIIGDRVEIGASTTIDRGALDNTVIGNGVIIDNQCQIAHNVIIGDNTAVAGGATMAGSLKIGRYCMIGGASVINGHIEICDKVTVTGMGMVMRPITEPGVYSSGIPLQPNKVWRKTAALVMNINEMNKRLKSVERQLEGENE

SEQ ID NO: 10612 - protein, 165 aa, Xenorhabdus bovienii
  Coding DNA sequence: Name=SeqID_4504
  Gene classification: Gene name=HlpA; Function=Outer membrane protein; Function class=M Cell envelope biogenesis, outer membrane
  Homolog annotation: Query=1..165bp; Hit=1..161bp; Blast score=112; Percent Identity=57.0; E value=2e-25; Homolog= hlpA COG2825
VKKVLCAASLGIALAFSAGVQAADKIGVVNVGEIIQKLPAREAAVKQLDSEFKGRISELQSMEADMQAKVQKLQRDGSTMKASDRTKLEKEVMAQRNDYAQKAQSLDNDSRRRQMEEQNKLLTRIHDAVKVVAGKEGYDVVLDANTVLYSVSGKDITADVLKQVK

SEQ ID NO: 10613 - protein, 811 aa, Xenorhabdus bovienii
  Coding DNA sequence: Name=SeqID_4505
  Gene classification: Function=Predicted outer membrane protein; Function class=M Cell envelope biogenesis, outer membrane
  Homolog annotation: Query=19..811bp; Hit=1..810bp; Blast score=1170; Percent Identity=70.0; E value=0; Homolog= yaeT COG0729
MISPASKVGDRLGKRITTMAMKKLLIASLLFGSATAYSSDGFVVRDIQFEGLQRVTSGAALLNMPVRVGDTISDEDISRTIHTLFATGNFEDVRVLRDGNTLVVQVKERPTIASITFSGNKSVKDDMLKKNLESSRVSVGEALDRTMLSNMEKGLEDFYYSVGKYNATVQAVVTPLPRNRIDLKLIFSEGISAQIQQINIVGNKAFSTNELLNRFQLRDDIPWWNFMSDQKYQKQKLAGDLETLRSFYLDRGYARFSIDSTQVNLTPDKKGIYITVNINEGAQYKIASIDLNGNLAGYQSEATKLTNIQPGSLYNGTEVTSMEKAIKNLLGRYGYAYPRVITQPEINDTDKTVKLHVNVDAGNRFYVRKIRFEGNDVSTDSVLRREMRQMEGAWLGSDRVEQGKERLDRLGFFETVNVDTERVAGSPDLVDVVYKVKERNTGSMNFGVGFGTESGMSFQIGLQQENWLGTGNSVGISASKNDYSTSADLSFTDPYFTVNGVSLGGRVYYNDFRADDAELSGYTNKAYGTEGILGFPLNENNRLAMRLGYAHNSLSDMRPQAAMWRYLKKMGKEPPFEGKASFDSNDFPLTFSWIYGNFDRGFFPTSGFKSSVDAKVALPGSDNQYYKLTWSATGYYPIDDKNSWVMMGRTRMGYGGGLGGKEMPFYENFYAGGSNSVRGFRSNNIGPKAIYLGKDKEPEKNSPSRDAVGGNALATASFELITPTPFLDAKYANTVRTSFFVDAGTVWDTNWNKIYPGLPDYSKPNNIRVSAGIALQWLSPLGPLTFSYGKPIKEYEGDRAEQFQFNIGGTW

SEQ ID NO: 10614 - protein, 450 aa, Xenorhabdus bovienii
  Coding DNA sequence: Name=SeqID_4506
  Gene classification: Function=Predicted membrane-associated Zn -dependent proteases 1; Function class=M Cell envelope biogenesis, outer membrane
  Homolog annotation: Query=1..449bp; Hit=2..449bp; Blast score=594; Percent Identity=69.0; E value=1e-170; Homolog= yaeL COG0750
MDILWNLAAFIVALGILITVHEFGHFWVARRYGIYVERFSIGFGKALWRRTDKQGTEYVIALIPLGGYVKMLDERVESVSPERRHMAFNNKTIGQRAAVVSAGPIANFILAVIAYWLVFVIGVPSVRPVVLDVKPDSIAAQANILPGMELKMVDGIETFDWNSVRLALVSKVGESFVSMDVMPVGASASTQKTLDLRDWAFDPSKQDVLLSLGIMPVVPRISSQVENVYPGSPAEKAGLQRGDRIVKVNGQNVDVWHTFVSFIRKNPNVPLKLDVARADSIIPLSLTPEARRLSNGREEGFAGAELQVIPLADEYKVIQQYGAFSAIYQAGDKTWQLMKLTVNMIGKLIVGDVKLNNLSGPISIAKGAGVSADSGLVYYLMFLALISVNLGIINLFPLPVLDGGHLLFLAIEKIKGGPVSERVQDFSYRIGTILLVLLMGLALFNDFSRF

SEQ ID NO: 10615 - protein, 287 aa, Xenorhabdus bovienii
  Coding DNA sequence: Name=SeqID_4507
  Gene classification: Gene name=CdsA; Function=CDP-diglyceride synthetase; Function class=I Lipid metabolism
  Homolog annotation: Query=37..281bp; Hit=1..245bp; Blast score=251; Percent Identity=58.0; E value=6e-67; Homolog= cdsA COG0575
LLKYRLLTTLILIPIVIAALFLLPPSGFGLVVITVSVLAAWEWGQFAGLFTQAKRITLAVLFAVGLLALQYSLSDFFHLIEKPQIIYLLWAGMIWWAAAILLVITYPASASIWKSSTALRLLFGVLTIVPFYCGMMLLRTQGYENNPYHGAWWLLYAMLLVWGADSGAYIFGRTLGKHKMAPRVSPGKTLEGLVGGVLTAALISWLFGKFAPVPVMPENLLLISAVVVIASVFGDLTESMFKRESGIKDSSLLIPGHGGVMDRVDSLTAAVPVFAGLVLLISSGFGL

SEQ ID NO: 10616 - protein, 231 aa, Xenorhabdus bovienii
  Coding DNA sequence: Name=SeqID_4508
  Gene classification: Gene name=UppS; Function=Undecaprenyl pyrophosphate synthase; Function class=I Lipid metabolism
  Homolog annotation: Query=1..226bp; Hit=25..250bp; Blast score=343; Percent Identity=72.0; E value=6e-95; Homolog= yaeS COG0020
MDGNGRWAKQRGKLRVFGHRAGVKAVRVAVSFSVKHNIESLTLYAFSSENWNRPQQEVSSLMELFVFALDNEVKSLHKHNVKLSVIGDISRFSSRLQERIRRSVELTAGNTGLQLNIAANYGGRWDLAQGVKQIAEKIRANELEPEEITEATVGSFINLSEQPEVDLVIRTGGEHRISNFLLWQIAYAELYFTDILWPDFDETVFEGAINAFVKRERRFGGTIPDDAEVGS

SEQ ID NO: 10617 - protein, 69 aa, Xenorhabdus bovienii
  Coding DNA sequence: Name=SeqID_4509
MKKPCQQLPRLFLGHGPNESLYLWHTLGKRVTNIEPAIITTIIYPRTIPFAKTQTNIYLLARFAIWKRS

SEQ ID NO: 10618 - protein, 398 aa, Xenorhabdus bovienii
  Coding DNA sequence: Name=SeqID_4510
  Gene classification: Gene name=Dxr; Function=1-deoxy-D-xylulose 5 -phosphate reductoisomerase; Function class=I Lipid metabolism
  Homolog annotation: Query=1..393bp; Hit=1..393bp; Blast score=531; Percent Identity=69.0; E value=1e-151; Homolog= dxr COG0743
MKRLTILGSTGSIGKSTLSVVRNNLDKFQVVALVAGKNIEIMAQQCLEFRPQYAAMADAHSATVLRQLLQEQGSQTEVLSGREAICDLAALDDVDQVMSAIVGVAGLLPTLAAIRKGKQVLLANKESLITSGRLFMEAVNQYQAQLLPIDSEHNAIFQSLPESVQHNLGNASLKQHGISSIILTGSGGPFRRTPLEKLLDVTPDEACAHPVWSMGRKISVDSATMMNKGLEYIEARYLFNASADEIEVLLHPQSVIHSMVRYQDGSIIAQLGTQDMCTPIAYAMAYPNRIASGAKPLDFTELSTLTFEALDYRRYPCLKLAIDACHEGQAATTALNAANEETVSAFLKDGIRFTDIVMINRLVVEKLNLSEPQSIEEVLEIDKVARKLVKETIKTFSK

SEQ ID NO: 10619 - protein, 205 aa, Xenorhabdus bovienii
  Coding DNA sequence: Name=SeqID_4511
  Gene classification: Gene name=Frr; Function=Ribosome recycling factor; Function class=J Translation, ribosomal structure and biogenesis
  Homolog annotation: Query=21..205bp; Hit=1..185bp; Blast score=256; Percent Identity=75.0; E value=8e-69; Homolog= PM1987 COG0233
MISYFDIRGLQNNQFPRVCNVINEIKKDAQDRMEKSVEALKSQISKIRTGRASPSLLDGINVEYYGSATPLRQIASVVVEDARTLAITVFDRSMTPAIEKAIMASDLGLNPSSAGTIIRVPLPALTEERRKDLIKVVRGDAEQGRVSVRNIRRDANDKVKALLKDKEISEDEERRSQDEIQKLTDNFIKKIDEALASKETELMDF

SEQ ID NO: 10620 - protein, 242 aa, Xenorhabdus bovienii
  Coding DNA sequence: Name=SeqID_4512
  Gene classification: Gene name=PyrH; Function=Uridylate kinase; Function class=F Nucleotide transport and metabolism
  Homolog annotation: Query=1..240bp; Hit=1..240bp; Blast score=421; Percent Identity=90.0; E value=1e-118; Homolog= pyrH COG0528
MATNAKPVYQRILLKLSGEALQGAEGFGIDASVLDRMAQEVKELVELGIQVGVVIGGGNLFRGAGLAEAGMNRVVGDHMGMLATVMNGLAMRDALHRAYVNARLMSAIPLNGVCDNYSWAEAISLLRHGRVVIFSAGTGNPFFTTDSAACLRGIEIEADVVLKATKVDGVYSSDPAKDTEAVLYSKLTYQEVLERELKVMDLAAFTLARDHSIPIRVFNMNKPGALRRVVMGESEGTLISHG

SEQ ID NO: 10621 - protein, 285 aa, Xenorhabdus bovienii
  Coding DNA sequence: Name=SeqID_4513
  Gene classification: Gene name=Tsf; Function=Translation elongation factor Ts; Function class=J Translation, ribosomal structure and biogenesis
  Homolog annotation: Query=1..285bp; Hit=1..283bp; Blast score=365; Percent Identity=74.0; E value=1e-101; Homolog= tsf COG0264
MADITAALVKELRERTGAGMMECKKALVEANGDIELAIDNMRKSGQAKAAKKAGRVAAEGVILVEVAADAKYAGIVELNCETDFVAKDSGFLAFGKEVIAAVMADKNADIDALKAQFEEQRANLVAKIGENINIRRVTILEGDAVGSYLHGARIGVLVAAEGASEELIKHVAMHVAASKPEYVNPTDVPADVVAREHQIQMDIAMQSGKPREIAEKMVSGRMNKFTGEISLTGQNFVMDPSKTVGDLMKENNAKVINFIRFEVGEGIEKVEADFAAEVAAMSKQS

SEQ ID NO: 10622 - protein, 241 aa, Xenorhabdus bovienii
  Coding DNA sequence: Name=SeqID_4514
  Gene classification: Gene name=RpsB; Function=Ribosomal protein S2; Function class=J Translation, ribosomal structure and biogenesis
  Homolog annotation: Query=1..241bp; Hit=1..241bp; Blast score=449; Percent Identity=92.0; E value=1e-127; Homolog= rpsB COG0052
MATVSMRDMLQAGVHFGHQTRYWNPKMKPFIFGARNKVHIINLEKTVPMFNIALAELNKIASRKGKILFVGTKRAASEGIKEEALGCDQYFVNHRWLGGMLTNWKTVRQSIKRLKDLEIQSQDGTFDKLTKKEALMRTRELGKLENSLGGIKDMGGLPDALFVIDAEHEHIAIKEANNLGIPVFAIVDTNSDPDGVDFIIPGNDDAIRAVKLYLGAVATAVREGRSQDLAVQAEEGLVDAE

SEQ ID NO: 10623 - protein, 270 aa, Xenorhabdus bovienii
  Coding DNA sequence: Name=SeqID_4515
  Homolog annotation: Query=155..257bp; Hit=4..105bp; Blast score=72; Percent Identity=36.0; E value=7e-12; Homolog= ref|ZP_00091551.1|
MGFFFFAQCHDFTAIVGDDDGVLILSRPAVVFGFDCPAIFHGADTGIAGIDHRFNRERHPFLQYNATIIGIIMEYMGFFVEDPADTMAAVFADDRVILPFHILLDRFAKAAQADAGFHHFQRKVQAFLGNAAQTLALNSRFADNEHFGGIAVKFLFDDSDINVDDIAFFQRLVIAGNTVTNHIIDGDAYGFRETVVAKTGRNCLLFMGNVIVANTIKLTCGHTNLNVRFDHFQNFGCQTSGNAHFLDVFICFDRNSHEIGPFKSEIYPTV

SEQ ID NO: 10624 - protein, 884 aa, Xenorhabdus bovienii
  Coding DNA sequence: Name=SeqID_4516
  Gene classification: Gene name=GlnD; Function=UTP; Function class=O Posttranslational modification, protein turnover, chaperones
  Homolog annotation: Query=11..883bp; Hit=17..889bp; Blast score=1206; Percent Identity=68.0; E value=0; Homolog= glnD COG2844
MSVDITFAHAPIPPLSPAEFSLNDLQRPALKQHVDEFQLWLQQAFKAGISPEALISARSDYIDRLLMRLWQAYGFDQLTSLSLIAVGGYGRRELHPLSDIDLLVLSESQLTEDQAHNIGQFITLLWDIRLEVGHSVRTFEECLHEGLSDLTVATNLIESRLICGDLPLFLRLQKHIFSDDFWPSATFFAAKLREQWERHQRYHSTSYNLEPDIKSSPGGLRDIHTLLWVARRHFGAASLDEMVDFSFLTREERNELNECQDFLWSIRFALHLVVTRYDNRLLFERQFNVAQLLGYEGERNQPVERMMKNFYRVTRRVSELNDMLLQLFDEAILTLQPDEKPRPLNEAFQLRGDLIDLSDETLFIQDPTSILKMFYHMAEHREIKGIYSTTLRQLRYARRNLKHPLCELPEARKLFMDILRHPRAVKNALLPMHRHSVLGAYMPLWSNIVGQMQFDLFHAYTVDEHTLRVLQKLESFADENNRVIHPLCVELYPRIPQPELLRLAAFFHDIAKGRNGDHSELGAKDAFTFARQHGLTTREAELVEWLVRDHLLMSVTAQRRDIQDPDVIQQFAGQVKNQNRLNYLLCLTVADICATNSKLWNSWKQSLIRELYFATETQLRQGIQNTPDLRERVRHNRLQALALLRQEGTDEEQLHNIWSRCHADYFLRHTPDQLAWHAGHLIQHQSAQPMVLISTAFSHGGTEIFIWCQDRPSLFAAVVGELDRRNLSVHDAQIFTNRDEMAMDTFIVLEPNGHPLALDRHEPIRRALLKVVNDPHPKAPKARNLPAKLRHFDVPTKVSFLPAQNVRRSYMELVALDQPGLLARVGNIFAELGVSLHGARITTIGERVEDFFVLADKDHQELDNKIKGELSERLTETLNTKDKV

SEQ ID NO: 10625 - protein, 280 aa, Xenorhabdus bovienii
  Coding DNA sequence: Name=SeqID_4517
  Gene classification: Gene name=DapD; Function=Tetrahydrodipicolinate N-succinyltransferase; Function class=E Amino acid transport and metabolism
  Homolog annotation: Query=1..280bp; Hit=1..274bp; Blast score=478; Percent Identity=89.0; E value=1e-135; Homolog= dapD COG2171
MQQLQSIIEIQAIIDNAFENRTDITPSTVDEATRDAVNQVIQMLDSGKLRVAEKIAGQWVTHQWLKKAVLLSFRINDNQVIEGAESRYFDKVPMKFADYDQARFEKEGFRVVPPAAVRQGAYIARNTVLMPSYVNIGAYVDEGTMVDTWATVGSCAQIGKNVHLSGGVGIGGVLEPLQANPTIIEDNCFIGARSEIVEGVIVEEGAVISMGVYIGQSTKIYDRETGEIHYGRVPAGSVVVSGNLPSKDGSYSLYCAVIVKKVDAKTRGKVGLNELLRNID

SEQ ID NO: 10626 - protein, 128 aa, Xenorhabdus bovienii
  Coding DNA sequence: Name=SeqID_4518
  Homolog annotation: Query=1..128bp; Hit=1..128bp; Blast score=199; Percent Identity=90.0; E value=9e-51; Homolog= ref|NP_928013.1|
MYDNLKSLGITHPEDIDRYSLRQEANNDILKIYFRKDKGEFFAKSVKFKYPRQLKTISDDNSAQGYKEVKEINTNLRYVIEELDQICKRDQVEVDLKHKILDDLRHLEHVVANKIAEIEADLEKLTRK

SEQ ID NO: 10627 - protein, 164 aa, Xenorhabdus bovienii
  Coding DNA sequence: Name=SeqID_4519
  Gene classification: Gene name=FldA; Function=Flavodoxins; Function class=C Energy production and conversion
  Homolog annotation: Query=15..163bp; Hit=1..149bp; Blast score=186; Percent Identity=62.0; E value=9e-48; Homolog= yqcA COG0716
MNERSTNRLKRSIFMAKIGVFVGTVYGNALAVAEEALQILQQQGHEVEVFEDATLTQWQKYLQQVVLVVTSSTGQGELPDNIQPLYSDLNDKLGHQPDLRYGVIALGDSSYDFFCGGGRTFDKLLQEQGAKRVGEVLLIDGIDVVEPEVFAQNWVEEWGALLTE

SEQ ID NO: 10628 - protein, 250 aa, Xenorhabdus bovienii
  Coding DNA sequence: Name=SeqID_4520
  Gene classification: Gene name=RluA; Function=Pseudouridylate synthases, 23S RNA-specific; Function class=J Translation, ribosomal structure and biogenesis
  Homolog annotation: Query=1..244bp; Hit=1..244bp; Blast score=322; Percent Identity=66.0; E value=2e-88; Homolog= yqcB COG0564
MLDIIYQDDHIVAVNKPAGWLVHRSWLARHETVFVMQTLRDQIGQHVFPVHRLDKPTSGVLLMALSSEVARTLSQQFECHHIQKTYHAIVRGYVEGDGIIDYALMEELDKIADKFADTDREAQSAITHYRSLAKVECPVEIGRYPTSRFSLLELMPKTGRKHQLRRHMSHLRHPIIGDTTHGDLRQNCGVVKYYQTGRLMLHASQLQLAHPVTGENLLLTARWEASWQHLLEQFGWQGILPELECPTTHE

SEQ ID NO: 10629 - protein, 108 aa, Xenorhabdus bovienii
  Coding DNA sequence: Name=SeqID_4521
  Gene classification: Function=Uncharacterized BCR; Function class=S Function unknown
  Homolog annotation: Query=1..85bp; Hit=1..85bp; Blast score=83; Percent Identity=52.0; E value=3e-17; Homolog= PM0478 COG3098
MNIEQQILLKLQLIEADMNAAGLWRSHPPKPEAFESTEPFSLDTMSAEEWLQWVLIPRMRAMIEQNANLPTAFEITPYFEEAYKEEAERYLPLLEHLRELDSLFTQDI

SEQ ID NO: 10630 - protein, 183 aa, Xenorhabdus bovienii
  Coding DNA sequence: Name=SeqID_4522
  Homolog annotation: Query=1..179bp; Hit=1..180bp; Blast score=254; Percent Identity=68.0; E value=3e-67; Homolog= ref|NP_928008.1|
MTFNVAEALTDFTRRYVELWQEETGLPPASSDLYGIPSSCIERTGDGVVYWLPKLFSVHEKLSKVETALDIRLQDSIHDYYVTQLAGDMPASFEGQNLSLIQVWSDDDFIRLQENLIGHLVTQKRLKLSPTAFIATIDSEMSMISVCNLTGQVILEQSGKPKRAILSADLASFLSVIKPATSL

SEQ ID NO: 10631 - protein, 62 aa, Xenorhabdus bovienii
  Coding DNA sequence: Name=SeqID_4523
MKSREKSASLASPFLAKRMHCSRTEYPFMISFSGCYFAENYIHPMDFKMQRDGKGTNPQAHR

SEQ ID NO: 10632 - protein, 623 aa, Xenorhabdus bovienii
  Coding DNA sequence: Name=SeqID_4524
MNSNYNDMGLPSSRNNPVEKASPGVFVFRGPDAPHIPWVVKIIRQERDEHGAVCPDYVHSSTGFLVSDMWLLTARHAVEQGGRPVRPEDVSVRGFYRTQEPGTPVSQVMLQIDAIEFSPNGGDIAALRLTAPYRLNDYAPVNLLHSAQGMIGIRVRLYAYADANNYRLGTAFGTVSRVYPDPQYPPTQQLLVHYDVGQGSGVSEAGDSGGPVLLGYPIDIGPRSYEMVVGLHVGGEPLQAEGDFVLLSDHRDFIEPLLMPQLIASISESNYQLVTALHLLNNCSYFERLAREPFSREAVLSDDAGTVPTSCNAFDSYRFFYKKASEGDSWDNATAYEVTPSGQTHRYELPLDKTHPHSDRELWDITVLPVGDGKVFGAGENGKPLPGVQSNFFVRTTPTVSLPTHLTISEQPGMPGMVKVSWKNSESPISGTIKGYTLFYMPADHVPFYWAGCEGTSVAPTSYETTSVVIPVYTSGNYALLVLPAVGDGVVGTQEDGTPYPGTYSGDQVTLIGPPVVRYQIPKGGENMHIDLNSHGYGIMANVSFDDQNDYEWVWCKDKPDGNYSSGGDWSFTSGKKSSILIFGSPEKPARSADSGWYKLKVENAFGVVETKPVFVRIEPPPM

SEQ ID NO: 10633 - protein, 39 aa, Xenorhabdus bovienii
  Coding DNA sequence: Name=SeqID_4525
MSGLGQKSADEKAFLRCRMCIGKQVSSDSLGHNNPSNRI

SEQ ID NO: 10634 - protein, 76 aa, Xenorhabdus bovienii
  Coding DNA sequence: Name=SeqID_4526
  Homolog annotation: Query=12..49bp; Hit=8..45bp; Blast score=71; Percent Identity=78.0; E value=3e-12; Homolog= ref|NP_929680.1|
MRLWHHFPGEHKIYGSPSFCNTHFDVWLACVNLSGITLGKDACALMGSVSDVPKNLFGFKEPFFMLGLSSSRSCHQ

SEQ ID NO: 10635 - protein, 563 aa, Xenorhabdus bovienii
  Coding DNA sequence: Name=SeqID_4527
  Gene classification: Gene name=GlcD; Function=FAD/FMN-containing dehydrogenases; Function class=C Energy production and conversion
  Homolog annotation: Query=6..561bp; Hit=48..596bp; Blast score=607; Percent Identity=51.0; E value=1e-173; Homolog= PA4140 COG0277
MNSSNIMRKENILASECPHVKPEYNLISFPNGIKWENRHFKNWSGEIEQHNIPCCIPRSVEEILAVVNWAWKENYKLRPVGQSHNWSPLILPQKQRPESRVMLMDLSQYFTQVSIEHRSQFSIVTAQTGILMETLMAEMEKHGLGFTATPAPGDLTLGAVLAINGHGTAIKALNETCLPGYTYGSLSNTILALSAVIWDTESQQYIIKRFERHEPSCASLLTHLGCSMVLEVQLQAGQNQRLRCESFTHIPAAELFSPVQSKNTQRTLSHFLDKSGRAEVILFPFTNKPWLKVWSVAPEKPASSVEVTEPYNYPFSDNISSSLSQLVNEMLSGIPQLTPSIGALQYTLVNTTLPKNGKDIWGWSKNLLLYVKPTTLRVTANGYAVLTRRADIQRVLHEFYSEWQSLMKEFQYKNQYPINGPLEVRVTGLDTPEDVMQEAAVVPSLSAIRPRLDQPHWDVAVWLDVLTFPGTPYAIEFCRKFEQWLFKEFDGSYALARVEWSKGWAYSPNAAWEDNDTLTKTIPASFNDGLPADNHWASSVAALQQYDPHHLFRSPLLEKLISG

SEQ ID NO: 10636 - protein, 281 aa, Xenorhabdus bovienii
  Coding DNA sequence: Name=SeqID_4528
  Gene classification: Function=Enzyme related to GTP cyclohydrolase I; Function class=R General function prediction only
  Homolog annotation: Query=140..281bp; Hit=3..145bp; Blast score=235; Percent Identity=75.0; E value=5e-62; Homolog= yqcD_2 COG0780
MSLYQDNQAFAQLTLGKATPYCDHYDPTLLQAVPRSMNREPLGLFPDNLPFHGADIWTMYELSWLNSRGVPQVAIGHVSLSAASVNLVESKSFKLYLNSFNQTRFADWDTVQKTLQQDLSVCANGDVHVVLRPLHDFSQQPIAEFEGKCIDNQDIEIDDYQFSRDYLNDAAAGSVVDEILVSHLLKSNCLITHQPDWGSVQIRYKGPKIDQEKLLRYLVSFRHHNEFHEQCVERIFNDLIALCAPEKLTVYARYTRRGGLDINPWRSNEAFIPETGRLARQ

SEQ ID NO: 10637 - protein, 445 aa, Xenorhabdus bovienii
  Coding DNA sequence: Name=SeqID_4529
  Gene classification: Function=Predicted Rossmann fold nucleotide -binding protein; Function class=R General function prediction only
  Homolog annotation: Query=1..443bp; Hit=11..452bp; Blast score=730; Percent Identity=80.0; E value=0; Homolog= ygdH COG1611
MDLLSQLEVDALKRTASSDLYRLFRNCSLAVLNSGSQTDNSKELLSKHEDFDINVLRRERGVKLELVNPPEDAFVDGKIIRSLQANLFAVLRDILFVHAQIDSAQKVHHLNMENGMHITNTIFSILRNAKALHLSEDPNMIVCWGGHSINEKEYLYGRKVGNELGLRELNICTGCGPGAMEAPMKGAAVGHAQQRYQKSRFIGITEPSIIAAEPPNPLVNELIIMPDIEKRLEAFVRIAHGIIIFPGGVGTAEELLYLLGILMNPDNKDQVLPLILTGPKESADYFHVLDKFIVNTLGEQARQYYRIIIDDPSEVARVMKKTMPQVKEHRRSTGDAYSFNWSLKISHDLQHPFEPFHSNMANLNLHPNQPPEKLASALRCAFSGIVAGNVKEAGIHAIEKDGAFKIHGDVDIMRHMDELLKDFVRQDRMKLPGGTAYEPCYKIIK

SEQ ID NO: 10638 - protein, 251 aa, Xenorhabdus bovienii
  Coding DNA sequence: Name=SeqID_4530
  Gene classification: Gene name=Exo; Function=5'-3' exonuclease (including N-terminal domain of PolI); Function class=L DNA replication, recombination and repair
  Homolog annotation: Query=2..248bp; Hit=33..279bp; Blast score=361; Percent Identity=67.0; E value=1e-100; Homolog= exo COG0258
MIHLLIVDALNLIRRIHAVQGSPCVPACEHALKQLITHSSPTHAVAVFDEDDRGHSWRHQLLPDYKAGRSAMPDDLQQEMPLIKQAFNALGVTCWHAEGHEADDLAATLATKVVSTGHRVTIVSTDKGYCQLLSPNIQIRDYFQKRWLDLPFVEREFGVSPAQLPDYWGLAGVSSSKIPGVQGIGPKTAAILLQQTGSLDNLFQHLEAQPDKWRNKLAAHKEMAYISREVASLRTDLSLNGNLQQLRLDHR

SEQ ID NO: 10639 - protein, 460 aa, Xenorhabdus bovienii
  Coding DNA sequence: Name=SeqID_4531
  Gene classification: Gene name=TolC; Function=Outer membrane protein; Function class=M Cell envelope biogenesis, outer membrane
  Homolog annotation: Query=28..459bp; Hit=24..444bp; Blast score=313; Percent Identity=42.0; E value=2e-85; Homolog= PA1248 COG1538
MFRSSGFTGRVLFLSLFLLMSFSGTVQALSLTEAYALALQHDPTFQAAIKAQEAGQEEKNLGRAELLPKLAFNYQYVPQNWQKMESSSSDSGQRGSTVTESRNRQYHSYSGSLVLTQPLVDFEAWARYKTRQAYALMSDARFRVDTQQLAVRVVNSYVDVAYAQDRLAQVAQQGRAYEEQLERNQKLFASGEGTRTDVAETQARYSQIVADELTVKDELDAVIRDLQLLVGTPLPSDLPVNRLSPVQNFKTIKLAFAHYADWEQMALSQNPQLAEARQKVAVAAQDIERNRAGYLPKLELYASHTENKSSSDNIIDQKYRTDSIGLRVSMNLYNGGGTSAAVRQSAANYGRAKYEMDAEAGEILNALRRNYNACMNGEKRIRAYESAVEAAELQVKATQKSVALGQRVNVDILNAEQQLYMARRDLSQAKYQYMKSWIGLLSESGQLNGEDIQLASGYFE

SEQ ID NO: 10640 - protein, 445 aa, Xenorhabdus bovienii
  Coding DNA sequence: Name=SeqID_4532
  Gene classification: Gene name=AcrA; Function=Membrane-fusion protein; Function class=Q Secondary metabolites biosynthesis, transport and catabolism
  Homolog annotation: Query=21..444bp; Hit=8..431bp; Blast score=367; Percent Identity=45.0; E value=1e-102; Homolog= PA1247 COG0845
MSYQTNAKSAKNDESGLLPLDANHYLRLGWLVIGIGLLGFFVWAAFAPLDKGVASPGIVVVDGNRKTVQSPANGIIRQILASEGEQVKAGQVLVQLSQVQVNAQIDSLKQQLHTTLATEVRLLAEQQGLEVISFPATLSDQQSEPRIKDILVLQKQLFLSRREMLRSDLAGMQQAEEGLSFQLKGLREALTNKQQQQVSLKEQVTNLRPLTEEGYFPRNRYLELQRSQSELSGSMAEMAGRIGQLEKQCQETRQRIIQRQADYQREVRSQLSDVQVQANELKNKLETAQFDLSHTSITAPVGGSVVGLTVFTQGGVVASGEKLMEILPAQSALEVEARLMVHLIDKVEMGQDVDLMFTAFNQNQTPKVTGKVTVISADRLVDGVTREPYYQMRVRVTPEGMAQLAGLHIKPGMPVEVFVKTGSRSLLSYLFKPLMDRASTSLIEE

SEQ ID NO: 10641 - protein, 541 aa, Xenorhabdus bovienii
  Coding DNA sequence: Name=SeqID_4533
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..536bp; Hit=37..563bp; Blast score=579; Percent Identity=59.0; E value=1e-165; Homolog= PA1246 COG1132
MLVPSIYMLQVYDRVLPSSNEMTLLMLTLITLGMFAIMGGLEYIRSMVVIRIGSQFDMCLNQRVYTASYESNLKNGSTDAGQMLNDLATIRQFLTGNALFAFFDVPWFPVYLWVIFLFSPYLGLLALVGAIILIALAVLNQWLSQSPLSEASHLSLRSANLASTNLRNAEVIEALGMLPALRQRWFSLHERFLNFQRIASERAASITALTKTVRMALQSLILGLGGWLAIEGNITPGMMIAGSILMGRALSPIEQLIQAWKSWSAARLSWQRLDKLLKAQPERKSGMSLPAPKGILLLEKVAAIPPSKTQARQTAGNHKQVLQDISFSLNAGDVLGVIGPSASGKSTLARLLVGIWPSQEGVVRLDDADIYQWNKDELGASIGYLPQDIELFGGTIAENIARFNDVDPEKVIEAAKKAGVHELVLNLEQGYDTVIGAGGMGLSGGQKQRIGLARALYGNPSLLVLDEPNSNLDDIGEKALSQAITQLREQGKTVVVITHRPSLLSQTNKILLLVQGKMKMFGPSQQVMAALSQSKAVERAS

SEQ ID NO: 10642 - protein, 75 aa, Xenorhabdus bovienii
  Coding DNA sequence: Name=SeqID_4534
MRATECHNEFPPINKVCHPLLGLMTKKGQTIAIIVSQSDTIRCRTPALYRVPHQFGQARITFQRPNGPLRQTGIR

SEQ ID NO: 10643 - protein, 476 aa, Xenorhabdus bovienii
  Coding DNA sequence: Name=SeqID_4535
  Gene classification: Function=RTX toxins and related Ca2+-binding proteins; Function class=Q Secondary metabolites biosynthesis, transport and catabolism
  Homolog annotation: Query=3..476bp; Hit=2..479bp; Blast score=374; Percent Identity=49.0; E value=1e-103; Homolog= PA1249 COG2931
MTSKNKYTYVGLSDSKSVQDVNALLTAYVPNSDPGIRVAHTPLGDKAPDELVRTNYHWSNKVGSSGAVELSYHFLESAPSVMPRFGIAGFSSFNDEQKEAARLSLQSWSDVANVKFNEVSSLSKANITFGFFDYSITDDYAFATLPKGQNTTYSWYSAESHTFIDNDIGVNGYGRQTFTHEIGHTLGLDHPAEYDASDAVRPTYISVGEYFEDSRAYTVMSYFSEKYTGQDYKGAFSSAPLLNDISAIQDLYGANTETRTGDTVYGFNSNTDRDFMTATDANSKLVFSVWDADGNDTFDFSDFTQDQRINLNAGSFSDVGGLKGNVSIARGVTIENAIGGSGDDILVGNSADNVLKGGDGDDIIYGGLGGDHLWGGAGKDTFVYLNGKESLKDNPDWIHDFVSGEDKIDLSDFNFGSKGDIKFVDSFSGRAGEVLLTYDKVTDITDMSISLGGDLVSNDFLVKIIGQPVAEADFIV

SEQ ID NO: 10644 - protein, 365 aa, Xenorhabdus bovienii
  Coding DNA sequence: Name=SeqID_4536
  Gene classification: Function=Predicted SAM-dependent methyltransferase; Function class=R General function prediction only
  Homolog annotation: Query=1..364bp; Hit=1..364bp; Blast score=575; Percent Identity=73.0; E value=1e-164; Homolog= ygdE COG2933
MNKVALYCRPGFEKECAAEITDKAGKKGVYGFARVKENSGYVLFECYQHDDADRLIREIPFGELIFARQMVVVGELLKNLPQEDRITPILGMLTGVIERAGELRVEVPDNDESKELMTFCRKFTVPLRNAMRQEKLLLAKESAHRPVIHVLFIAPGCCYVGYSYSNNNSRFYMGIPRLKFPSDAPSRSTLKLEEAFHVFIPHDEWEERLGSGLYAVDLGACPGGWTYQLVRRGMIVHAVDNGLMADSLMDTGQVKHHRVDGFKFEPSVKNVYWLVCDMVEQPAKVAQLMTDWLVKSWCREAIFNLKLPMKKRYEEVAQILQKIEQQLKENGINVQIQAKHLYHDREEVTVHVRRIWSAYAMTRDF

SEQ ID NO: 10645 - protein, 147 aa, Xenorhabdus bovienii
  Coding DNA sequence: Name=SeqID_4537
  Gene classification: Function=Uncharacterized small membrane protein; Function class=S Function unknown
  Homolog annotation: Query=17..147bp; Hit=1..131bp; Blast score=115; Percent Identity=52.0; E value=2e-26; Homolog= ygdD COG2363
MCEGVSFHTSRNRSGAMSSRVMLIFVGISGFFYVALGAMGAHMLVPVLTSRQMEWIHTGLQYQGLHTLVMMVLAVLLMRQPMKPFGWAGIFFAAGMVLFSGSLYCLAFLPLKFLVYLTPIGGFSFLIGWLCILIGALRLRKLAPSHE

SEQ ID NO: 10646 - protein, 306 aa, Xenorhabdus bovienii
  Coding DNA sequence: Name=SeqID_4538
  Gene classification: Gene name=LysR; Function=Transcriptional regulator; Function class=K Transcription
  Homolog annotation: Query=1..302bp; Hit=1..301bp; Blast score=517; Percent Identity=84.0; E value=1e-147; Homolog= gcvA COG0583
MSKRLPPLNALRVFDAAARHLSFTKAAEELFVTQAAVSHQMKSLEDFLGLKLFRRRNRSLLLTEDGQSYYLDIKEIFTAINDATRKLQARSAKGALTVSLSPSFAIQWLVPRLSGFNQSFPGIDVRIQAVDREEDKLADDVDVAIFYGRGNWPGMRTDRLYPEYLLPVCSPSLLMGERPLKTPADLAKHTLLHDSSRRDWQAYIRQLDMQQLINVQQGPIFSHSSMVIQAAVHGQGVALANNVMAQNEIDAGRLVCPFNDVLVSKNAFYLVCHDNQAELGKIAAFRKWILMQAASEQARLGFITNE

SEQ ID NO: 10647 - protein, 60 aa, Xenorhabdus bovienii
  Coding DNA sequence: Name=SeqID_4539
MLQSLVDQTTCKHNITTTKPKASMYHYRVTFRSGLGSCAHYRDLLVYHQWTNYNDSDYKN

SEQ ID NO: 10648 - protein, 367 aa, Xenorhabdus bovienii
  Coding DNA sequence: Name=SeqID_4540
  Gene classification: Gene name=CsdB; Function=Selenocysteine lyase; Function class=E Amino acid transport and metabolism
  Homolog annotation: Query=1..365bp; Hit=35..399bp; Blast score=443; Percent Identity=58.0; E value=1e-124; Homolog= csdA COG0520
MIEATQHYYQNHSATVHRSQHASAQAMTARYEQARSLVAELLNAPRPENIIWTKGTSEAINLTAQGYFRPRLNVDDEIIVSEQEHHSNLLPWLILAEQTGAKIVKWPIGNQNRPDINILAKLLNEKSRLVAISQMSNVTGTTVDLAQVTALAHQYDCLILVDGAQGIVHTPVDVQRLDIDFYAFSAHKLYGPNGLGVLYGKGELLDAMSPWQGGGKMLTQVSFNGFTPEAVPYRFEAGTPNVAGVVSFAATLEWLKTVDIPLAESHAVTLTDYAEQQLSIFAGFISYRAANASLLAFNIQGIHHNDLATLIAEQNISLRSGQHCAQPLLDALGISGCLRASFMPYNNRQDVDKLVSAVKFALSLLEE

SEQ ID NO: 10649 - protein, 152 aa, Xenorhabdus bovienii
  Coding DNA sequence: Name=SeqID_4541
  Gene classification: Function=SufE protein probably involved in Fe-S center assembly; Function class=R General function prediction only
  Homolog annotation: Query=10..139bp; Hit=7..136bp; Blast score=147; Percent Identity=58.0; E value=5e-36; Homolog= ygdK COG2166
MTSISDSILAPHPFGTEISEQQLIENFQQCQLWEDRYRQLIGLAKKLPPLADELKQQNIEMSGCENRVWLGHQLRSDGCLHFYGDSEGRIVKGLLAVLLTAVEGKTAEQVLQAPLSELFQHMGLEQQLSGSRLNGIKSLINTVQEIARSHLS

SEQ ID NO: 10650 - protein, 270 aa, Xenorhabdus bovienii
  Coding DNA sequence: Name=SeqID_4542
  Gene classification: Function=Dinucleotide-utilizing enzymes involved in molybdopterin and thiamine biosynthesis family 1; Function class=H Coenzyme metabolism
  Homolog annotation: Query=1..267bp; Hit=1..267bp; Blast score=436; Percent Identity=82.0; E value=1e-122; Homolog= ygdL COG1179
MQVSLSDAYLQRFAGTARLYGQKALSLFARSHVCVVGIGGVGSWAAEALARTGIGAITLIDMDDVCITNTNRQLHTLVQNVGLPKTEVIAERIRAINPECQVTCVDDFVTPDNVAELMSAEFSYVIDAIDSVRPKAALLAYCRRYKIPLVTTGGAGGQLDPAQIQVVDLAKTVQDPLAAKLKERLKSDYRVVKNSKGKLGIDCVFSTEQLVYPQSDGTVCAAKSTADGSKRMDCASGFGAATMVTATFGFIAVSHALKKMVAKAERENRL

SEQ ID NO: 10651 - protein, 365 aa, Xenorhabdus bovienii
  Coding DNA sequence: Name=SeqID_4543
  Gene classification: Gene name=MltA; Function=Membrane-bound lytic murein transglycosylase; Function class=M Cell envelope biogenesis, outer membrane
  Homolog annotation: Query=4..359bp; Hit=5..358bp; Blast score=504; Percent Identity=66.0; E value=1e-143; Homolog= mltA COG2821
MKLWGKYLLCGFVISLLSGCQVRPTDQGQQYKDGRISEDLQLVNIPNAQGSPINAGDFQAQVKFISKSSPRLYGNNRATLDAIQNWMLSGGDPRELNQFGLLAYQMDGDDNYGNVKFTGYYTPVLQARHVKQGEFKYPLYRMPGKSRFRLPNRAAIYNGALSEKFIIGYTNSLIDNFLMEVQGSGYIDFGDGNPLTFFGYSGKNGHAYQSIGKILVNRGEVPLEKMSLKAIRQWASQHNESEVRELLEQNPSFIFFKPEPFTPVRGASAVPLVAEASVASDKVLIPLGTALLAEVPVLDKTGKFTGQYRMRLMVALDVGGAIKGNHFDIYHGVGHDAGEAAGFYNHYGRVWVLKKSSPGFLTANQ

SEQ ID NO: 10652 - protein, 32 aa, Xenorhabdus bovienii
  Coding DNA sequence: Name=SeqID_4544
MTNPHKRYLPQSFILCLISCHHDSTTNNIKPR

SEQ ID NO: 10653 - protein, 415 aa, Xenorhabdus bovienii
  Coding DNA sequence: Name=SeqID_4545
  Gene classification: Gene name=AmiC; Function=N-acetylmuramoyl-L -alanine amidase; Function class=M Cell envelope biogenesis, outer membrane
  Homolog annotation: Query=1..415bp; Hit=31..446bp; Blast score=584; Percent Identity=70.0; E value=1e-167; Homolog= amiC COG0860
MSHSDYNSSRRNLLKGAAAMWLLSISSIGHAATSKIIAVRIWPASSYTRVTLEANIPLKYRQFSLSNPNRIVIDLQGVQLNSVLSGMGSQIHQRDPYLKLVRAGQFDPKTVRLVFEIKQPVAPHIFTLPPIAKFKHRLVLDLYPSKAANVEDDPLQALLEEYNSGDLKKNLPAEKRKPGRPGRNRPIVIMLDPGHGGEDSGAIGKYKTREKDVVLQIARRLQTLIKREPGMKVYMTRNEDVFIPLQVRVAKARKMQADLFVSIHADAFTNRTARGSSVFALSTKGATSNTARFLAQTQNEADLIGGVSKSGDEYLDHTMLDLVQTATINDSLKFGSEVLKRIGKVNKLHKNSIDQAGFAVLKAPDIPSILVETAFISNLEEERKLKTAKFQQQVAESIFAGIKAYFKSGVELARR

SEQ ID NO: 10654 - protein, 444 aa, Xenorhabdus bovienii
  Coding DNA sequence: Name=SeqID_4546
  Gene classification: Gene name=ArgB; Function=Acetylglutamate kinase; Function class=E Amino acid transport and metabolism
  Homolog annotation: Query=1..289bp; Hit=2..290bp; Blast score=469; Percent Identity=79.0; E value=1e-132; Homolog= argA_1 COG0548
MKERCTELVEVFRHSVPYINAHRGKTFVIMLGGEAIAHENFPNIVNDIGLLHNLGIRLIVVYGARPQIDQKLAEYHSQPIYHKHTRVTDAKTLELVKQSAGLLQLDITARLSMSLSNTPLQGANINVVSGNFIIAQPLGVDDGIDYCHSGRVRRIDEEAINQQLDNYSIVLIGPVAVSVTGESFNLTSEEIASQLAIKLKAEKLIGFCSSQGVLDAEGNILSEIVPNEGQARLNELESEGDYSSGTVRFLRGAIKACRRGVRRSHLISYRENGSLVQELFSREGSGTQIVMERSEQIRRANINDIGGILELIRPLEQTGILARRSREQLEMEIDKFTLIEHDNVTIACAALYSYPDEKIGEMACVAVHPNYRNSSRGEVLLNSIAGQARQAGLEKLFVLTTRSIHWFREKGFEPAEINMLPVEKQALYNYQRCSKILMLNLEIH

SEQ ID NO: 10655 - protein, 635 aa, Xenorhabdus bovienii
  Coding DNA sequence: Name=SeqID_4547
  Gene classification: Gene name=RecD; Function=ATP-dependent exoDNAse (exonuclease V), alpha subunit - helicase superfamily I member; Function class=L DNA replication, recombination and repair
  Homolog annotation: Query=8..622bp; Hit=7..601bp; Blast score=603; Percent Identity=55.0; E value=1e-172; Homolog= recD COG0507
MSDMKLLLQQAVAQKLLRPLDVQFAYAMIENGDPLLLLVMALVSAESGAGHVCLPLERISPEYLFEGRQPELAASLWSSAGKPNQQQVISALQACSAVSTGESPTPIILSRHALADYRLYMQRMWQSERRIAEFFSSVEFSDDIDEVQLRRILDELFGVTAEGEIDWQKVAAAVAVTSRISVISGGPGTGKTTTVAKLLAALIKLNEGKTLSIQLAAPTGKAAARLTESLSEAVDKLALTSQQSNSIPEQAQTIHRLLGAQPDSQKLRYHRDNPLSLDILIIDEASMVDLPMMARLIEALPPRAKVIFLGDKDQLASVEAGAVLGDICRFSEQGYSTKRAEQLSQLTGCQLTSYSMPDSGEHALAVRDCLCLLRKSYRFNSASGIGQLASAVNQGNSVGVSAVLSRSLPDVHFNPLSGDEDYQRLLTQTAEGYYRYLAMVNEQAADKDILAEFNRFRLLCALREGPFGVSGLNQRVEQLLHRKGVISLPRNAESRGYAGRPIMILRNDSTLGLFNGDIGIMLRNKDNELKAHFQLSDGTIKPFQPSRLPQHETAYVMTVHKSQGSEFEHTALVLPTQFSPVVSRELVYTALTRAREKLTLYAHKPVLDKAVGTSTQRRSGLAEWLKPQGKCQSGQ

SEQ ID NO: 10656 - protein, 1205 aa, Xenorhabdus bovienii
  Coding DNA sequence: Name=SeqID_4548
  Gene classification: Gene name=RecB; Function=ATP-dependent exoDNAse (exonuclease V) beta subunit (contains helicase and exonuclease domains); Function class=L DNA replication, recombination and repair
  Homolog annotation: Query=10..1203bp; Hit=8..1179bp; Blast score =1340; Percent Identity=57.0; E value=0; Homolog= recB COG1074
VSTEILNHKLNPLTLPLHGQRLIEASAGTGKTYTIGLLYLRLLLGLGGDAAFFHPLNVEEILVVTFTEAATDELRGRIRENIHQLRLACIREGTEGSDPVYQQLLDQIPDRASAASWLLAAERQMDEAAIYTIHGFCQRMLVHNAFESGVLFDQTLIQDEYPLRKQGCADFWRRHCYPLSLSMATVINQEWSGPEALLKDVSSHLQGDMPYIVNAPASDETLIGRHEKIIGLIDTVKHQWNDVASDLHDLIANSDVDKRSYSKKHLPNWLNSVSEWAKSQTSDYQLPKDLDKFCQSRLAEKTKKGEAPQHPVFTVIDDLYQQPLTLRDIIISKAIVEIRQSVNQEKLMRGHMGFDDLLTRLDSALQREGGEQLATTIRQRYPVAMIDEFQDTDPQQYRIFQAIYRDQPQNEQRENGLLFIGDPKQAIYAFRGADIFTYIRARSQVSAHYTLETNWRSSVPMVQAVNKLFSHTERPFLFSQIPFINVKAAEKNHNLRFLFHNQEEAALQFWLQPGEGISKGQYEQSMARHCAAQIRDWLLAGQLGQAFLQQAEKSQPVTAADITVLVRNRREAALIRDELNALKIPSVFLSNRDSVFDTPEAKDLLWLLQAVLSPEKERELRSALASSLFGLSAQQIDQLNHDETAWDQLVDEFSGYARLWRFRGVLPMLRAVMVKYQIAENLLAGYDGERRLTDVMHIGELLQETSLQLDSEHAVVRWLAQQISRPDPQSETQQMRLESDKHLVQICTIHKSKGLEYPLVWLPFICSFRKQEQAIYHDRQSFETHFSIFQDDEKKALADEERLAEDLRLLYVALTRSIYHCSVGVAPLIQGNKKKAGNTDLHLSALGYLLQKGQQGDAQLLADSLDELSNGDIQVTLMEETDDAQWCSQNDNDSLLAARKFRRSIQDDWRVTSYSGLQYSSSHSISHAYASAFGESVDVIVQSIAPKLDIDARGEKQEEPSSQMTPHTFPRGASAGTFLHSILEDLDFSELPEQMWLAEKLTAAGFDENWAPVLQQWIADFVTAELNEQGMQLAHVPRHQQQSEMQFYLPVDKLLHSHALSALTRRYDPLSAQCTPLSFHQVRGMLKGFIDLVFCWQGKFYVVDYKSNWLGESSQSYTQEAMTRAMIEHRYDLQYQLYTLALHRYLRHRLANYDYQQHFGGAIYLFLRGIDKANPGHGVYRYLPPIEFVDELDRLFSAAGEEQGV

SEQ ID NO: 10657 - protein, 961 aa, Xenorhabdus bovienii
  Coding DNA sequence: Name=SeqID_4549
  Gene classification: Gene name=Ptr; Function=Secreted/periplasmic Zn -dependent peptidases, insulinase-like; Function class=O Posttranslational modification, protein turnover, chaperones
  Homolog annotation: Query=1..956bp; Hit=1..956bp; Blast score=998; Percent Identity=50.0; E value=0; Homolog= ptr COG1025
MPKYVIRIMTMLFLLFWGTTAYAKLPWQPLPETINKSERDLRQYKAIQLPNGMTVLLVSDEKAIKSLAAISVPVGHMENPDNQLGLAHYLEHMVLMGSKRYPQSGGFTEFLQKHSGSHNASTSSNRTAFYLEVENGSLTEATDRLSDALAEPLLDPVNADRERHAIDNEMTIARAGEGHRIWQVRSETLNPAHPNARFGGGNLETLKDKPDSKLQTALTDFYQRYYSANLMKGVLYGHQPIDKLAHIAVETFGRIPNRHASVPAITVPAITDKEKGIIIHYVPSKPYKSLQLEFSIADNSADFRSKTDTYLGYLIGNRSANTLSDWLQKQGLVEGISASASPTTDGNSGTFGIDVSLTDKGFEQRDRVIAAIFSYINLLKQKGIEKSYFDEMAKVLNLSFEYASIVRDMGYIQWLSDVMQDVPVSHVLDVGYLADEYNPQAISSRLAELTPENARIWFTGPEEPHNKEAYFVHAPYQVNKITPQQRTEWRKLEKEVSLSLPELNPYIPDDLSLIKASGSQKHPKMIFEQPNVRLLYMQSQYFMDEPKSIITLNMRNADGMSNAKDQVTYSLLSYLSDMGLDQLGYQASVGGMGLTLGYSEGLQIGVSGYTQHLPELLTSAISQYITFTPTQEELNQAKSRYRDQVKAVNNGKAYEMATHPVSRLSRVPYFEQADRLKVLDTITIDDIVKYRQRMIQHSALQAGIFGNLTEKQSIDIVKSAHKQLANQGTTWWSGDHIVVDRDYAVNFKGTASSTDNALSEVYIPTGYDRINGYIYSNLLGRILSPWFFEQLRTSEQLGYVASAFNTSVGEQSGLGFLLQSNSKQPDYLHQRYQSFYQQAAKKLQAMSDADFKQYKKALLTEMRQPPETFYAEASRYNYDFGSNNFKFDTHEKTIAATEKVTKAQLIAFYDKAVMKRQGLALISQITGKKGTAHQYAELTGWKTYSNVSDFQKQLPVKVNAQ

SEQ ID NO: 10658 - protein, 1131 aa, Xenorhabdus bovienii
  Coding DNA sequence: Name=SeqID_4550
  Gene classification: Gene name=RecC; Function=Exonuclease V gamma subunit; Function class=L DNA replication, recombination and repair
  Homolog annotation: Query=1..1121bp; Hit=1..1116bp; Blast score=1257; Percent Identity=57.0; E value=0; Homolog= recC COG1330
MFRVYHSNQLDILKELMAIFIGENPLADPFGKEVVLVQSPGMSQWLQIQLAEKLGIAANMEFPLPATFIWQMFTQVLPDVPKDGSFSKDAMKWKLMTLLPGLLTEPEFSSLRHYLDQDIDKRKIHQLAGRVADLFDQYLVYRPQWLESWESDQSIDGLSDNQAWQKRLWLELTEYTRQLEQPLWHRANLYHRFISTLQEGRFPLEKLPARVFICGVSTLPPAYLQIFKALGQHIDIHLMFTNPCLYYWGDIQSYAFLAKLNSRKPKHYQSQQSLERFRDPENASSLFNDEGEQSLNNPLLASWGKLGRDNLYLLSQLEPDSDVHAFVELEPGCILHQIQRDMLNLEDHAQIGSTEHSFKNSLKKRQIDGEDRSLSFHSCHSPQREVEVLQDQILRLLDDDPSLTPRDIIVMMADIDSYAPYIQAVFGNAPEERYIPFAISDRKARQAHPVLQAFITLLELPQSRFTAEQVLALLEVPALASKFAIQEDGLRLLRRWVKESGICWGLDDDNIEALSLPATGQNTWRFGLTRMLLGYAMDSHAGPWNDVLPYDESSGLAAELAGQLAEFLMELNRWRKILSEEQGLSDWLAVCPQLLETFFDADEETELVLALITQQWQKVIDNGLNAHYSESAPLVLLRDELALRFDDEKISQRFLAGSLNFCTLMPMRSIPFKVVCLLGMNDGVYPRTIPPLGFDLMAEKSQRGDRKRRDDDRYLFLEALISAETCLYISYIGKSIRDDTECNPSVLVNELLDYVCQSCCLPGDEMLNVDDSARNVRNHLLLQHTRVPFAMENFVPDHYQQSYAAEWLPAASQQGVSPVDFCQPIGFESSEIKEVTLDELSRFYRYPVRAFFQRRLKVHFVIEETELPEEEPFVLDHLQRYQFNQLLLNILIEEGSPESLFYHLRASGGLPHGAFGEVYWLNQLEAMQPLANKIREERTESSFIDLHHELDTVVLTGKIHQVQPDGILRWRPANLMANDGIQLWIEHLAYCFSGNNGDSESRMYGRENSEWRFSPLTSDEAKKYLNQMVAGYFQGMSEPLPLFCRSGWAWLDDCFDRESQEINFSAEAQQKAENKLMQQWLGTQGKSGESSDAYVQRAFRQVDQLFWVRMKREVQSYLLPMACHLSRSSSK

SEQ ID NO: 10659 - protein, 125 aa, Xenorhabdus bovienii
  Coding DNA sequence: Name=SeqID_4551
  Homolog annotation: Query=9..125bp; Hit=9..125bp; Blast score=114; Percent Identity=52.0; E value=4e-25; Homolog= ref|NP_927974.1|
MKRFHLHRHERQNGMSLPEVMLASVVFAISLLGLMRYHQALSSNFQQYWLQLKAVRLAHDQLEQYERLKGQMVLEETESQQGWKIELQREFRSLGCYQITVNVTKSYNQSNKLERWFCASGSIDV

SEQ ID NO: 10660 - protein, 132 aa, Xenorhabdus bovienii
  Coding DNA sequence: Name=SeqID_4552
  Homolog annotation: Query=1..131bp; Hit=24..160bp; Blast score=142; Percent Identity=53.0; E value=1e-33; Homolog= ref|NP_927973.1|
MLMALSLMMLKALHYQQESAMLMMMDEKKYLNAFQRAESSLEWGKVQSWQFNAQEEENWFCQQQPEFHLQSCLKHYADNLFLLKGVAQFASGETLELYQWMKQMKNANRDTLIPIESGWLDFCPVPQAEFCL

SEQ ID NO: 10661 - protein, 203 aa, Xenorhabdus bovienii
  Coding DNA sequence: Name=SeqID_4553
  Homolog annotation: Query=12..202bp; Hit=6..194bp; Blast score=238; Percent Identity=56.0; E value=3e-62; Homolog= ref|NP_927972.1|
MTLAIPLFKGKQTGFSLLEVMVAMLISSVIFIAMTKTYPVLSGQILDLYRKYRLHYLVNRTVYMMEKDLRRAGYCRDRKQCEGEPLLINNKNTEAANSCFIVAFDLNLNNQWEKPDYIESEFFGYRLNNHVLEWKRGVENCQGNGWERLFDPMEVRVDVFHLEKSQEKNGLIFITLSINTRWLKSPSIIYRHQMTVRLRNIRK

SEQ ID NO: 10662 - protein, 171 aa, Xenorhabdus bovienii
  Coding DNA sequence: Name=SeqID_4554
  Gene classification: Gene name=HofG; Function=General secretory pathway proteins G and H and related periplasmic/secreted proteins; Function class=N Cell motility and secretion
  Homolog annotation: Query=12..155bp; Hit=4..147bp; Blast score=74; Percent Identity=33.0; E value=5e-14; Homolog= ZppdA COG2165
MATKNGGSINGQSGFTLLELLIAMSLISMSLSWGLYHWGQYQNRLRLQSAVQNVLSFMERQQGLANYMNQERTLWLVIGQTWCLISSVSRISDCHEGEGERVNSPYDDVFLASATSDRIDFYGVRNTAMPASFVLANSAGEISVVISGRGRIRTCSNDISQLPNCEGIKGS

SEQ ID NO: 10663 - protein, 65 aa, Xenorhabdus bovienii
  Coding DNA sequence: Name=SeqID_4555
MASRYFLILRTTADKCKKSRLNPLFNNLVDTLHLLLGIGLNRDWGFNTRMRIIIHNLKVFEPIIK

SEQ ID NO: 10664 - protein, 264 aa, Xenorhabdus bovienii
  Coding DNA sequence: Name=SeqID_4556
  Gene classification: Gene name=ThyA; Function=Thymidylate synthase; Function class=F Nucleotide transport and metabolism
  Homolog annotation: Query=1..264bp; Hit=1..264bp; Blast score=499; Percent Identity=87.0; E value=1e-141; Homolog= thyA COG0207
MKQYLDLMKKVLAEGTAKDDRTGTGTLSIFGHQMRFNLQEGFPLVTTKRCHIRSIIHELLWFLNGDTNTQYLRDNNVTIWDEWADENGDLGPVYGKQWRAWGSADGRQIDQLAKVLEQLKSDPDSRRIIVSAWNVGELDKMALAPCHAFFQFYVAKGKLSCQLYQRSCDVFLGLPFNIASYALLVHMLAQQCDLEVGDFVWTGGDTHLYSNHLEQTELQLSREPRALPKLVIKRKPASLFDYRFEDFEIVDYDPHPGIKAPVAI

SEQ ID NO: 10665 - protein, 292 aa, Xenorhabdus bovienii
  Coding DNA sequence: Name=SeqID_4557
  Gene classification: Gene name=Lgt; Function=Prolipoprotein diacylglyceryltransferase; Function class=M Cell envelope biogenesis, outer membrane
  Homolog annotation: Query=1..279bp; Hit=1..281bp; Blast score=400; Percent Identity=74.0; E value=1e-111; Homolog= lgt COG0682
MSTSYLAFPNIDPVIFSIGPVSLHWYGFMYLVGFIFAMWLANRRAAKPNSGWNKNEVESLLYTGFVGVFVGGRLGYVLFYNLPMFLDNPLYLFKVWDGGMSFHGGLVGVICAMWWFARRTKRHFLQVSDFVAPLIPFGLGMGRIGNFINGELWGRVTLDTPWAILFPSSRSEDIALATTDPSLWPILEKYGVLPRHPSQLYEMVLEGIVLFIILNLFIRKPRPMGSISGLFLIGYGAFRIIVEFFRQPDAQLGLFEGISMGQILSIPMILVGILMMIWACKCPRNNKIQEAK

SEQ ID NO: 10666 - protein, 748 aa, Xenorhabdus bovienii
  Coding DNA sequence: Name=SeqID_4558
  Gene classification: Gene name=PtsP; Function=Signal transduction protein containing GAF and PtsI domains; Function class=T Signal transduction mechanisms
  Homolog annotation: Query=1..748bp; Hit=1..748bp; Blast score=979; Percent Identity=65.0; E value=0; Homolog= ZptsP COG3605
MLMRLREIVEKVAMAANLSEALELLVNETCLAMSTDVCSIYLADHQRYCYYLMATRGLKKPKERAISLAFDEGVVGEVGRLSELINLADVRDHPSFKYIPQVKEEGLRAFLGVPIVYRRQLQGVLVVQQNERRLFNESEESFMVTLAMQLAVILAQAQTKGLFGQYRQTRIKALAISSGIVMAQGWQDGSQPSLEQVFEASTLEYQAERSRLTEALEQATAECRRISKRFTSSSQKESAAIFDLYSHLLNDPKLKQDLFSSVDNGFVAEWAVKSVVEKYAEQFASLQDPYMRERASDLRALGQRVLFHLDGSFTGDSEWPERFILVADELSANLLAEMPQEQLAGVIVRDGATHSHSAILVRAMGIPAIMGADIQPELLHNRMLILDGYRGEVFVEPEPLIIQEYRQIIEEEQVLSELAEGELKQKAQLKNGERVLVQLNAGLSLKYEQQIGGSIDGVGLYRTEIPFMLHRGFPSEDEQKNRYQEMLALLPDKPVVLRTLDIGADKQLPYMPISEENPCLGWRGIRITLDQPEIFLIQLRAMLKANVLIGNLKILLPMVTSIEEIDEAKKLIDRAKAEVEQTIGSTITLPQIGIMVEVPSTIFLLPQLKKRIDFISIGTNDLTQYLLAVDRNNTHVAALYDNLHPAVIKALKLAFDESQRVGLPVSICGEMAGLPMGALILIGLGYRSLSMSGRSVPRIKYLLRHLDTNDLELLIKEILKAETSQQVKALSTEFMEANGLGGLVRGGI

SEQ ID NO: 10667 - protein, 176 aa, Xenorhabdus bovienii
  Coding DNA sequence: Name=SeqID_4559
  Gene classification: Gene name=MutT; Function=NTP pyrophosphohydrolases including oxidative damage repair enzymes; Function class=L DNA replication, recombination and repair
  Homolog annotation: Query=1..175bp; Hit=1..175bp; Blast score=282; Percent Identity=81.0; E value=1e-76; Homolog= ygdP COG0494
VIDDDGYRPNVGIVICNRQGQVLWARRYGQHSWQFPQGGINPGESPEQAMYRELFEEVGLNRKDVRVLASTRSWLRYKLPKRLVRWDTKPVCIGQKQRWFLLQLLCNEVDINVQRSNAPEFDGWRWVSYWYPVRQVVSFKRDVYRRVMKEFSSIVMPVQESAPQLHSPYLHRRRRS

SEQ ID NO: 10668 - protein, 54 aa, Xenorhabdus bovienii
  Coding DNA sequence: Name=SeqID_4560
MENTFISMISVSNSYVGTSRIRFDGFFSEMRFYNSSTPLRWRYCRDFRYGCKVQ

SEQ ID NO: 10669 - protein, 337 aa, Xenorhabdus bovienii
  Coding DNA sequence: Name=SeqID_4561
  Gene classification: Gene name=TbpA; Function=ABC-type iron/thiamine transport systems, periplasmic component; Function class=H Coenzyme metabolism
  Homolog annotation: Query=28..337bp; Hit=18..327bp; Blast score=462; Percent Identity=70.0; E value=1e-130; Homolog= tbpA COG1840
VFKNLFSRFIAISTLSISACVFAQTAQAKPTLTIYTYDSFASEWGPGPAIKKAFEAECNCELKLVALEDGVSLLNRVRMEGKKTSADIVLGLDNNLIQAAQQTGLFTPSHIDTSKLKLPVTWNSATFIPYDYGYFAFVYNKNTLPHPPKSMDELINSNQNWKIIYQDPRTSTPGLGLLLWMQDIYGDKAVQEWPKVAKKTLTVTKGWSEAYGLFLKGEGDMVLSYTTSPAYHILSEKKDNYAAAIFSEGHYLQIEVAAQLASSKQPELAQKFMQFMISPAFQQAIPTTNWMYTVIDIPLPEVFKKLPVPEKPLQFSADDVAKHRNQWIRTWQSAVSR

SEQ ID NO: 10670 - protein, 534 aa, Xenorhabdus bovienii
  Coding DNA sequence: Name=SeqID_4562
  Gene classification: Gene name=ThiP; Function=ABC-type iron/thiamine transport systems, permease components; Function class=H Coenzyme metabolism
  Homolog annotation: Query=1..531bp; Hit=1..531bp; Blast score=629; Percent Identity=72.0; E value=1e-180; Homolog= ZyabK COG1178
MAKRRKPLIAGWLLPGVIASGLLLVVALSAFGALWFNAPESHWQGFLDDSYLWHVIRFTFWQAFLSAVLSVTPAIFLARALYRRRFPGRALFLRLCAMTLVLPVLVALFGILTVYGRVGWLANISQWMGIEYRFTPYGLQGILLAHIFFNMPMAARLLLQSLENIAIEQRQLAAQLGMNEWQHFRFVEWPYLRRQILPTGALIFMLCFASFATVLALGGGPAATTIELAIYQALSYDYDLAHAALLALIQLFCCLGLVLVSQKLKGTLFVGYGHQQQWRNPQDSWLQKGCDGLFIVMALLLLIPPLLAVIVDGLNGAVLNVLHQPALWQAFTTSAIIALGAGLLCVMLTMMLLWSSRELHLRHSPRWGQAMETSGLLILAMPGIVLATGFFILLNTTVGLPHSPYGLVILTNGLMAIPYALKVLDNPMRDLAERYNPLCRSLNIQGIHRLRWIELKALKIPLAQALAFSCVLSIGDFGVVALFGNEDFRTLPFYLYQQIGAYRSQDGAVTAFLLLLLCFILFSVLERLPGRRHD

SEQ ID NO: 10671 - protein, 231 aa, Xenorhabdus bovienii
  Coding DNA sequence: Name=SeqID_4563
  Gene classification: Function=ABC-type thiamine transport systems, ATPase components; Function class=H Coenzyme metabolism
  Homolog annotation: Query=1..230bp; Hit=1..230bp; Blast score=276; Percent Identity=60.0; E value=1e-74; Homolog= ZyabJ COG3840
MIKLENVIYTYEHLAMHFHVNIEAGERVAILGPSGAGKSTLLSLMAGFQSAESGDIWLNDENHTHTSPSKRPVSMLFQENNLFSHLTIEQNIGLGLHPGLRLTGEQQKTLQQIAAQVSLQDYLNRLPAQLSGGQRQRAALARCLVRQQPILLLDEPFSALDPALRNEMLELLTQVCDARRLTLMMVSHNLDDAAKIAPRSLLIVDGRIYYDGATAKLVNGEAPEAAILGIG

SEQ ID NO: 10672 - protein, 35 aa, Xenorhabdus bovienii
  Coding DNA sequence: Name=SeqID_4564
MALQAGAWLHGVAQMVSFNHSSYPQNRRLRRFPIN

SEQ ID NO: 10673 - protein, 163 aa, Xenorhabdus bovienii; identical to SEQ ID NO: 7546
  Coding DNA sequence: Name=SeqID_4565
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 10674 - protein, 117 aa, Xenorhabdus bovienii; identical to SEQ ID NO: 7849
  Coding DNA sequence: Name=SeqID_4566
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 10675 - protein, 185 aa, Xenorhabdus bovienii
  Coding DNA sequence: Name=SeqID_4567
MTTPSNHLKKCHDFYIRNIYKPQTLVIKRKYKTDINRNISISYAKFVMKSFKAILQTARVGFGLRHSNQRTHMMKSLKLSVAALLVLFSSTALAAPAVSLEHASKTATAVEHNVKTAKDNVSSLEKKVTKGSKSQKASQKNNSKKSKAGSAEKGANSALCKDGTYSKSKTHKGACSRHGGVAKWL

SEQ ID NO: 10676 - protein, 95 aa, Xenorhabdus bovienii
  Coding DNA sequence: Name=SeqID_4568
MRLTDDKKIRKSIIRLFTFTEQIIMLKSFRLVKHETRDDFSNWLKGLAYNFMESAKNTTFFSIILAVFTYISPPKSHYAVLIFNNLIFIYPVFYV

SEQ ID NO: 10677 - protein, 146 aa, Xenorhabdus bovienii
  Coding DNA sequence: Name=SeqID_4569
MKSKIVLSEPERITLQQLALNHQHRGIRTRGTGLLMLARGLKPRQIAVETGCSVRVIYNWVHTWHDFGIAGLLGGHAGGRYLAMTPEMIATAVEIACSESLTLARIALGVEEKHGPLPCTLETLAKTLKKQGLTYKRARLSLKKTR

SEQ ID NO: 10678 - protein, 178 aa, Xenorhabdus bovienii; identical to SEQ ID NO: 8288
  Coding DNA sequence: Name=SeqID_4570
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 10679 - protein, 169 aa, Xenorhabdus bovienii
  Coding DNA sequence: Name=SeqID_4571
LNKARIIGCGYLVGIKLFIFCINHKIFFVPESQNKAYPPLNTQGIKIYIDDDKKARKRITDIFTFKEQLTLLRCFSLERENTHGDFLAWINKTSADFFSSIKMMLIILFIFFIISIIKYYEAWNYILVTFFIFMMPLMTLICIFFTSHMMGCKFITSVKLLYFHLRNEI

SEQ ID NO: 10680 - protein, 257 aa, Xenorhabdus bovienii
  Coding DNA sequence: Name=SeqID_4572
  Gene classification: Gene name=Bax; Function=Uncharacterized FlgJ -related protein; Function class=R General function prediction only
  Homolog annotation: Query=5..249bp; Hit=6..271bp; Blast score=199; Percent Identity=44.0; E value=2e-51; Homolog= Zbax COG2992
MPSLIMRTTAVFAFFLSLIFTGLSYASTSTSKMKEYSHNGIQESLPDLRQYPSGTPRKKAFLNIVVPVIDEHNQKIMQDRKWLLSHQKTRHWSVQDISRLQKICASYKMACTSPKQVNWNKLLSRVDIIPTHFVATQAAAESGWGTSELAKKNNNLFGMRCNSCSKTKGKIKGYSVYRNVDDSVIAYMKNMNTHRAYESLRTSRAKQRTTQTPLNTSKLIDNLNGYSELGAHYNRYLHQVFNGNKKLISQAQELTDP

SEQ ID NO: 10681 - protein, 473 aa, Xenorhabdus bovienii
  Coding DNA sequence: Name=SeqID_4573
  Gene classification: Gene name=DltB (BS); Function=Predicted membrane protein involved in D-alanine export; Function class=M Cell envelope biogenesis, outer membrane
  Homolog annotation: Query=1..473bp; Hit=1..478bp; Blast score=268; Percent Identity=39.0; E value=7e-72; Homolog= NMA1478 COG1696
MNFFSFEFLGSFVILLLAYWLLQKAPKLQNGLLILVSYLFIFSFAAKFAYILFAYTLFIYFLANILSRYLSNKAIFTLLIFGIVGCFTAFKYYSFFQETIQQSLANLGISVELPILELLMPLGLSFYAFHSVSYVMSVCKKELPPAPLLDVILYLCFFPSIVAGPINRAKDFLPQIQASSRVMLEPFKALLLIALAIAKLFLLSSTLSENFVNPVFDDPTGYHAGQVLVAIYAYAWNIYFNFSGYTDLVTGIALLLGFTVPQNFNAPYLAENLQEFWRRWHISLSTFIRDYVYIPLGGNKKGTVRKNMNLFSAMVISGLWHGAGLSFIIWGAIHGLGLIFHNIKNALFPSTGNRNKTRRKNPISLFLSRVMTFHFVCFAWVFFRSPTFNDALVVLNQLCSGDVFTALLSSSTLLVAFWGFFIIYPWLVNIRDTMEKNHSLMSWVYYPIPLALILTLVFMLSPSGMPGFIYANF

SEQ ID NO: 10682 - protein, 378 aa, Xenorhabdus bovienii
  Coding DNA sequence: Name=SeqID_4574
  Gene classification: Function=Uncharacterized BCR; Function class=S Function unknown
  Homolog annotation: Query=20..367bp; Hit=11..316bp; Blast score=226; Percent Identity=36.0; E value=4e-59; Homolog= NMA1479 COG2845
MPTSEFISNLKKVGQVMFIVTLTSLLLIWLNQRSLDSFWQQKYHRNSPWTALKGEPVWDLGSNMQQGAIAAGEIFMAYVRGIHQDNQRQALNINETPSIILPDFQVGLRFLEGYTYSIESRYLTFPDLLHKDVRHTQSSLLRNHSPSNAVIEITPKTNVSLGKKDQVLFAGDSMMQGVAPHLKRRLYQEHGIASINLSKQSTGLAYPGFFDWPKTIGDTLRKNPDIKLVVVFLGPNDPWDMPTKRGGAYLKFASEDWENLYRQRIETILNDAHQHKVDVIWVGPPNMRQKKLSGGMAYLNKLYQAEVAKMGEIYVSVNDMFKYRSENYSDYIGDGSSTIKLRSGDGIHFSLNGQQTIANAIFSLMTFIQEPVKKDATI

SEQ ID NO: 10683 - protein, 404 aa, Xenorhabdus bovienii
  Coding DNA sequence: Name=SeqID_4575
  Gene classification: Gene name=TesA; Function=Lysophospholipase L1 and related esterases; Function class=E Amino acid transport and metabolism
  Homolog annotation: Query=21..402bp; Hit=20..390bp; Blast score=201; Percent Identity=34.0; E value=1e-51; Homolog= NMA1480 COG2755
MQPFRPFRWFYRITGAGLVIALSVSLLSCHGKKSKPSSELQTTQIHRQNQLTNFGDPNFPLLADKLRHSNSRQLHFVQLGDSHTAADFFTGKLRSLLQNRYGDAGPGFISPISIPGQRTATVKFTDDKKNWWLSSSRKDNRADYPLGGFIATPENVSSTIRMNLSPSAFEKYGISALYQSHEASQIRTQFSQWDLPATQSEWQFSQQHSVFFPLRVDAQDTHLKIGGWLIKRQSSGIMLSALGINGATISMLDKWQPQWINTLVQLKPDMVILAYGTNEAFNDSLDLVAYQKELTSKVQEIRKAMPEVVILLIGPSDSLKNKTAVSCAEQQPALLNGIIQAQQAVAKQQHTLFWNWQEFMGGSCSIRSWQQQNLARPDYVHLSAAGYERSAEALYSQIVGLIEQ

SEQ ID NO: 10684 - protein, 446 aa, Xenorhabdus bovienii
  Coding DNA sequence: Name=SeqID_4576
  Gene classification: Gene name=GntT; Function=H+/gluconate symporter and related permeases; Function class=G Carbohydrate transport and metabolism
  Homolog annotation: Query=1..446bp; Hit=1..446bp; Blast score=548; Percent Identity=78.0; E value=1e-156; Homolog= gntU COG2610
MTTLTLVLTAVGSVLLLLFLVMKARMHAFIALMLVSMGAGIFSGMPLEKITQTMQNGMSGTLGFLAIVVALGAMFGKILHETGALDQIAVKLLGSFGEKRANYALGIAGLICALPLFFDVAVVLLIGVVFAVARRTGGNVVKLAIPLFAGVAAAAAFLVPGPTPMLLASQMGADFGWMILIGLSAAIPGMLLAGPMYGNFISKHVTLELPEDLNTPSIGKSQMPSFGFSLALVLFPLVLVGLKTIAARFVDQQSTLYQWLEFVGHPFTAILIACLVAIYGLAIRRGMSKDRVMEVCSAAIQPAGIILLVTGAGGVFKQVLVDSGVGPALGNALVGAGLPIALACFILAGAVRVIQGSATVACLTTVGLVLPVIGELGYSGAQMAALSVCIAGGSLILSHVNDSGFWLFGKFTGATEVQTLKTWTIMETILGTTGAIIGMIYFAMLS

SEQ ID NO: 10685 - protein, 179 aa, Xenorhabdus bovienii
  Coding DNA sequence: Name=SeqID_4577
  Gene classification: Gene name=GntK; Function=Gluconate kinase; Function class=P Inorganic ion transport and metabolism
  Homolog annotation: Query=14..173bp; Hit=1..160bp; Blast score=233; Percent Identity=71.0; E value=9e-62; Homolog= gntK COG3265
MSNTQQPNHVFVLMGVSGSGKSAVASGVARKLGAAFLDGDFLHPRANIIKMAQGHALNDDDRQPWLKALNDAIFAMQRTNNVSLLVCSALKKNYRDMLRNGNKNLSFLYMQGDFDLIESRLKARKGHFFKPQMLISQFEALEEPTDDEKDVYHIDIKPDLDEVIKNTITTIDRITEGHS

SEQ ID NO: 10686 - protein, 312 aa, Xenorhabdus bovienii
  Coding DNA sequence: Name=SeqID_4578
  Gene classification: Gene name=PurR; Function=Transcriptional regulators; Function class=K Transcription
  Homolog annotation: Query=1..312bp; Hit=10..321bp; Blast score=432; Percent Identity=68.0; E value=1e-121; Homolog= ZgntR COG1609
MTVSRFLRNPDQVSEALGKRIAETLDQLGYIPNRVPDILSNATSRTIGVLLPSLTNQVFAEVIRGIEQVTDRNGYQTMLAHYGYSAQKEEERLLSLLSYNIDGLILAERTHTPKTLKVLETAGIPVVELMDSVSPCLDIAVGIDNFEAARQMTVAMIERGCQNVIYLGARQDERTLIRLDGYEMAMRSVGLQPRNVMTPASSSYSLGAQLLRETCQKYPDVDGLFCTNDDIAIGAIFECQRQGINVPEQIAVAGFHGHDVGQVMMPKLASVLTPRDLIGRRAAEALFARLKGQKLEQTLIDVGFTLSLGESV

SEQ ID NO: 10687 - protein, 324 aa, Xenorhabdus bovienii
  Coding DNA sequence: Name=SeqID_4579
  Gene classification: Gene name=PurR; Function=Transcriptional regulators; Function class=K Transcription
  Homolog annotation: Query=1..319bp; Hit=1..327bp; Blast score=283; Percent Identity=45.0; E value=3e-76; Homolog= VC1286 COG1609
MITLEDVASYSGVSRATVSRVVNGDKKVKAATRTKVENAIVELGYSPNLAARELASNQSNTLGLVTTSYRGGFFGALMDSIQTEAESHGKQLLVMQGRNRAENEWQAIMHLHSLRCGGMILHVRAISDDKLRQLAQSGRSFVLLDRLVSGLEPRCVVFDHHKASYLATQTLVEHGHTRIACVSGPLSRNPSQQRRQGFLDAMQDAGLNPVACLEGEYDLQSGYRQTRTILAKSRPDALFFCSEEMALGALLAITELGLCVPEDISIICYDRGERAAFVYPALTSVHFPITDMACFATRLLIEPDTPPPEFTPQIIYRNSLRQSK

SEQ ID NO: 10688 - protein, 436 aa, Xenorhabdus bovienii
  Coding DNA sequence: Name=SeqID_4580
  Gene classification: Gene name=CelF; Function=Alpha-galactosidases/6 -phospho-beta-glucosidases, family 4 of glycosyl hydrolases; Function class=G Carbohydrate transport and metabolism
  Homolog annotation: Query=4..435bp; Hit=6..436bp; Blast score=511; Percent Identity=58.0; E value=1e-145; Homolog= VC1284 COG1486
MKPIKIAVIGGGSSYTPELVEGIIQRSQTIPLSELALVDVEAGRHKLEIIAALTRRMLDRHDLDYVTVTVHYSPDEAIKGASFVLTQLRVGQLPARAADERLGLKYGLLGQETTGVGGFAKALRTIPVLLDIAHKVERLAPEAWIINFSNPAGVVTEAVSRYSKAKIIGLCNVPISMHHMIANMLQRPYQDVQLRFAGLNHMVWVHQVLVNGRDETDQVLELLCNGAELTMNNIKEEPWPPEFLQALGAIPCPYHRYFYQTGKMLQEEKESAASKGTRAEQVMQAERELFELYADPKLDHKPAQLSFRGGSFYSEVALELISAIHNNLGTQLVVNTANRGAIIGLPDDAVIEANCIVDAQGAHPLAFGHLPDSMSALTQQVKAFERLTIEAAVHGDRKVALLALVTHPLIGDAALDSSLLNEILEINHMYLPQFKR

SEQ ID NO: 10689 - protein, 115 aa, Xenorhabdus bovienii
  Coding DNA sequence: Name=SeqID_4581
  Gene classification: Gene name=CelC; Function=Phosphotransferase system cellobiose-specific component IIA; Function class=G Carbohydrate transport and metabolism
  Homolog annotation: Query=6..107bp; Hit=13..114bp; Blast score=80; Percent Identity=43.0; E value=4e-16; Homolog= celC COG1447
VNISFEQQDFEQQIVELLVHAGSARSSALMALQQAKAGDFQQAGMLMEEARQETRAAHAIQTKLIGLDEGCGKLPINLITVHAQDHLMNAMVIQDLASNMIDLYQRLPPQDRQSE

SEQ ID NO: 10690 - protein, 436 aa, Xenorhabdus bovienii
  Coding DNA sequence: Name=SeqID_4582
  Gene classification: Gene name=CelB; Function=Phosphotransferase system cellobiose-specific component IIC; Function class=G Carbohydrate transport and metabolism
  Homolog annotation: Query=1..435bp; Hit=4..438bp; Blast score=414; Percent Identity=53.0; E value=1e-115; Homolog= VC1282 COG1455
MSFYTSLTRIVENHIAPIAGRIGSQRHIIAIRDGFISAMPFLIIGSIMLIVANPPFDAQTSSSFGQAWLEFAKAYWKTITMPFFMTMGLMSVFVSIGTAYSLAKSYGLDGLTSALLSLMAFLLAAAPQVDNKMPLDFLGGTGVFTALICAIWSVELIRLLKKYNISIKMPSQVPPAIARSFELLYPVVGILLTVYPISLLLQSEFNLLLPAAVMQIFEPLIAIGDTLPAVMLVVLIANLLWFAGIHGDNIVTGLLNPIFMANIAANAALMTQGMATTQILTAPYWSFYVCIGGSGSTLVLAFLYLRSRSIHLKTIGKLSVVPAMFNINEPLLFGSPVVMNPTLLIPLLVVPLINAVLAYGALHLDLVQKMIAIAPWTAPAPMGALISAAWDYRAVVLVGLLMVIDLLIWYPFFKVYEKQLLAEEQQQAKSLADAQA

SEQ ID NO: 10691 - protein, 101 aa, Xenorhabdus bovienii
  Coding DNA sequence: Name=SeqID_4583
  Gene classification: Gene name=CelA; Function=Phosphotransferase system cellobiose-specific component IIB; Function class=G Carbohydrate transport and metabolism
  Homolog annotation: Query=1..100bp; Hit=1..100bp; Blast score=87; Percent Identity=48.0; E value=3e-18; Homolog= VC1281 COG1440
MKTILLCCAAGMSTSMLVQRMQAEAEKRGLEVAIKAVPALELGMYINEADVILLGPQIKYELPRFTALAEPLGKPISLIEMMDYGALRGDKVLDHALSLLE

SEQ ID NO: 10692 - protein, 47 aa, Xenorhabdus bovienii
  Coding DNA sequence: Name=SeqID_4584
MNCINWCFTAIIGFIRDFGDLFGDDYQIINEAFFVSKISRWYLRFCI

SEQ ID NO: 10693 - protein, 202 aa, Xenorhabdus bovienii
  Coding DNA sequence: Name=SeqID_4585
  Gene classification: Gene name=AcrR; Function=Transcriptional regulator; Function class=K Transcription
  Homolog annotation: Query=5..194bp; Hit=4..194bp; Blast score=143; Percent Identity=39.0; E value=1e-34; Homolog= mlr0535 COG1309
MTRKRGRPLNFDKELALKKAMDIFWAKGFEGTQLVDLTAVMGINPPSFYAAFGSKFNLFCEAVQLYIETIGNKTVNALNDAKTTKEGLKAMLENSIINASSNEAGGCLMIMGIVNNRAENYPAWEYLREERAKTLTLIQLRIERGIMEGDLPKNTDSKTLAEYFLGITQAISFQARDGVSKNTLQRLIEPALAALPSSNTLE

SEQ ID NO: 10694 - protein, 328 aa, Xenorhabdus bovienii
  Coding DNA sequence: Name=SeqID_4586
  Gene classification: Function=Transposase; Function class=L DNA replication, recombination and repair
  Homolog annotation: Query=3..320bp; Hit=2..310bp; Blast score=138; Percent Identity=31.0; E value=8e-33; Homolog= NMB1750 COG3547
MYYVGIDVSKNKLDICLLYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELAELEALIAEHINQHPNLKKDFELLTSIKGVGTQIGLNMLIILRTNTFTRATQVAAYLGVIPIAKQSGTSVHGRVRLSKTGPAKIRAKLFMSALTAVRFNPHINDLYNRLVNKGKAKMLALGAAMRKLVHLCYGVLNTQQSYDENYAIRT

SEQ ID NO: 10695 - protein, 399 aa, Xenorhabdus bovienii
  Coding DNA sequence: Name=SeqID_4587
  Gene classification: Gene name=AraJ; Function=Arabinose efflux permease; Function class=G Carbohydrate transport and metabolism
  Homolog annotation: Query=14..370bp; Hit=1..358bp; Blast score=229; Percent Identity=47.0; E value=4e-60; Homolog= PA3336 COG2814
MQNTSVTDNKSETLPLAVYILAFGIFALVTSEFQVAGMIPVMASDLGVSISQIGYLVSLYALAMAVGGPLLSIGLLKIPPKFALMILYVIFTIGEVLGTIASLYHFLVVARLITGAASGAFYGVAIAICVEIVSEHKRGWAISIVLAGIMAGTILGLPMANLIGTHLGWRESFCVVSVLAVLGLIVSILWIPSLPKQQAIGLKSELSALKSPRLWAVFSTSLLIIGATFSAFTYFTPILKNITGYSDGAVAVLLTVYGIATMLGNIVVGKLADRHTITILAVRLALLTIFLALFAIFAENKLISVLSLIGIGLVGVTMNPAMVTRVIRTANGRPLVNTIHTSVITLGIVIGAFLGGLGISFDLGLTSPMWVGFFMAIVGFTTLIPDLQLYHRERVKLNS

SEQ ID NO: 10696 - protein, 248 aa, Xenorhabdus bovienii
  Coding DNA sequence: Name=SeqID_4588
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=2..247bp; Hit=4..247bp; Blast score=201; Percent Identity=46.0; E value=8e-52; Homolog= mll0534 COG1028
MSNLSGKIALITGGSRGIGAGIAKRLAQEGADVVITYVNNSDAAKAVVEDIINSGRVGKAIRADSADADAIKLAVKQIIKQFGQIDILINNAGHMDVSGTPLPHVPLDVVNQTIMVNIRGSYLFAQEVASHISDNGRIINIGSCLGERMPVAGLTLYAMSKSAMVGLTKGLARDLAYKKVTVNQISPGPVDTDLNPADGPNADFFRELTALKQYGTTNDITSIVNFLVSREAAFITGANIAVDGGMNL

SEQ ID NO: 10697 - protein, 67 aa, Xenorhabdus bovienii
  Coding DNA sequence: Name=SeqID_4589
MALQQAKAEDFQQAEMLMEEARQETRGTVAYNSANIPNFYCLLKDIKIDNDNIINSYLHPQQCWPPL

SEQ ID NO: 10698 - protein, 38 aa, Xenorhabdus bovienii
  Coding DNA sequence: Name=SeqID_4590
MKTILLCCAAGMSTSMLVQRMQAEAERRGLEVAIKAVR

SEQ ID NO: 10699 - protein, 276 aa, Xenorhabdus bovienii; identical to SEQ ID NO: 8172
  Coding DNA sequence: Name=SeqID_4591
  Homolog annotation: Query=1..276bp; Hit=185..460bp; Blast score=510; Percent Identity=95.0; E value=1e-144; Homolog= ref|NP_927691.1|

SEQ ID NO: 10700 - protein, 31 aa, Xenorhabdus bovienii
  Coding DNA sequence: Name=SeqID_4592
MISASRSQTEITLAICSPNRLSAVCEARSHL

SEQ ID NO: 10701 - protein, 155 aa, Xenorhabdus bovienii; identical to SEQ ID NO: 8170
  Coding DNA sequence: Name=SeqID_4593
  Homolog annotation: Query=1..155bp; Hit=1..155bp; Blast score=296; Percent Identity=97.0; E value=6e-80; Homolog= ref|NP_927691.1|

SEQ ID NO: 10702 - protein, 72 aa, Xenorhabdus bovienii
  Coding DNA sequence: Name=SeqID_4594
LSATVYPRTYGEHCRSLIPIQKALGLSPYLRGTRDLCRGFNAQWRFIPVSTCLSYTNILTRPPSLLNFYLID

SEQ ID NO: 10703 - protein, 209 aa, Xenorhabdus bovienii
  Coding DNA sequence: Name=SeqID_4595
  Gene classification: Function=Putative transposase; Function class=L DNA replication, recombination and repair
  Homolog annotation: Query=7..209bp; Hit=1..210bp; Blast score=201; Percent Identity=51.0; E value=4e-52; Homolog= mll9070 COG3316
MSLIRNVFKRLHYPVDIIAQCVRGYLAYALSLRNLKEIMAECGVTVDHPTLSRWVHRWVPLIVKRYRRSKPEVERRWRMDETYIKIKGQWRYLYRAVDSDGNTVEFFLTAHRDKKAALRFFKKAMRQHGQPDGVTLDKSGANKAALGEINKEKPKNKQINVRQSKYLNNLIEQDHRNVKRRTRPMLGFKNFRGTQTLLAGIERVSMLRK

SEQ ID NO: 10704 - protein, 40 aa, Xenorhabdus bovienii
  Coding DNA sequence: Name=SeqID_4596
MILLAISLLMRQNRPHSIKALILYAAKRDISILAKSDITT

SEQ ID NO: 10705 - protein, 134 aa, Xenorhabdus bovienii
  Coding DNA sequence: Name=SeqID_4597
  Gene classification: Gene name=VapC; Function=Predicted nucleic acid -binding protein, contains PIN domain; Function class=R General function prediction only
  Homolog annotation: Query=1..131bp; Hit=1..131bp; Blast score=165; Percent Identity=58.0; E value=1e-41; Homolog= HI0947 COG1487
MIKYLLDTNIVIFTIKRKPESLLPKFNQHTNQLAISAITLAELIFGAEKSMNPTKNLATVNDFVSRLTVLPYDEQAAFHYGDIRAILEKKGKRIGDNDLHIAAHARSKGLIVVTNNTREFERVDGLRIEDWTKP

SEQ ID NO: 10706 - protein, 80 aa, Xenorhabdus bovienii
  Coding DNA sequence: Name=SeqID_4598
  Homolog annotation: Query=5..78bp; Hit=4..77bp; Blast score=85; Percent Identity=60.0; E value=2e-16; Homolog= ref|NP_840563.1|
MIQQGKVFMSNRTQNVRLPADTRFPDNVKEVIVRVSGKERIISPVQNAWDSFFLSDQSVTDDFLPNRADQITSERESFDD

SEQ ID NO: 10707 - protein, 60 aa, Xenorhabdus bovienii
  Coding DNA sequence: Name=SeqID_4599
MPAGKEIVHVGLSLYSPILLCFPCLTHFILFILLSTPWIWNTFFAKSMPIVITVISRLRW

SEQ ID NO: 10708 - protein, 142 aa, Xenorhabdus bovienii
  Coding DNA sequence: Name=SeqID_4600
  Gene classification: Gene name=GloA; Function=Lactoylglutathione lyase and related lyases; Function class=E Amino acid transport and metabolism
  Homolog annotation: Query=15..138bp; Hit=6..130bp; Blast score=106; Percent Identity=44.0; E value=7e-24; Homolog= DR1341 COG0346
LTINTTTETTYWNPMVPELTVTNFPVSLDFYVQILGFNIMIRRKDPDFAYLHLGKAQLMLETFHETGWNTAELNKPLGRGINLQIEVDDINSILNRLQINKIKLYRPLKDNNYATGDTHICQREFLVQDPDGYLLRFSQYIE

SEQ ID NO: 10709 - protein, 919 aa, Xenorhabdus bovienii
  Coding DNA sequence: Name=SeqID_4601
  Gene classification: Function=Predicted helicases; Function class=R General function prediction only
  Homolog annotation: Query=14..862bp; Hit=20..844bp; Blast score=496; Percent Identity=38.0; E value=1e-140; Homolog= ZygcB COG1203
MPTLINNFGYIIRYWGKAQKNIYSDADYHLLAYHCLAYHCLDVAAVGKYLLAPHKKITADIADFLELSKEELQNLFVFFLLLHDIGKFSSAFQQLYSPEQHTELLKPQHCKPYDGKHYRHDRLGLFFWKQIQDDVLFALVGDNNLQRRDKDRAQDTLMVLMQCMLGHHGKPIDDSDWQAIGDFTEAQNITDAKAFTNDLIALFQPHLSLEKLLSKEWKDNLKQVSWQLAGIVVMADWIGSDSARFRYQTSSMPLAEYWQTAEQQAQIALNAIDMQYTPAISPYKSIQHYYGFSPTPLQQWAEKVPIDDSPQLFILEDVTGAGKTEAALTLTHRLMQAGVAEGFYFGLPTMATSNAMFSRVAKHYREMFNTSGKPPSIVLAHGASKMNDAFNDIILTSENSDNDYTKDEITATAQCHQWLADSRKKALLAPVGVGTIDQALLAVLPRKYQSLRLIGLNRKILIFDEVHAADEYMFALLENLLNLHLHQGGSVILLTATLSLKQRQKLADIWLSSAGQTPQKLRQTAFPLATKITLTPENPIIEQPLHSRSDVSREVIVKTLDSLDACVQTALNAAKEGQCVVWVRNSVDDALHAFRLIQSQMNNPEDCLLFHSRFILHDRKKIEDLVLEIFGKNSTQLHRQGKILITTQVFQESLDADADEMIADICPIDDLIQRTGRLHRHTRNAEGKYQQGINDGRPAPVLYLHAPKWDDQPQADWLSKDFRNTQYVYRSPGRLWLGLRELRRLGAIRMPAEARTLIEAVYSDDAYEHIPDTLRHKENEFIGEGHSKEAKAESQTLRWKHGYCNHSASGWYDDDSDINTRFSDIETVEVLLVKLTDKGALIPWANEGKFAVQLSTIRLPKNKFADKLLAVPESFSHAVEQLKSQFKSAKYLQIWLPELDPNFSYDPTIGFYEIHQQEA

SEQ ID NO: 10710 - protein, 262 aa, Xenorhabdus bovienii
  Coding DNA sequence: Name=SeqID_4602
  Homolog annotation: Query=1..246bp; Hit=1..246bp; Blast score=355; Percent Identity=68.0; E value=4e-97; Homolog= ref|NP_928091.1|
MNLIKDAWLTFKMRDGSQKKLPLAAIRDPNVMDFALPRADFQGAAYQLAIGLLQTVFAPVDKFQWHDFYETPPTQADLQTAFDRVEHAFNLSGNGPLFMQDFDSLESVKSTTISGLLIEAPGANTLKLNTDHFIKRGQCEIVSPEMAAIALFTLQINAPAGGVGHRVGLRGGGPLTTLVQPQTLDTPLWHKLWLNIVNQEYCGYPEADLHSPSVFPWLGKTKLSQPAGTEIYASDVHELYMYWAMPHGVSVCRSTINPLFAN

SEQ ID NO: 10711 - protein, 292 aa, Xenorhabdus bovienii
  Coding DNA sequence: Name=SeqID_4603
  Homolog annotation: Query=6..289bp; Hit=247..534bp; Blast score=307; Percent Identity=50.0; E value=1e-82; Homolog= ref|NP_928091.1|
LGDATRRIRLQIDDKPAICQLTGQPTEQSVTRYRTQNYGNNYAGNWQHPLTPYKWNPKKANDDHLSIKGQPGGITYKLWNSLAFSRNNEGQKAALVVDHFHQICDYFAEEHSATPRLWVFGYDMDNMKARGWYSTTLPLFSIAVEKQDVIFRRARNLQTLSANALSQCRSQIKSGWFNRPNDVKGDMSFIDAAFYQRTQTAFFKAIQQIISSQQASSYLSPEEAKSWLYQLRNTCFDLFDEYVLSESVDPKTLPKKVKARHFLTQWLFGAKEIKSFMTEYQIERQQKEVINE

SEQ ID NO: 10712 - protein, 183 aa, Xenorhabdus bovienii
  Coding DNA sequence: Name=SeqID_4604
  Homolog annotation: Query=1..182bp; Hit=1..182bp; Blast score=187; Percent Identity=52.0; E value=6e-47; Homolog= ref|NP_928092.1|
MNKLSESTLLRWWESMFLSPSELKAKGRYPAPTVYKAQLKRCQNIDAAMLTGGFRTLWLSLQERNAETVDEKTIIKWAMIAMTGVHVKHNVTTTLATAAGTKTENDKPVVSALRFAQLQGAKTPDEFVTRLRRTLQLIDGKVSMLDLAKDIEQWAHECHQQRPRRANQRLSVQWALEYYKAAK

SEQ ID NO: 10713 - protein, 345 aa, Xenorhabdus bovienii
  Coding DNA sequence: Name=SeqID_4605
  Homolog annotation: Query=1..342bp; Hit=1..341bp; Blast score=480; Percent Identity=71.0; E value=1e-134; Homolog= ref|NP_928093.1|
MSQFIQLHLLTSYPPANLNRDDTGRPKTARMGGFDRLRISSQSLKRHWRVSDLFQSALAGHLGFRTKRFGLEIYQQLIEADVKEKQATECASAIAGVFGKNKKDTPLEIEQLAHISPTEKAATISLAKQLANENRAPTKEELSLLSKERMAVDIALFGRMLASSPAYNIEAACQVAHAISVHDVMIEDDYFTAVDDLNDGKSDTGSAHIGENGFAAALFYSYICINKTLLMENLADNQILVNQAIAALTEAAVKISPSGKQNSFGSRAYASYVLAEKGEYQPRSLSVAFLKPINDEEQAASAIRALEEQVENFDNVYGDCADARHSINTLTGKGSFAELIKFITN

SEQ ID NO: 10714 - protein, 250 aa, Xenorhabdus bovienii
  Coding DNA sequence: Name=SeqID_4606
  Gene classification: Function=Uncharacterized ACR; Function class=S Function unknown
  Homolog annotation: Query=1..239bp; Hit=1..234bp; Blast score=132; Percent Identity=35.0; E value=3e-31; Homolog= Z4066 COG1688
MQTYLVFRLYGVLASWGVEAVGESRPTSLYPTRSAILGLLGAALGIRRDDEMRLAELQQSVNIAIKQIVASSLMRDYHTSQVPSQNNKQQHLTRKSELGESELNTVLSSRDYRSDGLWIIAISLTDQAHLTLATLRDALLKPVFTLSLGRKSCPLCIPMMPQITRSPCLKAALDTEFPPLTQSEKADHYWLGDNGIVSYFWEGDKNEIEIPDVAVLTSQLWDEPLSRTRWQFTQRTMHQLSLMEKAHVPV

SEQ ID NO: 10715 - protein, 224 aa, Xenorhabdus bovienii
  Coding DNA sequence: Name=SeqID_4607
  Homolog annotation: Query=1..224bp; Hit=1..224bp; Blast score=251; Percent Identity=56.0; E value=6e-66; Homolog= ref|NP_928095.1|
MYLSKVTLRPSAYREQFLSKMAKNSVYSSHQLLWQLFTEQAERNFLFREDMSINGTPEFFVLSHTAPTPNSAMFQIQSKAFTPQLRSGQKLAFKLRLNPTICITDKDSGKQRRHDVLMNAKRQAQLAGVSTDEIQPLMMQAVQAWIQDEKRLTNWGIQFDFDPDVERYTQHRCRKPSGQKVAFSSVDFQGVLTLSDHELFLAQYAKGFGRAKSFGCGMMLIRTL

SEQ ID NO: 10716 - protein, 72 aa, Xenorhabdus bovienii
  Coding DNA sequence: Name=SeqID_4608
LNVSASDFSKNNFVLMSLSHGEHSNISQTKFQKGSLNTYGEHLQSPYQHHPTAKGFRPTKALSVLRQKKFMI

SEQ ID NO: 10717 - protein, 330 aa, Xenorhabdus bovienii
  Coding DNA sequence: Name=SeqID_4609
  Homolog annotation: Query=1..330bp; Hit=46..373bp; Blast score=398; Percent Identity=61.0; E value=1e-110; Homolog= ref|NP_927863.1|
MTLTNFSKLLAATLCLATSYSHADSERPLFSLTMAESGVQKTNSDGSLSHSTKSESRILPIWGDEARAKGYDLPEPFGVSYGYMNLRQDIIIDSIKFQFTNPLIEERWKDQIIVNAGDTRERNETHMLKLDTWVLPFLNVYGVYGTTKGKSKTNLDNIVAFGDDETYRNIPFELSFKGKTYGGGATFAGGYNQFFATLDANYTRTNLDILDGDISAFVVTPRVGYEFVFEPLFTGQGNAKVQVWVGAMYQDITQRFKGDVSKLNLPSEISELFGMVQSQTDIKFDVEQHLAHKWNNTVGARFEITRNFNILSEVGFGNRNSLFVSGEFRF

SEQ ID NO: 10718 - protein, 379 aa, Xenorhabdus bovienii
  Coding DNA sequence: Name=SeqID_4610
  Homolog annotation: Query=2..379bp; Hit=6..381bp; Blast score=517; Percent Identity=66.0; E value=1e-145; Homolog= ref|NP_927862.1|
MTIKRLVISSLLIFTASSAQADILPDRQKIDGWLSELGGSNQFDASKKVDWGVLPGPFYTPEMGMGIGVAVVGLYRPDNSDHTSQTSSLGLSGFGSSTGAFGLNFTNYNFLARDQWRLFVSGTLNNTPTYYWGKGYDAGKNNGNKEKYRAQEFDIRPRLLYRVTDAMYMGLGWHFSSLNASDPDIGAAKYFAQSVGGRSVISSGVSAYFSYDTRDFLPNAKHGQAFEIVYTHFSPELGGDNRFNTTQLQFSTYHQLSEKSVLAFDNYARFSSGDVPWNQLSLLGSSQRMRGYYEGRYRDTNIFTSQLELRHKLDWRHGIVGWIGTGTLSDSPSKLGAKHWLPSIGVGYRFEFKPRMNVRLDFGVGKDSTGFYFQVGEAF

SEQ ID NO: 10719 - protein, 375 aa, Xenorhabdus bovienii
  Coding DNA sequence: Name=SeqID_4611
  Homolog annotation: Query=8..365bp; Hit=12..369bp; Blast score=439; Percent Identity=58.0; E value=1e-122; Homolog= ref|NP_927861.1|
MTLLFSFLLMACQGKSAPVMPVEPVLVSDTQEQPELDWPALTPIEPPEGLRACCAFGYDLKTEVVGVPVPFYDIDNIVEAEKLGEHHYNDSALGASAALLGISNEKIGLLYTQKGGFIDISHVRDTADYTLYLFSQIYAHLGQERELSLSNELAARKIHFFAFTPPVDLVERYTLSAYLAAKLAFQLAAWHEIAQWYGYQSVPGFPEGISAFSPEDLYSNLLGARLALTLILQGHASSVTQFTTSMAAILPSALHKLEPYSKSDTKKMFNQIDGLWWNSHERIPQKFLVLRRNYETQDNRYPLMPSGKEKFALRLSLPDEYKPFSLDKLAELQLWPTEQMKNLPVPNSYWTMKDFNMLAEHAQHEDARQLLLSSK

SEQ ID NO: 10720 - protein, 176 aa, Xenorhabdus bovienii
  Coding DNA sequence: Name=SeqID_4612
  Homolog annotation: Query=20..165bp; Hit=1..145bp; Blast score=167; Percent Identity=61.0; E value=7e-41; Homolog= ref|NP_519942.1|
MNLLELEDKTSRNRKVVETMPDSKVFVDNYLPALLGQAWMLVSSEFHDIVEARGLSVLEWRVLSALAGSGPIGISLLAQKTVSKQPTITRVLQRLELQGHVTRFSNGGGDRRITLVHLTDSGRQVVVGLLAEAESHEKSILEPLGSGKSQLLKEVLQELIKRHTPMRRALGRFGKE

SEQ ID NO: 10721 - protein, 37 aa, Xenorhabdus bovienii
  Coding DNA sequence: Name=SeqID_4613
MQPKLFQYHAGYRNRWGDNERETFQRRIQSPLWSDAE

SEQ ID NO: 10722 - protein, 31 aa, Xenorhabdus bovienii
  Coding DNA sequence: Name=SeqID_4614
MASLPRCNEINVMSNVAHAITMGCVKFCHIN

SEQ ID NO: 10723 - protein, 395 aa, Xenorhabdus bovienii
  Coding DNA sequence: Name=SeqID_4615
  Gene classification: Gene name=AraJ; Function=Arabinose efflux permease; Function class=G Carbohydrate transport and metabolism
  Homolog annotation: Query=8..392bp; Hit=59..443bp; Blast score=274; Percent Identity=47.0; E value=1e-73; Homolog= XF1728 COG2814
VRSTTSHTGETNALPLASLLALAMTGFLALMTETVPAGMLAQISMGLNISESMAGQFVTLYAIGSVIAAIPLTTATQSWRRRPLLLVVLGALFVFNTLTILTSNYTFALIARLFAGMAGGLIWGMLAGYARRMASEPLKGRALAIAGVGAPLALSLGVPLGAFLGSLIGWRMTFGLLSLLTLAVMVWIRLRVPDYPGQSSEKRLSIRSVFATPGVRPVLTVLIFWVLAHSILYTYIMPFLAPAGLSHRVDIILLIFGASSVLGIWLVGVLIDKYLRSLVLISIGLFALVALALGLAGILPAVIYISMAIWGLTFGGAAALLQTASADAAGSGADVAQSILVTVWNLSIAAGGMLGGILLDTQGVHIFPWTLLGLLVVGLIIAWGAKKHGFPATLQ

SEQ ID NO: 10724 - protein, 307 aa, Xenorhabdus bovienii
  Coding DNA sequence: Name=SeqID_4616
  Gene classification: Gene name=LysR; Function=Transcriptional regulator; Function class=K Transcription
  Homolog annotation: Query=12..299bp; Hit=1..288bp; Blast score=299; Percent Identity=50.0; E value=3e-81; Homolog= PA2316 COG0583
MTNMSSIGKRVMDNFSVLEVFVRVSEVRSFTAAGNQLGVSSSAISKAISRLEEKLRVRLFHRSTRTVTLTPEGTLFLKRCRRILNEIEAAENELSQSQSVPYGKLKVSMPSIGVLFMPKFAEFSQQYPEIELEIDSTDGLVDLIEEGFDAVIRTGEPADSRLMARVLGSYKRVIVGSPTYFQKFEIPKKPEELINHFCMMYRYKSTGKLDIWPISQDNPTLQLEWPTRMVTNTLDPLVSFAENSLGITCIPDLAIREQLKTGKLITILNDFNNDITTCRILWPSSKYLSPKLRVFINFMVENLFKNE

SEQ ID NO: 10725 - protein, 569 aa, Xenorhabdus bovienii
  Coding DNA sequence: Name=SeqID_4617
  Gene classification: Gene name=Fmt; Function=Methionyl-tRNA formyltransferase; Function class=J Translation, ribosomal structure and biogenesis
  Homolog annotation: Query=73..224bp; Hit=79..227bp; Blast score=77; Percent Identity=36.0; E value=4e-14; Homolog= PA3554_1 COG0223
MKTMESSENYTFVIIGQGTLAVRCCQFLLSIGIHLEVVMPLDSVFLSWAKKEGLKCINTIQDLESLVSNNSVEWLLSISNPIILTSALLDNIKLGAFNYHDAPLPKYAGTHATSWALFAMEDKYAVTWHRIATVVDAGDIAVQQNVEINRSDTALSLNMKCYNAAFEGFKKLISLIKGGKTIEYVKQNLSERSFFSSRKRPYAGACLQWEHSAEELSALVRGLSFGERYRNPLCVPKVYLINIIGIVKTLEVLSVSTHKQAGILVDIAQNFWIVTTGTTDIRIEFIQLTGEDLRADFLADMLCISVGDSLPIINNSDLEDLTQEHEELAPYESFWVNRLESCRPLNFKFDTLYHDLDCIFEIYYNWNFYIDIENVTSEERLVNILGAFAVYLALVNDVQYFHLDCVTELPKHEVIDYSVFFSASVPFEFNIDFNCSALNLYSSISVERSILNKFKTFHKDIIFRYPQLRSTESVYSKYICNVRISIIDFINSEVKPAASQLYEKNNASLTMQIDPVKGAFRWISNSSHIESADLKRMADHIISLDRLLLSNSNLPLKSLLSQCGTLGII

SEQ ID NO: 10726 - protein, 933 aa, Xenorhabdus bovienii
  Coding DNA sequence: Name=SeqID_4618
  Gene classification: Gene name=EntF; Function=Non-ribosomal peptide synthetase modules and related proteins; Function class=Q Secondary metabolites biosynthesis, transport and catabolism
  Homolog annotation: Query=52..651bp; Hit=506..1078bp; Blast score =290; Percent Identity=30.0; E value=4e-78; Homolog= PA2402_1 COG1020
MHSVTQNKSWERLLNLKGFELDIRELVELKNSLSYDKISISWSTSGQEERFEYAIDQCLPGLFLSSVRHIPDNVAIVDGDDKLCFWQLAHLSLHVANYLRYLNCSTDECIGLFVEPSLEQLIGVWGIIFSGAAYLALAPDYPPERLKYMIENSSMKYIFVQEKVKFKILDIISSDITLITISDVIDYVKMSAKTKSAPKPRELQPENLAYIVYTSGSTGKPKGVMIEHRSIVNQMLWLNKKGFLSRDKKIIHKTSISFDAAQWEMLSVCCGTQLIISDFSINKNISKLVDDIIENNVSLLQCVPTLLQSLVNRHKFAKCSSLSHILCGGESLTKKLALQCLDILPNCELINVYGPTEFTCNASFYNVSIGIKKEHHEGVSIGRPVDNTEFHILDENGKSVSSGNSGELYISGIQISRGYFNQEDLTNKHFFSFIPTGSNTPIMSYKTGDLAYQNMDGSFYFIGRKDTQIKIRGMRVELEEIKIELESLPLINIAAVMNKYHDVSQSILMACVELSTEGVILKENHDHQELVSILKKELARRIPDYMIPTLFFFVDVMPLTITGKIDFYKIENIFGKENFKEKYEPKSINERVIQSIWMECLKKNSISVCDDFFSLGGDSLSAVDIIQSINNKLGSNLPLHILFEASTIEKLACLVDVNRNKYSERLVSLQPHGALSSIFCWPGLGGYPMSLRLLAEKIGKVRPFYGIQAFGLNEDERPYGSIQKLVHADITAIRNKQPQGPYVLWGYSFGTILAFEAAYQLEQLGEKVEELVLIAPGMTKGHSLQLQSSDKSSGYENKSLVSLLFSVFSRSSDDQDLLECLDYVNDEDDFASFISKRHSGLSLDLIKRISRVVITTSESLRSESESIFHDRLITAPVKIFSAKSDQLSYFETNSNCFINIPDVVKINVPHFELLKEPGINELLSKMRMLITWM

SEQ ID NO: 10727 - protein, 510 aa, Xenorhabdus bovienii
  Coding DNA sequence: Name=SeqID_4619
  Gene classification: Gene name=AsnB; Function=Asparagine synthase (glutamine-hydrolyzing); Function class=E Amino acid transport and metabolism
  Homolog annotation: Query=1..440bp; Hit=1..458bp; Blast score=216; Percent Identity=33.0; E value=5e-56; Homolog= ZasnB COG0367
MCGIAAIFTTKEILIEQLNSKLVSMIERMKHRGDLSRFNEHLVKKYFGIATNRLAIVERETATQPVSDEERDIHVILNGQIFNYKKIREKLIKRGHEFKGYGDAEVILKAYIEYDLEFVNMLDGMFAFVIYDNKKSKFLIGRDHVGIKPLYYAKKNDVWYVASEMKAFLELDVEVKTLEPGSLYDGNELYKYTRYDKSIEKSKDCYLVAKQKVRKLMEEAVESQVDTDLPVAVMFSGGIDSAIILALANKYHSNVTAISFGLPGSDDIKISKRFCEENKIRQIIYTFTEQDLIDDIDSAVYYGEFFEKIDSVDSIIANFGYLIANKLGFKVALCGEGSDEIFCGYDLFKTYPFIDELSLYRLNNLHRTDLQRVDRASMRNSVEARVPFMNNQVVRYALSLHESLKINNGVEKYILREAFRDFLPDYIIDRPKIRMPDGSGVKNILIDYVNSIDLQIPKEVLRMLESIGLNDKSSFYFANKYLNNGYHLPDERFKKLGKDYTASGYFDFIS

SEQ ID NO: 10728 - protein, 443 aa, Xenorhabdus bovienii
  Coding DNA sequence: Name=SeqID_4620
  Gene classification: Gene name=AroA; Function=5-enolpyruvylshikimate -3-phosphate synthase; Function class=E Amino acid transport and metabolism
  Homolog annotation: Query=17..437bp; Hit=39..454bp; Blast score=189; Percent Identity=32.0; E value=4e-48; Homolog= DR1096 COG0128
MSKRIDKDSKFVEVIYSKRLQGTLNLPASKSSSTRALLTSSITSGKSIIRNIATGFNTIAMKSNCERLGAVFKEDKDNLIVNGIDVSSINQPLELNPGNSGVVLRLLMGVAGFLPETKFITDYHASLGVRSQTEMVNALCMLNVQCRALGEEHRLPIRIKSDRKLNDYTEVSCRKSSQFLSGLLYLGAVMDNDLTIKVVDKITAPSMVHTTINNLKKAGIRIEYDSDFREFFVHGRCGLQASDFTVGSDPASTAAILALCGSLESEVQLNGFFEEELGNGAVIQYLIDTGTNIEFIGNETIIIKGNTEIRPLDFDGSLAPDAVPALAARASLASGTSIFYNIEHIRYKESDRISDFRKELSKLGVKSDEKHDQLIIHGNPKGYKGGVVLDGHYDHGLIMGLTTIGLHCSEPVLIKEPFHVGQTYPEYFSEIRSLGAKVNELAK

SEQ ID NO: 10729 - protein, 433 aa, Xenorhabdus bovienii
  Coding DNA sequence: Name=SeqID_4621
  Gene classification: Gene name=AroA; Function=5-enolpyruvylshikimate -3-phosphate synthase; Function class=E Amino acid transport and metabolism
  Homolog annotation: Query=4..429bp; Hit=3..413bp; Blast score=88; Percent Identity=24.0; E value=1e-17; Homolog= MTH766 COG0128
MSKVTVFPSFGLTGEVFIPSSKPHIQRALLLALLNENTTRIVNISWNVETENQINALKKFGLKILHKDGTTLLLRGVGRNLSYNGEIYVGGSGMLFRMCAALASLIDNEKIVIKCNESLFNRESVFDEDFCNYLDIHIERIENERIIITKSETNIKNPLTVLNSTQFITFALFVAPFSKQKIVPIVLDGSKMGYIDMTIKSMLLLGSIVTYEQKHFKVTKYIPKDIEIKIPSDFTSLSYIASSILSSKGASDVLIRNYYFNDTINERDLFKFYQSIGLIITYDSTWNNLRIFRQSIRLWDGEFSLKELPSVAVNIIAASSNLKGNKIFSGVRGINNHKSQRAFIVNENIRTMGGNSVLIFDRVGMFESIYIEGKGPLNGGVELKSYGDHRICAANLIASLGAEKESIIYDIDKLNDGFPDYIDTLRNLGVHIK

SEQ ID NO: 10730 - protein, 55 aa, Xenorhabdus bovienii
  Coding DNA sequence: Name=SeqID_4622
MLYGGNNLASAADLCSGEIRVIFFSISVVNGDDNYADRKGFFPTTYRLDEKNSGK

SEQ ID NO: 10731 - protein, 151 aa, Xenorhabdus bovienii
  Coding DNA sequence: Name=SeqID_4623
  Gene classification: Gene name=Uup; Function=ATPase components of ABC transporters with duplicated ATPase domains; Function class=R General function prediction only
  Homolog annotation: Query=10..140bp; Hit=330..459bp; Blast score=67; Percent Identity=35.0; E value=5e-12; Homolog= slr0864 COG0488
MSTLINCNRISFSVNSKLLFKELSITIKENDRIGLVGYNGTGKTHLLKLLAGIETPDEGLIEYVSGLRLETVSQFIDDSLLEMSLLECISRKVKQFDEYADYKAVSVLHSFGFQEADFSTKVADLSGGQKTKLMFPSVQLRRQSCCTAVTI

SEQ ID NO: 10732 - protein, 48 aa, Xenorhabdus bovienii; identical to SEQ ID NO: 6457
  Coding DNA sequence: Name=SeqID_4624

SEQ ID NO: 10733 - protein, 424 aa, Xenorhabdus bovienii
  Coding DNA sequence: Name=SeqID_4625
  Gene classification: Gene name=ET17; Function=O-acetylhomoserine sulfhydrylase; Function class=E Amino acid transport and metabolism
  Homolog annotation: Query=1..412bp; Hit=1..412bp; Blast score=665; Percent Identity=76.0; E value=0; Homolog= PA5025 COG2873
MKLETLSIHAGYSPDPATKAVAVPIYQTTSYAFDDTQHGADLFDLKVEGNIYSRMMNPTNDVLEKRIAALEGGIGALSVASGMAAVTYAIQTIAQAGDNIISVAKLYGGTYNVMAHTFPSIGIETRFVDHNDIAAIEALIDEKTKAVYCESITNPGGHIIDIQAMADVAHKYGIPLIVDNTVATPYLCRPFEHGADIVIHSLTKYIGGHGTTMGGIIVDSGKFPWAEHQDRFAILSTPDASYHGIIYTEHFGAAAYIARCRVGPLRSTGATLSAFSAFLILQGLETLALRMERHTENALRVAQYLNEHPQVSWVKYAGLPEHPEHELAVRYMGGKPSSVLSFGIKGEEEAGTRFIDALELIVRLVNIGDAKSLACHPASTTHRQLNDEEMVKAGVSRDLIRLSIGIEHSDDIIADLSQALDAAK

SEQ ID NO: 10734 - protein, 324 aa, Xenorhabdus bovienii
  Coding DNA sequence: Name=SeqID_4626
  Gene classification: Gene name=IlvA; Function=Threonine dehydratase; Function class=E Amino acid transport and metabolism
  Homolog annotation: Query=4..319bp; Hit=3..318bp; Blast score=427; Percent Identity=68.0; E value=1e-120; Homolog= YKL218c COG1171
MNFLPDYRDVVEAHSRIKKYINKTPVFTSRTVNQIFNAEVYFKCENYQRMGAFKFRGAMNALYQFSDEQKKAGVVTFSSGNHAQAISLAANLLNIPATIVMPQDAPKAKIAATKGYGGKVVIYDRYTEDCEEITRDLANQYGLTFIPPYDHPHIIAGQGTSTKELFEEVGELDALFIPLGGGGLLSGSALSAVHFSPKCRIFGVEPVAGNDGQQSFKKGEIVHIATPKTIADGAQTQHLGKYTFPIIRNLVEDILVTSDDELVDAMYFLAERMKTVVEPTGCLGFAAARKVREELKGQRIGIILSGGNIDMERYSNLLSNFNKI

SEQ ID NO: 10735 - protein, 135 aa, Xenorhabdus bovienii
  Coding DNA sequence: Name=SeqID_4627
  Homolog annotation: Query=16..125bp; Hit=190..300bp; Blast score=139; Percent Identity=55.0; E value=6e-33; Homolog= ref|ZP_00123735.1|
LFVLLIYCILITNNQGGNRGFFGYDYRNLQVDPEWKPGENQAVSLVIKAGQCVIFWSTLMHASYPNTSEKHYRMGFTTRYAPSYVDIYPNTDYVYEYGGNIPLDKFGCVIVSGQSRNTNNRIASHNLLDQPLIPL

SEQ ID NO: 10736 - protein, 227 aa, Xenorhabdus bovienii
  Coding DNA sequence: Name=SeqID_4628
  Gene classification: Function=Predicted metal-dependent hydrolases related to alanyl-tRNA synthetase HxxxH domain; Function class=R General function prediction only
  Homolog annotation: Query=5..214bp; Hit=4..232bp; Blast score=68; Percent Identity=25.0; E value=4e-12; Homolog= BH2934 COG2872
MTQIQCYLNNTYCFLSTGEVIASGSDEWGQWIALNNNLFHPQGGGQPADIGWVNNVPVKVRKQATGQIAVYPESTLHAPLGAQLNSKLSEEARICHAALHTAGHLLNWEMRQYGWMAISGHHFPGESRVEFSPIGSSAIPFDQLSLQNIETTINTKLRDGGQVTTWYEADTRLCLIEGTEPMPCAGTHVDNLNKINKFTIKSVKFKKGTLRISYDASHIILRADNVS

SEQ ID NO: 10737 - protein, 305 aa, Xenorhabdus bovienii
  Coding DNA sequence: Name=SeqID_4629
  Gene classification: Gene name=RhaT; Function=7 Permeases of the drug/metabolite transporter (DMT) superfamily; Function class=G Carbohydrate transport and metabolism
  Homolog annotation: Query=20..295bp; Hit=11..284bp; Blast score=81; Percent Identity=26.0; E value=1e-15; Homolog= DR2393 COG0697
MSHDVLPLSRRRLYLLDLGLLAVALSWGASYSLMQLIIQAGLTVPLFLMLRFALSVPFMFLGTRVRLRNIKPGEIINGLIFGCLLYAILTFETLGVKYTTASNAGFLIALSVVIVPFFERIFRKRKQSKFIYFTCFISLAGGGILSFSDTGNFGFNNGDWLILLAALIRGFQIFMFGKQTSGKSYSLVNITLIELVTVSVLGLAFVLMTDTASLHLIPTITFDVWGYILFLSLLATAFAFLLQLYAAKTTSPTRVGLILSLEPAFAALFAVAIMGETIGILQSFGGAIIVCAALLGRIVEGKRYE

SEQ ID NO: 10738 - protein, 54 aa, Xenorhabdus bovienii
  Coding DNA sequence: Name=SeqID_4630
MVHDGVLMLRLSSDESVILNPGDFYAFSGDVIHSYICIDVAVSATVVMSYSIQS

SEQ ID NO: 10739 - protein, 36 aa, Xenorhabdus bovienii
  Coding DNA sequence: Name=SeqID_4631
MNHNVFMSPYCMSGTTNNKLINEIICTFVIVGNTIH

SEQ ID NO: 10740 - protein, 146 aa, Xenorhabdus bovienii; identical to SEQ ID NO: 8316
  Coding DNA sequence: Name=SeqID_4632

SEQ ID NO: 10741 - protein, 178 aa, Xenorhabdus bovienii; identical to SEQ ID NO: 8288
  Coding DNA sequence: Name=SeqID_4633
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 10742 - protein, 99 aa, Xenorhabdus bovienii
  Coding DNA sequence: Name=SeqID_4634
LRLARNISLNELSKLSGVSKAALSQLESGNSNPRIDTLDAIAIALRLPLGDLFGSNNERYPYLEKNIPMEDTYSQVMKFRIGLGSVAEIWHLQMNPGVK

SEQ ID NO: 10743 - protein, 149 aa, Xenorhabdus bovienii
  Coding DNA sequence: Name=SeqID_4635
  Homolog annotation: Query=6..133bp; Hit=6..133bp; Blast score=99; Percent Identity=46.0; E value=7e-21; Homolog= ref|NP_931036.1|
MLQINDCFKIIYTSALLLIMPGPTNTLLLCSGFSQGIIKSLKLILAECIGYLLSISSWGLLVIVLAKHSPLLLLTIKLISALYVAYLAVKIWHFSLQGYDYHVTTMTIFFTTLLNPKSFIFAAFIIPTSAFSIRYQALNVIHGLTLATG

SEQ ID NO: 10744 - protein, 466 aa, Xenorhabdus bovienii
  Coding DNA sequence: Name=SeqID_4636
  Gene classification: Gene name=RtcB; Function=Uncharacterized ACR; Function class=S Function unknown
  Homolog annotation: Query=43..460bp; Hit=35..468bp; Blast score=189; Percent Identity=33.0; E value=8e-48; Homolog= TM1357 COG1690
MSTFTRLQKRLSRQGIETQYENNIYRFNKEQIEAEVLLPESLPLEEKAVQQLLDLASVHVPGSDAKVCRTRATPDFHPGAVAPVGCIVATTEDLVIPAAIGTDINCGMRLLTTGLSYAEAYSQKEALIQQLKNTLLLDQRDVPVTSTSFSALFDEGLAAWLQELPQQGVWQQADFKRMHAELNAILSTQAVQAHSRYAPEAFFEQREIIRPASLGTVGSGNHFVELQIVDTILDRHAAYAAGLHEGEVLMMIHTGSRDVGFYIGQRWMDKARALWPATAKYPSSGLFGLTDEHAQEYFLAMGCAARYAWANRIVLTELVRAAWKQVFGQDKSKLIVDLSHNIIFPEQGMNLHRKGATPARAGELALIPGSMGDYSYLVLGKGNEDWLWSCSHGAGRSVRRQAMRNKVPDLQKNSRLPWQCITLKSDRLREEAPEAYKPITPVIEIQEQTGLIQPVARVRPWITFKA

SEQ ID NO: 10745 - protein, 41 aa, Xenorhabdus bovienii
  Coding DNA sequence: Name=SeqID_4637
MLGDITEITHELDNFICILTLHITLLISMVLFDKIIILETV

SEQ ID NO: 10746 - protein, 168 aa, Xenorhabdus bovienii
  Coding DNA sequence: Name=SeqID_4638
  Homolog annotation: Query=1..167bp; Hit=1..162bp; Blast score=192; Percent Identity=55.0; E value=2e-48; Homolog= dbj|BAC06580.1|
LKKLERQEAPDCLSNFKHGVDSWGAVPKDEIWSKLEQMQGEFCAYCECRLKGKSKHIEHFRKRETFPDKAFNWGNLFGSCGDPQKTGGWGRCGIYKDNRKLNPPCDINKLIKPDEEDPGDYLLFLISGHVVPQRNLCDRERQKAEETIRVFNLNNDTSLFNSRKNTIE

SEQ ID NO: 10747 - protein, 548 aa, Xenorhabdus bovienii
  Coding DNA sequence: Name=SeqID_4639
  Homolog annotation: Query=3..547bp; Hit=4..559bp; Blast score=452; Percent Identity=47.0; E value=1e-125; Homolog= dbj|BAC06579.1|
MKKNRHIRALEMNAKKGDLLANFNLYQEYLSGEMNVEKNESLSEYYFEQCCVLIEENNFILESLKLIDFRRFKKLNIEKGLDRHLTVFIGTNGEGKTSIIEAISKTLSWLNANILKEDGQGSGITYDDIHNESEGYADIYTEFKYGVDTRINARLSRAIEAASKKRDSEVVGLKSIANMWRIINDKRRINLPLFASYLIERSYPLKINKRNFLIDIPEKRRLRFDAYTDALRGTGKFENFVDWFISLSKIKKYGTSIFNEELNQLKKQIEIKVMNEILSTIYDDSILKEMKNKYLESLEEKQDDGSHESIIVSKVIEAISHVVPSVEDIWVTDKSGVDEILVLIDGKAVKLTQLSDGQRVFIALVADLTRRLVLLNPEKENPLEGNGIVLIDEIELHLHPKWQQSIITTLQETFPNIQFIISTHSPQVLSTVNRKNIRYFSGEDDTGAVWLRVPDFQTKGVANSDVLEQLMNTFSIPDLPESKWVNDLIELVEKDNYENNSNAKELFNKIKEHFGDEHPEVKRCESHIRLQSLKVKARKKFDKKKDEN

SEQ ID NO: 10748 - protein, 310 aa, Xenorhabdus bovienii
  Coding DNA sequence: Name=SeqID_4640
  Gene classification: Function=Retron-type reverse transcriptase; Function class=L DNA replication, recombination and repair
  Homolog annotation: Query=29..304bp; Hit=41..318bp; Blast score=260; Percent Identity=49.0; E value=1e-69; Homolog= VC2385 COG3344
MTVLFGLVKTLGISEREAITFLSDAPKKYKVYSIPKRSSGHRIIAQPSKRLKEYQTAFLKCCLLPVHPSAMAYRQGLSIKDNANYHKDNQYLLKMDLENFFNSITPNILWESWNKKELFIDDNDRKILQRLLFWCPSKKNSGKLVLSIGAPTSPAVSNSFLYNFDEELYNFCLKYQIAYTRYADDLTFSTNQTGVLFTVHEMVKKLLIKHFDRQITLNHGKTIFSSKAHNRHITGVTITNDGKLSIGRQKKRYIKHLVYQFELGVLSIEDICYLQGLLAFAKHIEPLFIPRLVQKYSKETLKNIFDIGSS

SEQ ID NO: 10749 - protein, 303 aa, Xenorhabdus bovienii
  Coding DNA sequence: Name=SeqID_4641
  Gene classification: Function=Predicted restriction endonuclease; Function class=L DNA replication, recombination and repair
  Homolog annotation: Query=14..293bp; Hit=12..291bp; Blast score=362; Percent Identity=58.0; E value=1e-100; Homolog= Z5892 COG3440
MIAIPLPVSQKAHMLTIKKLQTAISSLSVWRKGDQRAPHKPLLLLYVLSQYQKKHGRLFNYGEELHQPLLELLNNFGPKRKNHYPTMPFWRLRGDGFWELQNTERCTLQKGNKEPPKRELIEYGVIGGFDQASYQLLQTKPELIDKLAQQILSEHFPESVQELIANQLDFSLGDIRKLRDPHFRQNILRAYNYQCAVCGYNLRHDNTPVGLEAAHIKWKQYGGPCTVTNGLALCSLHHSAFDMGSIGLDDSMKLIVSKGINGGQMVEQLFWNFADQPIVLPQQKEYYPQEEFVTWHRSQVFKQ

SEQ ID NO: 10750 - protein, 350 aa, Xenorhabdus bovienii
  Coding DNA sequence: Name=SeqID_4642
  Gene classification: Gene name=PotD; Function=Spermidine/putrescine -binding periplasmic protein; Function class=E Amino acid transport and metabolism
  Homolog annotation: Query=1..350bp; Hit=1..348bp; Blast score=527; Percent Identity=73.0; E value=1e-150; Homolog= potD COG0687
MKKWFYLLAAGMMAFSIGSVNAAAADDGKTLYFYNWTEYVPPGLLNQFTNETGIKVIYSTYESNESMYTKLKTYKDGAYDLVVPSTYFVSKMSKEGMLQKIDTSKLSNFKNLDPNLLHKSFDPKNEYSIPYIWGATAIGVNSDNIDPKTISSWADFWKPQYQNGLVLTDDAREVFQMALLKLGYSGNTTNPKEIEAAYQELQKLMPNVLAFNSDNPANPFMEGEVDLGMVWTGSAYVARQSGTPVDIIWPKEGGIFWMDSLAIPANAKNVDGAMKLINFLLRPEIAAQVAQKIGYPTPNLAAKKLLPAEITGDQSLYPDEAIIQKGEWQSDVGNANILYENYFQKLKAGQ

SEQ ID NO: 10751 - protein, 46 aa, Xenorhabdus bovienii
  Coding DNA sequence: Name=SeqID_4643
MKCRFYNSRFSKGRFTPSLYKTNAPTARETLHEKVVLSASRWDDGI

SEQ ID NO: 10752 - protein, 259 aa, Xenorhabdus bovienii
  Coding DNA sequence: Name=SeqID_4644
  Gene classification: Gene name=PotC; Function=ABC-type spermidine/putrescine transport system, permease component II; Function class=E Amino acid transport and metabolism
  Homolog annotation: Query=1..256bp; Hit=1..256bp; Blast score=353; Percent Identity=89.0; E value=1e-97; Homolog= potC COG1177
MIGRLLRGGFMTLVYAYLYIPIVILIVSSFNQSRFGISWQGFTTEWYSLLFNNDSLLQAAGHSLTMAVTSATFATLIGSLTAVALYRYSFRGKNFVSGMLFVVMMSPDIVMAISLLVLFMLLGVSLGFWSLLFSHITFCLPFVVVTVYSRLKDFDVKMLEAARDLGAGELTILRKIILPLAMPAVMAGWLLSFTLSMDDVVVSSFVTGPSYEILPLKIYSMVKVGVSPEVNALATILLVMSLVLVLFSQFIMRDRTGKA

SEQ ID NO: 10753 - protein, 271 aa, Xenorhabdus bovienii
  Coding DNA sequence: Name=SeqID_4645
  Gene classification: Gene name=PotB; Function=ABC-type spermidine/putrescine transport system, permease component I; Function class=E Amino acid transport and metabolism
  Homolog annotation: Query=1..267bp; Hit=15..281bp; Blast score=380; Percent Identity=83.0; E value=1e-105; Homolog= ZpotB COG1176
MVSWLMLFVFMPNLMIIGTSFLTRDDANLVQMVFSLDNYTRLFDPLYAEVLLHSLNMAIVATLCCLVIGYPFAFFLARMPEKLRPLMLFLLIVPFWTNSLIRIYGLKMFLSTRGYLNDFLLWLGIVDKPLRIMYTSEAVVLGLVYILLPFMVMPLYSSIEKLDKPCLEAARDLGAGKLQTFIRIIIPLTMPGIIAGCLLVLLPAMGLFYVADLMGGAKNLLIGNVIKSQFLNIRDWPFGAATSICLTLVMGLMLLVYYRAAKLLNKKVELE

SEQ ID NO: 10754 - protein, 371 aa, Xenorhabdus bovienii
  Coding DNA sequence: Name=SeqID_4646
  Gene classification: Function=ABC-type spermidine/putrescine transport systems, ATPase components; Function class=E Amino acid transport and metabolism
  Homolog annotation: Query=5..369bp; Hit=12..376bp; Blast score=587; Percent Identity=81.0; E value=1e-168; Homolog= ZpotA COG3842
MTENTSLTPLVELNTLCKGFDGKQVISQLDLIINDGEFLTILGPSGCGKTTVLRLIAGLEDADSGKILLEGQDITDIPAEHRHVNTVFQSYALFPHMTVFENVAFGLRMQKTPAKEIAPRVEEALRMVQLEEFAQRRPAQLSGGQQQRVAIARAVVNKPKVLLLDESLSALDYKLRKQMQNELKALQRKLGITFIFVTHDQEEALVMSDRIVVMRDGRIEQDGTPREIYEEPKNLFVARFIGEINIFDAKVLHRIDEQRIRADVEGHECDIFTSLPVTAGQILKVLLRPEDLRVEEINHGEQVSGLVGYVRERNYKGMTLDSVVEMENGKMVMVSEFFNEDDPDVDHSLNQKIAVTWVESWEVVLVDEEDA

SEQ ID NO: 10755 - protein, 106 aa, Xenorhabdus bovienii
  Coding DNA sequence: Name=SeqID_4647
MITSRSMLYPVYTPGNNFLSGILQSLLIFFTFNEILQTRKPALPSIKTHLKTPFMLLCRTSGVIQTLLSLLSPSTKTRHPILFLKKIKLFELFFIALITKFIIHCF

SEQ ID NO: 10756 - protein, 376 aa, Xenorhabdus bovienii
  Coding DNA sequence: Name=SeqID_4648
  Gene classification: Gene name=PtsN; Function=Phosphotransferase system mannitol/fructose-specific IIA domain (Ntr-type); Function class=G Carbohydrate transport and metabolism
  Homolog annotation: Query=1..260bp; Hit=1..262bp; Blast score=258; Percent Identity=54.0; E value=7e-69; Homolog= fruB_1 COG1762
MFHLSLKDIHLAAYADNKESAIRQVTAALAASGYVSERYIEGMLEREIQSSTYLGNGIAIPHGTTATRDQVLHTGVQVLQFPDGVAWGNNQTVHIVIGIAAKSDEHLTLLHQLTRIISDENLASQMAKTASADELYRLLMSTPSSHFLDASTITLDIDAHDLTTLQALNIARLQLAKAVNAAFIADVLARPPIHLGQGLWLSDSAIGNLRNAVAITRPKTPFTMDGQPVGVLMTIAYADDQLQSLLSPISTLLQQNKAERLYSAPDAAAIIALLTTATPQEATALSADFILPNEHGLHTRPSSLLVNTIKQFNSQITIAHLDGSGVPVDGRKLMQVAGLGVKKGERIRFTAVGSDAEQALTAITALIEQNMGGEIA

SEQ ID NO: 10757 - protein, 319 aa, Xenorhabdus bovienii
  Coding DNA sequence: Name=SeqID_4649
  Gene classification: Gene name=FruK; Function=Fructose-1-phosphate kinase and related fructose-6-phosphate kinase (PfkB); Function class=G Carbohydrate transport and metabolism
  Homolog annotation: Query=1..312bp; Hit=1..312bp; Blast score=432; Percent Identity=68.0; E value=1e-121; Homolog= fruK COG1105
MSKRVATITLNPAYDLVGLTTDISIGKVNRVQTAGLYPAGKGINVGKILKNLGIDVTVGGFLGEDNQDSFQNTFAELGMNNQYQLVEGRTRINVKLTEQSDIVTDFNFSGFSVSKEEWQQFANRSLQWLSEFSMVCVSGSLPAGVDLDDFTHWMQRLREECMCVVFDSSREAFVAGLKALPWMVKPNRHELEIWAGQPLPTQEDIVTAAHQLRAQGVSHVVISLGDEGAILVNASGTWLAKPPHCEIVSTVGAGDAMVGGLIYGLMMGQPSEHTLRLATAISALTVSQSSVGSIDRQQLARMMARVELTPLHTQSAKNN

SEQ ID NO: 10758 - protein, 562 aa, Xenorhabdus bovienii
  Coding DNA sequence: Name=SeqID_4650
  Gene classification: Gene name=FruA; Function=Phosphotransferase system, fructose-specific IIC component; Function class=G Carbohydrate transport and metabolism
  Homolog annotation: Query=227..561bp; Hit=1..334bp; Blast score=463; Percent Identity=78.0; E value=1e-130; Homolog= fruA_3 COG1299
MNTLILTDNQQGQARAYLARHTLETIAAQHGLSLVTDVNNAELVIIIGDSAPDNVNLHGKKTFAGSAEQAIREPDTFISHAKNQASVYQSQDSHHSPDNAVQHNTMNIVAITACPTGVAHTFMAAKALETEAQKRGWQIKVETRGSVGTNNAITRAEIVAADLVIVAADIDVDLTPFSGKRLYRTSTGAALKKTAQELDKALTTAEIYSAKRETSASNNPKPAGTGAYQHLMTGVSYMLPMVVAGGLCIALSFVFGIEAFKESGTLAAALMQIGGGSALSLMVPVLSGYIAYSIAGRTGLAPGLVGGMLAVSTGAGFLGGIISGFLAGYIAMLLTTRLRLPQSMEALKPILIIPLVATLVTGLTMIYVVGNPVAAMMEWLTHWLKSMGTTNAVILGAILGGMMCTDMGGPVNKAAYAFGVGLLSTQTYGPMAAIMAAGMVPPLAMWLATVIARNKFDQSEREGGKAALVLGLCFISEGAIPFAAKDPVRVLPSCILGGAVTGALSMYFGVHLMAPHGGLFVLLIPGAITPVVNYLGAIVIGTVLTAGVYGVVKKKAEVEVVG

SEQ ID NO: 10759 - protein, 82 aa, Xenorhabdus bovienii
  Coding DNA sequence: Name=SeqID_4651
MVSLLINPITIYPPHLRGTATLTVICSLTLRFIPAFAGNRAPRARINWIPTVYPRICGEQTNFMLLFLISFFKGEISTAFFP

SEQ ID NO: 10760 - protein, 124 aa, Xenorhabdus bovienii
  Coding DNA sequence: Name=SeqID_4652
  Homolog annotation: Query=2..123bp; Hit=77..198bp; Blast score=128; Percent Identity=52.0; E value=2e-29; Homolog= ref|NP_417236.1|
LRIPCGAKLRFKLRANPVKTIKDERQRRTRDGELKCCRVPLIHEEQQLQWLSRKLAGAALLSTAWVISEPPIYFRKSDISGKIQPICFEGQITVQESEVLISLLSKGIGPAKAIGCGLLSLAPD

SEQ ID NO: 10761 - protein, 76 aa, Xenorhabdus bovienii
  Coding DNA sequence: Name=SeqID_4653
MGLDRLTLGERTISTASGFMAAFPNRPDDARDFLFRVEEWQSDRGVGVLLQSAQEPSSVKVAQVIASKAIAYSLWC

SEQ ID NO: 10762 - protein, 173 aa, Xenorhabdus bovienii
  Coding DNA sequence: Name=SeqID_4654
  Gene classification: Gene name=WecD; Function=Histone acetyltransferase HPA2 and related acetyltransferases; Function class=K Transcription
  Homolog annotation: Query=8..162bp; Hit=9..158bp; Blast score=78; Percent Identity=32.0; E value=4e-15; Homolog= Z4777 COG0454
MSLIIEEITQQHNRKAFDCGVRERELNQFLQQQARQKAIKHISKTYVVCRASEPTTILGYYTLSGYSVITQPTHRDYKKYPHPLNAVKLARLAVDSSYQGQRLGEKLLIDAIYRTVLVSQQISAIGLFVDPMSPEVIPFYQQYDFLSVEPDEHSCLEMWLPIKTCMEVASVLL

SEQ ID NO: 10763 - protein, 97 aa, Xenorhabdus bovienii
  Coding DNA sequence: Name=SeqID_4655
  Homolog annotation: Query=1..94bp; Hit=12..105bp; Blast score=127; Percent Identity=76.0; E value=5e-29; Homolog= ref|NP_929886.1|
MGTYSERKETRLVARTSLEIQELIQRAADYSGATLSQFLIEAAMDRARNVIEQAEILQLSMAGTDALFVALENPPKVSKKLLKAAADYKDEVNVLDN

SEQ ID NO: 10764 - protein, 76 aa, Xenorhabdus bovienii
  Coding DNA sequence: Name=SeqID_4656
MAHKINLYQIVCHNGIQKYNTVITMDNRNAISSVTNLCPESNLLAMEGSISIDLANCRKLTFMFSNVSAMISLGCT

SEQ ID NO: 10765 - protein, 261 aa, Xenorhabdus bovienii
  Coding DNA sequence: Name=SeqID_4657
  Gene classification: Gene name=RacX (BS); Function=Aspartate racemase; Function class=M Cell envelope biogenesis, outer membrane
  Homolog annotation: Query=32..251bp; Hit=2..222bp; Blast score=150; Percent Identity=38.0; E value=9e-37; Homolog= PAB0912 COG1794
MQIQHSPWKHCNYEPSRLCHHNDYLLRWHMKKIIGILGGMGPAATVDAMEKIIKHTPATCDQEHIPVIAVSFPEIPDRTANIISDGASPLNKMLVALRKLESAGAQCIIMPCNTAHYWYNELKAATKINFMNMIDITCNKIVNERINNVAILATTATIKSELYQSRLEKENINCVILDDIQQRCVMESILAYKGGNAGKAYFLLKGVISQLQSFGVEKFVMGCTEIPLILSRDGNVDRYIDATEELIKSAVDWCYSDEICF

SEQ ID NO: 10766 - protein, 298 aa, Xenorhabdus bovienii
  Coding DNA sequence: Name=SeqID_4658
  Gene classification: Gene name=LysR; Function=Transcriptional regulator; Function class=K Transcription
  Homolog annotation: Query=1..294bp; Hit=7..299bp; Blast score=262; Percent Identity=45.0; E value=3e-70; Homolog= yjiE COG0583
MLNNIELKWLYDAVMLEELRNFTLAAERRNISQSSFSRRIQALESAVGFEIFDRNFNPLQLSLQGRSFIVYARNLLSDIEHQVGKIKGGEIAKHRINIAAAHSLAISLLPEFISGFAEKSDKIFNVESINVDEAVHNLKEGKSDFILSFFNEELMTSPFLHHKVLDAQLHLVSGCKPDGEPLYNLDSSPLPLMKYTDESYMGRQVNQLLEKDFSDGFNYFFHSSMSELLKRMVLNGHGVGWLPDYSISKELKNQQLCILGQDYASIKMGVYIYRTHSRLNPSSERFWQYMRKRESGSQ

SEQ ID NO: 10767 - protein, 422 aa, Xenorhabdus bovienii
  Coding DNA sequence: Name=SeqID_4659
  Gene classification: Gene name=GltP; Function=Na+/H+-dicarboxylate symporters; Function class=C Energy production and conversion
  Homolog annotation: Query=10..407bp; Hit=9..402bp; Blast score=357; Percent Identity=51.0; E value=1e-98; Homolog= CC0263 COG1301
MNRQKLMKQIIIAILLGIITGWGFHHYLDASQTKEVASYINIITDVFLRLIKMIIAPLVFATIVAGLISIGGSSSVGRITIKAMAWFIIAGLVSLGIGMLMANLFQPGVGLNVSVPQQDNVDTGLNTSGFTLKNFISHIFPSSFAAAMSNNEILQILIFSIFFGSALSYVCHNSKKKSPIVTFIEDLGRIMFRITDYVMSFAPIAVFAAIASAVTVQGLGLLYDYGKLIGLFYLGLFLLWAVLSAVGFLFLGKSLFSLMRLIREPVALAFATASSESAYPKTMNALDRFGVPKRISSFVLPLGYSFNLDGSMMYQSFAVLFIAQAYHIDLSITEQIIIMLTLMITSKGMAGVARASVVVVAATLPMFNLPEAGILLILAIDQFLDMGRTATNVVGNSISTAVIAKLEEKQGRSELEPVDQEA

SEQ ID NO: 10768 - protein, 32 aa, Xenorhabdus bovienii
  Coding DNA sequence: Name=SeqID_4660
MRHGYGGDTSIEAGFNRLKTMEVKQAIIKAGA

SEQ ID NO: 10769 - protein, 88 aa, Xenorhabdus bovienii
  Coding DNA sequence: Name=SeqID_4661
MGTFFCPFEVFLIIATGRVGDQRLFNPCRTHSMPFFNSLKNSLKRVLLTLKRIRNNITLIWMLCVWVLRYPSHQPPLSSISNKIFNFR

SEQ ID NO: 10770 - protein, 283 aa, Xenorhabdus bovienii
  Coding DNA sequence: Name=SeqID_4662
  Gene classification: Gene name=PinR; Function=Site-specific recombinases, DNA invertase Pin homologs; Function class=L DNA replication, recombination and repair
  Homolog annotation: Query=11..270bp; Hit=1..260bp; Blast score=228; Percent Identity=46.0; E value=7e-60; Homolog= mlr9562 COG1961
MNHTKDKNQIVKVAQYLRMSTEHQKYSIENQSVYIQQYAEQHSMAIIYTYDDSGKSGVTLSGRNAFKRLIADVTNRVIDIAAILVYDVSRFGRFPDPDEAAHYSYILKTHNVKIIYCAEPLSEDHPEISMLALPILRYGAASFSKNLSEKVFAGQANLIKQGYHQGGMAGYGLRRQLIDDKHEPKLILGYGQRKNIQTDRVILTLGPKDEIKIVNEIYDLFIFKNFPEYLIATQLNQKKIPAENNGIWTREKVHQILTNEKYIGNKLINEIICTFVIVGNTIH

SEQ ID NO: 10771 - protein, 146 aa, Xenorhabdus bovienii; identical to SEQ ID NO: 8316
  Coding DNA sequence: Name=SeqID_4663

SEQ ID NO: 10772 - protein, 178 aa, Xenorhabdus bovienii; identical to SEQ ID NO: 8288
  Coding DNA sequence: Name=SeqID_4664
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 10773 - protein, 56 aa, Xenorhabdus bovienii
  Coding DNA sequence: Name=SeqID_4665
MVLNLQLIFLDYLTFIIKPLSNLNKNLSKIQEMNGSDAMVHLKLLSPEKNFFWLNK

SEQ ID NO: 10774 - protein, 36 aa, Xenorhabdus bovienii
  Coding DNA sequence: Name=SeqID_4666
MSPPNRALNTELEGLVSSSSIIKPLNFPFSSSFFLR

SEQ ID NO: 10775 - protein, 58 aa, Xenorhabdus bovienii
  Coding DNA sequence: Name=SeqID_4667
MDINNLNPVDYYILPRLDIVYEEFVIKEKNPIFLELYRYDNLDLFFEIITRREIMECI

SEQ ID NO: 10776 - protein, 299 aa, Xenorhabdus bovienii
  Coding DNA sequence: Name=SeqID_4668
  Gene classification: Gene name=Spo0J (BS); Function=Predicted transcriptional regulators; Function class=K Transcription
  Homolog annotation: Query=13..209bp; Hit=6..207bp; Blast score=60; Percent Identity=29.0; E value=2e-09; Homolog= BB0434 COG1475
MKEKTNDSNHNIEMIDISLIKISNPRPRNKFIHQEIQSNIDISGLRKPITVRRIKDKKYKYSLICGQGRMEAIYNLSNTHIPAIIKDVNEEDGYIMSLSENVARRKPRVTELYERIRDMKNNGICDHDIASIIGYSVSWVKSVILLLEKGEQKLLTAVERGHIPIYLAVKFARSDDKYNQNLLIDAYNDGSITNKNIATIKKILEKRSLGSKGGTSHDYIYHKNNQNITPQELLSIYKKNVEEHRLLQAKSEYVIDNLVLAKQIISELLLEPSFNSILITENLTKIPSIIMDTAKPHED

SEQ ID NO: 10777 - protein, 292 aa, Xenorhabdus bovienii
  Coding DNA sequence: Name=SeqID_4669
  Homolog annotation: Query=6..287bp; Hit=21..304bp; Blast score=194; Percent Identity=40.0; E value=1e-48; Homolog= ref|NP_789893.1|
MLKVCFNNELIDLSIEKMMASKPLPENVKSSIKYNQIKLSIKEIGLIEPIIIYFDDTGKSIKILDGHLRIEAMKELGIKKACCIVSTINDCYTPNKHVNHLTIIEEQKMLKKALISGVSIEKLSAALGISQETLKNRFRVTQGIASEAASLLSDKHIPVASLNVLRKMQPLRQIESANIMTSVDNFSAKFALSLLHATPDSLLKNSNVKKEKSDIQKNLTRLEKEMAMVQTETKKHEEHYGANTLKLVIIKSHIANLLNNTKILHWLFENKPDYLSLLKKISDLDSLTEQEK

SEQ ID NO: 10778 - protein, 272 aa, Xenorhabdus bovienii
  Coding DNA sequence: Name=SeqID_4670
  Gene classification: Gene name=Pnp; Function=Purine nucleoside phosphorylase; Function class=F Nucleotide transport and metabolism
  Homolog annotation: Query=1..265bp; Hit=1..265bp; Blast score=316; Percent Identity=56.0; E value=2e-86; Homolog= BH1531 COG0005
MHKTADILESKNHVESITNIKPTIGIILGSGLGSFADTLEGAVHIPYSNIPHFAKSGAVGHSNELVIGSIGGKNVVVMKGRFHYYEGFTLDQVTFPVRLMKALGVEKLIITNACGAVNTDFSPGDLMLITDHINLTANNPLIGPNNPDLGVRFLDVSEVYNKALRSIVIDVAKAQNITLRQGVYAWWTGPTYETPAEIRMIRTLGADAVGMSTVPEALIARHAGIDTVGISCLTNMACGILDQPLSHEEVIETAEKVKATFLKLIAETISRF

SEQ ID NO: 10779 - protein, 64 aa, Xenorhabdus bovienii
  Coding DNA sequence: Name=SeqID_4671
MVWPSSVGVVVFFIIDLRLILHHFDFSWHSGGFICHLSLYITAGACRSLRVSYVVADTNRDNRL

SEQ ID NO: 10780 - protein, 106 aa, Xenorhabdus bovienii
  Coding DNA sequence: Name=SeqID_4672
  Gene classification: Function=Uncharacterized ACR; Function class=S Function unknown
  Homolog annotation: Query=1..104bp; Hit=1..104bp; Blast score=150; Percent Identity=77.0; E value=2e-37; Homolog= ybjQ COG0393
MKNTTTPTLEGHTITEYLGVVTGETILGVNIIKDFFAGVRDIIGGRSGAYEKELKNAREIAFVEMNAQAQALGANAVVGIDIDYETVGKNGGMLMVTVSGTAVKIV

SEQ ID NO: 10781 - protein, 64 aa, Xenorhabdus bovienii
  Coding DNA sequence: Name=SeqID_4673
MKFSAKVQGNGFELRKEIKHYFSHIGSLYHPVSCCLLNYCMTIIGPDLNKCSASIPSINASACE

SEQ ID NO: 10782 - protein, 62 aa, Xenorhabdus bovienii
  Coding DNA sequence: Name=SeqID_4674
  Homolog annotation: Query=1..61bp; Hit=97..157bp; Blast score=99; Percent Identity=77.0; E value=9e-21; Homolog= ref|NP_681031.1|
MIDASHIKVHPHAAGTKGGNQDMGRTKGGSIPRYIWPWMRMVCRSEFLLQEVPQLITHKLKH

SEQ ID NO: 10783 - protein, 73 aa, Xenorhabdus bovienii
  Coding DNA sequence: Name=SeqID_4675
  Gene classification: Function=Predicted transposase; Function class=L DNA replication, recombination and repair
  Homolog annotation: Query=11..73bp; Hit=6..68bp; Blast score=65; Percent Identity=46.0; E value=1e-11; Homolog= CC0928 COG3293
MSTPSHRRHDISDHIWNLLEPHLLGRKGAWGREAQDNRLFINAVFWILRIGSPWRDLPPDYGDWKNTHRRFCR

SEQ ID NO: 10784 - protein, 313 aa, Xenorhabdus bovienii
  Coding DNA sequence: Name=SeqID_4676
  Homolog annotation: Query=10..309bp; Hit=1..302bp; Blast score=173; Percent Identity=35.0; E value=3e-42; Homolog= ref|NP_742191.1|
MRYRIGNKYMNVYKVSIDYKGYYAIDKDDYEQRTSRRSPWYKTSDTGSPQYFAICPACDNPIQIIGFYKPSINTPHPYGKHFGRSVPGVGVYDHEAYTWCPYSKKNINNPDERPKREPSYLTGQILKILICHFDKIVFFLSKNMGIRIDEKLAESMLLQYRDEEGWLYARATLMNVPWQFAYMTDNQVILFKKILSSDLAEILINQVPKYLMLNDNGYLIKHPDCKKYIELGTYYTRHHIHVQGNELVEKMDCVFTLKEGYNTPREIHRITIEFDYRYFDNLANFSQWTRSPYNNKLLQLANEILGPQLAKFK

SEQ ID NO: 10785 - protein, 66 aa, Xenorhabdus bovienii
  Coding DNA sequence: Name=SeqID_4677
LGSFLYIFLKRVDCRSHPDFFEIQSDDFVYLALLQFNVKGILYVKGLKDEYGLSFILYVIPPFLMR

SEQ ID NO: 10786 - protein, 247 aa, Xenorhabdus bovienii
  Coding DNA sequence: Name=SeqID_4678
  Homolog annotation: Query=3..122bp; Hit=24..140bp; Blast score=117; Percent Identity=48.0; E value=2e-25; Homolog= ref|NP_660030.1|
MNDRFTEKTKRVIQERVGNRCSNPDCNILTSGPNAHPEKSTKTGVAAHITAASPGGARYDSSLNSEQRKSAENGIWLCQNCAHFIDTDYLKYPVRRLYEWKNKAECEAERGTKRMIDKSTSRDDIKFIEQEEGWICPFCGTVVGVEKLVCIGCHAEVVPGLTRAERNELVKTGMMAGGGLSALLFLILPSWIASYFDIRLDLFGHNYIYVFICISVIMVFVIGKFFVYFSEKSRLQKPPRFFRNSIR

SEQ ID NO: 10787 - protein, 132 aa, Xenorhabdus bovienii
  Coding DNA sequence: Name=SeqID_4679
  Gene classification: Gene name=InsB; Function=Insertion element IS1 protein InsB, putative transposase; Function class=L DNA replication, recombination and repair
  Homolog annotation: Query=1..132bp; Hit=7..137bp; Blast score=141; Percent Identity=57.0; E value=2e-34; Homolog= Z1562 COG1662
LDEQGSFVGNKKQRHWLWYAFDTKRKQVTAHVFGPRTDATCRKLLNLLASFNIRFITTDNWGSYAREMVPEKHLVGKIFTQRIERHNLNLRIHIKRLARRTICYSRSMEIHEKLIGAYIEKHHYNSFGVMTK

SEQ ID NO: 10788 - protein, 93 aa, Xenorhabdus bovienii
  Coding DNA sequence: Name=SeqID_4680
MGGDLFPFRIKSIPKPMTLFFIAYKRPLLIQFTDKCDIVISDLSRCYLFWREFFNVRITVLIPRPNTRPVSLTPEPFIAISTIFSFMPGLWPL

SEQ ID NO: 10789 - protein, 61 aa, Xenorhabdus bovienii
  Coding DNA sequence: Name=SeqID_4681
MAVVTIVELKGSLAVFAIVTREASLTCTVFAYRFSLVAISTSHFYRNSHDDVPLKSTRISN

SEQ ID NO: 10790 - protein, 455 aa, Xenorhabdus bovienii
  Coding DNA sequence: Name=SeqID_4682
  Homolog annotation: Query=5..452bp; Hit=7..441bp; Blast score=175; Percent Identity=28.0; E value=1e-42; Homolog= ref|NP_644249.1|
MIKSITYEGKKIELYNNINNRENIFSIIIGKNGTGKSRLLQLICEEYSNNNTPKIKNSPSRIIAVSTTPFDKFPLKNNFKKGYYYQGIRGIQAQAISKGYISKFIGDFLLGITENKINSLSKALEYLGYEDKIAISFRYIGGKRIENIINSNESDINESLKYHPYFESIVLNKLGIVKEYSTNRRVYELRSYLVEKLIKGKEEINQFLVKDDKSLHELFKSICNSPWLHKIRKLKMNIIGKNVEFNKELSLSKDLINLINSGLLKIENIILKKTNSKEAFHIDSASSGEQSVIMNILGISSVIKDNSLILIDEPEVCLHPEWQEKYIKLLIDIFKINKKCHFIITTHSPQIIANLGEKNCFITSIEDGKSKKSINYINKSSDFQLATLFNSPGFKNEYLTRLSLNLLSKIISEKSVDHEDKKIMEELLLIKNKLHEKDPLLELITSLDEMVKYYG

SEQ ID NO: 10791 - protein, 208 aa, Xenorhabdus bovienii
  Coding DNA sequence: Name=SeqID_4683
  Homolog annotation: Query=4..186bp; Hit=2..182bp; Blast score=143; Percent Identity=38.0; E value=2e-33; Homolog= ref|NP_644248.1|
MADINEPISYSKNSTEFICKKKSTENFSHTQWDEENLKTVRKEIRDYYRMKQNGCCVYCRNELSITSPINCHIEHIAPKSRYLNFIFEPRNLCVVCADCNTIKKDKEIKNECENTISSSAKLYPRSSKAFSVYHPHFDFWKDHIVKFNGEIYADLTDKGANTIRICRLNRRLRKFGINEQIISNLDKFHLMNKIIEENKIEKFKDFFK

SEQ ID NO: 10792 - protein, 270 aa, Xenorhabdus bovienii
  Coding DNA sequence: Name=SeqID_4684
MNNRDVIRQSRILDKLDSHTLNMYDTTCRWLPKGIFLWVETKGTGHTFISVHAESGISVFTYGRYADTGPLGLTGDGVLIWLQNNEAIEYMSTELYRMEAQVYNIRDADIFAIMGYFKSLWHTGKNIGGTSVSESTQRFGKIIDTYDVTGVNCTTHSVKALKYAGSSVFQRKNVFSVNYTEDFTIPYSLRMYMNDIDTLKKSMIITDVTWSFKQQMRNTKGLAPLNDAGKVQGALGVGAKSSGTLGTQSSGYGGATFGGSSGWNYTPEEE

SEQ ID NO: 10793 - protein, 141 aa, Xenorhabdus bovienii
  Coding DNA sequence: Name=SeqID_4685
MWIKSLFNMLIIIILFVFSNIGFISIDLTIKEIITLWTNKEYTPSELSFFIQITDYVMLTNNFLFVLCTTIFFLRNKLRYSLRMIFSVFLITLLNNISTFIYALNFSIFFKFIKNHDIHLILILFPVSMIIIYILARIKNK

SEQ ID NO: 10794 - protein, 45 aa, Xenorhabdus bovienii
  Coding DNA sequence: Name=SeqID_4686
  Gene classification: Gene name=XerC; Function=Integrase; Function class=L DNA replication, recombination and repair
  Homolog annotation: Query=1..35bp; Hit=346..380bp; Blast score=58; Percent Identity=71.0; E value=1e-09; Homolog= Z4313 COG0582
MACGAMGESGLWSDDAIERQLSHIESNNIRAAYIHTSVVLIGRLK

SEQ ID NO: 10795 - protein, 90 aa, Xenorhabdus bovienii
  Coding DNA sequence: Name=SeqID_4687
  Gene classification: Gene name=XerC; Function=Integrase; Function class=L DNA replication, recombination and repair
  Homolog annotation: Query=2..65bp; Hit=277..340bp; Blast score=78; Percent Identity=51.0; E value=1e-15; Homolog= Z4313 COG0582
MKMKTEHIVPLSRQAISLIKTLHSLSGEGEVMFPGDHDPKKVMSENTVNNALRAMGYDTNTEFVGTDSAQWHAVQWANQACGVMMLSSAS

SEQ ID NO: 10796 - protein, 132 aa, Xenorhabdus bovienii
  Coding DNA sequence: Name=SeqID_4688
  Gene classification: Gene name=XerC; Function=Integrase; Function class=L DNA replication, recombination and repair
  Homolog annotation: Query=1..127bp; Hit=121..247bp; Blast score=122; Percent Identity=46.0; E value=1e-28; Homolog= Z4313 COG0582
MRNLKQYISPYIGTLDVRTLRTRQLLEPIKAVDTDGKHDVVQRLQQRVTAIMRYAVQNDILEYSPANDTVGALTIVKSKHHAALPHERLPEFLMRLSCYRERLITRIAVELTLLTFVRSSEMRFTRWGRDRY

SEQ ID NO: 10797 - protein, 109 aa, Xenorhabdus bovienii
  Coding DNA sequence: Name=SeqID_4689
  Gene classification: Gene name=XerC; Function=Integrase; Function class=L DNA replication, recombination and repair
  Homolog annotation: Query=1..89bp; Hit=1..87bp; Blast score=89; Percent Identity=56.0; E value=4e-19; Homolog= ZintL COG0582
MKLNARQIETAKSKETSYKLAGGAGLYLEITPRGSKYWRMKYHHPTDKKEDRLAFGVYPAVSLADARAKRDEAKKLLAQGIDPKAEKKDAQAESKGAYAFEQIAIVLKQ

SEQ ID NO: 10798 - protein, 66 aa, Xenorhabdus bovienii
  Coding DNA sequence: Name=SeqID_4690
MVPKAGIEPAHPKAVDFESTASTDFATSALKYSRSTRKTEAIIPVRSPFATLILSILFKCRKKKHI

SEQ ID NO: 10799 - protein, 405 aa, Xenorhabdus bovienii
  Coding DNA sequence: Name=SeqID_4691
  Gene classification: Gene name=AmpC; Function=Beta-lactamase class C and other penicillin binding proteins; Function class=M Cell envelope biogenesis, outer membrane
  Homolog annotation: Query=53..401bp; Hit=29..377bp; Blast score=404; Percent Identity=57.0; E value=1e-113; Homolog= ampH COG1680
MNKQLYKLFAVSALSWALSACAAPDNAHQNNFPQSGKKPAKWQVFEGDDNTKKMASSLVDQYAQSIFDEGNPLGMAMVIIDNNQVVHRSFGETYPGSGARPRQDSVIRLASITKLMTSEVMIKLAQKERLKITDPLQKYTYYGVRVPDYAMAQPIRLYHLASHTSGLPREQPGGKWGRPVFIWPTQSNRWAWLKTAGMNAAPGTTASYSNLAYDLLADALSKATGEPYTRLLQEEITRPYRMKDTTLTPSRSQCARLMEGVKPSPCLSTTAAAGSGGIYSTPVDMQRWMQQFLSSHNQLRKKTASREQGIYFKRENLTSITGMDVAGQADGIGLGWVYMDAKKGVPGIYQKTGGGGGFNTYMAMIPEQNIGVFVVMTRKEQSKFSRVTNGVNELVAALSRNHGKL

SEQ ID NO: 10800 - protein, 358 aa, Xenorhabdus bovienii
  Coding DNA sequence: Name=SeqID_4692
  Gene classification: Function=Predicted permeases; Function class=R General function prediction only
  Homolog annotation: Query=2..357bp; Hit=5..360bp; Blast score=473; Percent Identity=72.0; E value=1e-133; Homolog= yjgQ COG0795
MFGVLDRYIGRTILQTILMTLFTLVSLSGIIKFVDQLRKVGQGEYSAFAAGIYTLLSIPKDIQIFFPMAALLGGLLGLGMLATRSELVVMQASGFTRLQVAGSVMKTAIPLVLLTMVIGEWVAPQGEQIARNYRSQKMFGGSLMSTAKGMWAKDGNDFVYIKSVDKDNALKDVSIYHFDDNKKLLSVKYAATAVYDQNNRQWKLSQVEESDLRQIGRITGSQRISAEWKSLLTPEKLGVVALDPDALSIRGLQQYITYLKQGQQDAGRYQLNMWKKVFAPLSVAVMMLMALSFIFGPLRSVAMGVRVIAGISTGFIFYVLNEIFGPLSLVYSMPPLLGALLPSLLFFVVSVYFLLHRK

SEQ ID NO: 10801 - protein, 366 aa, Xenorhabdus bovienii
  Coding DNA sequence: Name=SeqID_4693
  Gene classification: Function=Predicted permeases; Function class=R General function prediction only
  Homolog annotation: Query=1..365bp; Hit=1..365bp; Blast score=437; Percent Identity=67.0; E value=1e-123; Homolog= yjgP COG0795
VIIIRYLVRETLKSQIAILFILLLIFFSQKLVEVLGAAVEGSVPANLVLSLLGLGVPEMAQLILPLSLFLGVLMTFSKLYTESEITVMHACGLGKGVLVKSALILALFTSMLAAANVLWFTPWSSKYQEQVLADAKANPSLAAMMEGQFKPSRDGNMVLYIGNVKGNNFENVFLAQLRPVNNQRPSVVIADGGHMEERPNGNQVAVLHQGMRYEGTALMRDFRITDFKNYQAVIGHKAADIDSDKVEQKTLSQLWHKGDEDSRAELHWRLTLIVSVLVMALMVVPLSAVNPRQGRVLSMLPAMLLYLIFFLLQSSLRSNGGRGKLDPAFWMWLVNGAYFALALALNMWDTVPMRKLRSRFKNQGAA

SEQ ID NO: 10802 - protein, 36 aa, Xenorhabdus bovienii
  Coding DNA sequence: Name=SeqID_4694
MLWYHFSNGEAKLMHINGRYTTKLATFLQKDKFSQA

SEQ ID NO: 10803 - protein, 502 aa, Xenorhabdus bovienii
  Coding DNA sequence: Name=SeqID_4695
  Gene classification: Gene name=PepB; Function=Leucyl aminopeptidase; Function class=E Amino acid transport and metabolism
  Homolog annotation: Query=1..502bp; Hit=1..503bp; Blast score=894; Percent Identity=87.0; E value=0; Homolog= pepA COG0260
MEFSVKSGSPEKQRSACIIVGVFEPRRLSPIAEQLDKISNGYISALLRRGELEGKVGQSLLLHHVPNVLSERILLVGCGKERELDERQYKQIIQKTISTLNETGSMEAVCFLTELHVKGRNNYWKVRQAVETAKESLYVFDQLKSSKNELRRPLRKIVFNVPTRRELTSGERAIQHGLAIASGIKASKDLANMPPNICNAAYLASQARQLADTADNLNTKVIGEEQMKELGMNSYLAVGQGSQNESLMSVIEYKGSKDANAKPIVLVGKGLTFDAGGISLKPGEGMDEMKYDMCGAASVYGVMRVIAELQLPLNVIGVLAGCENMPGGRAYRPGDILTTMSGQTVEVLNTDAEGRLVLCDVLTYVERFDPELVIDVATLTGACVVALGSHYTGLMSNHNPLAHELLNASELAGDRAWRLPMADEYFEQLDSNFADMANIGGRAGGTITAGCFLSRFATKYNWAHLDIAGTAWRSGKAKGATGRPVALLAQFLLNRAGLNADD

SEQ ID NO: 10804 - protein, 52 aa, Xenorhabdus bovienii
  Coding DNA sequence: Name=SeqID_4696
MMGKAIQKGIAAAIPLIPLIPLISLDYTFYVELLGNKKGAGVLIIRIQACTI

SEQ ID NO: 10805 - protein, 154 aa, Xenorhabdus bovienii
  Coding DNA sequence: Name=SeqID_4697
  Gene classification: Gene name=HolC; Function=DNA polymerase III chi subunit; Function class=L DNA replication, recombination and repair
  Homolog annotation: Query=1..150bp; Hit=1..145bp; Blast score=193; Percent Identity=64.0; E value=5e-50; Homolog= ZholC COG2927
MKNATFYLLEKLSQEQSSSSDELQPHEWLACQLAADQWRAGKRVLIACESQQQAEKLDEALWQREPSQFVPHNLAGEGPRYGAPVELCWPQKRSNVPRDILVTLLPHFADFATAFHEVIDFVPIDENLKQLARERYKVYRSVSFNLTMATPPIY

SEQ ID NO: 10806 - protein, 965 aa, Xenorhabdus bovienii
  Coding DNA sequence: Name=SeqID_4698
  Gene classification: Gene name=ValS; Function=Valyl-tRNA synthetase; Function class=J Translation, ribosomal structure and biogenesis
  Homolog annotation: Query=15..965bp; Hit=1..951bp; Blast score=1658; Percent Identity=83.0; E value=0; Homolog= ZvalS COG0525
MEKTLANQTQSEPSLDKTYNPTEIEQPLYNHWEKNGYFKPNGDTSRESFCIVIPPPNVTGSLHMGHAFQQTIMDTMVRYQRMQGKNTLWQAGTDHAGIATQMVVERKIAAEEGKTRHDYGRDAFIDKIWQWKAESGGNITNQMRRLGNSVDWERERFTMDEGLSKAVKEAFVRLYQEDLIYRGKRLVNWDPKLRTAISDLEVENREVKGSMWHLRYPLADGTRTAEGKDYLIVATTRPETLLGDTGVAVNPEDPRYKDLIGKEIILPLMNRRIPILGDEHADMEKGTGCVKITPAHDFNDYEVGKRHSLPMINILTFDGDIRDEAEIFDTNGEASDVYSADIPAAYRGMERFAARKAIVAEFEKQGLLVETKPHDLTVPYGDRGGVVIEPMLTDQWYVRTAPLAKVALEAVENGDIQFVPKQYENMYYSWMRDIQDWCISRQLWWGHRIPAWYDTQGNVYVGRDEEEVRRENNLGADIALTQDEDVLDTWFSSGLWTFSTLGWPEQTEALKTFHPTNVLVSGFDIIFFWIARMIMMTMHFIKDENGKPQVPFKTVYMTGLIRDDEGQKMSKSKGNVIDPLDMIDGISLENLLEKRTGNMMQPQLAEKIGKRTEKQFPEGIEAHGTDALRFTLAALASTGRDINWDMKRLQGYRNFCNKLWNASRFVLMNTEGQDCGQNGGEMSLSLADRWILAEFNQTVKTYREALDTYRFDIAANILYEFTWNQFCDWYLELSKPAINKGSEAEVRAARHTLIEVLEGLLRLAHPIIPFITETIWQRVKVVKGINADTIMLQPFPQFDQAKVDELALSDLEWIKEAIIAVRNIRAEMNIAPSKPLEVLLRDANADAQRRVAENLNFIQAMGRLSSVTVLAVGEEAPVSVTKLINGAEILIPMAGLIDKDVELARLDKEIEKLDKEISAIEAKLSNDGFVSRAPEAVVAKERERLASNNAAKEKLLAQKETIAAL

SEQ ID NO: 10807 - protein, 257 aa, Xenorhabdus bovienii
  Coding DNA sequence: Name=SeqID_4699
  Gene classification: Gene name=ArtI; Function=ABC-type amino acid transport system, periplasmic component; Function class=E Amino acid transport and metabolism
  Homolog annotation: Query=1..257bp; Hit=11..267bp; Blast score=283; Percent Identity=55.0; E value=2e-76; Homolog= mll3861 COG0834
MKIVLNILLATIIQLGITQLAYAKSTLDNIQSTGVFRIGTEGAYAPFSYHDASGKLTGFDVEIGREIALRMKVKPEFIEGKWDGLIGGLDAGRSDAVMNQIAITPERAKKYRFSLPYVISEAVLITRKDNHDIKTFSDLKGRTSAHTLTNNFAQIARHYGAEIIGTNGFSQEVELVSTGRADATINDKLSYLDYKKHRPDAQVKIVAADTNAAQTAVLLRKSDPELKAAVDKAITEIKNDGTYQRIWDNYFGGEVAE

SEQ ID NO: 10808 - protein, 50 aa, Xenorhabdus bovienii
  Coding DNA sequence: Name=SeqID_4700
MALISGFGITILAERWLNNQNKIMGVFLIIHSPLKLKNTFNLDFLTGSII

SEQ ID NO: 10809 - protein, 235 aa, Xenorhabdus bovienii
  Coding DNA sequence: Name=SeqID_4701
  Gene classification: Gene name=ArtM; Function=ABC-type amino acid transport system, permease component; Function class=E Amino acid transport and metabolism
  Homolog annotation: Query=3..218bp; Hit=2..217bp; Blast score=269; Percent Identity=71.0; E value=2e-72; Homolog= mll3859 COG0765
MTPSWLSLALDSLWPMLYAGLTFTIPLTLITFALGISLGFIVALIRLYGPKPLIAVVRFYVWLIRGTPLLVQLFLIFYALPSVGITLEAFTSAVIGFTLNVGAYTSEVIRAALISVPKGQWEASHSIGMSWWQSLRRIVLPQAARVSIPPLSNTFISLVKDTSLASVITVPEMFLAAQRIAAVTYQPLILYTEAAILYLLLSSVLSALQVRLEKKFSQQFSQHRSSKEAKNDSAL

SEQ ID NO: 10810 - protein, 254 aa, Xenorhabdus bovienii
  Coding DNA sequence: Name=SeqID_4702
  Gene classification: Gene name=GlnQ; Function=ABC-type polar amino acid transport system, ATPase component; Function class=E Amino acid transport and metabolism
  Homolog annotation: Query=1..247bp; Hit=1..247bp; Blast score=321; Percent Identity=65.0; E value=4e-88; Homolog= mll3858 COG1126
MIQLSNIEKSFDGQKVLKNISLTIKEGSLTALIGPSGSGKSTLLRCINLLEIPQAGTLEIGKEQIAFTGKERLPHREIQRFSLQTGMVFQNFQLFPHLTVIENIMEGLIYVQKWPRERARERAQELLKKVDMFHKADVWPNTLSGGQQQRVAIARAMAPSPKVLLCDEPTSALDPELSKEVVSVLKHLAEEGTTMVMATHDLRLAANLAHNVIFLESGEIVESGTAQTMFTRPDKQRTGEFISTLTETLPDWEI

SEQ ID NO: 10811 - protein, 257 aa, Xenorhabdus bovienii
  Coding DNA sequence: Name=SeqID_4703
  Gene classification: Gene name=ArtI; Function=ABC-type amino acid transport system, periplasmic component; Function class=E Amino acid transport and metabolism
  Homolog annotation: Query=1..257bp; Hit=11..267bp; Blast score=307; Percent Identity=63.0; E value=8e-84; Homolog= mll3861 COG0834
MKAFLSLLLAGATALSISAPSYAGKDLDTIKASGVFKVGTEGTYPPFTYHDQANKLTGFDVDIAREVARRLNVKPEFMEVKWDGLIAGLDAKRFDAVINQVGVTPEREAKYSFSIPYTASQVVLITRDNNNDIKTFADIKGKRSAQSLTSNYGQLATYNGAHLVSTDGFNQAIDLVATGRADATLNDRLSFLDFKKQRPDAPVKIVAQQADASKSAVLLRKGDPELIAVINKALQDMKDDGTYARISEKYFGTDISK

SEQ ID NO: 10812 - protein, 167 aa, Xenorhabdus bovienii
  Coding DNA sequence: Name=SeqID_4704
  Gene classification: Gene name=WecD; Function=Histone acetyltransferase HPA2 and related acetyltransferases; Function class=K Transcription
  Homolog annotation: Query=11..167bp; Hit=5..160bp; Blast score=129; Percent Identity=42.0; E value=2e-30; Homolog= VC1217 COG0454
MTEKTTQHYVIRPITPQDNTGIAAVIRQVSAEHGLTADRGFAVADPILDTLYEVYSQPRSAYWVVEMDGEVVGGGGVAPLAGGDDDTCELQKMYLSSVLRGKGVARQIVKQSLEFGTEQGFKRCYLETTEILQAAIKLYEKLGFSYLGEPLGNTGHSDCEVRMIKAL

SEQ ID NO: 10813 - protein, 143 aa, Xenorhabdus bovienii
  Coding DNA sequence: Name=SeqID_4705
  Gene classification: Function=Uncharacterized BCR; Function class=S Function unknown
  Homolog annotation: Query=1..120bp; Hit=1..120bp; Blast score=148; Percent Identity=75.0; E value=2e-36; Homolog= yjgD COG3076
MADPHALEEQREETRLIIEELLEDGSDPDALYIIEHHFSAENFDLLEKAAVEAFKLGYEVTDAEELETEDRVVLMCCDIISESRLDAELINTQVEQLMNLVEKLGVNYDGWGTYFEDPNAPDDEDEDEAEAENFPEQDERKLH

SEQ ID NO: 10814 - protein, 60 aa, Xenorhabdus bovienii
  Coding DNA sequence: Name=SeqID_4706
MIKRVSSRCSSKACGSAMPIPSVIWLSCCAFSHLFPAKDIAIQFHQKGNTDRKLWHEKLS

SEQ ID NO: 10815 - protein, 337 aa, Xenorhabdus bovienii
  Coding DNA sequence: Name=SeqID_4707
  Gene classification: Gene name=ArgF; Function=Ornithine carbamoyltransferase; Function class=E Amino acid transport and metabolism
  Homolog annotation: Query=1..333bp; Hit=1..334bp; Blast score=528; Percent Identity=75.0; E value=1e-150; Homolog= ZargI COG0078
MNPFYQRNLLRLHDYTPSEINTFLTLASELKTNKKSGKESPLLSGKNIALIFEKDSTRTRCAFEVAAHDQGASVTYLSSNGSQIGYKESIKDTARVLGRLYDGIQYRGYGQEVVETLAKYAGVPVWNGLTNEFHPTQLLADLLTMQEHSQKPLTEIKFAYLGDARNNMGNTMLEAAALTGMDLRLVAPKACWPDAALIAECETLAEKTGGRIALTENIAAGVKDADFLYTDVWVSMGEPKTVWQERITLLKPYQVNMDVIQLTGNPEVKFLHCLPAFHDEETTLGKQLAEEFNLYGGLEVTSEVFESKHSIVFDQAENRMHTIKAVMVATLAKGLSF

SEQ ID NO: 10816 - protein, 357 aa, Xenorhabdus bovienii
  Coding DNA sequence: Name=SeqID_4708
  Gene classification: Gene name=RbsK; Function=Sugar kinases, ribokinase family; Function class=G Carbohydrate transport and metabolism
  Homolog annotation: Query=61..347bp; Hit=6..292bp; Blast score=303; Percent Identity=50.0; E value=3e-82; Homolog= ZyeiC COG0524
MPSRENQILRLIKQDPFIQQQEIADILGVSRSCVAGHIMNMNKKGHIKGKGYIFPSSNNAYAVTIGAANMDFTSYASEKLVYEDSNPGKIISTPGGVGRNIAQNIAALKSESHFISVVGNDYNGKVLFEQTKLAGVNIRYFHKLDEEKTSICNSIIDENGKCIVSVNDMDIMEKLTPTLLSQSEELIRRASVLVIDCNLTEGSLEWLFNHAGNVPIFIDTVSTFKATKIRHWLSHIHTLKPNRSEAEILSGIEIETQKDAAVAASWFHQQGVQRLILSMGAEGVYYSELDNKSGYSRAITTSVLNASGAGDAMMAGLAHCWLQSMSLEDSIRYAQRCSALTLSSEDTWILPNKSSIP

SEQ ID NO: 10817 - protein, 72 aa, Xenorhabdus bovienii
  Coding DNA sequence: Name=SeqID_4709
  Gene classification: Gene name=TauD; Function=Probable taurine catabolism dioxygenase; Function class=Q Secondary metabolites biosynthesis, transport and catabolism
  Homolog annotation: Query=7..67bp; Hit=137..197bp; Blast score=92; Percent Identity=70.0; E value=6e-20; Homolog= ZtauD COG2175
LFIESNSFSEPLKVLLAGLEAEHAFTKAFPEYRYRNTEEEHQRWLQATRKNPPLLHPVVRTHPVAGKVFSFY

SEQ ID NO: 10818 - protein, 111 aa, Xenorhabdus bovienii
  Coding DNA sequence: Name=SeqID_4710
MKPSIIIIAESILTIPFVSLHANTNAKTKANVKITDCNQLNGKPGQDGKNGIPNSNCINGGNGSNGSSPGQSEGNGGNGANGSSSEQTQGNGGDGGKVSNYHNLQHAGRHA

SEQ ID NO: 10819 - protein, 50 aa, Xenorhabdus bovienii
  Coding DNA sequence: Name=SeqID_4711
MEAKYPIITISNMQAAMLKTNTYTWNHYKQKSGNDECQQSISNQHGNLRK

SEQ ID NO: 10820 - protein, 48 aa, Xenorhabdus bovienii
  Coding DNA sequence: Name=SeqID_4712
MNASRASVTNMVISENKNLIEAYIFDRHRFCQSNAIICLMEFKALFMH

SEQ ID NO: 10821 - protein, 77 aa, Xenorhabdus bovienii
  Coding DNA sequence: Name=SeqID_4713
MWGTLLCSPVQGHSGQKVDISYQAQVPPAVLYHGTAPVFWILFSSRDWWQVCAITCIYRQMKPQPLKSGSVMASRVP

SEQ ID NO: 10822 - protein, 97 aa, Xenorhabdus bovienii
  Coding DNA sequence: Name=SeqID_4714
  Homolog annotation: Query=1..97bp; Hit=1..97bp; Blast score=176; Percent Identity=93.0; E value=6e-44; Homolog= ref|NP_927614.1|
MSVRFTKKAREHIRAVKLYSMRRWGVNVAEAYATSLRVTMTAILDRHPSPGRDRSEDLYFGVLSFPVESHIIYYREVPTGIEVLAVLHQTQDPHNYL

SEQ ID NO: 10823 - protein, 89 aa, Xenorhabdus bovienii
  Coding DNA sequence: Name=SeqID_4715
  Homolog annotation: Query=1..89bp; Hit=1..89bp; Blast score=153; Percent Identity=97.0; E value=6e-37; Homolog= ref|NP_927615.1|
MEIIPAQLAKNQFGDLLMKVQREPVEISKHGKRVAVVISPEEYDQFTQLKLQNLKAVLAESIAQADRGELHSIDDVFAPLTVDELEGKA

SEQ ID NO: 10824 - protein, 126 aa, Xenorhabdus bovienii
  Coding DNA sequence: Name=SeqID_4716
VHRATSNQNSQPPTSWSSSPRGSHPQATRPGIECHFQKTIARNVRSRLHSIAGVVEQIADPILGGRSFRSNGTVKVLIELDVILQGPKIGRSHSYRLNPQFGWKGTVNNHKKALTNGLSVIQGGRA

SEQ ID NO: 10825 - protein, 154 aa, Xenorhabdus bovienii
  Coding DNA sequence: Name=SeqID_4717
  Homolog annotation: Query=1..153bp; Hit=1..153bp; Blast score=65; Percent Identity=28.0; E value=4e-10; Homolog= ref|ZP_00062966.1|
MIELREMTTAEFELFRLLFINEHALDLASTRGYPADVSLKKASQLIDVTQSQVTEKVINKFWCIVKSDHELPVIGYLWIELQEKAAWVCDFRLLPEWRRKGLGKAALDKMKSNLMSMGITEVGLRVAPNNPVAKALYEKSGFHITGFNMSKTLS

SEQ ID NO: 10826 - protein, 181 aa, Xenorhabdus bovienii
  Coding DNA sequence: Name=SeqID_4718
  Gene classification: Gene name=KptA; Function=RNA; Function class=J Translation, ribosomal structure and biogenesis
  Homolog annotation: Query=1..180bp; Hit=35..218bp; Blast score=223; Percent Identity=59.0; E value=1e-58; Homolog= kptA COG1859
MAQFDTKISKFLSYVLRHQPESIGLTLDSEGWADISVLIKCAEKHGKHLNHALIATIVEANDKKRFAISDDQKRIRAVQGHSSQKVNISYQAQVPPAVLYHGTATRFLDSIFQQGLVAGSRHYVHLSADEATAIKVGQRHGKPGILKINAQLMHEQGFKFHQADNGVWLTKSVPVKYISFN

SEQ ID NO: 10827 - protein, 265 aa, Xenorhabdus bovienii
  Coding DNA sequence: Name=SeqID_4719
  Gene classification: Function=Predicted nucleotidyltransferase; Function class=R General function prediction only
  Homolog annotation: Query=11..257bp; Hit=12..258bp; Blast score=259; Percent Identity=54.0; E value=3e-69; Homolog= PA4584 COG3541
MERKTTAVSPAMRTRVKQELADIEKRYGVRVLYACESGSRGWGFASPDSDYDVRFIYVHPVDWYLTVEAGRDVIELPISDELDICGWELRKTLKLLKQANPTLMEWLDSPIIYKADPAATNGLKTMVPHFFSDIKARYHYLSMAKKNFRGYLQGEKIRRKKYFYVLRPLLAVRWIEMGKGVPPIDFETLVAGTVDDPQLKAEIGDLLRLKRSANEAEYGLRKLRVHAFIESELDETLSRCELKDKRERSHALLDDYLRRWVMKRV

SEQ ID NO: 10828 - protein, 413 aa, Xenorhabdus bovienii
  Coding DNA sequence: Name=SeqID_4720
  Gene classification: Gene name=RtcB; Function=Uncharacterized ACR; Function class=S Function unknown
  Homolog annotation: Query=12..413bp; Hit=5..404bp; Blast score=644; Percent Identity=76.0; E value=0; Homolog= PA4583 COG1690
MTATEMKTNAYNLLTQENGTQIKMWTHGVPVDPKAITQLQNTAKMPFVFKHLAVMPDVHVGKGSTIGSVIPTRGAIIPAAVGVDIGCGMIAVRTSLVASDLPDSLLNIRHAIEAAVPHGRTVNRGGRDKGSWHRAPEIVDQHWATLADGFKCITDKYPKLLNTNNHQHLGTLGTGNHFIELCLDETDRVWVMLHSGSRGVGNAIGNLFISLAQKDMQQHIANLPDRDLAYFEEGSRYFDDYMEAVGWAQDYARQNREVMMHRVLEALSREIPKPFTTQEEAVNCHHNYVQREQHYGEEVLVTRKGAVSARRGQMGIIPGSMGAKSYIVRGLGNEESFCSCSHGAGRVMSRTEAKKRFTVSDQKRATAHVECRKDSDVIDEIPMAYKDIDAVMEAQSSLVEIVHTLRQVVCVKG

SEQ ID NO: 10829 - protein, 73 aa, Xenorhabdus bovienii
  Coding DNA sequence: Name=SeqID_4721
VKIKIINFQIDKKYSCFFQSWHVIGNNSYVGTRLLLNTAKVMESIAERITQISVYGGLDQVLNGLVQIKGEQK

SEQ ID NO: 10830 - protein, 525 aa, Xenorhabdus bovienii
  Coding DNA sequence: Name=SeqID_4722
  Gene classification: Gene name=PspF; Function=Transcriptional regulators containing an AAA-type ATPase domain and a DNA-binding domain; Function class=T Signal transduction mechanisms
  Homolog annotation: Query=1..523bp; Hit=1..530bp; Blast score=689; Percent Identity=67.0; E value=0; Homolog= PA4581 COG1221
MKRRVVIGVLGTKLDRRGKKANRWTKWRPTIGMCQQAELPIDRLELLYQTNDYGLAQRVKEDIAETSPKTEVVLQELKIEDPWDFEEVYTAQLDFAVRYPFDTENEEYLVHITTGTHVAQICWFLLTEARYLPAQLLQTSPRNSDRESHPEGVYTIIDLDLSRYTTLTSRFLHEQQEQVAFLKSGIATRNANFNRLIDQVERVALRSSAPILLMGLTGAGKSFLARRIYQLRQSRHLIQGRFVEVNCATLRGDNAMSTLFGHVKGAFTGAIQPRTGLLREADGGILFLDEVAELGLDEQAMLLKAIEEKSFLPYGSDKEVHSDFQLIAGTHRDLRDWVAQGKFREDLYARINMWTYQLPGLAQRREDIEPNIEYELARYAQMQQTQVRFDKEARLIYLHFSCSEQAQWRGNFRELGASVARMATFAENGRINQHLVEEEIMRLKQNWQDNRLSSLLPNHLPEVDLFDRQQLETVIKVCRESASLSEAGRKLFAVSRQQKKQPNDADRLRKYLARFGLDWDSIQHD

SEQ ID NO: 10831 - protein, 304 aa, Xenorhabdus bovienii
  Coding DNA sequence: Name=SeqID_4723
  Gene classification: Gene name=ElaC; Function=Metal-dependent hydrolases of the beta-lactamase superfamily III; Function class=R General function prediction only
  Homolog annotation: Query=1..304bp; Hit=7..311bp; Blast score=384; Percent Identity=60.0; E value=1e-107; Homolog= elaC COG1234
MELKFLGTSAGVPTKERNVTSLVLDLRGIRNTLWMFDCGEGTQHQILNSSIKIPKLEKIFITHLHGDHIFGLPGLLCSRSMGGSTDPVMLYGPKGIRQFVETALQLSGSFLTYPLDIVEVQSGLLFDDGELKATAYALNHRVECYGYRIEEHDKPGGLDTQKLNQDNIPRGPWMQVLKQGGTVTLEDGRTVCGKDYLGAPISGKSLAIFGDTTPTPEALKLAANVDVMVHEITLEDALAEKANHNGHSTTKQAATLARDAKAKHFIATHISGRYGIEDCPRLLAECREIFPNTDLAEDFAIFIV

SEQ ID NO: 10832 - protein, 66 aa, Xenorhabdus bovienii
  Coding DNA sequence: Name=SeqID_4724
MLIFIYNFLQYIYLLPTNRRHYLNASFVARMLSEDVIARIILVKKMLICHLKMVTKNKMIKNGFII

SEQ ID NO: 10833 - protein, 406 aa, Xenorhabdus bovienii
  Coding DNA sequence: Name=SeqID_4725
  Homolog annotation: Query=24..240bp; Hit=24..240bp; Blast score=211; Percent Identity=46.0; E value=2e-53; Homolog= ref|NP_929449.1|
MNSIIKTDIKESMANISTENTVNIWSDWLDEKELKKLTDHPVLQSFNDSTASEEMLKTFLIQHCYYSRHFTRYLIALISKLDVFEDIKDLLHNLLEEMGLEDENKITHAELFQRTLKTVGADINSQKPFENTTAMVDAMFSFCLSDDPLEGLSAMCLGAEAIVPLIYKPVLNRLMTLNYNKNATEFFTLHIEEDEDHAIKMFEIIDRLTSQDESLRLKAINIGSEMIRNRVKMLDSVWESEVVRKNNAEKADLNNQKNDLSFHSADFWRVNYKPTPSIPEKLIHKDVINSNSHGENQFSAERKHKVNIVNLPTKTISMTLGHLDAEQSTNLHRHNYETVIYIIEGNGVSKIGNNDVAWSGGDAIYIPSWVEHKHSNMGQDKCLYIACENAPLLQNIGNIALREELE

SEQ ID NO: 10834 - protein, 536 aa, Xenorhabdus bovienii
  Coding DNA sequence: Name=SeqID_4726
  Gene classification: Gene name=CaiC; Function=Acyl-CoA synthetases (AMP-forming)/AMP-acid ligases II; Function class=I Lipid metabolism
  Homolog annotation: Query=43..515bp; Hit=29..503bp; Blast score=280; Percent Identity=35.0; E value=2e-75; Homolog= PA0996 COG0318
MSLATFPTLEAIVSTTKSINLAQRFVMENSSLDKDCFIGPDGSLSYSQLAFFVQKSASAMSLKKIEKNTAVILCLNDSRELAIIFFASLAIGALPVVINPKLPANTLNYILGEFDTPFIFLDEGNEISIAPEAKENTIRIKRSADLSAFCDWMPENTNDKWHDFLEKTHLEPAFIQYTSGSTGKPKGVIHSVTSILSSCEHFSKHQLGLTTTDIIYSTPKTFFGYGMGNTLFFPLYIGATAIIDSLWPSIIRVTSNIKKFQPTVLLAGPMIFRLLLEDAEFKQYCHLRLVVSSGSMLPAPLKESWFQRLNIVIHDAFGATEACHAFATTYGHPSRSGSIGKLITGCTGKIVDKDGKTVPARETGVLMLSSESLALGYWNNHQDTNIKFSNGWYRTGDLFSQDEEGFLYYHGREDEQFKVLGRWLVPVEIEKLVHSAFPEIGDAFMIPWVDSTQECRPVLCLKTSSSEFEAISQQIANFISHQVESYKHPYVYLNLEQFPLNGNGKIDRKSMIEIARQKITDENMSSHPRRINYAQS

SEQ ID NO: 10835 - protein, 500 aa, Xenorhabdus bovienii
  Coding DNA sequence: Name=SeqID_4727
  Gene classification: Gene name=TrpE; Function=Anthranilate/para -aminobenzoate synthases component I; Function class=E Amino acid transport and metabolism
  Homolog annotation: Query=3..497bp; Hit=2..489bp; Blast score=379; Percent Identity=41.0; E value=1e-105; Homolog= PA0609 COG0147
MHNLNEFLAYGEEGYNLVPVWKNIKKTQISPISIYEALANKSYSYLFELSEKHEDKYRATYSIVGLPCHQRIEIKDYSIKVFDENNTPTYITDIPPLDALRQILASYRVPKIDQLPNYAGGLFGYFGFETTRLIEPKLQANTRKKTLIDLPDILQIVSQELIVVDHRNDLIYVIVHAKPTESQNFADANLRINQIISELEKIPHQQQANFSPSTTTDRTTWFKDMESHFPQHDFQMAVNKIKEYIKAGDAMQVVLSQAMSRPLKANAIQLYQALTSMTNTPYCYLMNVEDSHVVGASPEMMVSLHQNKLISHPMAGTRHRGMNQQEDDALKAELLADNKEIAEHIMLVDLARNDIGRVAKTGSVTVNNLLSVEYFSHVMHIVSEVSGEKMDGIDEIDVISSTFPAGTLSGAPKIRALEIIHELEPYGRGVYGGCLGYITWNGDINLAITIRTGLLHQGQLYVQAGAGIIDASRAEREWQETIEKNSMMMHAAYQAEQFSL

SEQ ID NO: 10836 - protein, 198 aa, Xenorhabdus bovienii
  Coding DNA sequence: Name=SeqID_4728
  Gene classification: Gene name=PabA; Function=Anthranilate/para -aminobenzoate synthases component II; Function class=E Amino acid transport and metabolism
  Homolog annotation: Query=1..186bp; Hit=1..186bp; Blast score=229; Percent Identity=58.0; E value=1e-60; Homolog= BS_pabA COG0512
MYFIIDNYDSFTYNIAQYLGMLGIEVLVKKNDRITLEYIEQHNPTGLIISPGPCTPNEAGISTLAIQHFAGKIPILGICLGHQCIAQEFGGQVLRANKVYHGHTSTITHNNKNLFANLPQDIKVGCYHSLVVDDLPECLTVTARSCDEYNDIMALKHNDFPIYGVQFHPESILSDFGLDMLKNFIKITQEWKLMNSIQ

SEQ ID NO: 10837 - protein, 538 aa, Xenorhabdus bovienii
  Coding DNA sequence: Name=SeqID_4729
  Gene classification: Gene name=CaiC; Function=Acyl-CoA synthetases (AMP-forming)/AMP-acid ligases II; Function class=I Lipid metabolism
  Homolog annotation: Query=171..475bp; Hit=210..507bp; Blast score =108; Percent Identity=28.0; E value=2e-23; Homolog= AF2368 COG0318
MITPEEIKKIISSENIGAGNFIHHLNNYFSERGISPKITCDVPTYDNPEEEKSQFEINDLVKISDQLSGAYIALGVQKREPVALYFDDTIDYLIHFIALNNIGSFPIFVNGDLSSHIAMSFMRNSGTKFIISTEERINSLDDKSTDIQFITPNELNLFKKPISSYYRHHADDIILLGHTSGTTGLPKPVIFTHESMFHGIFKEVSKQRGKQILSMFPHSHGASMTLIMLTLTRGAAIHIQSKKTAFDILDSIEQIKPDTVAAFPKIFVDLCREDLNDWDLDSISHWVSTGDANHEPHIRKLISYGHHFVDGKKERGSFFIDNLGSSEFAFAMFRNIHQPKTDRYDRCIGIPFSWVDAAILDADGNVLPNNQVGMLGVISKSVTMGYWNNHLLTEKNRVNGYWLTGDLVYRTNDGFFYHVDRTSDWIKTPQEPLYSTQCEEWLLKNIDSIFDISIVATSLPNGDQQTTAIVELKAGHEISPATLLQKINACHQEKQWPLIDNIVYQSADNDLGVTGKKLKRKIRDRMPEDNSMVTEEGN

SEQ ID NO: 10838 - protein, 243 aa, Xenorhabdus bovienii
  Coding DNA sequence: Name=SeqID_4730
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=2..235bp; Hit=6..235bp; Blast score=137; Percent Identity=37.0; E value=8e-33; Homolog= mll2196 COG1028
MKTCLITGANRGIGFEIAKKLGERGHRVILSGRDIPALEHSVLQLNQMGITADLLHLDVTDPESIKSAANLLLSTNTTLDILINNAGVFLDSIQKPSETSLDDIHKSLTVNLVGPWLITQAFLPLLSRSEEARLIFLSTDLAALSQAADPHSKYNRIEGPAYRASKAALNMLALQWAKEFRDSKISVSVCSPGWCRTDLDSQISSEQAPNSAAEGADTVVWLALDKGREQHGHFYSARQTIDW

SEQ ID NO: 10839 - protein, 453 aa, Xenorhabdus bovienii
  Coding DNA sequence: Name=SeqID_4731
  Gene classification: Gene name=PutA; Function=NAD-dependent aldehyde dehydrogenases; Function class=C Energy production and conversion
  Homolog annotation: Query=20..449bp; Hit=9..445bp; Blast score=204; Percent Identity=32.0; E value=1e-52; Homolog= ZadhE_1 COG1012
MTMNENIDITVQQTETASYIDKLVDQGKIAQKELEKQSDEDIDNVLHHLAKIFSTHCREWAEKELAVTRIGNADDKEHKLALVVNQVFKGLYGTKTYGRLGGTQRLIEYASPVGLIFAVVPLTNPIPNSLFKIMLSIKTRNAIIFSYPGKTGKLANEFIDLVQQVLTEHGLPVSLVQVCTPPSHDKTHMLMQHPGVDMILATGGRNLVHAAYSSGKPAFGVGPGNVPVYISRSAHIPKTAANIVNGKIYDNGIVCGSESNLIVHPASKNDLISALEANGAAILTSSEVEQAIQTLFNPETQYVSRENIGVCAASLAAKANISRAYPIKLLVIPAEIGRNDFLSNEKMAPILTLYTADEENGISLAYSLICNEGAGHTAVIHSEDPDEIHQFSTVMPAGRILVNTSATQGMLGETTELPVSFMQGSGTFGHNHSTDPIVWKHLVNIKRVAYGLH

SEQ ID NO: 10840 - protein, 372 aa, Xenorhabdus bovienii
  Coding DNA sequence: Name=SeqID_4732
  Homolog annotation: Query=1..368bp; Hit=1..383bp; Blast score=283; Percent Identity=39.0; E value=4e-75; Homolog= ref|ZP_00021602.1|
MKIQCIGAGPAGLVFSILAKMQDHNRDVVVYERNLSNVTTGWGLVLSEPMLQQLANIDPSIVEQLRPHISTLNHIDIHIKEKTFRSSGYQFLAISRLEMINTLRKKALDLGIKINYDSSLNAEDLINFPADLTVISDGANSKIRHQLKNEFDTDIDEGKNLYLWLGTSHLFNDTFNFIFEQTETGWFWAHCYKFENDHSTFVVECTHETWAKTGFAHMDEKETIAFLEKVFHRHLCGHPLQINDTCREKAYWRRFVTPVSKHWSHDKKVLLGNAAHSAHFSIGSGTKLAIGDAIALAENLKSSNKLDSACFTDYQHNRQNESSNLHIAAQNSQSWFENVESLIENDPLEFSISLLLRSGRLSRDELTINLLE

SEQ ID NO: 10841 - protein, 140 aa, Xenorhabdus bovienii
  Coding DNA sequence: Name=SeqID_4733
  Gene classification: Function=Uncharacterized ACR; Function class=S Function unknown
  Homolog annotation: Query=3..136bp; Hit=8..141bp; Blast score=105; Percent Identity=38.0; E value=1e-23; Homolog= Z3974 COG2128
MNYAKISPKIINPLYKCYDEIQKCELDQSLILLVEMRTSQINGCAYCCRLHAEMGRKLGIEEEKLDKLPGWFNSRIYNQKEVLALEWCEALTIGLRDKDLNDLRERLEELFSEKELVDLTSAISVMNALNRMAISIGDNN

SEQ ID NO: 10842 - protein, 147 aa, Xenorhabdus bovienii
  Coding DNA sequence: Name=SeqID_4734
MLNGTQLRYAALIARYSLAIAYLVAVADRLGLCGEYGDPQITWGNFTVFLGVVKHLNPWAPDFMIPIFGWGVTILEVALPIFLIIGFKIKETALVSAALLLIFAVTMTTAGLLKSVFDYSVLSAFSCSLLLYCFEKFRVSEDKKQLN

SEQ ID NO: 10843 - protein, 245 aa, Xenorhabdus bovienii
  Coding DNA sequence: Name=SeqID_4735
MIFNQKEMNIIQARDFMNEILVSKKTTDILRQMIQKDTIIKSPIGTYVGFESFIALLKIWYRAFPNLVYKENNLYVHNENIIIDWEAKGKHLGEFYAISATGKQVTCQGTTEIVMNDGKILDYHTKINIQNIITQLIGLPCSPTLDIRNIEIYQLINQILGYQLSCRQIECLSLSTLNTSIKDIARLLSIESNTVKTHLKRAFEIIGISNKKMLMEFVIECQAIEILVRLGLFLRVQTKRNNYLE

SEQ ID NO: 10844 - protein, 76 aa, Xenorhabdus bovienii
  Coding DNA sequence: Name=SeqID_4736
MLCNIVCGAVFHVFSQQIVAHYTHDSIHRKVCRKKFLFCVIWRRLMIEGYNLVIVTRNRWIMVSIWIESLSGVPLF

SEQ ID NO: 10845 - protein, 56 aa, Xenorhabdus bovienii
  Coding DNA sequence: Name=SeqID_4737
MNAIVSIMRDDLLGENMKYCTTHDVTKHQANEKLPAGSLGVLFFPLQNRSLKKPLK

SEQ ID NO: 10846 - protein, 313 aa, Xenorhabdus bovienii
  Coding DNA sequence: Name=SeqID_4738
  Gene classification: Gene name=PyrB; Function=Aspartate carbamoyltransferase, catalytic chain; Function class=F Nucleotide transport and metabolism
  Homolog annotation: Query=1..311bp; Hit=1..311bp; Blast score=509; Percent Identity=81.0; E value=1e-144; Homolog= pyrB COG0540
MANPLYRKHIISINDLSRTDLELVLQTAAALKANPQTELLKHKVIASCFFEASTRTRLSFETAIQRLGASVVGFADSNNTSLGKKGETLADTISIISQYADAIVMRHPQEGAARLASEFSGHIPVINAGDGANQHPTQTLLDLFTIQETQHKLDNLKIAMVGDLKYGRTVHSLTQALAKFSGNHFCFIAPDALAMPSYILHMLDKKQVSYSIHHNFEDVMPELDILYMTRVQKERLDPSEYANIKAQFVLHAADLVNVKENLKVLHPLPRIDEITVDVDKTPYAYYFQQAGNGIFARQALLALVLNESVIIEK

SEQ ID NO: 10847 - protein, 375 aa, Xenorhabdus bovienii
  Coding DNA sequence: Name=SeqID_4739
  Gene classification: Gene name=ProP; Function=77 Permeases of the major facilitator superfamily; Function class=G Carbohydrate transport and metabolism
  Homolog annotation: Query=5..360bp; Hit=14..381bp; Blast score=80; Percent Identity=25.0; E value=3e-15; Homolog= TM0342 COG0477
MLNKLVFSYFNTSFGYWLAGFLIPLIVLDVSKSPLLVSVSYALNIIPYIIFTPFAGVIGDMVNRKKVIILGELICAITATVLLLVPFNNEFVWEMILLGFVISSMSAIHHPIFQAIIPDIYKGDDLKKINSNINIIDNLVSILSPVILGVILLSMDKHYVIVLIIFCYVLSFSSFSFILYASHHNNVAFRFSNIMSSMSDGVKYVFNVKGLRNISILFFFVNFGIRVIAVNLFWIYSMVFYLKDDELALCFVIIGLGSFLGAKAAIYLIGKFNDENIIAGSTFFIGVLSLLLLVANNAIVMSLILSLSSFVQSIIVVTFFTYRQKITEGFILSRVISVTRLISFMAIPLSSLISGYILQKTENRKQKTENRKQKM

SEQ ID NO: 10848 - protein, 49 aa, Xenorhabdus bovienii
  Coding DNA sequence: Name=SeqID_4740
MIILSIYIKGHSLVSITAGIMVCEAIKLLSKSQHAGLTNKRKSFIFDDL

SEQ ID NO: 10849 - protein, 152 aa, Xenorhabdus bovienii
  Coding DNA sequence: Name=SeqID_4741
  Gene classification: Function=Predicted transposase; Function class=L DNA replication, recombination and repair
  Homolog annotation: Query=1..126bp; Hit=1..117bp; Blast score=106; Percent Identity=46.0; E value=8e-24; Homolog= mll8100 COG3293
MARYDIPDDAWIVIEPCLPPVHSERAGRPHVEHRRVMNGVFWVLCSGAPWRDLPERYGPWKTVYNRFNRGSKSGIINKIFNRLLSILDEKGLIDWAEICLDGSNIRASKDAACAKKNLPISLTIMRWVAHAVVMAPKSIWQPTDGVFPSTCF

SEQ ID NO: 10850 - protein, 168 aa, Xenorhabdus bovienii
  Coding DNA sequence: Name=SeqID_4742
  Gene classification: Function=Predicted transposase; Function class=L DNA replication, recombination and repair
  Homolog annotation: Query=4..158bp; Hit=110..271bp; Blast score=100; Percent Identity=45.0; E value=5e-22; Homolog= Rv1041c COG3293
MREKKPPDIADDHALGRSRGGYGTKIHLATDRRGFPLNLLLTAGQAHESRSAIPLLDGIGIQRKNGFMKRRGKAVLADKGYSGGKLRGYLRKLRIKSIIPYKINEKGSTDGRTQFDEQAYRDRNVVERCFGFLKGNRRIATRYEKTARNYLSRVKLGCIRLFYRRLSN

SEQ ID NO: 10851 - protein, 142 aa, Xenorhabdus bovienii
  Coding DNA sequence: Name=SeqID_4743
  Gene classification: Gene name=ArsR; Function=Predicted transcriptional regulators; Function class=K Transcription
  Homolog annotation: Query=21..139bp; Hit=109..227bp; Blast score=87; Percent Identity=37.0; E value=4e-18; Homolog= BH0391 COG0640
MVLGPPIKVQRKLPNPDLCTARFCYDHIAGFLGTSIYKFLISQNFILQDNNHLVLNKNIDNLLNLLRVDNFEDLCRGRKIAYACIDWSERTPHIAGALGTALAYAFIDNKCIKRRENSRVIEITTLGKISLSENFNINIDEK

SEQ ID NO: 10852 - protein, 772 aa, Xenorhabdus bovienii
  Coding DNA sequence: Name=SeqID_4744
  Gene classification: Gene name=BisC; Function=Anaerobic dehydrogenases, typically selenocysteine-containing; Function class =C Energy production and conversion
  Homolog annotation: Query=6..758bp; Hit=9..763bp; Blast score=919; Percent Identity=59.0; E value=0; Homolog= PA5181 COG0243
MKFKSKIEPYHSAAGGWGSLEATTRFVFDSKQALKNMVNLMRMNKAKGFDCPGCAWGDDNKSLFSFCENGAKAMTWEATRRHVDRAFFATYSVSKLYQQSDYFLEYQGRVVEPMRYNHQTDHYEPISWDDAFTLIAKHIKAMENPNQLELYTSGRASNEASWLYQLFGRVLGTNNFPDCSNMCHEASGYGLLKSLGVGKGTIRLDDFDHADAIFVFGQNPGTNHPRMLHSLRHAAERGARIVTFNTLRERGLERFADPQKPLEVITPMAGAISHRYYQPKLGGDMAVVRGMVKALLETHNAFLAAGKSGIFDLEFISTHTEGVDAYLQEVAVTEWAFIESQSGLTQAQIREAATIYQHADRVICTWAMGITQHKHSLDTVREIANLQLLFGQLGKSGAGLCPVRGHSNVQGNRTMGINEQPSKAFLDSMAEHFGFEPPRSHGHHVVKALSAMLRDEVRVLIALGGNLAVAAPDSPRTEEALRHCDLTVHISTKLNRSHLVTGKKDALILPALGRTEQDIQLSGAQFITVEDSFSMVHASEGLNKPLFDTQRSETAIVAGIANAVVGNTATINWLALAGDYNKIRDHIAATIPGFADFNKKCEQPGGFYLGNAAADLRFSTPSKKAQFSDASLPENLFPQLGKTDVPFTLQTLRSHDQYNTTIYGLDDRYRGVYGQREVLFMNPEDIALLGYQAGDRVDIETVWNDGIERKVYGFKLVPYAIPRGNLAAYYPETNPLVPMDSIGNGTGTPTSKSVPVKLSLTEIGEAELQRLV

SEQ ID NO: 10853 - protein, 71 aa, Xenorhabdus bovienii
  Coding DNA sequence: Name=SeqID_4745
MVSSLIMIHCDTYSVLRQRKNRSIAIESAMSAPQINHTISIGNFIDNCFITDCLFGMIFVMFTITTETYTK

SEQ ID NO: 10854 - protein, 405 aa, Xenorhabdus bovienii
  Coding DNA sequence: Name=SeqID_4746
  Homolog annotation: Query=3..398bp; Hit=2..388bp; Blast score=353; Percent Identity=50.0; E value=3e-96; Homolog= ref|NP_389072.1|
MNNTLITSDNSLMLWAFIMIAVAAAIMVEQRYRWASKIPGAVIALIIAVLASNLNIIPTEAPVYDAVWGYIVPLAIPLLLLKTNLHSIIKESWRLLILFLISSVATMIGAIVSFRLFKDHIPELDKISGMISASYTGGGVNFAAMAAKLEPSQSMTASTIVADNMMMAGYFIILIALSGWTVARKFWGSPHTDAIDNDPDLDKSQTFAAAYWKPKNIALKDIALSLAWSIFIVALSFQLSTWLKALLGQPNSIYQELLFSLISDKYLILTTVTFTLVSIFKETFSKLNGTQELGTYAIYMFFVVIGIPASIEAIISHAPLLFAFVFVIAMINLLLTFAVGKVFKFSLEENILACNANIGGPTTAAAMAISRGWVNLVGPIMVIGTVGYVIGNYVGTFVYFIVGRM

SEQ ID NO: 10855 - protein, 243 aa, Xenorhabdus bovienii
  Coding DNA sequence: Name=SeqID_4747
  Gene classification: Gene name=DdpX; Function=D-alanyl-D-alanine dipeptidase; Function class=M Cell envelope biogenesis, outer membrane
  Homolog annotation: Query=29..238bp; Hit=13..247bp; Blast score=67; Percent Identity=29.0; E value=1e-11; Homolog= slr1679 COG2173
MFLSIAMENNTVDKIAVEKLFDWEVINGVSINECHEPLEIITDTDKLKQQSAYFLADIKGSIDYCTVRESVARKLVMASQLLPPHLGLLVLDGWRSRETQQALQEQTQIKIADQYRHLSVEEQKALLQQFVAPAPTEQHQISPHLTGGSVDVTLFDVASGKPLFLGTEFDEVTELSYTAALEKEPEKNMPATLYRRLLYNAMIQVGFTNLPTEWWHYDYGNSLWAFYKNDIAIYGAVDGTRKR

SEQ ID NO: 10856 - protein, 154 aa, Xenorhabdus bovienii
  Coding DNA sequence: Name=SeqID_4748
  Gene classification: Gene name=PyrI; Function=Aspartate carbamoyltransferase regulatory subunit; Function class=F Nucleotide transport and metabolism
  Homolog annotation: Query=1..153bp; Hit=1..153bp; Blast score=222; Percent Identity=73.0; E value=1e-58; Homolog= pyrI COG1781
MTQDHQLQVEAIKCGTVIDHIPAHIGFKLLSLFKLTETDQRITIGLNLPSNQLGRKDLIKIENTFLTEQQANQLAMYAPHATVNNIENYEVVKKVPINLPEQIDSILVCPNSNCISHNEPVESSFYVIPTADDVIVRCKYCEKEFDRQAVINND

SEQ ID NO: 10857 - protein, 128 aa, Xenorhabdus bovienii
  Coding DNA sequence: Name=SeqID_4749
  Gene classification: Gene name=TdcF; Function=Putative translation initiation inhibitor; Function class=J Translation, ribosomal structure and biogenesis
  Homolog annotation: Query=1..127bp; Hit=14..140bp; Blast score=207; Percent Identity=85.0; E value=2e-54; Homolog= yjgF COG0251
MSRSIYTENAPAAIGPYVQGVDLGSMVITSGQIPVDPKTGDIPEDITAQARQSLENVKAIIEQSGLKVADIVKTTVFVKDLNDFATVNAAYEAFFNEHNAPFPARSCVEVARLPKDVKIEIEAIAVRS

SEQ ID NO: 10858 - protein, 143 aa, Xenorhabdus bovienii
  Coding DNA sequence: Name=SeqID_4750
  Gene classification: Function=Uncharacterized BCR; Function class=S Function unknown
  Homolog annotation: Query=5..143bp; Hit=2..140bp; Blast score=155; Percent Identity=53.0; E value=1e-38; Homolog= yhbP COG3787
MELNENFLTIRRYLAKQHVFTLCTSSPQDLWCASCFYAFDADSMAFWFMTEPDTRHGQMMQQNPVVAGTVAGQPRNIAQIKGIQFRGEITPLTGEAETLARARYCRRFPVALAAKSPIWRLSLSEIKMVDNTLGFGKKLNWQR

SEQ ID NO: 10859 - protein, 83 aa, Xenorhabdus bovienii
  Coding DNA sequence: Name=SeqID_4751
  Homolog annotation: Query=1..82bp; Hit=1..82bp; Blast score=86; Percent Identity=73.0; E value=8e-17; Homolog= ref|NP_931668.1|
MKAVKHIVAILALTAISFGSMAATEVQYAKGEKVGVVSVTGAETLDSLTAELSKKADKAGASYFRVISANGQNKLSGVAEIYK

SEQ ID NO: 10860 - protein, 114 aa, Xenorhabdus bovienii
  Coding DNA sequence: Name=SeqID_4752
  Gene classification: Function=Predicted endonuclease containing a URI domain; Function class=L DNA replication, recombination and repair
  Homolog annotation: Query=4..100bp; Hit=2..97bp; Blast score=109; Percent Identity=59.0; E value=6e-25; Homolog= yhbQ COG2827
MKSTHWYLYLIRTRNSSLYTGITTDIARRFMQHVSGKGAKALKGKGPLTLVYHSLVEDRGMALKLEYRVKKLSKKQKERLVTLQPVCIATYLSEMLVPKIAQSVITHDQNGQNT

SEQ ID NO: 10861 - protein, 167 aa, Xenorhabdus bovienii
  Coding DNA sequence: Name=SeqID_4753
  Gene classification: Function=Predicted acetyltransferase; Function class=R General function prediction only
  Homolog annotation: Query=1..164bp; Hit=1..164bp; Blast score=225; Percent Identity=67.0; E value=2e-59; Homolog= yhbS COG3153
MLIRVEIPVDAMGIDRLLRQSFETSAEAELVHRLREDGLLTLGIVATDDEGHVIGYVGFTPVDVNGQDHQWVGLAPLAVAEPYRRQGIGEKLVYEGLDSLNEFGYGAVVVLGEPAYYRRFGFRLAKEYQLHCQWPDCEDNFQIYTLADVSLENCHGLITYSDHFGHE

SEQ ID NO: 10862 - protein, 126 aa, Xenorhabdus bovienii
  Coding DNA sequence: Name=SeqID_4754
  Gene classification: Function=Putative lipid carrier protein; Function class=I Lipid metabolism
  Homolog annotation: Query=1..113bp; Hit=1..160bp; Blast score=114; Percent Identity=43.0; E value=1e-26; Homolog= yhbT COG3154
VLGKIHSHLVSQGPTLLRLSLKVTPFALPRQVLEQLLGWQFHEALAEGELAFLESRREDPDTLFFQHHLRIEGNTELGLHVKNLVDSIRLGSMPSILRLGLLCLAEFTKAGQKEGVDQHDRALSSC

SEQ ID NO: 10863 - protein, 367 aa, Xenorhabdus bovienii
  Coding DNA sequence: Name=SeqID_4755
  Homolog annotation: Query=28..365bp; Hit=1..338bp; Blast score=295; Percent Identity=49.0; E value=9e-79; Homolog= gb|AAO49467.1|AF487831_1
LVCRGKFLFNNVSICCSFVRLYIDFFILPKIGFFIDSNSAKKALNNIYILGLLNSVVFLFLTNINLNEIVLIATVIILTSIFTFIRSSDQVIRATYIKRVVSSEELYKANKNLELIRQGITFLSGGIAFFILEDKSISNVCIVSIFCFSISLFINIYVKKDNADKFDRVIDNNSGIKNTYKIGYGFFNGEVKRHVVLLSIFPYICVVSLNSIYPAFFNVINAQIQYYALLVVPYGVGAIMGSLIGSKRSSLSLKNNYIIFGTISIIGLFLPVFFNHLYSVYLCLFLISLSHSRIRVIRNTIIMNEAGNQILGRLLSFNEMIFITLSVGLSILLGVLSDFLGFWVAWFMVIFLNVTVLFFILLSKDKK

SEQ ID NO: 10864 - protein, 46 aa, Xenorhabdus bovienii
  Coding DNA sequence: Name=SeqID_4756
MAVKKTAIDIPDVKAEINIGIMLNTEIVDSLSRYIIPLLCIIFLYF

SEQ ID NO: 10865 - protein, 138 aa, Xenorhabdus bovienii
  Coding DNA sequence: Name=SeqID_4757
MASKNYLEKPKFIHNLWTQNEDDEYYLRFTKGLYEVDSNDARDFITIRGYCTGHNTITDIHEKTGMPKDRIVDIISSLHEIGMLRNEEIVSEEDFFDKIIIACEMWAEQIEETHLFNKFLYGDVSYNVLLGFMLENYH

SEQ ID NO: 10866 - protein, 397 aa, Xenorhabdus bovienii
  Coding DNA sequence: Name=SeqID_4758
  Gene classification: Gene name=AraJ; Function=Arabinose efflux permease; Function class=G Carbohydrate transport and metabolism
  Homolog annotation: Query=5..392bp; Hit=12..396bp; Blast score=210; Percent Identity=36.0; E value=3e-54; Homolog= BS_ytbD COG2814
MPFVIYVFSLCAFAIGFTEFITIGLISVMSVNLGADVTSIGLTVTAYALGVVIGAPVLTALASNWSRKRLLLTAMLVFTLGNLLAAASANLALLLAARLLSGLAHGVFFAVASGVATRLVPPERAGTALALVFGGVTIAMSLGVPAGTWLGSILDWRVIFLIISACGLLGTLGIGFKMPKDAGEQIVKTSASWRHLTILFDRRLLAGASVPMLSYTASFALYTFITPILLSITGVSVETASGVLLAYGIGAAVGTVWGGRLTDRQGMDLASLILLVGIAVVLAAMSFSLTHSLLMIGLTALLGLATYGAIPPLQSRILMLAKRHTPYAMDIASGMNIAAFNAGVVLGSVIGGATVREWGLETLTWVGAVTGVLAIVSLVWQMVIPSMREQRSIPESR

SEQ ID NO: 10867 - protein, 45 aa, Xenorhabdus bovienii
  Coding DNA sequence: Name=SeqID_4759
MNSVNPIANAQSENTYITNGIKNSPYTLKTRQPEFKVSNQYQASI

SEQ ID NO: 10868 - protein, 302 aa, Xenorhabdus bovienii
  Coding DNA sequence: Name=SeqID_4760
  Gene classification: Gene name=LysR; Function=Transcriptional regulator; Function class=K Transcription
  Homolog annotation: Query=7..273bp; Hit=5..272bp; Blast score=199; Percent Identity=37.0; E value=4e-51; Homolog= PA3565 COG0583
MVLRNLEDLSVFIRIIDTGSFTATAQALGLSPTTVSKQIARLEKNLGIVLFVRSTRSLRITPEGKAIAEKVRAALTLVEEAAEIAKDGSESLTGLIRLTAPVPLGRTYVAAAIAEFRKKYPSVGFTLHLTDKIVDLYKVEMDLAIRVANLTDSGLIARRLTDNKRILVASPDYLRLHGELQHPEELINHNCLLFSASGNKSTIWSLHDRKDTKAISLSSDLIANNGDVLRTWCTAGLGIALRETWDVVDLIRSKKLTQILPEWQEETSPINVVRAGKRPVPQRIKSFIEFLTEEWRTPPWDK

SEQ ID NO: 10869 - protein, 261 aa, Xenorhabdus bovienii
  Coding DNA sequence: Name=SeqID_4761
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..260bp; Hit=1..263bp; Blast score=251; Percent Identity=53.0; E value=5e-67; Homolog= PA1344 COG1028
MNINLKGKIALVTGSTAGIGLAIAQGMHKAGASVILNGRSEERLIQAVNKFDCLDRVFTVAADVGTKAGCELINKNFPDIDILVNNAGIFSPKPIFEISDDEWLNYFNINVLSGIRLARSYIPLMIGKRWGRVVFISSESALQIPVEMPHYGLTKTAQVAAARGFAQAATGTGVTVNSVLPGPTESEGVERFVRELITDPTLSMEEAGKRFIETARPASLLGRLATAEEVANAVLFLASPLASAITGTALRVDGGVIQSIL

SEQ ID NO: 10870 - protein, 262 aa, Xenorhabdus bovienii
  Coding DNA sequence: Name=SeqID_4762
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=5..258bp; Hit=3..244bp; Blast score=146; Percent Identity=36.0; E value=3e-35; Homolog= TM1724 COG1028
MERSLAGKAVIITGAGSGIGLAATTEFLNAGAYVIGGDINLEKLYELQGGEYLFPYQFNVRDPSDIDGLINTAISQFGKIDILINNAALVEPRKSFLDVTDDDWNSTIETNLLGYIRMARGVLPYMCNQKKGILLHIASEAALMPNLLLPDYSILKSSVLTLSKVISREFGKYGIRSNVISPAFIHTSIYDKPEGLITQLEQKYKVGREEALQRYIEEVDIAVGRLGQPEEVAVLLLFLASESAAFITGANYLVDGGVTPFI

SEQ ID NO: 10871 - protein, 425 aa, Xenorhabdus bovienii
  Coding DNA sequence: Name=SeqID_4763
MTNDYSKLPIPIFEQVLVADQLRDGYWLEAPDINKDGLFDLFGYGLSLGEIYWYRNPDWKRHLVVDNIRMPVGGDYADVSGNGYPDIIVCYDLYGPGGTLYDANPTGGKIDWIENPGSEFVESERWERHYVGRTTGMHRLRAGFFTQTDRLEILGLPIVPHGNIHSLLPVVLFTKPDNVKTANEWPMEIIENTFFRLIHGAEKKRGLIPGSDRDSLLLASDEGITWLYYDDQKSQWIKVLIGVGELTQFESTGFRGSGDLDVGRAGGDSFAYVAAVEPFHGNTVAVYVKDKLGTPAELATWKRFILDVFGDPNENGEGPGHQVLCADFDGDGDDEFLVALRGPWPWQGVFYYKAIDLSRGIFTRWRVSSESVARIAAADFNQDGKLDFATIAYSVPNYFVAKQARIVVHLNQIKRDVTVGDTDGA

SEQ ID NO: 10872 - protein, 251 aa, Xenorhabdus bovienii
  Coding DNA sequence: Name=SeqID_4764
  Homolog annotation: Query=7..245bp; Hit=4..248bp; Blast score=151; Percent Identity=35.0; E value=1e-35; Homolog= ref|ZP_00072464.1|
MKIKGTNHQRLLTFSNDLLPSIVVFDEGNLSLDGSAIVVNLGNKTALIDEFEKDNILPMTSTKLRNVDLSGGDLLLFFDTDKLFSAKELCGKSQWSKFFKRTERNKDGGNFDINLWRSPQDFTAEINVNFLPYYLSKKSKLDKIEHTSRFIVKTNLWFASAGTHCQIHREHPFIEIHTQIFGLGHMQKFKDKDFNTLYEDIGMYPGFTTTPPFCSALSCTEFEYPWHQYYAETDCIWLAVEYHPIIGGQYD

SEQ ID NO: 10873 - protein, 402 aa, Xenorhabdus bovienii
  Coding DNA sequence: Name=SeqID_4765
  Gene classification: Gene name=WecB; Function=UDP-N-acetylglucosamine 2-epimerase; Function class=M Cell envelope biogenesis, outer membrane
  Homolog annotation: Query=1..363bp; Hit=1..370bp; Blast score=295; Percent Identity=43.0; E value=7e-80; Homolog= VC0917 COG0381
MLKLGFVIGTRPEAIKCALPIIEMRKDERFDPVLISTGQHNEMLHSTLSVFGITADADLKVMRERQTISGVTHRILDGLSKLPVMQKIDAIVVHGDTASTVAGALFGFQNKIPVIHIEAGLRSGNLYSPFPEEGNRRLVSQISSLHLAPTVGNYLNLLHEGISADSIAITGNTVIDALNWSIPKVNQFNNTVLDDIERDSSRIILASTHRRESWSKLTQIAEALADVASLPNVRVVVPLHKNPIIRDALLPLLQKHPNITLLEPLPYLGFVRLMLRADVILSDSSGAEEEGPALGKPTLILREITERPEAIFSNSAKLVGNDRMEIVNSVREVLSNKEVYDRFVAGGCPYGDGKSTHRILDAIDQFFNRGCLSGKEINRLKQSSLTPAPSLTKISPLISSIL

SEQ ID NO: 10874 - protein, 100 aa, Xenorhabdus bovienii
  Coding DNA sequence: Name=SeqID_4766
  Gene classification: Gene name=XerC; Function=Integrase; Function class=L DNA replication, recombination and repair
  Homolog annotation: Query=25..86bp; Hit=129..190bp; Blast score=88; Percent Identity=66.0; E value=1e-18; Homolog= fimB COG0582
MAVSFTKRRKIIASVGSCFLMGRYGEQVGLSIRLHPHKLRHSCGFELANQGLDTRLIQDYLGYRNIHHTMHYTASNPERFQKAWQQNQQLKIDGGKYPAP

SEQ ID NO: 10875 - protein, 76 aa, Xenorhabdus bovienii
  Coding DNA sequence: Name=SeqID_4767
  Gene classification: Gene name=XerC; Function=Integrase; Function class=L DNA replication, recombination and repair
  Homolog annotation: Query=17..67bp; Hit=25..75bp; Blast score=64; Percent Identity=54.0; E value=2e-11; Homolog= Z0395 COG0582
MNGIVFFSVLNNATNKERDQCLLYLTYIHGLRVSELTSLKVSDIDIAGKTIYIKRLKNGFSTTQHTLSQKQKKSLS

SEQ ID NO: 10876 - protein, 74 aa, Xenorhabdus bovienii
  Coding DNA sequence: Name=SeqID_4768
MSIALFSRSKNRQKITLIIYYVSMATLFITLYNYLLCLLCLLCLLCFRFYLYSAKSHTGHIITKAKKLDAIDQK

SEQ ID NO: 10877 - protein, 52 aa, Xenorhabdus bovienii
  Coding DNA sequence: Name=SeqID_4769
MSLPSKYTIHKAIKSFLLISIIFNMFANESYIDQKMILCWNKNLHIRHISAK

SEQ ID NO: 10878 - protein, 1023 aa, Xenorhabdus bovienii
  Coding DNA sequence: Name=SeqID_4770
  Homolog annotation: Query=39..587bp; Hit=29..583bp; Blast score=439; Percent Identity=43.0; E value=1e-121; Homolog= ref|NP_407385.1|
MMYQVSQCRVVNILFRHYWRFFIVIGIAMHRKFDKSWPQNQPPLLKRMAWANIIIQLTLPVAGAFTPIIAAAKTHTTSHDQQLTALPTKPYILKSGETIDLIAKRYSLTVDDLKKINQLRTFSKSFSTLGIGDEIDVPRPRLNKFLPFNYSPLDESDSKDGTNSRLSNAAIRVGDVLKSNNISNSAKIQLNGLAVSEVNQQIQNWLGHYGTARVQANISDRGRLDGSQLDMLLPLYDTKSQLTFTQFGLRRLNKRNTVNLGVGQRRFFDGGMLGYNAFFDHDFTGENTRWGIGAEYARNYLKLGANGYFRLSNWKESHLLTDYDERPANGFDLRVQGYVPTLPQLGGKLMYEHYFGSEVGLINQNHRQKDPSAFTVGINYTPIPLLTFGIVRKQSTSGGGETQFNMELNYEIGTPWEKLIDPDATDFKRTLQGSRYDLVDRNNQIVLEYRKREIIRLTMDSLITGHAGDIKPLHLTVDSKYGLKNIQWEAVNLFADGGEIERQGGSHYLLTLPEYHHQGNNTYILSAVAYDEHGNASQRVETQVQVLPAAVRDNKSTFTAKDNELLADDRATTMLKLTLEDKEGKPIRDVAGDIKWVTNQLSGEGSDPTIGKIKETQSGVYEAILTAGKKIGILKITPEVDGVHIKPLKITFVHPDAPFVKNLTIVGKLEIGQKLSATYTFNPNGGEKVDKSRYVWGDKGNIDITNGHTIVESGKLPNYTLELSDAGRVKAVAVQAQNGLGLIGNTMIVNTSMSQESGNRTHGGSEGGKVRGIADDIAATVNTDNTKKSNAITLTVKTFKHGQPVRNVAVEVQATQAINRQNKPQTITVLIGGKPALYQGVTDEQGVLSIPVTDPNGNGVKTALKITAYGSAKPKTQDLIFTVPTSPDTPLANFWGHMSESVMGANGAVFMRPQLQIELKGNMKGMATFFESGEIWPRRVYRGAKWYCGKIHANLPTQEDLQSLYRAYSANEMHDLHGWPQHRSYRSSTPAEGNKVHIAVNIDNGIAHPIEDNIVSDYVICRQ

SEQ ID NO: 10879 - protein, 565 aa, Xenorhabdus bovienii
  Coding DNA sequence: Name=SeqID_4771
  Gene classification: Function=Putative regulator of cell autolysis; Function class=T Signal transduction mechanisms
  Homolog annotation: Query=1..561bp; Hit=1..561bp; Blast score=802; Percent Identity=73.0; E value=0; Homolog= yehU COG3275
MHEFNLVLLLLQQMCVYLVIAWLLSKTPLFIPLLQVSVRLPHKLMCYLIFSIFCIMGTYFGLSVNDSIANTRAIGAVLGGFLGGPAVGAMVGFTGGLHRYSLGGMTAFSCMVSTIVEGILGGLVHSYLMKRGQINKLLNPWTAAIVTFLAECIQMGIILLLANPFSDALKLVKNIAAPMIIANSIGAAMFIRILLDRRAIFEKYTSAFSAQALKIAVCTEGILRKGFNEDNSMRVAKVIYQELEIGAVAITDREKLLAFIGIGSDHHLSGTPIVSEQSHRAIENNEVVYADGNETPYCCSLSPICKLGSALVIPLRGENQQVIGTIKLYEAKNRLFSSINRTLGEGIASLLSAQILAGQYERNKQSLLQSEVKLLHAQVNPHFLFNALNTLQAVIRRDSQQAGQLVQYLSTFFRKNLKRPEEIATLENEIEHVNAYLQIEKARFRERLQIAIAIPESLHSAKLPAFSLQPMVENAIKHGTSQLLDTGRITIRAHQEANLLLVEIEDNAGLYCLKKMGDGLGMSLVDKRLQLRYGERYGVHVDCQPEKFTRVILCLPLEKEADKAV

SEQ ID NO: 10880 - protein, 239 aa, Xenorhabdus bovienii
  Coding DNA sequence: Name=SeqID_4772
  Gene classification: Gene name=LytT; Function=Response regulator of the LytR/AlgR family; Function class=K Transcription
  Homolog annotation: Query=1..238bp; Hit=7..244bp; Blast score=336; Percent Identity=69.0; E value=1e-92; Homolog= yehT COG3279
MNVLIVDDEPLARENLRCLLEEETDIQIIGECANAVEAIGAIHRLKPDVVFLDIQMPRITGLEMVGLLDPEHRPYIVFLTAFDEYAVQAFEEHAFDYLLKPLEKERLSKTLQRLRSGYQKQNLADLQQEDEQLKYIPCTGHSRIWLMQLDEVLYVTSRLSGVYVMSANEQEGFTELTLRTLETRTSLTRCHRQYLVNMTHLREIIFGENGQAELVLRNNERIPVSRRYLKPLKEVLGLN

SEQ ID NO: 10881 - protein, 662 aa, Xenorhabdus bovienii
  Coding DNA sequence: Name=SeqID_4773
  Gene classification: Gene name=SrmB; Function=3 Superfamily II DNA and RNA helicases; Function class=L DNA replication, recombination and repair
  Homolog annotation: Query=4..571bp; Hit=20..582bp; Blast score=890; Percent Identity=85.0; E value=0; Homolog= deaD COG0513
MTTETEISFADLGLSAPILAALGDMGYEKPSPIQQQCIPHLLNGRDVLGMAQTGSGKTAAFTLPLLHNIDAELKAPQILVLAPTRELAVQVAEACSEFSKQMRSVNVVALYGGQRYDVQLRALRQGPQVVVGTPGRLLDHLKRGTLDLSNLKGLVLDEADEMLRMGFIEDVENIMSQIPAEHQTALFSATMPEAIRRITRRFMKDPQEVRIQSSVTTRPDISQSYWSVHGVRKNEALVRFLETEDFDATIIFVRTKNATLEVAETLERHGYNSAALNGDMNQALREQTLERLKDGRLDILIATDVAARGLDVERISLVVNYDIPMDAESYVHRIGRTGRAGRAGRALLFVENRERRLLRNVERTMKLTIPEVELPNAELLSQRRLEKFAAKVQQQLESSDLDQYRALLSKLSTNDELDMETLAASLLKMAQGERPLILPPDPVRRPRREFNDRDDRRRDGFVSRERNDRGDRNDRGDKSDRPRRERRDVGDMELYRIEVGRDDGVEVRHIVGAIANEGDISSRYIGNIKLFATHSTIELPKGMPGDLLSHFTRTRILNKPLNMQLMGDAQPFERRERRGGGSGRTGNGSNGSNGSNGSNSGNGSTGGNGSNSGNAPRRDREGFGNGGRRFSTERRGDRANSRGRSGDESNSAPRRRQNSGNA

SEQ ID NO: 10882 - protein, 294 aa, Xenorhabdus bovienii
  Coding DNA sequence: Name=SeqID_4774
  Gene classification: Gene name=NrfG; Function=TPR-repeat-containing proteins; Function class=R General function prediction only
  Homolog annotation: Query=1..294bp; Hit=1..294bp; Blast score=462; Percent Identity=78.0; E value=1e-130; Homolog= nlpI COG0457
MNSFLRWCYVAVIFLLVGCSSTGWRKNEMIAIPLQPTLQQEVILARMEQILASRSLTEDEYAQLLYERGVLYDSLGLRALAQNDFSVALSIRPDIPEIFNYLGIYFTQAGNFDAAYEAFDSVLELDPTYNYARMNRGITLYYGGRYRLAQDDLQAFYQDDPNDPFRSLWLYLVEDKIDPKVAMTNLSRHFDKANRGLWGWNIVEFYLGKISEKTLMDRLKENSSDNTSLAEHLSETDFYLGKHYLSLGDEDNAVALFKLTVANNVHNFVEHRYALLELALLGQRQDDLSESNQQ

SEQ ID NO: 10883 - protein, 716 aa, Xenorhabdus bovienii
  Coding DNA sequence: Name=SeqID_4775
  Gene classification: Gene name=Pnp; Function=Polyribonucleotide nucleotidyltransferase (polynucleotide phosphorylase); Function class=J Translation, ribosomal structure and biogenesis
  Homolog annotation: Query=3..702bp; Hit=24..719bp; Blast score=1152; Percent Identity=86.0; E value=0; Homolog= Zpnp COG1185
MILLNPIVRKFQYGQHTVTIETGMMARQATAAVMVNMDDTAVFVTVVGQKKMKAGQNFFPLTVNYQERTYAAGRIPGSFFRREGRPGEGETLVARLIDRPLRPLFPEGFLNEVQIIATVVSVNPLVNPDIVAMIGASAALALSGIPFNGPIGAARVGYINDQYVLNPTSDELKNSRLDLVVAGTAGAVLMVESEAELLTEEQMLGAVVFGHEQQQIVIDHINALVAETGKDKWDWAPESINQPLHDRVAELAESRLGDAYRITEKQERYAQVNAIKEEVSAIIVTEAAEKGVELEGSEVLDVLSVLEKNVVRGRVLRGEPRIDGREKDMVRALDVRTGVLPRTHGSSLFTRGETQALVAATLGTERDAQVIDELMGERADRFLFHYNFPPYSVGETGMVGSPKRREIGHGRLAKRGVLAVMPTANEFPYTIRVVSEITESNGSSSMASVCGASLALMDAGVPIKAAVAGIAMGLVKEGDNFVVLSDILGDEDHLGDMDFKVAGSRDGISALQMDIKIEGITSEIMQVALNQAKGARLHILGVMEQAIQSPRNDISEFAPRIHTIKINPDKIKDVIGKGGSVIRALTEETGTTIEIEDDGTVKIAATDSDKAHHAIRRIEEITAEVEVGRIYNGKVTRIVDFGAFVAIGGGKEGLVHISQIADKRVEKVTDYLQLAQEVPVKVLEIDRQGRIRLSMKEAVTNTTTDEALQSPESSVE

SEQ ID NO: 10884 - protein, 52 aa, Xenorhabdus bovienii
  Coding DNA sequence: Name=SeqID_4776
MLTILEFTNNRIQQNHIPWLVLPTLNISNNRHSLFATPSRLMTTLNSLKHSH

SEQ ID NO: 10885 - protein, 89 aa, Xenorhabdus bovienii
  Coding DNA sequence: Name=SeqID_4777
  Gene classification: Gene name=RpsO; Function=Ribosomal protein S15P/S13E; Function class=J Translation, ribosomal structure and biogenesis
  Homolog annotation: Query=1..89bp; Hit=1..89bp; Blast score=127; Percent Identity=86.0; E value=1e-30; Homolog= rpsO COG0184
MSLSTEAKAQIVAEFGRGTNDSGSSEVQVALLTAQINHLQGHFSEHKKDHHSRRGLLRMVAQRRKLLNYLKRKDLARYTALIERLGLRR

SEQ ID NO: 10886 - protein, 315 aa, Xenorhabdus bovienii
  Coding DNA sequence: Name=SeqID_4778
  Gene classification: Gene name=TruB; Function=Pseudouridine synthase; Function class=J Translation, ribosomal structure and biogenesis
  Homolog annotation: Query=4..311bp; Hit=5..311bp; Blast score=447; Percent Identity=74.0; E value=1e-126; Homolog= truB COG0130
MGRRRRGRAIHGVLLLDKPQDISSNDALQKVRRIFNASKAGHTGALDPLATGMLPICLGEATKFSQFLLDSDKRYRVIARLGQRTDTSDSHGKIICEREVQITQPQLAAALDTFRGDTMQVPSMYSALKHQGKPLYEYARQGIEIKREARPITVYELQFIRWEGDELELEIHCSKGTYIRTIIDDLGELLGCGAHVIYLRRLQVANYPTHRMVTLEQLHELKKQSEEQEIDAGELLDSLLLPMDTAVAHFPVIQLASVVAAYFKQGQPVRGKHSLTSGEWVRVTEGDENKFIGIAVIDDDGLVAPRRLVVETEQL

SEQ ID NO: 10887 - protein, 136 aa, Xenorhabdus bovienii
  Coding DNA sequence: Name=SeqID_4779
  Gene classification: Gene name=RbfA; Function=Ribosome-binding factor A; Function class=J Translation, ribosomal structure and biogenesis
  Homolog annotation: Query=1..135bp; Hit=1..132bp; Blast score=177; Percent Identity=74.0; E value=3e-45; Homolog= rbfA COG0858
MAREFSRTQRVAQEMQKEIAIILQREVKDPRIGMATVSGVEVSRDLAYAKVFVTFLNVLVEGQDSEMVNGGIKALNEASGFIRSLLGKAMRLRVIPELTFSYDSSLVDGMRMSNLVTKVVKNDEQRRVSADHNEEK

SEQ ID NO: 10888 - protein, 924 aa, Xenorhabdus bovienii
  Coding DNA sequence: Name=SeqID_4780
  Gene classification: Gene name=InfB; Function=Translation initiation factor 2 (GTPase); Function class=J Translation, ribosomal structure and biogenesis
  Homolog annotation: Query=1..923bp; Hit=1..889bp; Blast score=1147; Percent Identity=77.0; E value=0; Homolog= infB COG0532
MTEVTVKLLAEEIQTSVERLIQQFADAGIQKTATDSVSQREKESLLAHLNREQGGSGGQPGKLTLQRKTRSTLNVPGTGGKSKSVAIEVRKKRTYVNRDAIEQSQTEEQAKREAEEQARREVEEKARLETEAKKFAEEQAKRDAEEQAKREAAKSAQREAEEKAKREGVEMTQREAAEKEKVTKQHTENKPKSVQTEPAVQSEKARREAEAADLKRKAEEEVHRKVEAEAKRVAEEARRMAEENKDKWSETAEPSESTDDYHVTTSHHARAAEDENDAKVEGDRRTRSRGGKATRQKKNNKHSESKADREEARAVGRTKGKQRKPSTLQQSFTKPVAAVNRDVVIGETITVAELANKMAVKGSQVIKTMMKMGAMATINQVVDQETAQLVAEEMGHKVILRRENELEEALMSDRDTGETLAESRAPVVTIMGHVDHGKTSLLDYIRSTKVASGEAGGITQHIGAYHVQTEKGMITFLDTPGHAAFTSMRARGAKATDIVVLVVAADDGVMPQTVEAIQHAKAANVPVVVAVNKIDKPDADPDRVKNELTQYGIIPEEWGGENQFMNVSAKAGIGIDELLESILLQAELLELNAVRTGMANGVVIESFLDKGRGPVATILVQSGTLNKGDIVLCGFEYGRIRAMRDELGFEVMSAGPSIPVEILGLSSVPSAGDEATVVRDEKKAREVALYRQGKFREVKLARQQKSKLENMFANMEEGKVSELNIVLKTDVQGTCEAICDSLLKLSTDEVKVKIIGSGVGGITETDATLAAASNAIILGFNVRADASARRIIESESVDLRYYSVIYSLIDEIKQAMSGMLAPEYKQQIMGLAEVRDVFKSPKFGAIAGCMVTEGSIKRNNPIRVLRDNVVIYEGELESLRRFKDDVNEVRNGMECGIGVKNYNDVRVGDMIEVFEIIEIKRSIV

SEQ ID NO: 10889 - protein, 502 aa, Xenorhabdus bovienii
  Coding DNA sequence: Name=SeqID_4781
  Gene classification: Gene name=NusA; Function=Transcription elongation factor; Function class=K Transcription
  Homolog annotation: Query=1..502bp; Hit=1..495bp; Blast score=778; Percent Identity=85.0; E value=0; Homolog= nusA COG0195
MNKEILAVVEAVSNEKSLPREKIFEALEIALATATKKKYEQEIDVRVCIDRKSGDFDTFRRWVAVDEVTLPTREITLEAAKYEDPEMELGGYIEDQIESVTFDRITTQTAKQVIVQKVREAERAMVVDQFREQQGEIVTAQVKKVNRENITLDLGNNAEAVILREDMLPRENFRPGDRVRGVLYDVRPEARGAQLFITRSRPEMLVELFRIEVPEIGEEIIEIKAAARDPGSRAKIAVKTNDKRIDPVGACVGMRGARVQAVSSELGGERIDIVLWDDNPAQFVINAMAPADVASIVVDEDNCTMDVAVENSNLAQAIGRNGQNVRLAAQLLKKHRGDDKWELNVMTAEELQAKHQAEAHASIDTFTKHLDIDVDFATVLVEEGFSTLEELAYVPINELLAIEGLDEETVEVLRERAKAALTTLELAQKESLGDQQPAEDLLNLSGMDRTLAFNLAAHGICTLEDLAEQGIDDLSDIEGLSDEKAGELIMAARNICWFGDDA

SEQ ID NO: 10890 - protein, 140 aa, Xenorhabdus bovienii
  Coding DNA sequence: Name=SeqID_4782
  Gene classification: Function=Uncharacterized BCR; Function class=S Function unknown
  Homolog annotation: Query=1..140bp; Hit=13..152bp; Blast score=243; Percent Identity=85.0; E value=5e-65; Homolog= yhbC COG0779
MISAPVEALGFELVGLEFIRARVSTLRVYIDSEEGITVDNCADVSHQVSAVLDVEDPISVLYNLEISSPGLERPLFKAEHYQRFMGEEVSLVLRMAMQNRRRWQGIIKVVDGEMITVTVDGKDEVFALSNIQKANLVPHF

SEQ ID NO: 10891 - protein, 45 aa, Xenorhabdus bovienii
  Coding DNA sequence: Name=SeqID_4783
MTLEKVHVVKKWLREPDLNRRPSGYEPDELPCCSIPRSKTWQILR

SEQ ID NO: 10892 - protein, 45 aa, Xenorhabdus bovienii
  Coding DNA sequence: Name=SeqID_4784
MLLHPAFENVANLTLIILKTQVSRLWCRGRDLNPYARCLGTTTSR

SEQ ID NO: 10893 - protein, 112 aa, Xenorhabdus bovienii
  Coding DNA sequence: Name=SeqID_4785
  Gene classification: Gene name=SecG; Function=Preprotein translocase subunit; Function class=N Cell motility and secretion
  Homolog annotation: Query=1..111bp; Hit=1..109bp; Blast score=139; Percent Identity=69.0; E value=4e-34; Homolog= secG COG1314
MYEALLGVFLLAGLGVIALVLLQQGKGADMGASFGAGASATLFGSSGSSNFMTRMTAVFATLFFVISLILGNMTSNRTGSDSKWENLAEPVKVEKQAEVPASPVKPNSDIPQ

SEQ ID NO: 10894 - protein, 445 aa, Xenorhabdus bovienii
  Coding DNA sequence: Name=SeqID_4786
  Gene classification: Gene name=CpsG; Function=Phosphomannomutase; Function class=G Carbohydrate transport and metabolism
  Homolog annotation: Query=1..444bp; Hit=1..445bp; Blast score=727; Percent Identity=84.0; E value=0; Homolog= mrsA COG1109
MSSRKYFGTDGIRGKVGDSPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDNVEEAIEAEMEKPLTCVESAELGRANRIVDAAGRYIEFCKGTFPSEQSLNGLKVVLDCANGATYHIAPNVLRELGANVVTIGCEPNGININEECGATDVRLLQKRVQEEQADVGLAFDGDGDRIIMVDHLGQKVDGDQILYIIAREALRQGQLRGGAVGTLMSNMGLELALKQLGIPFERAKVGDRYVLEKLQEKGWRLGAENSGHVILLDKTTTGDGIVAGLQVLSAMVRNNMSLHDLCSGMKLLPQILVNVRFTGDNDPLQSEPVLEAVKSVEAELNGCGRVLLRKSGTEPLIRVMVEGEDEELVTALAHRIADAVKKIG

SEQ ID NO: 10895 - protein, 285 aa, Xenorhabdus bovienii
  Coding DNA sequence: Name=SeqID_4787
  Gene classification: Gene name=FolP; Function=Dihydropteroate synthase and related enzymes; Function class=H Coenzyme metabolism
  Homolog annotation: Query=1..276bp; Hit=16..291bp; Blast score=395; Percent Identity=71.0; E value=1e-110; Homolog= folP COG0294
MKLTARGSVLDLSRPQVMGILNVTPDSFSDGGNHNTFDAALRYAATMIEEGAAIIDVGGESTRPGAVDVSEQEELDRVVAVVEALAQRFDVWISIDTSKAIVMQESAKVGAHMINDIRSLQEFGALDAAVKTGLPVCLMHMQGQPCTMQAEPYYEDVVWEAKTFLTRQIDRCGAAGIAKNKLIIDPGFGFGKNLSHNYQLLAHLEEFHHLGLPILAGMSRKSMIGQLLHVPPQERVTGSIACAVIAAMQGAQIIRVHDVKETVQTMQIVQATLSAKNTLAAKNTL

SEQ ID NO: 10896 - protein, 635 aa, Xenorhabdus bovienii
  Coding DNA sequence: Name=SeqID_4788
  Gene classification: Gene name=HflB; Function=ATP-dependent Zn proteases; Function class=O Posttranslational modification, protein turnover, chaperones
  Homolog annotation: Query=1..633bp; Hit=1..633bp; Blast score=1089; Percent Identity=85.0; E value=0; Homolog= hflB COG0465
MAKNLILWLVIAVVLMVLFQSFGPGDSSGRRVDYSNFISELSQNQVREVRISGRDIDYSKKDDGKKYSTYMPIQDEKLLDTLLNKQVKVVGEPPEQQGLLATLFISWFPMLLLIGVWIFFMRQMQGGGGKGAMSFGKSKARMLTEDQIKTTFADVAGCDEAKEEVGELVEYLREPGRFQKLGGKIPKGILMVGPPGTGKTLLAKAIAGEAKVPFFTISGSDFVEMFVGVGASRVRDMFEQAKKSAPCIIFIDEIDAVGRQRGAGLGGGHDEREQTLNQMLVEMDGFEGNEGIIVIAATNRPDVLDPALLRPGRFDRQVVVGLPDVRGREQILKVHMRRIPLDTDVDASIIARGTPGFSGADLANLANEAALFAARGNKRVVSMVEFEKAKDKIMMGAERRSMVMTEEQKESTAYHEAGHAIIGRLVPEHDPVHKVTIIPRGRALGVTFFLPEGDQISASRQKLESQLSTLYGGRLAEEIIYGVDSVSTGASNDIKVATSIARNMVTQWGFSEKLGPLLYAEEEGEIFLGRSVAKAKHMSEDTARLIDHEVKAIVDRNYQRARKILMDNLDILHSMKDALMKYETIDAPQIDDLMNRTTVRPPAGWEGDNNNGGNNRHNTSSPQQTVKPADGNPTA

SEQ ID NO: 10897 - protein, 209 aa, Xenorhabdus bovienii
  Coding DNA sequence: Name=SeqID_4789
  Gene classification: Gene name=FtsJ; Function=Methyltransferase involved in cell division; Function class=J Translation, ribosomal structure and biogenesis
  Homolog annotation: Query=1..208bp; Hit=1..208bp; Blast score=379; Percent Identity=91.0; E value=1e-105; Homolog= ftsJ COG0293
MANKKRSASSSRWLQEHFSDKYVLQAQKKGLRSRAWFKLDGIQQSDKIFKPGMTVVDLGAAPGGWSQYVVSQIGDRGRVIACDLLPMDPIVGVDFLQGDFRDELVLKALLERVGDNKVQVVMSDMAPNMSGTPAVDIPRSMYLIELALGMCRDVLAPGGSFIVKVFQGEGFDEYLREIRSLFTKVKVRKPEASRARSREVYIVATGRKL

SEQ ID NO: 10898 - protein, 97 aa, Xenorhabdus bovienii
  Coding DNA sequence: Name=SeqID_4790
  Gene classification: Function=Predicted RNA-binding protein containing KH domain, possibly ribosomal protein; Function class=J Translation, ribosomal structure and biogenesis
  Homolog annotation: Query=1..97bp; Hit=1..97bp; Blast score=131; Percent Identity=76.0; E value=1e-31; Homolog= yhbY COG1534
MTLNKKQVQYLKSLAHSLKPVVMIGNNGLTEGVLAEIKQTLSHHELIKVKVAGEDREIKTLIAEAIVRETGAYNVQIIGKMLVLYRPSKERRISLPK

SEQ ID NO: 10899 - protein, 158 aa, Xenorhabdus bovienii
  Coding DNA sequence: Name=SeqID_4791
  Gene classification: Gene name=GreA; Function=Transcription elongation factor; Function class=K Transcription
  Homolog annotation: Query=6..158bp; Hit=1..153bp; Blast score=240; Percent Identity=83.0; E value=5e-64; Homolog= greA COG0782
MKQIPMTVRGADKLREELENLKNVRRPKIITAIADARAHGDLKENAEYHAAREQQGFCEGRIQEIEAKLSNAQVIDITKMTNNGRVIFGATVTVLNVGSDEEQTYRIVGDDEANIKENLISVNSPIARGLIGKEVDDAVVISTPGGKVEYEVLNVEYL

SEQ ID NO: 10900 - protein, 34 aa, Xenorhabdus bovienii
  Coding DNA sequence: Name=SeqID_4792
MSTPYQAGLQTIKGEQTTVYPEVHIPILPANLLF

SEQ ID NO: 10901 - protein, 513 aa, Xenorhabdus bovienii
  Coding DNA sequence: Name=SeqID_4793
  Gene classification: Gene name=DacB; Function=D-alanyl-D-alanine carboxypeptidase (penicillin-binding protein 4); Function class=M Cell envelope biogenesis, outer membrane
  Homolog annotation: Query=52..513bp; Hit=16..477bp; Blast score=668; Percent Identity=66.0; E value=0; Homolog= dacB COG2027
MMDHRLLLPELHLSIIDVNIIRILPPSYARSMALLKITSKIACMLSFSLSIFSANASSIEEDAQYLPAGTDFSFIAQKIGSKTSLFDYNGQQLALPASTQKIVTALAALLQLGKDYRFITTLESNADISDGILRGNLTARFVGDPTLTRSQLRNMVETLKQSGIKQIDGDLIIDSSIFSSHDKAPGWVWNDMTQCFSAPPAAAIVDKNCFSVSLYSSEQPGELAFVRVPSFYPVSIFSEVKTLSKGSPEAKYCELDVTSGELNRFTLTGCLTQRSEPLPLAFAIQNGASYVGAILKNELHIADIELKGHLRRQSNPEQPEKILALNESVPLHDLLKIMLKKSDNMIADTIFRTLGHRYFNVPGTWRTGSDAIRQILKQKAGIDLGSTVMVDGSGLSRHNLITPATMMEILQFIAQHNDDLDFISMLPKSGYDGTLSYRPGLHEAGVNGQVFAKTGSLQGVYNLAGFITAASGQQIAFVQFISSYSVLPDAQRTRRVPLARFESHLYKSLYQNH

SEQ ID NO: 10902 - protein, 392 aa, Xenorhabdus bovienii
  Coding DNA sequence: Name=SeqID_4794
  Gene classification: Gene name=Obg (BS); Function=Predicted GTPase; Function class=R General function prediction only
  Homolog annotation: Query=1..391bp; Hit=1..389bp; Blast score=553; Percent Identity=79.0; E value=1e-157; Homolog= yhbZ COG0536
MKFVDEASILVVAGDGGNGCVSFRREKYIPKGGPDGGDGGDGGDVYLLADENLNTLIDYRFEKSFRAERGQNGQSRGCTGRRGQDITIKVPVGTRVRDIATGEVLADMVRHEQRQMVAKGGFHGLGNTRFKSSVNRAPRQKTMGTPGESRELMLELMLLADVGMLGMPNAGKSTFIRSVSAAKPKVADYPFTTLVPSLGVVRMDNEQSFVVADIPGLIEGASDGVGLGIRFLKHLERCRVLLHLIDLCPIDESDPVENARIIIKELHKYSEKLAEKPRWLVFNKVDLTDPEEAKQRAKAIADELGWEGDYYMISAINRQGVKDLCWDIMEFMKTQPRHMDVEEEAQPEKVEFMWDDYHKEQLQQSSDTDVDDDLDDDWDEGDEEGIEFIYKH

SEQ ID NO: 10903 - protein, 36 aa, Xenorhabdus bovienii
  Coding DNA sequence: Name=SeqID_4795
MCVAGLFIFWITPSLGTAAIQLYGGYPTEKSDEICR

SEQ ID NO: 10904 - protein, 85 aa, Xenorhabdus bovienii
  Coding DNA sequence: Name=SeqID_4796
  Gene classification: Gene name=RpmA; Function=Ribosomal protein L27; Function class=J Translation, ribosomal structure and biogenesis
  Homolog annotation: Query=1..85bp; Hit=1..85bp; Blast score=126; Percent Identity=92.0; E value=4e-30; Homolog= rpmA COG0211
MAHKKAGGSTRNGRDSESKRLGVKRFGGESVLAGSIIVRQRGTKFHAGSNVGCGRDHTLFALADGKIKFEVKGSKNRKFISIVAE

SEQ ID NO: 10905 - protein, 102 aa, Xenorhabdus bovienii
  Coding DNA sequence: Name=SeqID_4797
  Gene classification: Gene name=RplU; Function=Ribosomal protein L21; Function class=J Translation, ribosomal structure and biogenesis
  Homolog annotation: Query=1..102bp; Hit=1..102bp; Blast score=154; Percent Identity=85.0; E value=1e-38; Homolog= rplU COG0261
MYAVFQSGGKQHRVSEGQTIRLEKLDIATGETVEFDQVLMVANGEDIKIGAPVVEGVKVKAEVVAHGRGEKIKIVKFRRRKHSRKQQGHRQWFTDVKITGIA

SEQ ID NO: 10906 - protein, 323 aa, Xenorhabdus bovienii
  Coding DNA sequence: Name=SeqID_4798
  Gene classification: Gene name=IspA; Function=Geranylgeranyl pyrophosphate synthase; Function class=H Coenzyme metabolism
  Homolog annotation: Query=1..321bp; Hit=1..321bp; Blast score=488; Percent Identity=76.0; E value=1e-138; Homolog= ispB COG0142
MNLESIIKLTADDMAAVNETILNQLNSDVALINQLGYYIISGGGKRIRPMIAVLAGKALHCEEEKHITVAALIEFIHTATLLHDDVVDESDMRRGKATANAMYGNAASVLVGDFIYTRSFQMMTDLDSMRVLKLMSDATNVIAEGEVMQLMNCNDPDTSEDDYMRVIYSKTARLFEVAAHSAAILSGATPEQEAALRDYGRYLGTAFQLIDDLLDYDSDDNTLGKNTGDDLNEGKPTLPLLHAMHHGAPEQSALIRSAIEQGNGRHLLDTVLATMKQCGSLKYTRQRAEEEADKAISALQVLDESPYKAALVGLAHVAVQRLS

SEQ ID NO: 10907 - protein, 126 aa, Xenorhabdus bovienii
  Coding DNA sequence: Name=SeqID_4799
  Homolog annotation: Query=1..119bp; Hit=8..127bp; Blast score=182; Percent Identity=76.0; E value=8e-46; Homolog= ref|NP_931708.1|
MKKDWYSAKELIGLAGLPSSPQGVNLMARREGWEQRRKRGVQGKALEYHVNSLPEEVLNVLSVSENSVEYYRNKRQDPFMIWIEAYYQLTKPERERMVKFILRKGLASLVQYIGIQEVENKDSIPD

SEQ ID NO: 10908 - protein, 115 aa, Xenorhabdus bovienii
  Coding DNA sequence: Name=SeqID_4800
  Homolog annotation: Query=14..112bp; Hit=1..99bp; Blast score=155; Percent Identity=77.0; E value=1e-37; Homolog= ref|NP_931709.1|
MKKEWYTAMELTGVGELPRSPQGVNARAKREEWLRQKRAGVQGRAIEYHYSCFPESTLSALELHEISPEYQVQKQDPLSIWVSAFNLLADEEKEAITEVILRDGIRSFLEKIIAT

SEQ ID NO: 10909 - protein, 88 aa, Xenorhabdus bovienii
  Coding DNA sequence: Name=SeqID_4801
  Gene classification: Gene name=Nlp; Function=Predicted transcriptional regulator; Function class=K Transcription
  Homolog annotation: Query=7..80bp; Hit=7..80bp; Blast score=101; Percent Identity=71.0; E value=1e-22; Homolog= sfsB COG3423
MISMKSDWHPADIIAALRKRGTTLAAVSREAGLSSSTLANTLSRPWPKGEWIIANYLGLHPSEIWPSRYFDPHTGELLERKVREKKNN

SEQ ID NO: 10910 - protein, 312 aa, Xenorhabdus bovienii
  Coding DNA sequence: Name=SeqID_4802
  Gene classification: Gene name=Mdh; Function=Malate/lactate dehydrogenases; Function class=C Energy production and conversion
  Homolog annotation: Query=1..311bp; Hit=1..311bp; Blast score=488; Percent Identity=84.0; E value=1e-138; Homolog= mdh COG0039
MKVAVLGAAGGIGQALALLLKTQLPSGSELSLYDIAPVTPGVAADLSHIPTEVKVTGFAGEDATPALVGADVVLISAGVARKPGMDRSDLFNINAGIIRNLVQQAAKACPKALIGIITNPVNTTVAIAAEVLKKEGVYDRNRLFGVTTLDIIRSNTFVAELKGKNSEELEVPVIGGHSGVTILPLLSQIQGVSFTDEEVEALTKRIQNAGTEVVEAKAGGGSATLSMGQAAARLGLSLIRGLQGESNVIECSYVEGDGKYARFFAQPVRLGKNGIEERLDIGKLSDFEQKSLDSMLDVLKKDIELGEKFING

SEQ ID NO: 10911 - protein, 156 aa, Xenorhabdus bovienii
  Coding DNA sequence: Name=SeqID_4803
  Gene classification: Gene name=ArgR; Function=Arginine repressor; Function class=E Amino acid transport and metabolism
  Homolog annotation: Query=1..156bp; Hit=1..156bp; Blast score=265; Percent Identity=88.0; E value=1e-71; Homolog= argR COG1438
MRAPSKQEDLVKAFKALLKEEKFSSQGEIVAALQEEGFENINQSKVSRMLTKFGAVRTRNAKMEMVYCLPAELGVPTATSPLKNLVLDVDYNHCVVVIRTSPGAAQLIARLLDSLGKAEGILGSIAGDDTIFTTPAQDFTTKQLYEAILDLFDQEL

SEQ ID NO: 10912 - protein, 456 aa, Xenorhabdus bovienii
  Coding DNA sequence: Name=SeqID_4804
  Gene classification: Gene name=MurC; Function=UDP-N-acetylmuramate -alanine ligase; Function class=M Cell envelope biogenesis, outer membrane
  Homolog annotation: Query=1..456bp; Hit=1..456bp; Blast score=770; Percent Identity=79.0; E value=0; Homolog= ZyjfG COG0773
MRIHILGICGTFMGGLAILARSLGHEVTGSDANVYPPMSTLLEKQGIELIQGYDPSQLDPEPDMVIIGNAMTRGNPCVEAVLDRGIPYTSGPQWLHDHVLPERWVLAVAGTHGKTTTAGMLAWILEACGYKPGFLIGGVPGNFDVSAQIGESPFFVIEADEYDCAFFDKRSKFVHYGPRTLIMNNLEFDHADIFENLAAVQKQFHHLVRVVPGSGKILVPDNDINLKHVLGMGCWSELEHIGETGNWQAKKVSQDSSIYQVFHQSEQVGEVNWSLVGEHNMHNGLIAIAAAHHVGVQPADACQVLGDFINARRRLELRGEVNGISVYDDFAHHPTAILATLAALRSKVGGVARILAVLEPRSNTMKMGMSKNDIAPSLGRADEVFLYQPANIPWQVAEIAEHCIQPARWSADIDALVRMIVEVAQPGDYILIMSNGGFDGIHEKLLTELGKKVHEA

SEQ ID NO: 10913 - protein, 385 aa, Xenorhabdus bovienii
  Coding DNA sequence: Name=SeqID_4805
  Gene classification: Gene name=Fbp; Function=Fructose-1,6 -bisphosphatase; Function class=G Carbohydrate transport and metabolism
  Homolog annotation: Query=52..383bp; Hit=1..330bp; Blast score=581; Percent Identity=84.0; E value=1e-166; Homolog= fbp COG0158
MRCVTILTINAEIRNAIAYQSPHSLAKLPRMSATRKCSTLSKTTTKFRAFVMKTLGEFIVEKQHDFPHATGELTALLSAIKLGAKIIHRDINKAGLVDILGTSGVSNVQGEVQMKLDLYANEKLKAALKARGEVAGIASEEEDEIVVFDGDRAENAKYVVLMDPLDGSSNIDVNVSVGTIFSIYRRITPIGQPVTEEDFLQPGNRQVAAGYVVYGSSTMLVYTTGCGVHTFTYDPSLGVFCLTHEKVQFPAKGNMYSINEGNYIKFPMGVKKYIKYCQEQDEATQRPYTTRYIGSLVADFHRNLLKGGIYIYPSTASHPTGKLRLLYECNPIAFLAEQAGGKASDGKNRILDITPTQLHQRVPFFVGTESMVEKAESFMAEFPGE

SEQ ID NO: 10914 - protein, 176 aa, Xenorhabdus bovienii
  Coding DNA sequence: Name=SeqID_4806
  Gene classification: Gene name=Ppa; Function=Inorganic pyrophosphatase; Function class=C Energy production and conversion
  Homolog annotation: Query=1..176bp; Hit=1..176bp; Blast score=325; Percent Identity=89.0; E value=1e-89; Homolog= ppa COG0221
MSLNNVPAGKELPEDIYVIIEIPANADPIKYEVDKDSGALFVDRFMSTAMFYPCNYGYINNTLSLDGDPVDVLVPTPYPLQPGSVIRCRPVGVLKMSDESGEDAKLVAVPHTKLSKEYDHIKDVNDLPELLRAQITHFFEHYKDLEKGKWVKVDGWDNVEAAKAEILSSFERAAKK

SEQ ID NO: 10915 - protein, 115 aa, Xenorhabdus bovienii
  Coding DNA sequence: Name=SeqID_4807
  Gene classification: Function=Uncharacterized ACR; Function class=S Function unknown
  Homolog annotation: Query=1..111bp; Hit=1..111bp; Blast score=142; Percent Identity=59.0; E value=7e-35; Homolog= ytfP COG2105
MRVIVYGSLRRKQGNHHWMTYAQLLGEHRLEGYEIYDLGHYPAVIRGEGTIECEVYRITPSILTELDALKKNSQEYERELIKTPYGSAWIYLYRLPVDGLHRITCGDWIKRHEEE

SEQ ID NO: 10916 - protein, 1259 aa, Xenorhabdus bovienii
  Coding DNA sequence: Name=SeqID_4808
  Gene classification: Function=Uncharacterized BCR; Function class=S Function unknown
  Homolog annotation: Query=5..1259bp; Hit=5..1259bp; Blast score=1367; Percent Identity=54.0; E value=0; Homolog= ytfN COG2911
MRWIKRFSIAFLLLVGLLLITVMGLVGTQTGLHFMINSAARWVPGLDIANVSGGWRDLTLKGVKYQMPGVNVSADNLHLSLRLSCLKHSHLCVNALTTEGAAVSVNTAELPPSEESPASEPLTELKTPYPISLDLLSLKNTHVKVDDIVIALDEFKTGAQWREKQLTLKPTEISNLLVALPKTPPEQSGTVENTAQKGKQKPEPEKSLGETLKALFAKPFLAELPNVPIPLDITAENIHGSQLRLTGDTGITINDLRLQASNQGQQVDMKTFSVSAPEGSLSLQGTVGLFGQWPVKLAIKGNTNLNELKGQKVDLTLNGALLQQLNLALHLSGPVVANLSAQTELAKAGLPVRLTLESKQLQWPLTGEPEYRLDGVKLRLNGKASGYDLSLRSDIKGRDIPPALLMLDAKGNEELLRLTRLRLSALQGKAEITGVVDWSKAISWNANLILDGINTAKQWPEWPAKMNGKMAVRGSLYGGSWQLQIPEIALDGDVKQNTVKAHGKASGNAAGQWNIPQFDLTFGRNRLNVQGQLTDEKWKLDGEINAPQLNGLLPGLAGVVIGNVKLRGNMKAPQIVADLNARNVRWQNELKVDSATIKGDVRSAEQIEGQLLVTVHQLKQADLIINNLMLNAKGTEKQHDLHLKIEGNPVSGQLALNGRFDRGQERWQGTINNTYFDTPVGEWRLSKAIAIDYLNLQQKVTVGTHCWLNPNAQICVPKPIEAGASGHAEVVLKRFDLAMIQPFLDKMTQLKGVFSGNANVKWTAGQVLPQAKVVLQGNGVQLHQMVEGTALPVDFETLTVNAGLTNGKANVAWLFKLAGNGQLNGNVQVADLEGRRKLSGNVDIQALSLKLIKPILGKDEKAEGDLNANLRLGGNVKNPLLFGQLKTDDLQIVSHWLPFDITQGQLAIYFDGVRSGLEGVIKTPKGQLNLNGNADWRNLNAWYAKIAANGEKLRVTVPPMVKIDVSPNLVLEATPDLLKLDGNVDIPWARITVQELPESAVGISSDEVMLDKNLQPIEKKKSSILVKSNLNIRIGDDVRLNAFGLKAQLKGALKVIQDKQGLGLNGQIDIPDGRFHAYGQDLLVRKGTIIFSGPPEQPMLNIEAIRNPDSTANKVVAGVKVTGLADKPKVEIFSEPAKSQQEALSYLLRGEGLEKSGSDNNQMTSMLIGLGVSQSGQLVGKIGETFGVSDLALDTQGVGDKSQVVVSGKITNNLQVKYGVGIFDSLATLTLRYRVMPRLYLDAVSGIDQALDLLYEFEF

SEQ ID NO: 10917 - protein, 580 aa, Xenorhabdus bovienii
  Coding DNA sequence: Name=SeqID_4809
  Gene classification: Function=Predicted outer membrane protein; Function class=M Cell envelope biogenesis, outer membrane
  Homolog annotation: Query=7..580bp; Hit=10..577bp; Blast score=737; Percent Identity=61.0; E value=0; Homolog= ytfM COG0729
VSRYPFIFVLCVSVATPSAYSANLRLKVEGLSGELEKNARVQLSNISTDEVAPDGRFQARVEKAIQQGLRPLGYYDPTVEFTYQEKTPPSRPVLTANVTPGEPVRVVEVNVDLEGSAKTDKDYASLIKKNMPKEGVILNHGEYEHFKGALNSLAVRKGYFDAAMKKSELEVSREQHKSYWNFDFDSGDRYRFGSVRYHGSQIRENYLNNLLPFKQGEYYTSDQLAEFSSRLANTGWFNSVVVVPDFKVGHTSQDKLLPLDASLVPSSANYVELGGGYATDVGPRVKAKWKKPWLNSRGHSLSTNINLSAPEQVIDASYKMPLKSNPLEQYYELQTGYKRKDINDTISDTATLNLSRNWDLSTGWQYGINLRWSLSHFTQANVTNTTMLLYPGANVSRIRQRGGTMPYWGDSQRYSIDFSDKTWDSNVDFLVLQAHHVWIRTYKDKHRFVVRGDLGWIETNEFSKVPPDLRFFAGGDRSIRGYKYQKISPKNSEGKLTGASKLAVGSLEYQYNIYGNWWSALFVDAGEAVDDIKKSDFKTGAGVGVRWASPVGPIKFDLAAPVGDASNHGIEFYIGLGAEL

SEQ ID NO: 10918 - protein, 215 aa, Xenorhabdus bovienii
  Coding DNA sequence: Name=SeqID_4810
  Gene classification: Gene name=MsrA; Function=Peptide methionine sulfoxide reductase; Function class=O Posttranslational modification, protein turnover, chaperones
  Homolog annotation: Query=11..211bp; Hit=10..210bp; Blast score=248; Percent Identity=63.0; E value=3e-66; Homolog= ZmsrA COG0225
LPNSANESQHVSTQDALLGRAIPLTVSPYHVVTQHSINDIPENMEIAYIGMGCFWGVERLFWQQEGIYTTSVGYSGGTTPNPTYEEVCTGLTGHAEVIRIVFDPTKITYGQLLTLFWENHDPAQGMRQHGDVGTQYRSAIYTISSQQYEQALATREQFQQAMDENGDQRTITTEIRAAEPFYFAEDYHQQYLFKNPEGYCGLGGIGVCLLPTHKN

SEQ ID NO: 10919 - protein, 443 aa, Xenorhabdus bovienii
  Coding DNA sequence: Name=SeqID_4811
  Gene classification: Function=Hemolysins and related proteins containing CBS domains; Function class=N Cell motility and secretion
  Homolog annotation: Query=1..434bp; Hit=1..434bp; Blast score=644; Percent Identity=73.0; E value=0; Homolog= ytfL COG1253
MLNSLLIIFLLCAISAFFSLSEISLAASRRIKLKLMADEGNLNAAHVLKLQETPGMFFTIVQIGLNAVAILAGVVGESAFSPALKTLFSNFMRQEWADQLGFICSFIIVTSLFILLADLIPKRIGMIKPEAVAVRIVNPMRFCLATFRPLVWLFNGLADCFLKIFKIPMARNEDITSDDIYAVVAAGALAGVLRKQEHELIENVFELESRTVPSAMTSRESVIYFDKNEDENSIKEKISTHPHSKFLVCDGGIDHVTGYVDSKDLLNRVLNGQSLSLKDGVQTRNALMIPDTLSLSDTLESFKAAGEDFAIILNEYALVMGVITLNDVMTTLMGDLVDQGQEEQIVVRDENSWLVEGGTPIEDVLRVLDIDDFPDSSNYETIAGFMMFRLRKIPKRTDFVKFSGYKFEVVDIDNYKIDQLLVTKIVDTPTQSNPSPSGQAQTQ

SEQ ID NO: 10920 - protein, 68 aa, Xenorhabdus bovienii
  Coding DNA sequence: Name=SeqID_4812
  Homolog annotation: Query=1..68bp; Hit=1..68bp; Blast score=114; Percent Identity=86.0; E value=3e-25; Homolog= ref|NP_931721.1|
MKIFHHYNPLKVALYVKTLFRGRLYIKDMGAFEFNYGKILPPKIKDKRHLHVMSEINQQVLRLQAEIG

SEQ ID NO: 10921 - protein, 185 aa, Xenorhabdus bovienii
  Coding DNA sequence: Name=SeqID_4813
  Gene classification: Function=Predicted transcriptional regulator; Function class=R General function prediction only
  Homolog annotation: Query=6..183bp; Hit=6..183bp; Blast score=206; Percent Identity=54.0; E value=1e-53; Homolog= ZytfJ COG3054
MIKNIVLSAMLSLTSVFAFAHNITVGQPVPAVSVTDKGELLLNNDKFSYQNWNSTELPGKVRTIQHIAGRSSAKEMNDPLIQALKQADLPKAKYQTTSIVNTDDAIFGTSVFVRNSLEDSKKEFPWSQFIVDSEGLAKKAWGLEPKSSAIIVLDKNGNVKFVKDGKLSNEDITHVLNLIKEELNN

SEQ ID NO: 10922 - protein, 230 aa, Xenorhabdus bovienii
  Coding DNA sequence: Name=SeqID_4814
  Gene classification: Gene name=CysQ; Function=3'-Phosphoadenosine 5' -phosphosulfate (PAPS) 3'-phosphatase; Function class=P Inorganic ion transport and metabolism
  Homolog annotation: Query=1..230bp; Hit=17..246bp; Blast score=310; Percent Identity=70.0; E value=1e-84; Homolog= ZcysQ COG1218
MAVYQDEQPLKVEHKMDDSPVTAADIAAHKIIKAGLMRIAPDIPLLSEEDPPVWEERKNWQRYWLVDPLDGTKEFIQRNGEFTVNIALIEDGVPVMGVVYVPVLNVLYAGQGHQAWKETNGQTIPIKVAAAMLPTVVISRSHMDEELKDYLTQLGTHQTLSVGSSLKFCMVAEGKAQLYPRFGPTNIWDTAAGHAVAIAAGAHVTDWEGKKLNYAPRESFLNPGFRVTIF

SEQ ID NO: 10923 - protein, 433 aa, Xenorhabdus bovienii
  Coding DNA sequence: Name=SeqID_4815
  Gene classification: Gene name=TrkA (BS); Function=Predicted flavoprotein involved in K+ transport; Function class=P Inorganic ion transport and metabolism
  Homolog annotation: Query=12..418bp; Hit=5..405bp; Blast score=410; Percent Identity=50.0; E value=1e-114; Homolog= slr0801 COG2072
MLNIQNQILQPNYDVVIVGGGQAGLCISHYLQKAGIDHVVLEKESELTHSWRRKRWDNFTLVTPNWQCLLPEHPYQRQDPDGFMKKHEIVEYLDEFIEKLNPPAILNIQVEHVEKEAAYKFVIKTNYGTTTAKQLVVAAGGYHTPIYPKLSDVLPENIKVMHSEEYLNADQLPEGAVLVVGSGQSGAQIAEDLHLAGKKVYLSTGDAPRCARFYRGKDVVNWLFDMGHYKTTAKDHRYSEEVRNSTNHYVTGRDGGHDIDLRKFALEGMQLLGRFDDYKEGQLWFRPDLSENLDSADATYNRINASIDEYLAKNNIETDEPVSVYQPVWQPEQEIIHINLAKANITSVIWCIGFRPDYSWIDLDIFQANGYPKHDRGITIDPDVTFIGLPWLHTWGSGRFLGIDQDAAYVVRHIEQKISQQNSHNKQIAEMAE

SEQ ID NO: 10924 - protein, 96 aa, Xenorhabdus bovienii
  Coding DNA sequence: Name=SeqID_4816
  Homolog annotation: Query=1..96bp; Hit=1..96bp; Blast score=152; Percent Identity=80.0; E value=9e-37; Homolog= ref|NP_928538.1|
MPSVNFTVKWSNGEQTQYYSPSTVIYEYLSIGQCYPSTQFLHQVEDGLYAASERVRACYGFGCSSAMDNLAMIQHQAKLFELSPEDQITVIEMTHK

SEQ ID NO: 10925 - protein, 336 aa, Xenorhabdus bovienii
  Coding DNA sequence: Name=SeqID_4817
  Gene classification: Function=Selenophosphate synthetase-related proteins; Function class=R General function prediction only
  Homolog annotation: Query=50..326bp; Hit=42..318bp; Blast score=205; Percent Identity=39.0; E value=7e-53; Homolog= sll0787 COG2144
MELNQLLEILRHTPAMQSKQAIASSISTNTVSANTTCHVDSLDSLYAYPGDDAAALPLNGQYVLHACEGMLPNFVANHPYFAGWAAVMANISDIAAMGGRALSVVNSLWHTNSKQAQLLMQGMQDACHAYGVPLVGGHTNLGTVYQPALSVAIQGTARKLLSVLHVKPQQKILMALNLQGQFHPNTTYWKCFEQVSDCVLQSQIALLPQLAEAALVHAARDISNAGILGSLLMLLEATASGAHINLDAMPKPDDVDWSKWLQIFPSFGFLLTANVDKCEEIIKLFHSQDIACTVIAETNVSGVVTVQQQQQHGIFWDFNNQVFTGFCYANVLKTFN

SEQ ID NO: 10926 - protein, 187 aa, Xenorhabdus bovienii
  Coding DNA sequence: Name=SeqID_4818
  Gene classification: Gene name=WecD; Function=Histone acetyltransferase HPA2 and related acetyltransferases; Function class=K Transcription
  Homolog annotation: Query=13..172bp; Hit=15..175bp; Blast score=108; Percent Identity=40.0; E value=4e-24; Homolog= sll0786 COG0454
MELSRYACLFGLNEELKQFISDDIAIKMVSEDWERRQYYRLREVTFRDEQKILKEDRDEYDVKALGIVAIGKMAGEHDRVIGAVRIFPDGEQTWYGGRLCVEPLYRRHHTIGKALINAAVSTAKNLGCCTFLATVQSQNEHYFQRLCWDSLCQLTVANIPHVLMQAQIENYPLQYIPMQTYMQKETQ

SEQ ID NO: 10927 - protein, 359 aa, Xenorhabdus bovienii
  Coding DNA sequence: Name=SeqID_4819
  Gene classification: Function=Biotin synthase-related enzyme; Function class=R General function prediction only
  Homolog annotation: Query=194..316bp; Hit=105..222bp; Blast score=59; Percent Identity=29.0; E value=7e-09; Homolog= PAB2355 COG2516
MSAIQLLTDLQCNGLKWEGEFGLSRKGGAGPSDHKALSLDGKTMMIPVLNLAAQDSPYTAKPDLNSDKVTVFKNRIPVAILTIPARPRFYDLKTAEGIAYEQIATLHSHDVLATTVLQHCIRMNDKATACQFCSIDQSLIGDRTLIRKRPEQLAEVAKAAVELDGIKQMVITTGTPNTGDRGAKILCDSVKAIKAQVDLPIQVQCEPPDDFAWFQRLKDAGAVSIGMHLEAVSERVRQKIMPGKAEVSLEKYFSAFEAAVAVFGRGQVSTYILAGLGDTEPEIVEMTAKLTEIGVYPFVVPFVPIQGTPLEHHPKPDHAFMQSLYPKIGLQLKQHSLNSENTQAGCAKCGACSSLKAYE

SEQ ID NO: 10928 - protein, 330 aa, Xenorhabdus bovienii
  Coding DNA sequence: Name=SeqID_4820
  Gene classification: Function=Predicted amidohydrolase; Function class=R General function prediction only
  Homolog annotation: Query=5..306bp; Hit=13..313bp; Blast score=407; Percent Identity=62.0; E value=1e-114; Homolog= sll0784 COG0388
MNRIIKAAAVQCSPVLYSQAATVKKICDIISELGKQGVQFAVFPETVVPYYPYFSFVQPPFAMGKEHLKLLNESVVVPSEATLAIGQACLEANMVVSIGINERAGGTIYNAQLLFDADGSIIQHRRKITPTYHERMVWGQGDGSGLHAIDSAVGRVGSLACWEHYNPLARFALMADGEQIHASMFPGSLVGQIFADQISATIQHHALESGCFVVNATAWLHPEQQQQIMQDTGCNIGPISGGCFTAIVSPEGKFLAEPLTQDEGYCIADLDLSLINKRKRMMDSVGHYSRPELFSLLIDRRPTNVLHELKIETPDQNHLEKHAKFNETQI

SEQ ID NO: 10929 - protein, 160 aa, Xenorhabdus bovienii
  Coding DNA sequence: Name=SeqID_4821
  Homolog annotation: Query=1..159bp; Hit=1..159bp; Blast score=303; Percent Identity=94.0; E value=5e-82; Homolog= ref|NP_928543.1|
MPKIDIEQYKDGDFLVDYEEKVFEDVKAQPGEKALLTFHTVAFEGSIGLINVLQAKRLLRKGFETKILLYGPGVQLGVQRGFPTLGAEAFPGHLAVNNQLKAFMEEGGEVYACRFALQAMYGQTEKALIPGIRPINPLDVMDLKLLMRRENALIIDTWTV

SEQ ID NO: 10930 - protein, 641 aa, Xenorhabdus bovienii
  Coding DNA sequence: Name=SeqID_4822
  Gene classification: Gene name=FhlA; Function=Transcriptional regulator containing GAF, AAA-type ATPase, and DNA binding domains; Function class=K Transcription
  Homolog annotation: Query=274..639bp; Hit=292..657bp; Blast score =310; Percent Identity=44.0; E value=4e-84; Homolog= hyfR COG3604
MNTTDFISDWVTSENSIRPLVFEHTSQALIVLDPHQNQFIDVNISATRLLRYERHEIIQKTITSVFGHLSQLPHLLAFTEEALEKDWAWNNELCSFDKHGEKIQLDITSISLPYKNKTLLIWSLVDVRELELRQLKKNTDKAIRTDLKEWQALQELFIDSDTGKHLLLSSVGDGIYSINKQGLCTFINPAGAKMLGLQPEDVLSNNIHKIHHHTHDNGDHYPVEECPIYAAVHDGIVYEGIQENFWRRDGSYFPVEFTSTPVIRDSEIIGAVVVFRDITDRLNTEKQLTHALEELQDLKSRLEQQNEYLQEEILQENKYHEIVGNSASILQIIEKIKVVASTDANVMIYGESGTGKELIARAIHQFSHRKQQPLIRVNCAAIPSELFESEFFGHVKGAFTGAVRDRIGRFELADQGTLFLDEIGDIQPELQSKLLRVLQEGTFERVGEEKTRHVNVRIIAATNRNLKEDVKYKRFREDLYFRLNVFPIHSPALRDRREDIPLLVTHFTRLICDNRKIKYLPFSQKHILELQQYDWPGNIRELQNVIERALITARQGAVSFKYLLEQDQQQPKIQRQDIYNEYQQTEGVLTIEQFKELEIKNLSLAVKQCKGKIFGDNGAARLLGINPTTLISRLKKLGIDY

SEQ ID NO: 10931 - protein, 71 aa, Xenorhabdus bovienii
  Coding DNA sequence: Name=SeqID_4823
  Gene classification: Gene name=CspC; Function=Cold shock proteins; Function class=K Transcription
  Homolog annotation: Query=1..70bp; Hit=1..70bp; Blast score=108; Percent Identity=75.0; E value=7e-25; Homolog= cspI COG1278
MSNTMTGTVKWFNSDKGFGFISPKDGSKDVFVHFSAIQSNDYKTLDEGQEVSFSVESGAKGPSATNVIALS

SEQ ID NO: 10932 - protein, 238 aa, Xenorhabdus bovienii
  Coding DNA sequence: Name=SeqID_4824
  Gene classification: Gene name=LexA; Function=SOS-response transcriptional repressors (RecA-mediated autopeptidases); Function class=K Transcription
  Homolog annotation: Query=2..233bp; Hit=5..230bp; Blast score=159; Percent Identity=40.0; E value=2e-39; Homolog= Z0309 COG1974
MKKKLTTEQLADAKRLKRIFVSRQKQLGISSQDAFADELGMTQSAVSHYLNGINALNLERAADFANKLGVRIADFSPSLDQQARKLLKVIYGDDPTLAAHQHPQKQYPLLNWANAGSWCEEPAPLYPGNDIEQWYETSIECSPHAFWLEVKGNSMASSNELNIQQGMIILIDPDVKPTANNLVIAKLEGEKELTFKQLITEGYDAYLKPLNPQYNMIPLNEKVHIVGVVVEAKIAKLP

SEQ ID NO: 10933 - protein, 64 aa, Xenorhabdus bovienii
  Coding DNA sequence: Name=SeqID_4825
  Homolog annotation: Query=2..62bp; Hit=3..63bp; Blast score=67; Percent Identity=52.0; E value=6e-11; Homolog= prf||0611193A
MEKILLSEYVKKNGQVKAASLVGVHQTAISKALRAGRKIFLIRQEDGSYKAEECRPFPSQKQAV

SEQ ID NO: 10934 - protein, 132 aa, Xenorhabdus bovienii
  Coding DNA sequence: Name=SeqID_4826
  Homolog annotation: Query=8..127bp; Hit=21..136bp; Blast score=64; Percent Identity=36.0; E value=4e-10; Homolog= ref|NP_274978.1|
MPANDYREILDSDLSDRNSSESQVISRCSEPLPSPDVLKNYESILSGCAERILSFREKEQRFRHDNQKKALDSMITKDKRGQWMGFSIAMFILTIATVFAFKGEMLFAGTLITIDLVGLAAVFAIGRKSNIK

SEQ ID NO: 10935 - protein, 184 aa, Xenorhabdus bovienii
  Coding DNA sequence: Name=SeqID_4827
  Gene classification: Function=Uncharacterized BCR; Function class=S Function unknown
  Homolog annotation: Query=5..182bp; Hit=5..182bp; Blast score=208; Percent Identity=55.0; E value=2e-54; Homolog= PA4580 COG3236
MRIYMDMRTLCERYQSGKKIKYLFFWGHKNNHTDYITKSCLSQWYPAPFIVNNVSYSSTEHYMMAEKARLFNDSATLEKIINAKNPGAAKAYGREVRGFNQSIWDEHRLAIVIDGNLAKFSQDNALAEFLLNTGDKILVEASPVDRIWGIGLAEDFANIENPLTWNGLNLLGFALMAVREELKI

SEQ ID NO: 10936 - protein, 200 aa, Xenorhabdus bovienii
  Coding DNA sequence: Name=SeqID_4828
  Gene classification: Function=Predicted esterase of the alpha/beta hydrolase fold; Function class=R General function prediction only
  Homolog annotation: Query=15..199bp; Hit=3..186bp; Blast score=124; Percent Identity=38.0; E value=5e-29; Homolog= BS_ydeN COG3545
MTQRTISSSDLFSGKKIIIVHGYSASPSSHWFPWLKEVLTEQGAEVMVPAMPESLAPIPEMWAKMLIDVIPKADDDTIFIGHSLGCVTLLRHLEAISSTADRIGGYILVSGFDSPLENLPKLNIFTAEPLSYTFLREVTEHRISIISSNDYIVSPQSSHALANSLQTKIINVDNAGHFLDREGFTRLLPVYDALKTIVSG

SEQ ID NO: 10937 - protein, 260 aa, Xenorhabdus bovienii
  Coding DNA sequence: Name=SeqID_4829
  Homolog annotation: Query=26..252bp; Hit=41..273bp; Blast score=104; Percent Identity=32.0; E value=1e-21; Homolog= ref|ZP_00065412.1|
MAPVDLTSTANQSHDDLINVNFDHKVGKYSAKDFKSDWGISPSASSGLNQGRLNIVVDPQHDRNKVLEITYLANIVSSKAGTSFDVPLKGAHQALWLQYKVMFSKDFMWVKGGKLPGLAGGDRPSGCIDNGDFDGFSSRLMWRERGELKGYLYYPEKESRCGDYFKFDITLNKGVWYTLTQYVKLNSIGKHDGIYIQYVNDKEVFKLKDVKWRNEGNVFIDAIKWSSFFGGSTLDWAPPVEQYAYFDNFIVSIEKPNSIK

SEQ ID NO: 10938 - protein, 57 aa, Xenorhabdus bovienii
  Coding DNA sequence: Name=SeqID_4830
MLSTHEYANDLILFALIVDCGSFSKAAESAGITSSVISKRIGRLEIPWRTSFVSYYT

SEQ ID NO: 10939 - protein, 207 aa, Xenorhabdus bovienii
  Coding DNA sequence: Name=SeqID_4831
  Gene classification: Gene name=LysR; Function=Transcriptional regulator; Function class=K Transcription
  Homolog annotation: Query=1..207bp; Hit=95..299bp; Blast score=225; Percent Identity=52.0; E value=3e-59; Homolog= VCA0982 COG0583
MSVPTVSGELLLSEKVAEFCSLHPKLKVEIRLENHFADLVNERIDLAIRTGTMPDSSLIARPILNSRWVIVCSPGYLEMYPQLKSAEDLLNHNCLTYTHQESGTANWLMKQPDSRDIYELQVNGNFSSNNALAIRKAVLGGFGIAMVPRVMVYEDLQTGKLVEILKGYSGKVLGVYAVYPYTRNLPLKIRMLIEHIMISYKNISHYF

SEQ ID NO: 10940 - protein, 537 aa, Xenorhabdus bovienii
  Coding DNA sequence: Name=SeqID_4832
  Gene classification: Gene name=LldP; Function=L-lactate permease; Function class=C Energy production and conversion
  Homolog annotation: Query=12..535bp; Hit=1..527bp; Blast score=550; Percent Identity=60.0; E value=1e-156; Homolog= PM1852 COG1620
LPYKNSHYEDFMPLFFSIAPIVLLIWMMTKRNGIPSYMALPLTAVIVYFTQLFWFESSSLLLHANIITALVSVLTPITIILGAILLNKLMQISGAEDVVRNWLENISPNPVAQLMIIGWAFAFMIEGASGFGTPAAIAAPILVGLGFNPLRVALLTLVMNSVPVSFGAVGTPTWFGFANLGLPDGNLLEIGRLSALIHFVAGFVIPLLALRFIVSWQEIRGNILFIFLSILSCTTPYLLLAQVNYEFPALIGGAIGLALSVLFARLGIGIKRYEKKGTVRVVPFSKIIKAMMPTLLLIVILIITRIHQLGIKELLNNADIQWQLNLGWLGELNVSKSLIINLQQVLGTSASASYKILYAPAIIPFLLVVLLCIPLFQLNRYQVKQMFCETGSRIFKPFIALFGALVMVNIMMLGGENAPVIIIGKALAVMTGESWLLFSSFLGALGSFFSGSNTVSNLTFGGIQYSIALNGGMNANLMLALQSVGGAMGNMICLNNIIAVCSILGIANAEGQIMKKTILPMLVYGAIAAVMALILTF

SEQ ID NO: 10941 - protein, 380 aa, Xenorhabdus bovienii
  Coding DNA sequence: Name=SeqID_4833
  Gene classification: Gene name=LldD; Function=L-lactate dehydrogenase (FMN-dependent) and related alpha-hydroxy acid dehydrogenases; Function class=C Energy production and conversion
  Homolog annotation: Query=1..380bp; Hit=1..380bp; Blast score=635; Percent Identity=85.0; E value=0; Homolog= PA4771 COG1304
MIISASTDYRAAAQAKLPPFLFHYIDGGAYAEHTLKRNTEDLSSIELRQRVLKNMSELNLETRLFGEKMAMPVALAPVGLSGMYARRGEVQAARAAAKKGIPFTLSTVSVCPIEEVASAIDRPIWFQLYVLKDRGFMRNVLERAQAAGVKNLVFTVDMPIPGARYRDAHSGMSGPNASMRQILQAMTHPQWAWDVGLMGKPHDLGNISAYRGIPTKLKDYIGWLGNNFDPSISWKDLEWIRDFWKGPMILKGILDPEDAKDAVRFGADGIVVSNHGGRQLDGVLSTARALPAIADAVKNDITILTDSGIRTGLDVVRMLALGADSVLLGRAFVYALAAAGEAGVSNLLDLIDKEMRVAMTLTGAKSIAEINSNLLVGKQG

SEQ ID NO: 10942 - protein, 168 aa, Xenorhabdus bovienii
  Coding DNA sequence: Name=SeqID_4834
  Homolog annotation: Query=1..166bp; Hit=1..172bp; Blast score=184; Percent Identity=54.0; E value=6e-46; Homolog= ref|NP_273571.1|
MTRLYMFYLGGNAGKSNIEVHDVQFVAVDQVEKAYPVLREVWFGDKDKLHLDGYMPITWADGYDITLSHDEYPGEMQLYFVNVGGYQKDSLAEAHEFGFFVARTVEEAKQKAKESLLAGYGQLHKDNLKDVDDCLLLGSVNSYYIHLVENPDGQPDKPEWQGYRPIGI

SEQ ID NO: 10943 - protein, 262 aa, Xenorhabdus bovienii
  Coding DNA sequence: Name=SeqID_4835
  Gene classification: Function=Predicted epimerase, PhzC/PhzF homolog; Function class=R General function prediction only
  Homolog annotation: Query=7..259bp; Hit=6..260bp; Blast score=224; Percent Identity=47.0; E value=7e-59; Homolog= PA3578 COG0384
MPSYPIYHVDAFTEKSFSGNPAAVVLLDKWLTDEALIAIAAEINLSETAFLVGNQLRWFTPKVEVNLCGHGTLATAFVLIEHQSCQDNPITFTSLSGELRVSHQEGIFTLDFAATDCHEEKTLVSIMQDALGQNINEVFASHDRYICVMDSADQVLNTQPDFNKIAALPLAGLTITAPGESPVDFVSRYFAPAKGVNEDPVTGSTHCVLTPFWGERLNKSILHARQLSERGGDILCKTDGNRVYLTGKAKLFSHGQILLEDQ

SEQ ID NO: 10944 - protein, 134 aa, Xenorhabdus bovienii
  Coding DNA sequence: Name=SeqID_4836
  Homolog annotation: Query=1..84bp; Hit=9..99bp; Blast score=63; Percent Identity=41.0; E value=5e-10; Homolog= ref|NP_929086.1|
LFFILSMGCTQALALDFSYKSEMPTDNKPSEEYLKKRAGLDSKYWNVDTLTQDNVLAEKREEEMKQYNKKFENKNGIGLSYDWESKNLKSFQHMQQTSHLSNRRCYRATRQKLEKDFGNSYSYSDIADTCGSFH

SEQ ID NO: 10945 - protein, 487 aa, Xenorhabdus bovienii
  Coding DNA sequence: Name=SeqID_4837
  Gene classification: Gene name=PTR2; Function=Dipeptide/tripeptide permease; Function class=E Amino acid transport and metabolism
  Homolog annotation: Query=2..423bp; Hit=31..437bp; Blast score=249; Percent Identity=39.0; E value=4e-66; Homolog= BS_yclF COG3104
MTEMWERFSFYGIRPLLILFMSAAIFEGGMGIPREQASAIVGIFAGSIYLTSLPGGWLADNWLGQRLAVWYGSIIIALGHLSIALSGIWNNNLFFIGLLLITIGTGLFKTCVTVMVGTLYKKDDPRRDGGFSLFYMGINLGSLIAALITGWLVKDYGWHWGFGVGGLGMLVALLIFRFYTIPLMRRYDKEAGLDSSWDHPMVKRKNVGKWIGALLVVICSIVATVAMGVIPFNPVMVANVLVYIISLSVILYFAYLFLFAGLDRNEKTRLFICFILLVSAALFWSAFEQKPTSFNLFAKDYTDRIVLGYEIPAVWFQSINPLYIILLAPLFSWLWPMLAKRNMNPSSIGKFMIAMLFAAGGFGIMMLASQYVLATGGTVSPLWLIFSILLLTLGELCLSPIGLATMTVLAPSRMRGQVMGLWFCASALGNLAAGLIGGNVRADKLDSLPELFSNVSLSLIICSAVLLVLIIPIRRLMSNLHQAETKS

SEQ ID NO: 10946 - protein, 313 aa, Xenorhabdus bovienii
  Coding DNA sequence: Name=SeqID_4838
  Gene classification: Gene name=HtrB; Function=Lauroyl/myristoyl acyltransferase involved in lipid A biosynthesis; Function class=N Cell motility and secretion
  Homolog annotation: Query=1..306bp; Hit=1..306bp; Blast score=421; Percent Identity=66.0; E value=1e-118; Homolog= htrB COG1560
MIQAPSFQRSFLHPRYWLTWLGIGILYLLVLLPYPVIYWIGTRLGRLSQRFLKKRAKIAERNLALCFPDMSPEKRNELLVRNFESVGMGLFETGIAWFWPDWRIKRWFKITGEENLQKVLSSNQGFIVIGIHFLTLELGARILGLLNPGIGVYRPNDNPVMDWLQTWGRLRSNKYMLDRKDVKGMIRCLKNGEMVWYAPDHDYGPRKSVFAPLFAVEHAATTTGTSILVRLSDPALLPFTPRRLPDGKGYELMIQPAVEGFPKNDEVEAAAFMNKVVEREIMQAPDQYMWLHRRFKTRPEGMPSLYDDNNNIH

SEQ ID NO: 10947 - protein, 352 aa, Xenorhabdus bovienii
  Coding DNA sequence: Name=SeqID_4839
  Gene classification: Function=Uncharacterized enzyme related to sulfurtransferases; Function class=R General function prediction only
  Homolog annotation: Query=1..345bp; Hit=1..345bp; Blast score=551; Percent Identity=75.0; E value=1e-157; Homolog= yceA COG1054
MSVLHNRISNKELKERMLAETEPRTTISFYKYFTISELQAFRDSLYQKFTELSVFGRIYIAKEGINAQISVPSKNVDALKALLDATDPALCHLRLNIALEDDGKSFWVLRMKLRERIVADGIEDETFNPSSTGEYLKAEQVNQMLDDPDTLFVDMRNHYEYEVGHFENAIEIPSDTFREQLPMAVEMLKDNKDKNIVMYCTGGIRCEKASAYMLHNGFDKVYHVEGGVIEYARKAKEQGLPVRFMGKNFVFDERMGERISEDIIAHCHQCGTACDSHINCKNDGCHLLFIQCLSCAERFEGCCSDICREEMKLPEEEQRFRRAGRENGAKIFNKSRYRLNDGLNITSRESIK

SEQ ID NO: 10948 - protein, 197 aa, Xenorhabdus bovienii
  Coding DNA sequence: Name=SeqID_4840
  Homolog annotation: Query=1..196bp; Hit=1..199bp; Blast score=181; Percent Identity=49.0; E value=8e-45; Homolog= ref|NP_929095.1|
MKLLVIDKCHYTRLGIIESLKENIDIFSIGAVSIHDAMNILPVFSPDVILVNLTNYGHHREYCEQLKLFISLVNDARIYTYIDKPYPLCDTSIQLTNKDFILPKRNLSTLLVRIKEMAEHDIQRYFANFNTQSSIFSLQENRIIHYWMRETDTHKIAKMLKISNSTVYSHKRHIIEKIGISNKIELLFIYNIFKYIC

SEQ ID NO: 10949 - protein, 84 aa, Xenorhabdus bovienii
  Coding DNA sequence: Name=SeqID_4841
  Homolog annotation: Query=1..84bp; Hit=1..84bp; Blast score=124; Percent Identity=76.0; E value=5e-28; Homolog= ref|NP_929096.1|
MEQKNEIIQTHPVVGWDISTVDAYDAMMIRLHYLSSQDQTPGNVNIDKTLWLTTGVAKQLILILQAGIEKIEASEYSQLDHIKH

SEQ ID NO: 10950 - protein, 216 aa, Xenorhabdus bovienii
  Coding DNA sequence: Name=SeqID_4842
  Gene classification: Gene name=PyrC; Function=Dihydroorotase; Function class=F Nucleotide transport and metabolism
  Homolog annotation: Query=1..213bp; Hit=135..347bp; Blast score=337; Percent Identity=73.0; E value=5e-93; Homolog= pyrC COG0418
VPLLIHGEVTASHIDIFDREARFIEQVMEPLRKQFPELKVVFEHITTKEAAEYILSGNDKLAATLTPQHLMFNRNHMLVGGIRPHLYCLPVLKRNIHQEALRSAVASGCNRFFLGTDSAPHLQHRKESSCGCAGVFNAPTALAAYATVFEEMEAIAHFEAFCSLNGPKFYGLPVNEGFVELTRKPTPVTEYIECGDEKLIPFLADEDARWEVKVCE

SEQ ID NO: 10951 - protein, 166 aa, Xenorhabdus bovienii
  Coding DNA sequence: Name=SeqID_4843
  Gene classification: Gene name=PyrC; Function=Dihydroorotase; Function class=F Nucleotide transport and metabolism
  Homolog annotation: Query=1..152bp; Hit=1..152bp; Blast score=220; Percent Identity=66.0; E value=6e-58; Homolog= pyrC COG0418
MTTESYTIKIRRPDDWHVHFRDDDMLKIIVPHTSRFFGRAIVMPNLAPPVTDVASAKAYRDRIIAAIPSDHHFQPLMTCYLTDSTDSSQIEIGYKEGIFTACKLYPANATTNSSHGVSDTKKIYPLLETMEELGVPLLIHGEVTASHIDIFDAGSSVYRAGDGTIA

SEQ ID NO: 10952 - protein, 102 aa, Xenorhabdus bovienii
  Coding DNA sequence: Name=SeqID_4844
  Gene classification: Gene name=MscS; Function=Small-conductance mechanosensitive channel; Function class=M Cell envelope biogenesis, outer membrane
  Homolog annotation: Query=1..93bp; Hit=213..305bp; Blast score=108; Percent Identity=49.0; E value=9e-25; Homolog= BU452 COG0668
MVGVAYNADIDEVKRVLGDVVKADKRIQHEKGITIRLHEMAPSSLNFIVRVWTSNDDAWSVYWDLMEGFKRTLDQHNISIPFPQMDVYLHQQQAAVQKKIDE

SEQ ID NO: 10953 - protein, 207 aa, Xenorhabdus bovienii
  Coding DNA sequence: Name=SeqID_4845
  Gene classification: Function=Lysine efflux permease; Function class =R General function prediction only
  Homolog annotation: Query=1..203bp; Hit=1..203bp; Blast score=226; Percent Identity=63.0; E value=1e-59; Homolog= ZyggA COG1279
MLSTFIQGFFLGAAMILPLGPQNVFVMQQGSRKQFHLMSATLCATSDIVLITAGVFGGSALLGQSAFLLQAVTWGGVAFLLWYGWSAFRVALSANIELSRSENIVQNRWRVIVTLFAVTWLNPHVYLDTFVVLGSVGGGLSSELRPWFTVGAATASISWFFALSILAAWFSPVLNQPRSQRIINLFVGCVMWYIAWSLLKQGLQIFY

SEQ ID NO: 10954 - protein, 71 aa, Xenorhabdus bovienii
  Coding DNA sequence: Name=SeqID_4846
MIALPEVDICGAGGNSAAEAAIQDKLPTAIIAANISDLCFTKPPSDTTSKQALFTVYSKTKRFPETLAHYL

SEQ ID NO: 10955 - protein, 235 aa, Xenorhabdus bovienii
  Coding DNA sequence: Name=SeqID_4847
  Gene classification: Function=Uncharacterized BCR; Function class=S Function unknown
  Homolog annotation: Query=1..234bp; Hit=8..233bp; Blast score=209; Percent Identity=55.0; E value=2e-54; Homolog= yggE COG2968
MMAVGSLSCMAASAAELPPAPHISTSGNAIIKAAPDIATLMIHVKVTQKSAADAKQKVDERVAKYFDFLKTNGIDKKEINAANLRTQPEYQYEQKTGKSTITGYSASRSVEVKVRQLDQLSTLLDGALKAGLNEISSVQFSVDNPQRYRDEARQKAIENAIQQATALAKGFNSKLGPVYSVTYRSPEAVPFPMSRLKYRSALMAAAPAEDSASETYEPQSIEFSDQVEAVFELQR

SEQ ID NO: 10956 - protein, 301 aa, Xenorhabdus bovienii
  Coding DNA sequence: Name=SeqID_4848
  Gene classification: Gene name=LysR; Function=Transcriptional regulator; Function class=K Transcription
  Homolog annotation: Query=1..297bp; Hit=1..297bp; Blast score=494; Percent Identity=85.0; E value=1e-140; Homolog= iciA COG0583
MKRPDYRSLQALDTVIRERGFERAAQKLCITQSAVSQRIKQLENMFGQPLLVRTVPPHPTEQGQKLLALLHQVELLEAQWLGDENGNDIPLLLSLAVNADSLATWLLPALHPVLSDVPIRLNIQVEDETRTQESLRRGEVVGAISIQSQPLPSCLVDKLGALDYLFVASPKFAERFFPNGVTRSALLKAPAVAFDHLDDMHQAFLQQHFDLSPGSVPCHIVNSSEAFVQLAKQGSTCCMIPHLQVDKELQAGELIDLTPGLCQRRMLYWHRFAPESGAMRKVTDTLLKLGRQMLRQEDEIS

SEQ ID NO: 10957 - protein, 52 aa, Xenorhabdus bovienii
  Coding DNA sequence: Name=SeqID_4849
VLPNLLLFSVRPVSYQSQPIISYKEKSGHQYKQYFASPGEKIWHSAVQHKKI

SEQ ID NO: 10958 - protein, 219 aa, Xenorhabdus bovienii
  Coding DNA sequence: Name=SeqID_4850
  Gene classification: Gene name=RpiA; Function=Ribose 5-phosphate isomerase; Function class=G Carbohydrate transport and metabolism
  Homolog annotation: Query=1..219bp; Hit=1..219bp; Blast score=342; Percent Identity=83.0; E value=2e-94; Homolog= rpiA COG0120
MTQDELKKAVGWAALEYVKPGTIVGVGTGSTASHFIDALGTIKNQIEGAVSSSEASTEKLKSLGIPIFDCNEVDSLDIYVDGADEINGHMHMIKGGGAALTREKIIAAVAKKFICVIDESKQVDVLGKFPLPVEVIPMARSYVARELVKLGGTPVYRQNVVTDNGNVILDVHNLAILDPVALENKINGIVGVVTVGLFARRGADVVLVGTADGVKTIAE

SEQ ID NO: 10959 - protein, 413 aa, Xenorhabdus bovienii
  Coding DNA sequence: Name=SeqID_4851
  Gene classification: Gene name=SerA; Function=Phosphoglycerate dehydrogenase and related dehydrogenases; Function class=E Amino acid transport and metabolism
  Homolog annotation: Query=1..413bp; Hit=1..410bp; Blast score=632; Percent Identity=75.0; E value=0; Homolog= serA COG0111
MVKVSLEKDKIKFLLLEGVHQNTVDNLRAAGYSNIEYHKGALEPEELKEAIRDARFVGIRSRTQLTEEIFEAAEKLVAVGCFCIGTNQVDLKAAEKRGIPVFNAPFSNTRSVAEMVLGELLLLLRRIPIANAKAHRGIWDKQAKGCYEARGKKLGIIGYGHIGTQLGILAENIGMHVHFYDIENKLPLGNAQQVHHLSELLNMSDVVSLHVPETGSTKNMIGVEELELMKPGAILINASRGMVVDIPALHDALESEHLSGAALDVFPSEPATNNEPFISPLSKFDNVLLTPHIGGSTQEAQENIGYEVAGKLVKYSDNGSTLSAVNFPEVSLPVHAKDTHRLLHIHENRPGILTSINQVFTDQEINIEAQYLRTNGDIGYVVIDITTQNSAQAEMVLQNLKALPGTIRSRLLY

SEQ ID NO: 10960 - protein, 197 aa, Xenorhabdus bovienii
  Coding DNA sequence: Name=SeqID_4852
  Gene classification: Function=5-formyltetrahydrofolate cyclo-ligase; Function class=H Coenzyme metabolism
  Homolog annotation: Query=17..197bp; Hit=2..182bp; Blast score=221; Percent Identity=59.0; E value=4e-58; Homolog= ygfA COG0212
MQSDPFLSLRKSIRKQIRQLRQNLSPEQQSQFAQQVAQNAMSHPKIQQANKIALYLAFDGELDTRPLIQQFWQQNKQVYLPVLHPFSQHHLLFLHYHPETSLHYNRFNIEEPPLDVRQVLPVSELDVMFIPLVAFDSTGQRLGMGGGFYDRTLAKWQQQNFYPIGLAHDFQLVNSLPSASWDIPLPEIITPEKIWRW

SEQ ID NO: 10961 - protein, 61 aa, Xenorhabdus bovienii
  Coding DNA sequence: Name=SeqID_4853
MPRQVVTLEPLVQGERSVAPIRLLGLAKHAHKKRSTTFYRYEISAQGTYLLTHTSEKFCST

SEQ ID NO: 10962 - protein, 53 aa, Xenorhabdus bovienii
  Coding DNA sequence: Name=SeqID_4854
MKYRLRGLTCSRTPQRNFVALKTNQLRIHPSRTCLSGSIHQALSNAIEPIVWN

SEQ ID NO: 10963 - protein, 101 aa, Xenorhabdus bovienii
  Coding DNA sequence: Name=SeqID_4855
  Gene classification: Function=Uncharacterized BCR; Function class=S Function unknown
  Homolog annotation: Query=1..101bp; Hit=1..101bp; Blast score=132; Percent Identity=79.0; E value=8e-32; Homolog= ygfE COG3027
MSAQPVDIQIFGRSLRVNCPPEQVEALQAAAKELDQRLHNLKERTRVTNTEQLVFIVALNVCHELAQEKMKTRDYSYNMEQKIKMLQQTIEQALLEQGKIT

SEQ ID NO: 10964 - protein, 102 aa, Xenorhabdus bovienii
  Coding DNA sequence: Name=SeqID_4856
MYIDHRWRYKFMLCYHQGESLYQTAHTDIRRVAFWYCTVMIVVGLVLIPKSAFMPESRYRHSNKSGRCHVCTTSRYSDFWAIITCQLSTRAGRGFASCCEGT

SEQ ID NO: 10965 - protein, 192 aa, Xenorhabdus bovienii
  Coding DNA sequence: Name=SeqID_4857
  Gene classification: Function=Uncharacterized BCR; Function class=S Function unknown
  Homolog annotation: Query=1..192bp; Hit=3..194bp; Blast score=200; Percent Identity=59.0; E value=7e-52; Homolog= ygfB COG3079
MSIQNSLPNYQSFDEILHQQSVALTAAEMHGLISGLLCGGNHDSSWQALMHDLTNDGLAFSQVLAQPIRELYETTFESLDDSDFVFNLLLPDDEASVFDCADALAGWVNHFLLGLGVANPKLTEKQEIQEVITDLRNIGMLGYDEDEDQEELSQALEEVLEYVRVAVQLCYIALATPKTANSVKKNEKPTLH

SEQ ID NO: 10966 - protein, 438 aa, Xenorhabdus bovienii
  Coding DNA sequence: Name=SeqID_4858
  Gene classification: Gene name=PepP; Function=Xaa-Pro aminopeptidase; Function class=E Amino acid transport and metabolism
  Homolog annotation: Query=1..437bp; Hit=4..440bp; Blast score=691; Percent Identity=75.0; E value=0; Homolog= ZpepP COG0006
MTKQEYLSRRQALLSNMAPASAAIIFAAPPAMRNSDCEYPYRQHSDLLYLTGFNEPEAVLVLIKSDENHNHSVLFNRVRDLTAEIWFGRRLGQDAALEKLGVDRALPFDDLSKQLYLLLNGLDVVYHAQGEFEYADNIVFSALDTLRKNNRRNLSAPSMMADWRPWLHEMRLFKSAAELDIMRKAGDISAKAHTRAMQNCRPGMFEYQLEAEIHHEFTRQGARYPAYNTIVGAGENACILHYTENERRMKEGDLVLIDAGCEYEGYAGDITRTFPVNGKFTRPQREIYDIVLQSINVSLELYRPGTSIRKVTEHVVRIMVEGLVKLGIMHGEVEQLIETNAYRQFFMHGLSHWLGLDVHDVGHYGIDRDRILEPGMVLTVEPGLYIAPDADVPPEYRGIGIRIEDDIVITEVGNENLTEHVVKDPDEIEALMAQAKQN

SEQ ID NO: 10967 - protein, 396 aa, Xenorhabdus bovienii
  Coding DNA sequence: Name=SeqID_4859
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=1..390bp; Hit=1..391bp; Blast score=501; Percent Identity=62.0; E value=1e-142; Homolog= ubiH COG0654
MNVIIVGGGVAGATLALAISSLSRGQLQVSLIESTEPTQEHPGFDARAIALAYGTCQRLSQIGVWPVLKDCVTPITHVHVSDRGHSGFVNIRADDYAIPALGNVIELHDAGIRLFNLLRQASNVKLHCPAKVNSVERLDTSVVVKLDNGEKITGELLVAADGSYSAVAKACNIPWQQQTYGQVAMIANVLTSEHPQGRAFERFTEHGPLALLPMSEGRSALVWCHPLEKQTEINDWSNEEFLQQLQKAFGWRLGKMLETGQRHSYPLALSTASQQISHRLALVGNASQTLHPIAGQGFNLGMRDVMTLAQVISAAADSGQDIGAYDVLARYQQQRHTDRETTIGITDGLVRIFANDYFPLKIGRNFGLITMETLSPLRNLFARQTLGWVAHHSSVE

SEQ ID NO: 10968 - protein, 410 aa, Xenorhabdus bovienii
  Coding DNA sequence: Name=SeqID_4860
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=1..400bp; Hit=1..399bp; Blast score=568; Percent Identity=71.0; E value=1e-162; Homolog= ZvisC COG0654
MQSFDVVIAGGGMVGLALSCGFQGSGLRIAIVEEHPPTGTFHANDEHALRVSAINAASERLLTHLGVWQHITTMRASAYQGMEVRDQDSFGRIKFDATENGLTHLGHIIENHVIRQALWQQAESLPDVTIFTPASLKNVAWGENEAFITLSDERMLTSRLVVGADGANSWLRQHADIPLTFWDYEHHALVATIRTEEPHQAVARQVFHGDGILAFLPLSDPHLCSIVWSLPAEAAQQSKAIDAVLFNRQLGVTFDMQLGQCELVSERQAIPLMGRYARNFAAHRLALLGDAAHTIHPLAGQGVNLGFMDVAELIGELSRLHRQGKDIGQYLYLGRFERRRKHSAAVMLAGMQGFRQLFDGNNPAKKLLRDIGLTFADHLPGVKSQLLRHAMGLNDLPDWLIPQTSSVEKI

SEQ ID NO: 10969 - protein, 365 aa, Xenorhabdus bovienii
  Coding DNA sequence: Name=SeqID_4861
  Gene classification: Gene name=GcvT; Function=Glycine cleavage system T protein (aminomethyltransferase); Function class=E Amino acid transport and metabolism
  Homolog annotation: Query=1..361bp; Hit=1..361bp; Blast score=587; Percent Identity=78.0; E value=1e-168; Homolog= gcvT COG0404
MSKHTPLYDQHLAYGARMVDFHGWMMPLQYGSQIDEHHTVRTDAGMFDVSHMTIVDLHGTGCRDFLRYLLANDITKLTEQGKALYTGMLNASGGVIDDLIVYFFTDDFYRMVVNSATRDKDLAWIQQHATNYPVEITVRDDLALIAVQGPNAQTKTQSLLNDEQKQAVTGMKPFFGVQSGDLFIATTGYTGEAGYEIALPKEQAADFWQQLLAVGVKPAGLGARDTLRLEAGMNLYGQEMDETISPLAANMGWTIAWKPEDRQFIGREALERQREVGTEQLVGLIMRDKGVLRGGLTVHFTDKAGEMRSGVITSGTFSPTLGFSIALARVPQGIGEQAIVQIRNREMPVQVVKPGFVRMGKPLVE

SEQ ID NO: 10970 - protein, 130 aa, Xenorhabdus bovienii
  Coding DNA sequence: Name=SeqID_4862
  Gene classification: Gene name=GcvH; Function=Glycine cleavage system H protein (lipoate-binding); Function class=E Amino acid transport and metabolism
  Homolog annotation: Query=1..129bp; Hit=1..129bp; Blast score=176; Percent Identity=72.0; E value=6e-45; Homolog= gcvH COG0509
MSHVPAELKYTSSHEWVRVEENGEYTVGITEHAQELLGDMVFVDLPEVGAVVNSGSDCAVVESVKAASDIYAPLSGEVTAVNSELESSPELVNSEPYNEGWLFRLKISDESELTHLLDAEGYQSLLAEEE

SEQ ID NO: 10971 - protein, 976 aa, Xenorhabdus bovienii
  Coding DNA sequence: Name=SeqID_4863
  Gene classification: Gene name=GcvP; Function=Glycine cleavage system protein P (pyridoxal-binding), C-terminal domain; Function class=E Amino acid transport and metabolism
  Homolog annotation: Query=484..976bp; Hit=1..492bp; Blast score=834; Percent Identity=81.0; E value=0; Homolog= gcvP_2 COG1003
MGRFLCVPFLASFRKLSSMTQTLIQLENQGEFTRRHIGSSAEQQKEMLATVGANSLDDLTNKIVPRDIALSEPPAVGEGATEQQALAELKVMASQNRRYQSYIGMGYAPSVLPPVILRNLLENPGWYTAYTPYQPEVSQGRLEALLNFQQVTIDLTGLDLASASLLDEATAAAEAMAMAKRVSKLKGAERFFVADDIHPQTLDVVRTRAETFGFEVIVDEAEKVLELEGVFGVLLQQVGTTGEVHDYSVLIAKLKEKKIIVSVAADFMALVMLTAPGKQGADMVFGAAQRFGVPMGYGGPHAAFFVCRDEFKRSMPGRIIGVSRDAAGNRALRMAMQTREQHIRREKANSNICTSQVLLANIAGMYAVYHGAEGLKRIAGRIHRLTDILAAGLQKAGITLRHKTWFDTLTVEVADKTPVLARAEKAQINLRTDILGAVGVALSEKTSRDDLQTLFQVLTGSDAMLDIDTLDSEMSAGSQSIPASMLRNDDILTHDNFRRYHSETDMMRYMHSLERKDLALNQAMIPLGSCTMKLNAAAEIMPITWPEFTDMHPFCPPEQAQGYHQLISQLSHWLVLLTGYDAVCMQPNSGAQGEYAGLLAIRRYYASRGEQHRHICLIPSSAHGTNPASAHMAGMTVVVVNCDKEGNIDLTDLREKAEKHRDELACIMVTYPSTHGVYEETIRQICDIIHQNGGQVYLDGANMNAQVGITTPGFIGADVSHLNLHKTFCIPHGGGGPGMGPIGVKKHLAPFVPGHSVVEMDTVTTLGAVSAAPFGSASILPISWMYIRMMGAKGLKQASQVAILNANYIAARLKGAYEILYTGRDGYVAHECILDIRPLKDEFGISEMDIAKRLVDYGFHAPTMSFPVAGTLMVEPTESESKVEIDRFIDAMLAIREEISKVAKGEWPLEDNPLVNAPHVQTELVSDWEHAYSREIAVFPTAETKANKYWPTVKRLDDVYGDRNLHCSCAPIEDYR

SEQ ID NO: 10972 - protein, 519 aa, Xenorhabdus bovienii
  Coding DNA sequence: Name=SeqID_4864
  Gene classification: Gene name=ProP; Function=77 Permeases of the major facilitator superfamily; Function class=G Carbohydrate transport and metabolism
  Homolog annotation: Query=35..490bp; Hit=7..461bp; Blast score=189; Percent Identity=34.0; E value=6e-48; Homolog= PA1282 COG0477
MLAHLFNTSVITGEVKVMSLNRVVSTHKRAEFRTWFGLLILMLPVLLVTVDNTILGFALPKIARALEPSANQQLWIIDAYSLVLAGLLVSMGNIGDRVGHRLLLLSGSLGFTIVSVMTALSSSPEQLIAGRAALGFFGAMLMPSTLALISHLFTDREQRRLAIAIWATTLTVGSALGPVIGGVLLQYFNWQAIFLLAVPVLVPLLVFAPILLPESDKKQIGVIDGYSVLLSIIAMAGIVYAIKHVASDGFEVSVIVEFAIGLIAGTLFIRRQQSLQIPLMDISLFRNGAFTGSIIVNLLSLGLLIGFVFFATQYLQIVLNMKPLAASLALVPGQIMAIVFGMVIVPIAQRVPSHWLVPLLLALAGTAFLLIACVGSNLTSIVIAFALLSIGVGAIASVSNDLVLSAVPSSKAGAASAISETAYEVGVVFGTTILGGLVTAFYRLNLQLPKSISQEQAGLALETLAGAYVIAASLIETEGRQLMDAAAHSFTSAIHITSWLTVVLAGCVVLMASYLLRKL

SEQ ID NO: 10973 - protein, 57 aa, Xenorhabdus bovienii
  Coding DNA sequence: Name=SeqID_4865
MFKADRVNDSLHLTACLFKEKAYLTSFLTVTLSTNLSLSRLPIVVADIATAQGKPQK

SEQ ID NO: 10974 - protein, 202 aa, Xenorhabdus bovienii
  Coding DNA sequence: Name=SeqID_4866
  Gene classification: Function=Predicted hydrolases of HD superfamily; Function class=R General function prediction only
  Homolog annotation: Query=10..201bp; Hit=2..197bp; Blast score=94; Percent Identity=37.0; E value=6e-20; Homolog= DR0704 COG1896
MSLAVPPVDFGPFTNIIAFIMELDKLKSVHRKTKLLNNQRHENSAEHSWHFALAVMSFAPYVGEMNIGHVVQMALIHDIVEIDAGDVIAFDLAAREAIHEHEVKAAHRIFGLLPEAQRDYFLALWNEYEDSETPEAIFAKTLDRVMPVLMNLHNDGQSWVENGIHFEQVFNLLHFISEAYPELWQYLLPQLEAAKEKGWLKA

SEQ ID NO: 10975 - protein, 336 aa, Xenorhabdus bovienii
  Coding DNA sequence: Name=SeqID_4867
  Gene classification: Function=Predicted aminomethyltransferase related to GcvT; Function class=R General function prediction only
  Homolog annotation: Query=16..334bp; Hit=11..326bp; Blast score=402; Percent Identity=65.0; E value=1e-112; Homolog= ygfZ COG0354
MADQILFSAQISAQLPSPSAALPLTLISLNDWGMISVTGADAEKYLQGQVTSDVALLNQKHMLSAHCDAKGKMWSNLRLFHRGEGFAYIERRTVLDPQLTELKKYAVFSKVTFAKDEESILLGVAGAESRNALAEMFPTLPGAETTVIQHETTTLLHFAFPTERFLLVTDQATAAQLAETLAEKFQAQLSDSQQWLALEIEAGFPVIDSASSAQFIPQAMNIQALEGSISFKKGCYTGQEMVARAKYRGANKRAMYWLAGTASSLPVAGDNLEWQLGDKWRRTGSVLTAVRLADGSIWVQVVMNNDMAADSIFRIREDEGSSLTIQPLPYSLDEEK

SEQ ID NO: 10976 - protein, 143 aa, Xenorhabdus bovienii
  Coding DNA sequence: Name=SeqID_4868
MPSEYALYCQYPCLKSLLIIFIRAIETAMLMSRKINKLPVISEMITVAKFHSQRELSTILDCFSSFVTVESRYIDNMRRASQQITFNVQSVNNKNNSFALSPISFTISLISQIVYWQELLWLTKFYFLLKFLHNSHLLQQHFP

SEQ ID NO: 10977 - protein, 88 aa, Xenorhabdus bovienii
  Coding DNA sequence: Name=SeqID_4869
  Gene classification: Function=Uncharacterized ACR; Function class=S Function unknown
  Homolog annotation: Query=1..88bp; Hit=1..88bp; Blast score=140; Percent Identity=80.0; E value=3e-34; Homolog= ygfY COG2938
MDIDNKARIHWACRRGMRELDISIMPFFEYEYDSLNDDDKRLFVRLLECADPDLFNWLMNHGRPEDDELFRMVQLIQSRNQARGPVAL

SEQ ID NO: 10978 - protein, 116 aa, Xenorhabdus bovienii
  Coding DNA sequence: Name=SeqID_4870
  Homolog annotation: Query=2..116bp; Hit=27..138bp; Blast score=94; Percent Identity=49.0; E value=5e-19; Homolog= ref|NP_930771.1|
MLAASLAPWPASGFYLWLPLFVIIMVSWVWSQKNIRRCQGRLVLFSGQKMHWQKAAWKLTRPPWLSRYGMVITLHAFDKTESIRHRSLIRLWVASDSVPPKMWRHLNQLMRQYPDI

SEQ ID NO: 10979 - protein, 173 aa, Xenorhabdus bovienii
  Coding DNA sequence: Name=SeqID_4871
  Gene classification: Gene name=FldA; Function=Flavodoxins; Function class=C Energy production and conversion
  Homolog annotation: Query=2..169bp; Hit=1..168bp; Blast score=239; Percent Identity=69.0; E value=1e-63; Homolog= fldB COG0716
MMKIGLFYGSSTCYTEMVAEKIRDILGEDLIELHNVKDCDPQLMEGYSVLILGIPTWDFGELQEDWLAIWDQLPSLDLAGKIVAMYGMGDQIDYSEWFLDSLGMLYHHLLPAGAQFVGFWPTEGYEFTSPKPLTEDGKQFVGLALDDVNQFEQTDERLSEWCMQILAEMEALF

SEQ ID NO: 10980 - protein, 48 aa, Xenorhabdus bovienii
  Coding DNA sequence: Name=SeqID_4872
MGSVPMTYLARNSFLINRVFLAQALLYICDFRAAIMPEKTILLLQCGP

SEQ ID NO: 10981 - protein, 318 aa, Xenorhabdus bovienii
  Coding DNA sequence: Name=SeqID_4873
  Gene classification: Gene name=XerC; Function=Integrase; Function class=L DNA replication, recombination and repair
  Homolog annotation: Query=28..317bp; Hit=8..297bp; Blast score=446; Percent Identity=79.0; E value=1e-125; Homolog= xerD COG0582
VPKKHDLSENYSSQDKSSEQTPSANLLIEQFLDTIWLEKDLAENTLSSYRLDLQALDSWLVYGGHDLLSVESIELQLFLAERVDSGYKASSSARLLSAMRRLFQYLYREKMRLDDPTALLSAPKLPKRLPKDLSEKQVEDLLNAPLIDQPIELRDKAMFEVLYACGLRVSELVGLTLSDVSLRQGVVRVVGKGNKERLVPLGEEALYWLEKYLEYGRPWLLNGSVSDVFFPSKRGTQMTRQTFWHRIKHYAVLSGIDTERLSPHVLRHAFATHLLNHGADLRVVQMLLGHSDLSTTQIYTHVATERLKALHQQHHPRG

SEQ ID NO: 10982 - protein, 233 aa, Xenorhabdus bovienii
  Coding DNA sequence: Name=SeqID_4874
  Gene classification: Gene name=DsbG; Function=Protein-disulfide isomerase; Function class=O Posttranslational modification, protein turnover, chaperones
  Homolog annotation: Query=3..231bp; Hit=2..229bp; Blast score=258; Percent Identity=51.0; E value=3e-69; Homolog= dsbC COG1651
MKKLAFCFSLLLTAFASNVFANDSAVNNSLSKMGLKAESITPSQLAGVSTVLTDQGIIHISNDGKYLFKAQVYDISGKLPKNVTNQVLVKKLDALKNQMIVYKAPKEKHVVTVFTDITCGYCRKLHEEMKEYNDLGITIRYLAFPRHSLQHQSAKDMQSIWCSATPNKALDAAFKGDNISPIKSCKNDIAKQYQLGLQFGVQGTPAIVLQDGSVFGGFMPPKDLKEALEQNGE

SEQ ID NO: 10983 - protein, 34 aa, Xenorhabdus bovienii
  Coding DNA sequence: Name=SeqID_4875
MDEYYWEDDCHPPPGGGGVVFLYSLGVASLNLSH

SEQ ID NO: 10984 - protein, 546 aa, Xenorhabdus bovienii
  Coding DNA sequence: Name=SeqID_4876
  Gene classification: Gene name=RecJ; Function=Single-stranded DNA -specific exonuclease; Function class=L DNA replication, recombination and repair
  Homolog annotation: Query=2..545bp; Hit=33..576bp; Blast score=781; Percent Identity=69.0; E value=0; Homolog= ZrecJ COG0608
MRGIRQADELERGAKGLLNYQSLNGIEQAVSLLITALHDHWRIVIVGDFDTDGATSTALCIRALRAMGYRNLDYLVPNRFEDGYGLSVQVVNEVVKKGADLIITVDNGISSHEGVAAAHQHSIKVLVTDHHLPGETLPAAGAIINPNLHDCAFPSKALAGVGVAFYLMSALRAELRKTAWFEQQGIPLPNLAELLDLVALGTVADVVPLDTNNRIFVYQGLNRIRAGRCCVGIRALLEISKRESTKLTASDLGFSLGPRLNAAGRLDDMSVGVALLLTDDMVQARQIACELDGLNQTRREIEQGMKQEALQICDQFERTHTQLPYGLVIYHPEWHQGVVGILASRIKERFHRPVIAFAPAGDGTLKGSGRSVNGLHMRDALERLDTLHPGLILKFGGHAMAAGLSIKQDKFDLFQRHFSALMADWLDIAQLEGVVWSDGELALGELSLEIAEILREGGPWGQAFAEPIFDGKFKLLQQRIVGEKHLKVMLEPLNGGPMLDGIAFNIDTHRWPDNSVKTVELAYKLDINEFRGNRDVQLLIQYIWPD

SEQ ID NO: 10985 - protein, 219 aa, Xenorhabdus bovienii
  Coding DNA sequence: Name=SeqID_4877
  Gene classification: Gene name=PrfB; Function=Protein chain release factor B; Function class=J Translation, ribosomal structure and biogenesis
  Homolog annotation: Query=1..219bp; Hit=147..365bp; Blast score=394; Percent Identity=90.0; E value=1e-110; Homolog= prfB COG1186
MLMRMFLRWAESKGFKTEIIEESDGDVAGLKSATIKIIGEYAYGWLRTETGVHRLVRKSPFDSGGRRHTSFSSAFIYPEVDDDIDIEINPVDLRIDVYRASGAGGQHVNKTESAVRITHIPTGLVTQCQNDRSQHKNKDQAMKQLKAKLYELEMQKKNADKQAMEENKSDIGWGSQIRSYVLDDSRIKDLRTGVETRNTQSVLDGDLDKFIEASLKAGL

SEQ ID NO: 10986 - protein, 504 aa, Xenorhabdus bovienii
  Coding DNA sequence: Name=SeqID_4878
  Gene classification: Gene name=LysU; Function=Lysyl-tRNA synthetase class II; Function class=J Translation, ribosomal structure and biogenesis
  Homolog annotation: Query=3..504bp; Hit=4..505bp; Blast score=829; Percent Identity=82.0; E value=0; Homolog= lysS COG1190
MSQQQQGAEQAPDLNNELKTRREKLAALRGNGIAFPNDFRRENISEDLHAKYDDKTQEELEALNIEVTVAGRMMTRRIMGKASFATLQDMGGRIQVYVSRDDLPEGIYNEQFKKWDLGDILGARGKLFKTKTGELSIHCTELRLLTKALRPLPDKFHGLADQEMRYRQRYLDLISNDESRKTFQIRSRIMAALRNFMVKKDFMEVETPMMQAIPGGASARPFTTHHNALDIDMYLRIAPELYLKRLVVGGFERVFEINRNFRNEGISPRHNPEFTMMELYMAYADYQDLIVLTEELFRTLTQEVLGTTLVKYGEQEFDFGKPFTKMTMKEAICKYRPETNIADLDDMDKAVVIAKSLGIDIEKSWGLGRIQCEIFEETAESHLIQPTFITEYPAEVSPLARRNDDNPFITDRFEFFIGGREIGNGFSELNDAEDQAERFAEQVRHKDEGDDEAMFYDDDYVTALEHGLPPTAGLGIGIDRMVMLFTDSHTIRDVILFPAMRPNK

SEQ ID NO: 10987 - protein, 386 aa, Xenorhabdus bovienii
  Coding DNA sequence: Name=SeqID_4879
  Homolog annotation: Query=13..381bp; Hit=3..374bp; Blast score=270; Percent Identity=41.0; E value=4e-71; Homolog= ref|NP_415977.1|
MITVETAMQATTLSHAFGHLTDLRINRTKQYALIDILTISICAVICGCEGFNAIEEYGKSKEDWFRQFLDLPNGIPSHDTFNDVINRLDPQEFGDAFTQWVSSLAKISDDIIALDGKTLRGTLDKANGAPALHLVSAWSVANQLCFGQVKVSDKSNEITAIPKLLALLDIGGSTITIDAMGCQYKIADQIVENQADYVLALKSNQGEFHDDIKLFLETQLANDFTGISHAKTQCTEGDHGRIEERRLWLVNDIGWLRARHPQWHTLGGIAVVESWREEQGKSARYERRYFITSHRDKSADFIACAIRSHWHIETKLHWQLDVSFGEDGQRLRSGYAAENMALMNKIALNLLKNEKTVKVGVKTKRQKAGWDNGYMLKVLTGGFTSV

SEQ ID NO: 10988 - protein, 31 aa, Xenorhabdus bovienii
  Coding DNA sequence: Name=SeqID_4880
MAVSTVIMVSMRIINHKHRLMPYVYVPNASS

SEQ ID NO: 10989 - protein, 40 aa, Xenorhabdus bovienii
  Coding DNA sequence: Name=SeqID_4881
MASGLWRYRARVWFYQIYKASVFNSAENDDFNKAGQTGLN

SEQ ID NO: 10990 - protein, 40 aa, Xenorhabdus bovienii
  Coding DNA sequence: Name=SeqID_4882
MLCIFDKTRPLRGIAINQKPLPFQPCATRTQQDMPSSALS

SEQ ID NO: 10991 - protein, 43 aa, Xenorhabdus bovienii
  Coding DNA sequence: Name=SeqID_4883
MQIKFIPLGNHVFLLRIYELKINDKNITDKESEFLSSCLIHLN

SEQ ID NO: 10992 - protein, 45 aa, Xenorhabdus bovienii
  Coding DNA sequence: Name=SeqID_4884
MISQWYEFYLHCCYFHVINFSEKALTLPCYIILSYITNRLYTHPD

SEQ ID NO: 10993 - protein, 90 aa, Xenorhabdus bovienii
  Coding DNA sequence: Name=SeqID_4885
  Gene classification: Function=Transposase; Function class=L DNA replication, recombination and repair
  Homolog annotation: Query=1..87bp; Hit=1..87bp; Blast score=73; Percent Identity=42.0; E value=3e-14; Homolog= insA_g5 COG3677
MAKVDVYCRYCHKSEHVKGHGKGNGGYPRYRCYTCCKVFQLEYTYQACKPGVKEQIVDIAMNNGGIRDTTRILRVATATVIKTLKNSPET

SEQ ID NO: 10994 - protein, 117 aa, Xenorhabdus bovienii
  Coding DNA sequence: Name=SeqID_4886
  Gene classification: Gene name=InsB; Function=Insertion element IS1 protein InsB, putative transposase; Function class=L DNA replication, recombination and repair
  Homolog annotation: Query=1..116bp; Hit=50..166bp; Blast score=102; Percent Identity=46.0; E value=7e-23; Homolog= insB_g4 COG1662
VGNKKNQRGLWYAWEPRLKRIVAHVFGDRSRKTLDKLLALLSSFNIRFYCTDDYVVYDNLPEEDHLTGKMFTQRIERTNLTQRTRVKRLNRKTISYSKSEEMHDKVIGTFIEREYYF

SEQ ID NO: 10995 - protein, 560 aa, Xenorhabdus bovienii
  Coding DNA sequence: Name=SeqID_4887
  Gene classification: Gene name=FhaC; Function=Hemolysin activation/secretion protein; Function class=N Cell motility and secretion
  Homolog annotation: Query=11..479bp; Hit=9..475bp; Blast score=166; Percent Identity=26.0; E value=6e-41; Homolog= PA0040 COG2831
MNERIIIPILLILCSPFQAVALSENIDNTSSSFMDEDMKTLQESSRNIRGLLEKRSHQSFINRAESVPEKKELQAFTGIGQCLQISGVYLKGITLLSLKDLTTLSAIPTTCITSNNINKLTSEIENIYIKKGYVTARLQFVPPSHDRRLGINVIEGFIEGIEGGTRWTNSQTLFPHLTNKPLNLNQLDQGLDQANRLQSNKTTIDILPGTKKGGSIIKLHNQHSSPWKVVVKTDNYGQKSTGEWVGRLNTSFDSPLGLSDFISFSGSNTLDKHNTKYSRSYILLYSIPYGDATISGFSGYSEYTRNADLRMSSVNFHGNSQQSGVRSDWVFYRDQMQIDTLSTQLTYKNSNNYIEGSKIAINSPTLSVFTLGISHLKITPGRLIILDANIEKGMRWFGAQTAAPFQDKTFIKGSLSAKLQQHFAVFNLPFQFNTQFYAQYSPNSLPGIEWLNISDNSALRGFSKNSVSADNGWYLRNTLSHSIPIPKGSVTLNIGADIGQVLGYKSKVGWQSSAGLSTGITLNYQNLFADVELSQGKILSHQNKNAGELIQLLTRFSFRF

SEQ ID NO: 10996 - protein, 1414 aa, Xenorhabdus bovienii
  Coding DNA sequence: Name=SeqID_4888
  Gene classification: Gene name=FhaB; Function=Putative hemagglutinin/hemolysin; Function class=M Cell envelope biogenesis, outer membrane
  Homolog annotation: Query=22..308bp; Hit=24..311bp; Blast score=126; Percent Identity=31.0; E value=1e-28; Homolog= PA0041 COG3210
MRNKRFKLSPTGKFAASMAIILVSSSTSLANGITPGGDSAHQPGTTNSKTGAAVVNIVAPSQSGLSHNQYNDFNVEQAGVVFNNSLSAGSSKLAGELSANSNLGGHTAKIILNEVISRNPSLILGKQEIFGMAADYVLANPNGITYRNGEFINTNQVSLVVGNPLVENGLLNGFSTLGNKHSLNIGSAGLVKSRIVNLIAPKIDNRGQIIVTKDINIITGNNRVSTDGKVLDSQQTSANALDSYYLGSMQAGRIRLLNTAKGNWVNLQGTMVADDSINVDSNGRLNLEGAIVKGNDVKFKAEHILSQGNINEYSSESHGKDNYHNIFGGIDAHQKQTKQSLTRTKLEGKNITLISNQDNQFMATDIEGDNVTLSGANLKLNGQQFHQSTQETENKSKFLWKHNRSNTDEQYQQKGNTIKAHGNIKLIANKGDLEISGSKIGAGEKISLSAKNDVKLANLIETKITTEKKYQRNETAALTTGESFKRKVRQKNISSELNADDDLGINAGGNVEIVGAKIHAKNNLILKADKQVKISTQSLNNIDTDDNKTKNWGGVAGGKNKNNHYEDKTQVSSEITTDGRVLLTGKTGISITGSKVKGKQGSYSDAVDGELTIDNAVNNTNKNINERTGAIFNITNQSNKNNSIEERSVKSEVTSDADLKLISNKDINVIGSLVKSADELNINTLGNLNVHSSDEKKSGSKEISSLNWKNHFIKPDVKESKSISVEVGLKNTRDDSKYDVTEQKSSELNGGNIKINADKDVSITGSDIITKKGNADIKADNISLLSADESKSMDKSHSIHNWDVAVTPDSNKFEAGFKGTKQSENNSQSQKTSKVSTTNITGDLKLNATKELKQQGARHNVAGNYDANAGRVNNLSTENTESSSSTNTQVKNKFGISIKGKNAQPYSDVDLKANGSRHSENTSKTTNDTTLINANKIKLVADGEIYDQGTQYQATKNDIVLQADSHKSDAVFNHEERKTSDTTGDANLEVGVKPVIQSTELSGKGKGDTLSHSQSSTDAITGSLKAKNGITIRMKHDAAYQGTSMDAGTGKVNLDVEGNINISQADNIKQVTEKSYSGDVSTKLEANIKPVSSDAGGKNIAKTQRTTMAKISEIHGKQGVSLNAGNNLTLQGANVDGEDINLTARQGNVELTSAQDTSNNDNLSMDVDSYANLGTNNSTSDKYGVGINPKLAKNHLDTTINHNSHIAGKKVTLVSDKDTFLKGANITADKVTSNTSGKLNIETVKNTTHSQNIKVSIGSDSPNDVQSTDVAKADVKKKEIFSKTASASPEIKNKLKATLDMDTKESLAEQSGIEGTEEVNLNVTGKTYLTGAKIDSKKGSVTLNTQEIVNRASTTYDKNEKDRVELPNSLTNFVTEIPEYISDITSGKIPFVKKQNHETKTQELQSTVKGHELD

SEQ ID NO: 10997 - protein, 451 aa, Xenorhabdus bovienii
  Coding DNA sequence: Name=SeqID_4889
  Gene classification: Gene name=DnaK; Function=Molecular chaperone; Function class=O Posttranslational modification, protein turnover, chaperones
  Homolog annotation: Query=1..449bp; Hit=1..449bp; Blast score=673; Percent Identity=70.0; E value=0; Homolog= VC1386 COG0443
MFIGFDYGTSNCSVARMMGNTPQLLAIEHDNFYMPSTLAAPTRESVSEHLFRHRNIRPGNQVGEQLLRSAMATNREEGIELLSEDIVFGQAALNRYMEDPQEIYYVKSPKSFLGAMGLREIQISFFEDLVCAMMANIKQRAEANTQQIIEEVVIGRPINFHGRGGDKSNQQAETILLHAAKRAGFRNIEFQFEPVAAGLEYEDTLTENKIVLVVDIGGGTTDCSLIQMGPDWKGKSERNESLLAHSGQRVGGNDLDINLTFKQLMHPFGLGSQFASGIEMPLTQFWNPIAINDIQAQKEFYSRENLRALKSLHMEAQEPEKLARLLKVYHDTLGYSLVRSAEEAKIALSDQSEHRVKLNLLSEVIEIDLHRDQMITAIESTKDKMAKLVSEAVEQGGTKPDVIFMTGGSASSPILRQAVEQVLPGIPLVSGNYFGSVTTGLARWAKVCFAQ

SEQ ID NO: 10998 - protein, 86 aa, Xenorhabdus bovienii
  Coding DNA sequence: Name=SeqID_4890
MSLIRNTFKRLHYLVDIITQCVRWYPAYSLNLRNLAKSAVNPRPVRGCQRLVGHRSLTNIKDKYRNYDNQTHVIERNKLLPNALNR

SEQ ID NO: 10999 - protein, 171 aa, Xenorhabdus bovienii
  Coding DNA sequence: Name=SeqID_4891
  Homolog annotation: Query=18..161bp; Hit=19..157bp; Blast score=85; Percent Identity=33.0; E value=2e-16; Homolog= ref|ZP_00110831.1|
MHNELLKFSHKSAKEGQWLLSEGNFYRVVATGAETNSRYSLVEIIVEPGKGAPFHFHKLEEEAFFILEGEMVFYTQTETMYGKQGAFLNFSVGQIRGFRNETDENTRMLIMLSPPGMEQMFFEDGKAIDAPIDLNTTFVENIGQPVTCPEIAGRYGIESVPLPLPEKKTTA

SEQ ID NO: 11000 - protein, 65 aa, Xenorhabdus bovienii
  Coding DNA sequence: Name=SeqID_4892
VEEPTKMTSTGALIVPKMLFHMLFQYQRHGINIKFPVTFFEMIAASKQQWLQAIGDIRINSSIIS

SEQ ID NO: 11001 - protein, 59 aa, Xenorhabdus bovienii
  Coding DNA sequence: Name=SeqID_4893
MSTSSRTRKRCSGFSIGPAPASPQATESTGRRWHNRTEAYHQLKSNIRKTYQQRISGDY

SEQ ID NO: 11002 - protein, 38 aa, Xenorhabdus bovienii
  Coding DNA sequence: Name=SeqID_4894
MLKPEHLFLVRELVDMRRGIDALTQHIEGLNLRCDLDD

SEQ ID NO: 11003 - protein, 8115 aa, Xenorhabdus bovienii
  Coding DNA sequence: Name=SeqID_4895
  Gene classification: Gene name=EntF; Function=Non-ribosomal peptide synthetase modules and related proteins; Function class=Q Secondary metabolites biosynthesis, transport and catabolism
  Homolog annotation: Query=1933..3225bp; Hit=1..1285bp; Blast score =924; Percent Identity=44.0; E value=0; Homolog= PA2400 COG1020
MIRNDMNLDNLKRAVLKKKIKQQLQTQQQQRPSIKQVDRNLPLPLSFAQQRLWFLAQLDPAASLAYHIPVALRLTGQLDRHALTTALDHLIARHESLRTRFVLVEGQPCQHIDPADIGFVLSCQDLRSLDPAMHSNRIAELADLEAQTPFDFTQGPLIRGQLLQLTDEAHVLLLTQHHIIADGWSIGVLVHELGTLYRAALDGHCDPLPPLPIQYADYAVWQRDWLQGDILTEQRDFWCSQLQDAPALLALPTDRPRPPVQRYAGGQVPFQLDATLLASLKELGQRHNTTLFMTVLTAWSIVLTRLSGQDDIVIGTPVANRPRHELENQIGFFVNTLALRVTPGDTSRVTDLLAQVRERALAAYAHQDLPFEQVVEALQPDRSLSYSPVFQVMLTLNNTPSQNLTLPGLQLTPVEQIRYGAHFDLTLSLTETEAGLIGDLEYAADLFDPATVERMVGYLENVLAAMAADATQAIASLPMLPFSERQQLLVDFNATQADFPQDALIHQLFEAQAAHSPGATAVVCGEQTLSYDELNHRANRLAHYLLALGVRPDDRVAICLERSPEMVVSLLAILKAGGAYVPLDPTYPAERLAYMLDDAAPVALLTQTAWIDMLSSTIPTVVLDAPESSMTTQSAYNPEPQALGLTSRHLAYVIYTSGSTGQPKGVAIAHRNTVNFLTWAQRTFSPEELAHTLFATSLNFDLAVYECFVPLIAGGTVHLVPDALSLMTTAQPVSLINTVPSAIAHLIEAKAVPMTARTVNLAGEALKPHVIEHLFADTSVQDVCNLYGPSEATTYSTWIRMNRAEGFASHIGRPIANTRIYILDAYGQPVPLGVTGEIHIAGAGVARGYLNRPELTAERFLADPFSSDPDARMYKTGDLGRWHPDGNIDYLGRNDFQVKLRGFRIELGEIETQLMQCRGVREAVVLAREDEPGQKRLVAYLRPLDGVELVPAELRQQLAQRLAEYMLPSAFMTLDAFPLTPNGKLDRQALPAPGLSAVVARGYETPVGEVEIALAQIWQDLLRLEQVGRHDHFFELGGHSLMIVNLIERLHGLGWRLDVRSVFATPVLTEMAQAIQGDTNAFVVQPNCIPEGCTALTPDMLPLVSLSQAEIDAIVDTIPGGASNVQDIYPLAPLQEGILFHHLLQEQGDAYLLQSLLAFDSRERLDTFLAALQQVIDRHDILRTAAYWQGLAQPVQVVWRQAPLCVNRFTPATADDVPAQLLAHTNPRQHRLDLSRAPLFAGDIAHDPAQDEWLLALRFHHLVSDHMTLELIFAEIAQVLQGQAETLPTALPYRDFIAQTLNVPAAVHEAYFRAQLADVNTPTAPFGVLKVQGDNEPVTEARLPLTPALAEAIRTQARRLGVSPGVLFHVAWAQVLAQTSGHNDVVFGSVLLGRLLGVAGADRILGMFINTLPVRVSLAGRSVQEVVQATYRDLMTLLEHEQAPLALAQRCSGVPQSMPLFSALLNYRHSQTSEADAVNTIWTGIRVVAVEEQSNYPLTLSVDDLGAGFHLTAQAVVGIDPARVTAYLVTAISGLVDALARDPQRLIQDVPILPPSERQQLLMDFNATQADFPQDALIHQLFEAQVAHNPGATAVVYEDQTLSYGELNRRANRLAHHLIALGVRPDDRVAICVERSPELVVGLLAILKAGGAYVPLDPAYPAERLAYMLDDAAPVVLLTQATLANTLINPISTPVPTIVLDAQESAMAAQSAHNPDTQALGLTSRHLAYVIYTSGSTGLPKGVMIEHRGLSSLIATQQDTLAIKPDSRILQFASNSFDAGIWECGMALLAGACLHLAQRIHLLPGAALLNTLETHAITHVLLSPTALAALDTVPVTLQTLIVGGETCSPALVKRWAEGRRMVNAYGPTESTVCAAIYLCDSQEEGAPPIGQPIANTRIYILDTQGQPVPLGVAGEIHIAGAGVARGYLNRPELTAERFLTDPFSADPGARMYKTGDLGRWRPDGNIEYLGRNDFQVKLRGFRIELGEIEAQLVQCPGVREAVVLTREDEPGHKRLVAYLLPQSDVKLVPAELRQQLSQHLAEYMLPSAFMTLDAFPLTPNGKLDRQALPAPDPSAVVARGYETPVGKVEITLAQIWQDLLRLERVGRHDHFFELGGHSLLAVQLVARVRQDLARELPLQQIFAQPLLAELAQTLTGTSATTQVAIPAADHSRPLPLSFAQQRLWFLGQLDPAASLAYHIPVALRLTGQLDRHALITALDRLVARQESLRTRFILIEGQPCQHIDPADIGFTLSYQDLRPLEPPAHTHRVAELATLEAQTPFDFTQGPLIRGQLLQLADEEHVLLLTQHHIMADGWSISVLVHELGALYRAILGGHSDLLPPLPIQYADYAVWQRDWLQGTVLTEQRDFWCAQLQNAPTFLELPTDRPRPSVQTYAGDRVPFQLDATLLTSLKGLGQRHNTTLFMTVLTGWSIVLSRLSGQDDIVIGTPVANRPHRELENLIGFFVNTLALRVTPGNTPRVADLLAQVRERALAAYAHQDLPFEQVVEALQPDRSLSYSPVFQVMLTLNNTPAQDLTLPGLQLTPLEQVRHSAHFDLTLSLTETEAGLVGDLEYAADLFGSATVERMVGYLENVLKAMAADATQTIADLPILPASERQQLLTGFNAIQVDFPQNTLIHQRFEAQAAHSPDATAVVFEDQTLSYGELNRRANRLAHHLIALGVRPDDRVAICVERSPELVIGLLAILKAGGAYVPLDPTYPAERLAHMLNDAAPVVLLTQTTWVDTLTSPVSTSVPTIVLDAQEASLMAQPDHNPDTQALGLTSRHLAYVIYTSGSTGLPKGVMVEHAHVTRLLAATQERFQFDGNDVWTLFHSFAFDFSVWELWGALSHGGRLIVVPTDCLHSPQAFYALLCREQVTVLNQTPSAFRQLISAQDATPHSLRCIIFGGEALELHTLAPWVTRNPTRQTRLVNMYGITEITVHATYRELTESDITLGRGSLIGQPLPDLRAYILDAHGQLVPLGVTGEIHIAGAGVARGYLNRPELTAERFLADPFSFDPDARMYKTGDLGRWRSDGHLEYLGRNDFQVKLRGFRIELGEIESRLVQCPGVREAVVLAREDEPGHKRLVAYLLPQTGAELVPAELRQQLAQHLAEYMLPSAFVTLDAFPLTPNGKLDRQALPVPGASAVVVRGYEAPVGEVETALAQIWQNLLGLERIGRHDHFFELGGHSLMIVSLIEELRGLGWRLEVRSVFAAPVLAEMVQTIQSDTDAFVVPPNRIPEGCTALTPDMLPLVTLSQAEIDAITDVIPGGATNVQDIYPLAPLQEGILFHHLLQTQGDDYLLQSLLAFDSRERLHTFLDALQQVIDRHDILRTAACWQGLVQPVQVVWRQAPLCINDFTPDTADDVPARLRAHTDPRRHRLDLSRAPLFAADITHDPAQDEWLLALRFHHLVSDHMTLELVFAEIALILQGHTDRLPTVLPYRNFIAQTLSIPAAVHEAYFRDQLADVDEPTVPFGILKVQADGELVTEARLPLIPALAEAIRAQARRLGVSPGVLFHVAWAQVLAQTSGRDDVVFGSVLLGRLQGGAGADRILGMFINTLPVRVSLADHSVQAVVQATYRGLTMLLEHEQAPLALAQRCSGMAQSIPLFSTLLNYRHNQAGKADTAETTWAGMRILTTEERTNYPITLSVDDLGTGFHLTAQTVTGIDPIRVTAYLATAISGLVDALTHNPQQLIRDVPILPPAERQQLLVNFNATQAHFPQNALIHQLFESQVAYKPDATAVVFEDQVLSYGELNCRANQLAHHLIALGVRPDDRVAICLERSLELVVGLLAILKAGGAYVPLDPAYPAERLAYMLDDAAPVVLLTQTAWVDTLVSPVTTPVPIIVLDAQEPTVAAQPIHNPEPQTLGLTSRHLAYVIYTSGSTGLPKGVMVEHRNVLRLIINNGFADIGEEDCIAHCANIAFDASTWEIWSALLNGGRLYVVSPSVLLDPVRFRDSLIKGQVTALWLTAGLFNEYLSDLGPLFGQLRYLLIGGDVLDPRKIQRAQLAESQPAHLINGYGPTETTTFATTYHIASPVDVAHAIPIGRPIANTRIYILDCHNQPAPLGVAGEIYIAGAGVARGYLNRPELTAERFVSDPFSADPDARMYKTGDLGRWLFDGNIDYLGRNDYQVKLRGFRIEPGEVEARLVQCHGVREAVVLTREDEPGHKRLVAYLLPQTGVELVPAELRQQLSQHLAEYMLPSAFMTLKSFPLTPNGKLDRQALPVPDSSAVVIRGYEPPQGRIETALAQIWQDLLGLEQVGRHDHFFELGGHSLLAVQLAARVRQDLARELPLQQLFAQPILTDLAHALTGASVTTQVIIPVADRSQLLPLSFAQQRLWFLGQLDPAASQAYHIPAALRLTGSLNRHALTTALDHLVARQESLRTRFVLVEGQPCQHIDPADIGFALSCQDLRPLDSAVRNNRVTELAALEAQTPFDFIRGPLIRGQLLQLTDEEHVLLLTQHHIIADGWSIGVLVHELVALYRAALDGHSDPLPPLPIQYADYAVWQRNGLQGAVLTEQHDFWSRQLQGAPALLTLPTDRPRPPVQSYAGGRVPLHLDTTLLASLKGLGQRHNTTLFMTVLTAWSIVLARLSGQDDIVVGTPVANRQHREFEGLIGFFVNTLALRVTPGDVTNVAGLLTQVRERALAAYAHQDLPFEQVVEALQPDRSLSYSPVFQVMLALNNTPTQDLSLPGLQLAPVEQVRYGAHFDLMLSLTETEAGLVGDLEYAADLFDHATVERMVGYVTHVLTAMAADTTQAIAGLPMLPTSERQQLLVNFNATQADFPQDTLIHQLFEAQAAHHPTDTAVVCGDQALNYDELNRRANRLAHHLINLGVRPDDRVAICVERSLEMVVGLLAILKAGGAYVPLDPAYPTERLAYMLDDAAPVVLLTQMAWVDTLNSAIPTVVLDTQEPFMEAQLTHNPEAQTLGLTSCHLAYVIYTSGSTGLPKGVMSSHQALCNRLLWFVRDIVTPPLVAALKTSISFVDSVTETLGVLLAGGKLVVFDNHEVKDLTRFGEGLRHADVNYLVVVPSLLKLLIQGSGDYLKSIRTLICSGERLAPELARQVITDYPWIHLLNFYGSSEINGDATWYEYCATASVPDVSVIGRPIANTQSYILDPHGQPVPLGVTGEIHIAGAGVARGYLNRPELTAERFLADPFSADPDARMYKTGDLGRWLPDGNIEYLGRNDFQVKLRGFRIELGEIEAKLVQCHGVREAVVLAREDEPGHKRLVAYLLPQTDVELVPAELRLQLSRQLAEYMLPSAFMTLEAFPLTPNGKLDRQALPAPDPSAVVTRHYEAPVGEVENALAQIWQTLLGLERVGRHDHFFELGGHSLMIVSLIERLRGFGWRLDVRSVFATPVLAELAQTILIHQDAADAFVVLPNRIPAGCTALTPDMLSLVSLSQAEIDAIVGMIPGGASNVQDIYPLAPLQEGILFHHLLQAQGDAYLLQTLLAFDTCQHLDAFLVALQQVIDRHDILRTAACWQGLVQPVQVVWRQAPLSVNHFTPTSADDVPAQLRAHTDPHQHHLDLNRAPLFAADIAHDPAQDEWLLALRFHHLVSDQMTLALIFTEIALLLQGHAQALPAALPYRDFIAQTLSVADTVHEAYFRSQLADVDEPTAPFGVLNVQGDGEPVTEARLLLTPNLAEAIRTQARRLGVSPSVLFHVAWGQVLAQTSGRDDVIFGSVLLGRLQGGAGADRVLGMFINTLPVRISLADCSVQEAVQATYRSLTMLLEHEQAPLALAQRCSGVAQPMPLFSALLNYRHSQADEAGAVDTIWAGMRIVATEGRTNYPVTLSVDDQGVGFRLTAQTVTSIDPARVTTYLATAISGLVKALVSDPQQPILQVPILPASERQQLLTGFNAIQVDFPQNTLIHQRFEAQAAHSPDATAVVFEDQTLSYGELNRRANRLAHRLIALGVRPDDRVAICVERSLELVVGLLAILKAGGAYVPLDPTYPAERLAYMLNDATPVALLTQTTQVDTLTSHVPAPIPTIVLDAQDASLMAQSDHNPDTQALGLTSRHLAYVIYTSGSTGLPKGVMVEHAHVTRLLAATQERFQFDGNDVWTLFHSFAFDFSVWELWGALSHGGRLIVVPADCLRSPQAFYALLCREQVTVLNQTPSAFRQLISAQDATPHSLRCIIFGGEALELHTLAPWVARNPTRQTRLVNMYGITEITVHATYRELTESDITLGRGSLIGQPLPDLRAYILGTHGQPVPLGVTGEIYIAGAGVARGYLNRPELTAERFLADPFSSDPDARMYKTGDLGRWRSDGHLDYLGRNDFQVKLRGFRIELGEIEARLVQCPGVREAVVLAREDEPGQKRLVAYLRPQDGVELVPAELRQQLTQHLAEYMLPSAFMTLDAFPLTPNGKLDRQALPTPDSSAVVARGYEAPVGEVETALAQIWQNLLGLERVGRHDHFFELGGHSLMIVSLIERLRGLGWQLDVRSVFSVPVLIDMAQAILNADTFVVPPNRIPEGCTAITPDMLPLVSLSQAEIDAIADAIPDGVTHVQDIYPLAPLQEGILFHHLLQPNRDPYVISSLLSVENQTKLDAFIAALQAVIDRHDILRTSIHWIGLSQPVQVVHRHAPLPVNVLTFDDDSDVVASMQARMALSHQHMDLSHAPLIRLQVATEPYSSKLYVLFQLHHIIDDNLSLRCLLAETTAFLMGLGADLLPSVPYRNFVAYARQEGKTQEAEAFFRTLLADIDEVTAPFGLADVQGNGEHNAAARKVLDVELSQAIRKTARRFGTNPAILFHAAWALVVARTSGRDDIVFGTVLSGRMSGVDGSARALGMFINTLPLRLKLRGSSVDELVKMTNDACASLLLYEQTPLSLAQRCSGLGGMSLFSALLNFRHGNDKNTRTPSLDLFGLASLDSCERTNYPFEMSIDDDGEYFVLSAQTVNDIDPNRINTYLTRAIEQLISILIEAPDTPALDLDVLPEDERQQLLVDFNATQADFPQNALIHQLFEAQAAHHPDATAVVCGEHALSYGELNRRANRLAHHLIALGVRPDDRVAICLERSPEMVVSLLAILKAGGAYVPLDPAYPTERLVYMLDDAAPVALLTQTTWVNRLISPVPTVVLDAQEPALAAQPTDNPEPQTLGLTSRHLAYVIYTSGSTGLPKGVAIAHRNTVNFLIWAQRTFSPEELAHTLFATSLNFDLAVYECFAPLVSGGTVHLVPDALSLVTTEQPVSLINTVPSAIAHLIEVNAVPATARTVNLAGEALKPHVVEHLFAHSFVQDVCNLYGPSETTTYSTWIRMNRAEGFASHIGRPIANTQIYILNPHGQPVPLGVAGEIHIAGAGVARGYLNRPELTAERFPADPFSPTPDGRMYKTGDLGRWRPDGNIEYLGRNDFQVKLRGFRIELGEIEAQLMQCHGVREAVVLAREDEPGQKRLVAYVRPLDGVELVPAELRQQLAQHLAEYMLPSAFMTLKSFPLTPNGKLDRQVLPAPDSSAVVAHGYQVPIGAAETALAQIWQDLLGLERVGRHDHFFELGGHSLLAVQLLNRMREQDMAVPLTTLFAHPTLCDLAIAIGERFAQSTSPFDANPVPLNPTGCLPPLFLVHETSGDPLVYSPLAALLPPELPVYALQALGIHTLEHPPASLEALAACHIQAIRRVQPQGPYRLAGWSIGGLIAYEMAQQFMSCGETVEFLGMIDSYNSINGLEITTDQPVDKEAKRIEIIIDSLRAQIGANDEQILEELHDLSDVNQILDRCIEHQWLPISITREDILLRLYTSEIITQLGQDYIAPKSPLPIHLYTADEALNGEIWHGWHDIVGTDSTLHAIGGTHFSIMRPPSLNQIADSLTEHLLPAPAYDPRVIIQSGSRSVPPLFCMPGAGASASSLLGLALSFPQQLPVYALQARGLGLTDEHNFPYVSVEGAARAYIQIIRQTQPHGPYHLLGHSFGGWIAFEMALQLQAEGEQVSDLILVDTDEPDPQGRTPKPVNRTETIMKLIEIYNMILDRPLPLTKQDFDNLAPDEQLQYLLRALVNAGLFPAKTPMSLLQGVVRVMQANLNTCYTPRTRYEGLVHLISAEEGDVDETKTRETLWNTHVAQLSTMHVPGNHMTMLSSPQIEHFVTGLWQKLDYANNPRSAVWFGYVKPHGSGRKDK

SEQ ID NO: 11004 - protein, 2210 aa, Xenorhabdus bovienii
  Coding DNA sequence: Name=SeqID_4896
  Gene classification: Gene name=EntF; Function=Non-ribosomal peptide synthetase modules and related proteins; Function class=Q Secondary metabolites biosynthesis, transport and catabolism
  Homolog annotation: Query=43..1061bp; Hit=2..1020bp; Blast score=769; Percent Identity=44.0; E value=0; Homolog= PA2399_2 COG1020
MTRINMNLDDLKRAVLEKKIDEQLKARGGQQRRPLIEQVNRHQPLPLSFAQQRLWFLSQLDPAASLAYHMSVVLRLTGQLDRDALTTALDRLVARHESLRTRFVLVEGQPCQHIDPADVNFALSCQDLRPLNPAMHTTRIAELSALEAQTPFDFVRGPLIRGQLLQLTDESHMLLLTQHHIIADAWSVGVLVHELGALYRAALNGHGDPLPPLPIQYADYSVWQRDGLQEAVLTEQRDFWCSQLQNAPALLTLPTDRPRPSVQTYVGDQVSFQLDTTLLASLKELGQRHHTTLFMTVLTAWSIVLSRLSGQDDIVIGTPVANRPHQELESLIGFFVNTLALRVTPGEAPRVADLLAQVRERALAAYAHQDLPFEQVVEALQPERSLSYSPVFQVMLTLNNTPAQDLALPSLQLSPVEQARYSAHFDLTLSLTENETGLTGDLEYASDLFDPTTIERMVEYFKQVLTAMAADAAQAIARLPILPASERQQLLVDFNATQTDFPQDALIHQLFEAQATHRPNATAVVFEDQTLSYGELNRRANRLAHHLIALGVRPDDRVAICLERSPEMVVGLLAVLKAGGAYVPLDPAYPAERLAYMLDDAAPVALLTLTAQIDRLTSPVTTVVLDAQESSLATQPTHNPDAQALGLTSRHLAYVIYTSGSTGLPKGVMVEHRNVLRLIINNGFADISPDDCIAHCANVSFDAATWEVWSGLVHGARILLIPEKTLLQPDYFGQRLSSEGVSALFLTTALFNQYASLIAPSLSGLRYVLFGGEQADIRPAIRLRVDYPPQHLLHVYGPTETTTFATAYEIPLTEGEERKIPIGHPIANTRIYILDTQGQPVPLGVAGEIHIAGAGVARGYLNRPELTAERFPADPFSADPDAHMYKTGDLGRWLPDGNIEYLSRNDFQVKLRGFRIELGEIEARLVQCHGVREAVVLTREDEPGQKRLVAYLRPLDGVELVPAELRQQLAQHLAEYMLPSAFMMLDAFPLTPNGKLDRQALPAPDSSSVVARGYEAPVGEVEAALTQIWQDLLGLTQVGRHDHFFELGGHSLMIVSLIERLRSFGWRLDVRSVFAAPVLAEMAQTILAHQDDIDAFVVPPNHIPEGCTSLTPDMLSLISLSQTEIDILVGAIPGGASNVQDIYPLAPLQEGILFHHLMQAQGDTYLLQSLLAFDSRERLDTFLAALQQVIDRHDILRTAACWQGLLQPVQVVWRQAPLYVNLFTPATADDVPAQLLAHTDPRRHRLDLNRAPLFAADIAYDPAQNEWLLVLRFHHLVSDHMTLELIFAEIAQILQGQAETLPTALPYRDFIAQTLNVPAAVHETYFSAQLADVDAPTAPFGMLTIPDDNESIAEARLPLTPDLAGAVRTQARRLGVSPSVLFHVAWAQVLAQTSGRDDVIFGSVLLGRLQGSAGADRVLGMFINTLPIRVSLASRNVQEVVQATYHNLMTLLEHEQAPLTLAQRCSGVAQPMPLFSALLNYRHSQIGEAEAVDTTWAGMRIIATKERTNYPLTLSVDDLGADFYLTAQAVAGIDPARVTVYLVNAIRGLVDALAHDPQQLILDVPLLPLAERQQLLVDFNATETDFPQDALIHQLFEAQAAIQPATTAVVYEDQTMSYDELNRRANRLAHHLIALGVRPDDRVAICLERSPEMVVGLLAILKAGGAYVPLDPTYPVERLAYMLDDAAPVALLTQTAWVDKLISPGPAVVLDTQESSLAAQPDYNPDAQALGLTSRHLAYVIYTSGSTGLPKGVMVEHRNVLRLIINNGFADIGPDDCIAHCANVSFDAATWEVWAGLVHGARILLIPEKTLLQPDYFGQRLTSEGVSALFLTTALFNQYASLIASSLSGLRYVLFGGEQADIRPAISLRTDYPPEHLLHVYGPTETTTFATAYEIPLTESEYRKIPIGHPIANTRIYILDTQGQPVPLGVTGEIHIAGAGVARGYLNRPELTAECFLTDPFVSDPGARMYKTGDLGRWLPDGNIEYLGRNDFQVKLRGFRIELGEIEARLVQCHGVREAVILVREDEPDHKRLVAYVRPLDGVELVPAELRQQLAQHLAEYMLPSAFMVLDAFPLTPNGKLNRQALPAPDASAVVASGYEAPLGEEETTLARIWQDLLGLERVGRHDHFFELGGHSLMAVQLTTRIQTEFLVDIPIASLFLSPKLAEQANIIFSAQMDAIGENDIESIQNSLDLMSTEELMAILGGDSNQ

SEQ ID NO: 11005 - protein, 9650 aa, Xenorhabdus bovienii
  Coding DNA sequence: Name=SeqID_4897
  Gene classification: Gene name=EntF; Function=Non-ribosomal peptide synthetase modules and related proteins; Function class=Q Secondary metabolites biosynthesis, transport and catabolism
  Homolog annotation: Query=7250..8534bp; Hit=1..1284bp; Blast score =896; Percent Identity=43.0; E value=0; Homolog= PA2400 COG1020
MPMPCNRINKDQLAFESSSESSSCKFSLSSTQQVVWLDQILHPDSPSYNLGSLVLIDGKLDETLLVRAFEAVVYRHDALRLRLINTQKLPLQELVDTLPVSVTIHDFSHHADAEAQAAQHIRTAFMRPYDLNGELWRAELLRVSDTRWYWHFCCHHLIGDATNLALIPEELANTYRHLIRGEALPEAAPSYLDFIAEDRAYLDSQRYVNDRQFWLERYVNLPPALLQPPNPDKTTDHGQTEPVLWQLDKGLFQRIEAIVTEHGLSVLHFMYAVLACYFARTTQAEEIVIGIPVHNRKNARQKRTLGMFSSVIPVGITITPHDTFLDVMRKAAAELRRCYKRQRLPIAEINRHTQIQQKTGRAQLFDIMLSFESFQANAEMPGATIKYSKIQRGTPFPFFVAIYQYAFANDEAVNQPVTIEFNYSTHYLNCAEVMALQSRLAMLMEAALSSPETQIRSLPVLPPAERQQLLVNFNATQTDLPQDALIHPLFEAQATHNPNATAVVYEDQTLSYDELNRRANRLAHHLIALGVRPDDRVAICVERSLEMVVGLLGILKAGGAYVPLDPAYPAERLAYMLDDAAPVVLLTQTGLTDRLTSHVPTVVLDAQEFAMTAQSVHNPDTQALGLMSHHLAYVIYTSGSTGLPKGVEMSLAALSNLLQWHRQNPSHLSGTGKTLQFAALGFDVAFQEIFTTLCEGGCLVLINEETRRDPQQFLRLIQQKQIDRIFLPYIALQHLAEAASRIEGDFSCLAHIITAGEQLRITPAIRHFLQRSGSCQLHNHYGPTESHVVTAYTLGKNMDQWPTLPPIGRPIANTQIYLLDPQGQPVPLGVAGEIHIAGAGVARGYLNRPELTAERFLTDPFSADPGARMYKTGDLGRWLPDGNIEYLGRNDYQVKLRGFRIELGEIESRLMQCHGVREAVVLAREDEPGHKRLVAYLRPMDGVELVPAELRQQLTRHLAEYMLPSAFMTLDAFPLTPNGKLDRSAFPAPDSSAVVTRGYAAPVGEIETILAQIWQDLLRLERVGRHDHFFELGGHSLLAVQLAARVRQDLARELPLQQLFALPLLADLAQALYGASATAQVVIPAADRSQPLALSFAQQRLWFLGQLDPAASLAYHIPVTLRLTGQLDRHALTTALDRLVARHESLRTRFVLIEGQPCQHIDPADAGFALSYQDLRPLDPAMHAHRIAELADLEAQTPFNFTQGPLIRGQLLQLTDEEHVLLLTQHHIISDGWSIGVLVHELGTLYHAALDGDSDPLPPLSLQYADYAVWQRDWLQGTVLTEQRDFWCAQLQNAPALLALPTDRPRPPVQRYAGGQVPFRLDSALLTSLKALGQRHNTTLFMTVLTAWSIVLTRLSGQDDIVIGTPVANRPHRELEGLIGFFVNTLALRVTPGDAPRVADLLAQVRERALAAYAHQDLPFEQVVEALQPERSLSYSPVFQVMLSLNNTPAQDQTLPSLQISQVEQESHSAHFDLMLLLTETEAGLVGGLEYAADLFDTATVERMVGYLQQVLTAMAADATQTLACLPMLPDSERQQLLVDFNATQVDFPQDALIHQLFETQAAHSPDATAVVCGEQVLSYGELNRRANRLAHHLIALGVQPDDRVAICMTRSPEMVVSLLGILKAGGAYVPLDPAYPAERLAYMLDDAAPVALLTQTAWVDTLTSPVPTVVLDAQAPALSAQSIHNPEAQALGLTSRHLAYVIYTSGSTGLPKGVAIAHRNTVNFLTWAQRTFNPEELAHTLFATSLNFDLAVYECFAPLVSGGTVHLVPDALSLVTTGQPVSLINTVPSAIAHLIEANAVPVTARTVNLAGEALKPHVVEHLFAHASIQNVCNLYGPSETTTYSTWIRMNRTEGFVSHIGRPIANTQIYILDAYGQPVPLGVAGEIHIAGAGVARGYLNRPELTAERFLTDPFSADSNARMYKTGDLGRWRPDGNIEYLGRDDFQVKLRGFRIELGEIEAQLMQCRGVREAVVLAREDEPGQKRLIAYLRPLDGVELVPAELRQQLARHLAEYMLPSAFMTLDTFPLTPNGKLDRQALPAPDLSAVVARGYEAPISEAETALAQIWQNLLGLERVSRHDHFFELGGHSLMIVGLIEQLYDFGWRLDVRSVFAAPVLTEMAQAIQSDASAFVVPPNCIPEGCTALTPDMLSLVSLSQAEIEAIVEATPGGASNVQDIYPLAPLQEGILFHHLLQAQGDTYLLQSLIAFNTREHLDTFLSALQQVIDRHDILRTAACWQGLAQPVQVVWRQAPLCVNHFTPATADDIPAQLSAHTDPRRHRLDLSRAPLFTADIAHDPAQDEWLLALRFHHLVSDHMTLELIFAEIAQIQQGHAESLPAALPYRNFIAQTLSVPAAVHEAYFRDQLADVDAPTTPFGVLTLPGNDEPIAEAHLPLTPALAEAIHAQARRLGVSPGVLFHVAWAQVLAQTSGRDDVVFGSVLLGRLQGVAGAARILGMFINTLPVRVSLAGHSVQEVVQATYRSLTTLLEHEQAPLALAQRCSSVTQPMPLFSTLLNYRHSQTSEANAVETTRAGMRIVATEERTNYPLTLSVDDLGTGFRLTAQTVAGIDPTRVTAYLVTAISGLVDALAHNPQRLIRNVPILPPTERQQLLVGFNATQSDFPQDALIHQLFEAQAAHHPDATAVVFEGQSLSYHELNHRANRLAHYLIALGVRPDDRVAICVERSLELVIGLLGILKAGGAYVPLDPAYPAERLAYMLNDAAPVALLTQTTQIDKLIHHIPTVVLDAQESAIAAQPTHNPDAQALGLMSRHLAYVIYTSGSTGLPKGVMVEHRSINRLVINNPYADIGSDDCVAHCANIAFDASTWEIWSALLNGGRLHVVSPSALLDPVRFRDSLVKGQVTALWLTAGLFNEYLGDLEPLFGQLRYLLIGGDVLDPRKIQRAQLAECQPAHLINGYGPTETTTFAATYRITSPVDVTRPIPIGCPIANTQIYLLDSYGQPVPLGVAGEIYIAGAGVARGYLNRPELTAERFLADPFSSDPNARMYKTGDLGYWRPDGNLEYLGRNDLQVKLLGFRIELGEIEARLVQCHGVREAVVVAREDEPGHKRLVAYLLPQTGVELVPAELRQQLAQHLAEYMQPSAFMTLDAFPLTPNGKLDRQALPAPDLSAIVTRGYEAPVGEIEIALAQIWQNLLKLEQVGRHDHFFELGGHSLLAVQLAARVRQQLAQKLSLQQLFAQPLLTDLAQTLTDASAIAQVVIPAANRSQPLALSFAQQRLWFLGQLDPAASLAYHIPIALRLTGKLDRHTLTSALDRLVARHESLRTRFVLIEGQPCQHIDPADIGFTLSFQDLRPLDLTARANRVAELTAFETQTPFDFVREPLIRGQLLQLTDAEHVLLLTQHHIIADGWSIGVLMHELGALYRAALDGHDDPLPPLSLQYADYAVWQRDWLQGAVLTEQRDFWYSQLQNAPALLTLPTDRPRPSVQRYAGDRIPLQLDTALLASLKALGQHHHTTLFMTLLTAWSIVLTRLSGQDDIVIGTPVANRPHTELENLIGFFVNTLALRVTPGEAPRVADLLTQVRERALAAYAHQDLPFEQVVEALQPERSLSYSPVFQVMLALNNTPSQNLALPGLQLAPVEQVRHSAHFDLTLSLTETEAGLVGDLEYSTDLFDSATVERMVGYLENVLTAMAADATQTVAGLPMLSASERRLLLTDFNATQADFPQDALIHQLFEAQAAHSPDATAVVFEGQSLSYHKLNHRANRLAHHLIALGVRPDDRVAICVERSPELVIGLLAILKAGGAYVPLDPTYPAERLAYMLGDAAPVALLTQTAQVDTLVSPVPIVMLDALAPSLAAQPTHNPDAQALGLTSRHLAYVIYTSGSTGQPKGVMVEHRGLSNLIATQQDTLAINPDSRILQFASNSFDAGIWECGMALLAGASLHLAQRTHLLPGTALLETLETHAITHVLLSPTALAALDSVPVTLQTLIVGGEACPSSLVKRWAVGRRMVNAYGPTESTVCAAIYLCDNQEEGAPPIGRPIANTRIYILDAYGQPVPLGVAGEIHIAGAGTARGYLNRPELTAERFPADPFSSDPDARMYKTGDLGRWRPNGNLEYLGRNDFQVKLRGFRIELGEIETQLMQCDGVREVVVLAREDDPGHPRLVAYVQPLDGIELVPAELRQQLARHLAEYMLPSAFMTLDAFPLTPNGKLDRQALPAPDASAVVARGYEAPVGEAETILAQIWQDLLGLERVGRHDHFFELGGHSLMIVSLIERLRGFGRRLEVRSVFSAPVLAEMAQSTQDNTNAFVVPPNRIPENCTALTPDMLSLVSLSQAEIETIIEATPGGAGNVQDIYPLAPLQEGILFHHLLQTQGDTYLLQSLLAFDSREHLDTFLVALQQVIDRHDILRTAACWQGLAQPVQVVWRQAPLYVNHFTPATADNVPAQLLTHTDPRRHRLDLSRAPLFAADIAHDPAQDEWLLALRFHHLVSDHMTLELIFAEIAQVQQGHAESLPAALPYRNFIAQTLSVPAAVHETYFRTQLADVDTPTAPFGVLTMPGDNESIAEARLPLTPALAEAIRVQARRLRVSPGVLFHVAWAQVLAQTSGHDDVVFGSVLLGRLQGVAGADQILGMFINTLPVRVSLAGRSVQEVVQATYRSLTTLLEHEQAPLALAQRCSGVAQSLPLFSTLLNYRHSQTSGADAVDIPRTGMRIVATGERTNYPLTLSVDDLGTGFHLTALTMAGIDPARVTAYLVTAISGLVDALARDPQQLLRDVPILPPLERQQLLLEFNATQTDFPQDALIHQLFEAQAVHHPDAIAVVFEGQSLSYHELNHRANRLAHHLLALGVRPDDRVAICVERSLDLVVGLLGILKAGGAYVPLDPAYPAERLAYMLDDAAPVALLIQTALTDTLASAIPTIVLDGSEPLLMTQPTHNPDAQALGLTSRHLAYVIYTSGSTGLPKGVMVEHRGLSNLIATQQDTLAIKPSSRILQFASNSFDAGIWECSMALLAGASLHLAQRTHLLPGAALLNTLETHAITHVLLSPTALAALDSVPVTLQTLIVGGEACSPSLVKRWATGRRMVNAYGPTESTVCAAIYLCDSQQEGAPPIGRPIANTQIYLLDHDGQPVPLGVAGEIYIAGAGIARGYLNRPELTAERFLADPFSSAPDARMYKTGDLGRWRSDGNLEYLGRNDFQVKLRGFRIELGEIEARLMQCPGVREAVVLAREDESGHKRLIAYLLPQTGIELVSAELRQQLAQYLAEYMLPSAFMVLDAFPLTPNGKLDRQALPAPDASAVVTRGYEAPLGEIEIALAQIWQDLLRLEQIGRHDHFFELGGHSLLAVQLVARVRQDLAQELPLQQLFDLPLLVDLAQALSGTLATAQVVIPAADRSRLLPLSFAQQRLWFLGQLDPAASLAYHIPVALRLTGQLDRHALTTALNRLVARHESLRTRFVLVEGQPYQHIDPADIGFALSCQDLRLLEPAAHTNRIADLAAREAQAPFDFIQGPLIRGQLLQLTDEAHMLLLTQHHIISDGWSIGVLVHELGTLYRAALDGHGDPLPPLSLQYADYAIWQRDRLQATALTEQRDFWYAQLQNAPALLVLPTDRPRPPVQTYVGGRVSFQLDTALLTSLKGLGQRHNTTLFMTVLTAWSIVLTRLSGQDDIVIGTPVANRPHSELENLIGFFVNTLAVRVTPGNAPRVADLLAQVRERALSAYAHQDLPFEQVVEALQPERSLSYSPVFQVMLVLNNMPAENLVLPDLQLSWVEQAHHSAHFDLTLSLTETEAGLAGDLIYAADLFDPATVERMVGYLENVLAAMAADATQTVAGLLMLPASERQQLLVNFNATQADFPQDALIHQLFEAQAAHSPDATAVVCGEQALSYDELNRRANRLAHHLLAQGVHPDDRVAICLERSPEMVVGLLAILKAGGAYVPLDPAYPAERLAYMLDDAAPVVLLTQTTWIDTLASPVPTVVLDAQDTSLIAQPDHNPDTQALGLTSRHLAYVIYTSGSTGLPKGVAITHRNTVNFLTWAQRTFSPEELAHTLFATSLNFDLAVYECFTPLLSGGTVHLVPNVLSLLTTEQPVSLINTVPSAIAHLIESDAIPMTTRTVNLAGEALKPHVIEHLFARESIQNVCNLYGPSETTTYSTWIRMSRAEGFVSHIGRPIANTQIYILDSLGHPVPLGVTGEIHIAGAGVARGYLNRPELTAEHFLADPFSADPDARMYKTGDLGRWRSDGNLDYLGRNDFQVKLRGFRIELGEIEAQLMQCHGVREAVVLAREDEPGEKRLIAYLRPLDGVELVPAELRQQLARHLAEYMLPSAFMTLEAFPLTPNGKLDRQALPAPDASAVVAHGYETPVGEAEAILAQIWQDLLGLEQIGRHDHFFELGGHSLMIVSLIERLRGFGWWLDVRSVFAAPVLAEMAQAIQGDASAFVVPPNRIPENCTILTPDMLSLVSLSQAEINAIVEATPDGASNVQDIYPLAPLQEGILFHHLLQTQGDTYLLQSLLAFNSREHLDTFLTALQQVIDRHDILRTAACWQGLAQPVQVVWRQAPLCVNRFTPATADDIPAQLSAHTDPRQHRLDLSRAPLFTADIAHDPAQDEWLLALRFHHLVSDHMTLELIFAEIAQIQQGQAESLPAALPYRNFIAQTLSVPAAVHEDYFRAQLADIDAPTAPFGVLTIPSDSESITEAGLSLTPALAEAIRAAARLMGVSPGVLFHVAWAQVLAQTSGHDDVVFGSVLLGRLQGGAGADRILGMFINTLPVRVSLAGRSVREVVQATYRDLMTLLEHEQAPLALAQRCSGMAQSIPLFSALLNYRHSQTSESDAVETSRAGMRIVATEERTNYPLILSVDDLGTGFHLTAQAVAGIDPTRVTAYLVTAISGLVDALVRDPQQLIRNVPILPSLERQQLLVNFNATQAEFPQDALIHQLFEVQAARYPDAIAVVFEDQGLSYGELNRRANRLAHHLITLGVRPDDRVAICLERSLELVVGLLGILKSGGAYVPLDPTYPAERLAYMLDDAAPVALLTQTIQVDKLAHSIPTVILDGQEPAMAVQPTHNPDAQALGLTSRHLAYVIYTSGSTGLPKGVMVEHRNVLRLIINNGFADIGPDDCIAHCANVSFDAATWEVWTGLVHGARILLIPEKTLLQPDYFGQRLALEGVSALFLTTALFNQYASLIASSLSGLRYVLFGGEQIDIRPAIHLRADYPPQHLLHVYGPTETTTFATSYEIPFTDSECKTIPIGHPIANTQIYILDTQGQPVPLGVTGEIHIAGAGVARGYLNRPELTAERFLTDPFSSDLDARMYKTGDLGYWRPDGNIEYLGRNDLQVKLRGFRIELGEIEARLVQCHGVREAVVLAREDEPGHKRLIAYLLPQAGVELVPAELRQQLARHIAEYMLPSAFMTLDAFPLTPNGKIDRPAFPVPDQSAIVMRGYADPIGETETALAQIWQDLLGLEQVGRHDHFFELGGHSLLAVQLVARVRQDLARELPLQQLFDLPILTDLAQALSGAATTAQVVIPTADRNRLLPLSFAQQRLWFLGQLDPAANLAYHIPVALRLTGQLDRHALTTALERLITRHENLRTCFVLVDGQPCQHIAPADIDFALPYQDLRPLESAAHIHRIAELATFEAQTPFDFAQGPLIRSQLLQLTDEAHLLLLTLHHIIADGWSIGVLMYELDALYRAALDGHGDPLLPLPIQYADYAVWQRNWLQGTVLTEQRNFWCAQLQDAPALLTLPTDRPRPSVQTYAGGRVSFQLDATLLASLKGLGQRHNTTLFMTVLTAWNIVLARLSGQDDIVIGTPVANRPHPELENLIGFFVNTLALRVTLSNTTRVDELLAQVRERALAAYAHQDLPFEQVVEALQPERNLSYSPVFQVMLALNNTPAQNLTLPGLQLASIEQTHHSAHFDLTLSLTETESGLAGDLEYAADLFDSATVERMVGYLESVLAAMAADATQTIAILPMLSAPERQQLLVDFNTTQTDFPQDALIHQLFEAQAAQRPDATAVVFEDQVLSYGELNHRANRLAHHLIALGVRPDDPVAICLERSLELVVGLLAILKAGGAYVPLDPAYPTERLAYMLNDAAPVVLLTQAAQVDTLASPVPTVILDAQDPSLMAQPAHNPDTQALGLMARHLAYVIYTSGSTGLPKGVMVEHRNVLRLIINNGFADIGPDDCIAHCANIAFDASTWEIWSALLNGGRLHVVSPSVLLDPVRFCDSLVKGQVTALWLTAGLFNEYLSDLKPLFGQLRYLLIGGDVLDPRKIRRAQLAESQPTHLINGYGPTETTTFAATYAIASPVDVTRSIPIGRPIANTQIYILDPQGQPVPLGVAGEIHIAGAGVARSYLNRPELTAERFPADPFSADPDARMYRTGDLGRWRPDGNIDYLGRNDFQVKLRGFRIELGEIEARLTQCRGVSEAVVLAREDEPGQKRLIAYVLPQTGIELVPAELRQQLARHLAEYMLPSAFMVLDAFPLTLNGKLDRQALPAPDSSAVITRGYEAPVGEAETALAQIWQDLLGLERVGRYDHFFELGGHSLMIVSLIERLRDLDWRLDVRSVFAAPVLAEMAQAIQDDSDTFVVPPNRIPKGCTALTPDMLPLVSLSQAEIESIVGTIPGGASNVQDIYPLAPLQEGILFHHLLQAQGDTYLLQSLIAFDTRERLDTFLAALQQVIDRHDILRTAACWQDLTKPVQVVWRQAPLGINLFTPATADDVPAQLRAHTDPHLHRLNLNRAPLFAADIAHDPAQDEWLLALRFHHLVSDHMTLELIFTEIAQIQQGHAESLPAALPYRNFIAQTLNVPATAHEAYFRTQLADVDAPTAPFGVLTMPGDSQPVAEARLPLAPALAETIRVQARRLGVSPSVLFHVAWAQVLAQTSGRDDVVFGSVLLGRLQGVAGADRILGMFINTLPMRVSLADRSVQEVVQATYRSLTALLEHEQAPLALAQRCSGVAQPMPLFSALLNYRHSQIDKADAIDTAWAGMRIVAIEERTNYPLTLSVDDLGVGFHLTVQTVAGIDPVRVTAYLATAINGLVDALVRDPQQPILQVSILPASERQQIVVDFNATQADFPQDTLIHQLFEAQAAHNPAATAVVCGEQALSYGELNRRANRLAHHLIALGLRPDDRVAICVERSPEMMVGLLGILKAGGAYVPLDPAYPTERLAYMIDDAAPVALLTQMAWIDTLSSPVPTVVLDGQESAIAAQPTHNPEPQKLGLTSHHLAYVIYTSGSTGLPKGVAITHRNTVNFLIWTQRTFSPEELAHTLFATSLNFDLAVYECFAPLLSGGTVHLVPDVLSLITTEQPVSLINTVPSAIAHLIEAKAVPITARTVNLAGEALKPHVIEHLFAHSSVQDVCNLYGPSETTTYSTWIRMNRAEGFVNHIGRPIANTQIYILNSLGQPVPLGVAGEIHIAGAGVARGYLNRPELTAERFLADPFSSDPDARMYKTGDLGRWRPDSNIDYLGRNDFQIKLRGFRIELGEIETQLMQCHGVREAIVLTREDEPGHKRLIAYVRPQDGVELVPAELRQQLAQHLAEYMLPSAFMTLDAFPLTPNGKLDRQALPAPDASAVVARGYESPQGRIETALAQIWQNLLELVRIGRHDHFFELGGHSLMVVQLITRIKAKFLVDIPLTSLFLSPKLAEQANIIFSAQMNAVGENDIESIQNSLDLMSTEELLAMLDGDNNRGDNNQ

SEQ ID NO: 11006 - protein, 42 aa, Xenorhabdus bovienii
  Coding DNA sequence: Name=SeqID_4898
MLFCYNFIKYNHSDIPFFILCCCCNKADFINTLMLLNNCHIY

SEQ ID NO: 11007 - protein, 35 aa, Xenorhabdus bovienii
  Coding DNA sequence: Name=SeqID_4899
MIIINNHILVCDLNHASLYRYIIFSYNEIIITILF

SEQ ID NO: 11008 - protein, 290 aa, Xenorhabdus bovienii
  Coding DNA sequence: Name=SeqID_4900
  Gene classification: Gene name=SmtA; Function=SAM-dependent methyltransferases; Function class=Q Secondary metabolites biosynthesis, transport and catabolism
  Homolog annotation: Query=56..290bp; Hit=29..258bp; Blast score=74; Percent Identity=25.0; E value=1e-13; Homolog= mlr6226 COG0500
MIINNNHCPLINNLKWKVVMSDIIVTQSNEEKMWWEEDAGFFGKLYKEADDSTQTFFEGENNLVQRTNKEVDGVINLCSLKSGQYLIDCPCGYGRHSVALREKGINVIGIDVNEEHLSIARRHAEVQNSDVIFKKDDMRTFKVERQVDALINMFYSFGFFSDEENVNAARNFYDALKKGGKFLMHTMITVPAFGDGRIPLEEKRKLQSGRTLVSKRRFNHITKREEGIWSLLNENNEEISLRPYDVRIYTDIEFKELCLEAGFSKVELYGDWDGSPYNDNSTYLIVVAEK

SEQ ID NO: 11009 - protein, 45 aa, Xenorhabdus bovienii
  Coding DNA sequence: Name=SeqID_4901
MIYVKSVTLIDKFKFFAALMMFFYHISSEKYSVRIFKMKFTKNIF

SEQ ID NO: 11010 - protein, 31 aa, Xenorhabdus bovienii
  Coding DNA sequence: Name=SeqID_4902
MMKIDIVPASHNEQFGYNVRYKYSARAFPAE

SEQ ID NO: 11011 - protein, 86 aa, Xenorhabdus bovienii
  Coding DNA sequence: Name=SeqID_4903
LNAKQKTRFTDSQILAILKQAEAGTPVPELCRWNNYRAVVLNERWNRSLNGEENRFQSDVTLARNTPAMNFRSGRRNINFIQPGKP

SEQ ID NO: 11012 - protein, 1034 aa, Xenorhabdus bovienii
  Coding DNA sequence: Name=SeqID_4904
  Gene classification: Gene name=EntF; Function=Non-ribosomal peptide synthetase modules and related proteins; Function class=Q Secondary metabolites biosynthesis, transport and catabolism
  Homolog annotation: Query=16..608bp; Hit=562..1141bp; Blast score =278; Percent Identity=33.0; E value=2e-74; Homolog= BS_pksK_1 COG1020
MLLVIGNNMKKKLLFEVISEIASKNPENIAVNFCGNTLIYSQLEQQSDLLAHYLLSKYPMHRKGKIAIYIEPGLILPVALLAILKAGFSYVPISHFYPVERMAKILDDSSAFLLLSTRSIINKRGLDTWFHSVLALEDIDFSAPTNTGCLPTVFSNDLAYILYTSGSTGIPKGVAIEHCNLSYYVDWFNQDLWSQTQALLPLTSSLSFAAAVAQLYAPLLRGDTLHILPADSLYEPEVLFNWYQQYSNGAIYCVPTIWDELLNYIINTNNSITLPKVVFLSGEPVSCDLKERTFQQLPGVRIFNLYGPTETTANGAFTELEKEKPVTLGKALRGSEIIIVNDDLQSVPAGQSGEICIIGEGVARGYVNRESLTKQRFFNYTTEYVFSRGYRTGDLGKVNSQGEIIYLGRIDRQMKINGVRIEPAEIEKVLRQFPNINKALVCLLSEKTDQPYLVAYLVSQEKHISISEIRLFLRKKLPDVMVPSHYLFIETLPKLPNGKLDINRLPLPCPVRPELGYPCVKAVSNLQQDLIDIWQEALGFRELGIHDNFFDLGGNSLQAIQVRQIIKRRLSCDINYSLFFNNATPHLLSFIIPDYINDKVADVSEDEILDGDNCLLSDEQNYFLMLDQISPDPTSYYINFYLIINGELNNSAIEWSLKRILECNSVLQSRFDLDEFSRIEENYPVEMIQILQQVYTRSLDLIDEMNIKHLLDFVDFPEVDLEQTLPISFKLLSLEKQKNILLVSVHHVVFDHDSINLFFNQFINYMRAYIAGDFHYKLGNGIQYQRYCQWQKKIKPIRYQQEQKFWVKTMEDYLLAGADASEFRTIEEVKGENHWFSISVELTLALTQFAKKRKTTLFICMLTAFNKLLKCTLRYKNSAIGIPVSNRMLYEDISLLGCFVNMVTYYDVINPHDSFRTMLLRCQQKMNTILDNPMFPYNELINEVRAKGWSEKLRFPVCFNYLSSMPERIYLDSCEYQIGYIMNKQARFELTLSVNEGKSFSLCFNYAKNVFNIDEIKELSEKYHSLLSEMIFDE

SEQ ID NO: 11013 - protein, 595 aa, Xenorhabdus bovienii
  Coding DNA sequence: Name=SeqID_4905
  Gene classification: Gene name=EntF; Function=Non-ribosomal peptide synthetase modules and related proteins; Function class=Q Secondary metabolites biosynthesis, transport and catabolism
  Homolog annotation: Query=7..585bp; Hit=446..1020bp; Blast score=369; Percent Identity=36.0; E value=1e-102; Homolog= BS_ppsD_2 COG1020
MASEKIIHSKVLLQTNKTPDLIALRCDESIITYQQLEQRSNALADYLIKHGVKPGNIVGVYINKGIDLVISLLGILKAGGCYLPLDPYYPHERLTYMISHSKTAFIITDNEQILTLFQCDCNFINIKTLNLTLNNQLTLPKVNDDHLCYVMYTSGSTGVPKGVMVSHRTVVNYLEWMQSEFILKYEDVVLNQSTFSFDVSVWEIFWPLIAGASCALITEEIKFDPFLIAKFITRHHVTVAQFVPTALRTIAGANVLSGCPSLKHLFAGGEVLDQSLVNELTEQFKGQIHNLYGPTEATIFACHWYCRAGEKEKTVPIGKAIPHARTYVLNEYFQPVPVGECGELYLAGDILAKGYLYEESLTQKCFVNDSFSCYSNQKMYRTGDLVKQCPDNILEFIGRIDDQIKMRGYRIELKEIERHLLSHPYITHAAVVIDDPPENKNSSLSAYYVLHHQQSVNVQDIKKYLLKFLPYFMLPSCFIELDKIPVHPNGKIDKSNFSLYVNENNKYFVDENSNTGIEEIIISIWKPVLNNRNFSKQDNFFDIGGNSLLMSKVYRQIKKKFSVPISIMDLFQYPSVQMLSRYICEKRAGILREKE

SEQ ID NO: 11014 - protein, 1830 aa, Xenorhabdus bovienii
  Coding DNA sequence: Name=SeqID_4906
  Gene classification: Function=Polyketide synthase modules and related proteins; Function class=Q Secondary metabolites biosynthesis, transport and catabolism
  Homolog annotation: Query=9..878bp; Hit=5..891bp; Blast score=645; Percent Identity=40.0; E value=0; Homolog= Rv2935_1 COG3321
MKDQKKLHEKDIAIVGMSARFPGAEDVTLFWQNLLDGVESISTFSEEELRASGVEEEVLASPNYIRRRGILGNALHFDANFFDITPRDAEIMDPQHRVFLECCWHAFEDAGYVPDTYAGKVGVFGGTGTAWHLNTVNKHPDVLKYTSGASIVTNNDKDYVTTRVSYKLNLQGPSINVQTACSTSMVAVVMGINSLLNRESDLVIAGGVSIDIPERRGYPYMQGGMESADGRCYAFDSRANGTVFSRGAGVVVLKRLKDAVNDGDHIYAVLKGGAINNDGNTKVGYTAPSIQGQIAVAKQAIINAQIEPVTISFVEAHGTATTLGDPIEFTSLSQTFREFTDKTQFCRMGSVKTNIGHTDAASGIASLIKASLALENGKLPASLHYMSPNPHIDFETSPFVMNTKLHILEASDIPHRALVNSFGVGGTNACVILESAPDTIPGDPYEGLIMLPFSAKSAAALEMMKQRMCDYLKNHEEINLSDVAYTLQIGRKHFSHSTVLIGNNRNKLLEKLEQPSPIIHLPEKSSKSVVFMFPGQGNQYINMAHDLYITYSVFREIMVYCCQYLEPILGLNLQSIIFQKENSSEKERINETQFTQPALFVVEYSLAQLWISWGIKPDVMIGHSVGEYVAACISGVFSLEDALKAIALRGKLVQGLPTGSMLAVLMDEKALSAQIQGYKLEIAAVNYPGLCVVAGETDETVRFQKQLEDNNIFCKPLDTSHGFHSYMMEPILPAFKEIIDNIDLHSPRIPFISTVTGEWMTDSLAKDSNYWVRHVRNPVLFSHAFNTLITKDDPDFIFLEVGPGRSLESAARQHIKSQSGVFIYSSLPIAKDITTTGESLLMALGNLWACGITVAWEGFYTGKRRLRLPLPGYPFERKEFKLPDINHNQNGAGTYDTQSVNARKRKKADIGDWFYIPRWKQTIPAKFMESKFINPETECWLLFVDEMGVAEHIQRQLTNSGHKVLTVCQGHQYQENHDSGSYVISPETHGNYILLLQSIKAQGLRPTRIVNLWNLSPEIVEPQFLDYCDSLYINTFYSPLYLQQALISENLLENLHLLFVTNNIFSITDEKLYSPEKALLIGPARVFYHEYPEVQCHLVDIEVFSDISTENIAQYLIAESHILTHGSLVAYRGCNRWEEDYQAIHLTQHNADQTITLKDDGVYLITGGLGGLGALVAGYLSEISNATLILTYLTGLPARNEWQSWLQSHPIDDPTSKKIAAILSLEDNGNQVHLAQVDICDYSGMCDLLSQFSQIDGVFHTAGIAGGGIIPLKDKADCARVLNPKVSGSLILHELLKDKQPDFFIMFSSITSIAGDAGRIDYCSGNAFMDAFAHYRNQYHKGRTVSINWGRWGDVGMAVNWSNQKKDRKDTIQEKVNSELLVLVKREGLQEIYRVNLTVEDWVINEHRLIQQPTLVGTTVLSLLHDWITHCKSGESLQVKSLFLTQPLIYHNGWPRLVNLFVIFENNSYKFSLKSRGVLDKQWQEHALGVIGLSDNVSDQAAESLDTIRTRCTTKIPFHPLKAYLDTVGLLSLSHRWNNHQEMFQGDNNEWLIHIVLDPAYSGDFIRYQYHPAIIDAASIRGIINVTKDEFLPISYGNVTYYSSLSPDCYAHVKLKGAYQPQDPSIVMDVIFFSTEGSPLLKLEKYTLIKLSPDNLSAESGYVLTNKEDTLPVKVNLADKDILFYEGLDALKRQFLHLEFGQLVVVTSDIHQLIDESVPEHNDNIVETLSETERNIHTRPALSVECVEPENDIEREIVKIWQLTLGIYGIGVDDNFTELGGNSLLAVQIISAVSNVFEIDISVDLFYQDQTVRGLSELIISELEELLRDK

SEQ ID NO: 11015 - protein, 1357 aa, Xenorhabdus bovienii
  Coding DNA sequence: Name=SeqID_4907
  Gene classification: Gene name=EntF; Function=Non-ribosomal peptide synthetase modules and related proteins; Function class=Q Secondary metabolites biosynthesis, transport and catabolism
  Homolog annotation: Query=52..1085bp; Hit=50..1099bp; Blast score =509; Percent Identity=31.0; E value=1e-144; Homolog= PA2399_1 COG1020
MANIKHTELKSLKLDELKRLVRQKKIKDNSIPKETIKKNTDPDRKYFPVTSAQKNIWMLNQYLDDKKVYSLPLAITCQLKYEVDLLLVKQALTYLAQKHDILRTTFHLTGKELCQYVSDDAVFDFRYDDITYLSERDKKRQVEAMAKAEGNRCFDLAGGPLAYLYIVRTNSHEYVFLLSFHHIIADGWTVGLFLKEFIETYLSLLSGEITLKAEENLQFSDYALAEDQWHAEGKYQQGLEYWAKKLGNVQGILNIATDRPRPSKMNTAGRIMSLFFDGDFCQRLQTCAVQYNATQFHVILAAYEILLYKYSGQQEISIGIPFANRNQSATQNIMGLFMNTLPLCFRIDPEITLSTLVQITAKECEQSMVYQDIPFNHILDKIAYVRNPQVNPIFQAILTYQIFPHYQATSLFKYQPLKIDYGVAKLDLNLWVEKERDGLLFTMNYSTALFNGDTIQRMLADLRTILDAFIGQPKLAVRELSLLSHTERTSLLAGCHPTPDISPAAVHQQFEQQACLIPNAIAVRCTGRTLSYKQLNQQANRLAHYLLEKGLSCGERVALLMAKSEDCVVALLAVLKAGGCYVPVDINLPQQQVDFILTNASVRYVLVESEERVTNVPCINVNQKFNGMPESNPQRQEPPEDTPAYIIYTSGSSSKPKGVQVNHSHLSHYCQAITPVLDQQPGARYGMFSSFTTDLAHTMLFPALVNQGQLEIIHSQHLSNPQELFDYLAASPLDCMKITPTHLAALLGTPEASKLIPKNLLVLGGEKVPVSLIQPIREFNANCRIVNHYGPTECTVGVTTYNLPAELDRLESDYLPIGTPLTDSHVLVLDANQKLVPAKVPGEIYIGGAHLAAGYIDRTEKNSDCFIPHPYLAGERLYRSGDKGRLLPDGNIEFLGRIDRQVKVRGYRVELTAIEDVLRQFPEVTNAAVIQSQSPTGATSLVAYLCGVGERYQATVQSELQKKLPHYMQPEQWIWLESLPLTFSGKINYTALPRLRPDTHQCTQELKSKTEHRLHDIYCTVLECNKVDTQKSFFSLGGNSINALQLIIEVNHQFDSCLSLGQLFENSSISQLATLLEQTAPSMASPLVMFNYGLPDNKPTLLMIHPAGGNILCYHPLVREMGADYPAYGLQVANFSQDAPYNHDIKSLAEFYLTQSGSLLQRTRLVLGGWSLGATIAFEMAQQLVQKTGVAPTVLVLDQPAPQVNIDNSVQMNKDERLVRFVRKVELFLGTSLNISCSVLAEMSEVQRSELFLTEFKRVHLVPDNISNREFQYFLVILRAHIHATDQYQGKIYPGKILVVEAEETLPGRIKLDESGLGWQPLSYDRLKIINAMGNHVSMMQEPYITHIANQLREVLP

SEQ ID NO: 11016 - protein, 528 aa, Xenorhabdus bovienii
  Coding DNA sequence: Name=SeqID_4908
  Gene classification: Gene name=ProP; Function=77 Permeases of the major facilitator superfamily; Function class=G Carbohydrate transport and metabolism
  Homolog annotation: Query=27..515bp; Hit=5..483bp; Blast score=369; Percent Identity=41.0; E value=1e-102; Homolog= PA3137 COG0477
MRSEVITMGSERSQLTRRQWCAISGGLMGGFMAILDIQITNSSMNVIQGALSASLDESSWLMTSYFTSEIVAIPLCGWLCQALGTGRYALWCISGFLGASLLCSSAWSLNSMIVFRSLQGFCGGALIPISFRLIIEFFPPEKRPLGMSLFSIISTFAPAVGPALGGWLTENLSWHAIFYINAIPALLSWVLINYSLKHQSINWNIIRFGDFVGIISIMLCLGTLIVILEKGSAENWLESDMICVLAVISTISFIIFLYDQLTYRYPLINIKLFKDYYFSFSLIIFALFGLAIYGTLFLVPYYLTMTQSYNASEIGRVVIWMGLPQLIILPFIPFLMQRFNLKYLICIGFAGLALSAFMDCSMDGNFAGSQMSGSMLIRALGQPFIMVPLSLLATRHVQQKDSASSAVLINVFRSLGGSCGTAILTTFFISRINIHIDNIKTSLLSSSSAFINYLNNVKSLLIQHGLATDTQSVKHTAITILGQRIARQAEIMAFNDLFLIMGGIMLVTTLLVLFSTHDFYLYLTRKKS

SEQ ID NO: 11017 - protein, 207 aa, Xenorhabdus bovienii
  Coding DNA sequence: Name=SeqID_4909
  Homolog annotation: Query=1..199bp; Hit=1..197bp; Blast score=64; Percent Identity=24.0; E value=1e-09; Homolog= gb|AAN41451.1|
MNQQKPMTIWHYLLSRDALMTIIIPIVLYNIIFWIMGTGIAVLMVALYSGGVQLFSRRRGSLAIIALIMVSGVSHYLYLHGYALFNISKENVFLSISGALSVVVVFSFYSFMGQPVVQTMAEQAMPRLKDIPAYGTALYARVWHEVSIVWILVFLLKAFGVYMLSCQNSVSIDTIIFIGGWPLTLLMVMFSFRWPKYRWKSNAHNKE

SEQ ID NO: 11018 - protein, 333 aa, Xenorhabdus bovienii
  Coding DNA sequence: Name=SeqID_4910
  Gene classification: Gene name=EmrK; Function=Multidrug resistance efflux pump; Function class=Q Secondary metabolites biosynthesis, transport and catabolism
  Homolog annotation: Query=8..333bp; Hit=24..353bp; Blast score=217; Percent Identity=36.0; E value=2e-56; Homolog= PA3136 COG1566
MMKYIRVIIIIFLSLLVLYLYWYFYWRYFQTTNNAYVQTNITHINARVSSVVLESNIQDNHKVKKGDFLVQLDEREFMLNKQKTAAALEQNENALINAQASYQMQKNVIEEHRSSLISAKASLKYARQQLDRYQLLKEKRYVSQSDVDNVISNYKIAESRYGEAQAKLKTQISKLVVQDSQLKQAKANVQQAMASLNQAELMLSYTRIAAPNDGVISNRSVQVGTMVQAGQGIASIVSNQTSWIQANFKETQISRMHKGQPVKVSIDAYPDKIFHAKIDSISPATGAIFALLPPNNATGNFTRVVQRLSVKIVFDQSEEIDSGLSATVTVDTR

SEQ ID NO: 11019 - protein, 96 aa, Xenorhabdus bovienii
  Coding DNA sequence: Name=SeqID_4911
VVKPACLIHIRLHRSVLNTFVIVSQQTRNNKFCTDCSGVSGTAFFVCPTKLANLQEGMEQRSITSIFARFKQGNTETPLRRMSAGTTDINGYPPLP

SEQ ID NO: 11020 - protein, 250 aa, Xenorhabdus bovienii
  Coding DNA sequence: Name=SeqID_4912
  Gene classification: Gene name=HtpX; Function=Zn-dependent protease with chaperone function; Function class=O Posttranslational modification, protein turnover, chaperones
  Homolog annotation: Query=1..248bp; Hit=43..291bp; Blast score=311; Percent Identity=63.0; E value=3e-85; Homolog= yggG COG0501
MKIKTLVAVAVSAVILTGCKNIDQGMLANSGMQLFQAATLSDSDVKQLSDQACKDMDAQNKTAPASSQYTKRLNKIAKALGSEVNGTPVNYKVYLTDDVNAWAMANGCVRVYSGLMNMMNDNEVEGVLGHEMGHVALGHSRKAMQIAYATVAARTAATSAGGVAAQLSDSQFAALGEKLINSQFSQHQESQADDFSYDLLKKRSINTGGLVTSFEKLAKLGSGKASMFDSHPPSQERAQHVRDRIAADKK

SEQ ID NO: 11021 - protein, 37 aa, Xenorhabdus bovienii
  Coding DNA sequence: Name=SeqID_4913
MLFFPLPYKQLFYFKSIKRPWILLKIIIEINLIFMIM

SEQ ID NO: 11022 - protein, 134 aa, Xenorhabdus bovienii
  Coding DNA sequence: Name=SeqID_4914
MSRISSEKSNNDYRKSLYSEYGALFLTNKAKEIFSITTPFLFNHLDENEYFNGNWWANDDVTIRDSWLKDLPFLKIKKNPFVNLYESGGKVLCPATYSGLLSHYNNDDDHIAVYSRCDDPFVGEKVIRQGGIPL

SEQ ID NO: 11023 - protein, 180 aa, Xenorhabdus bovienii
  Coding DNA sequence: Name=SeqID_4915
MERTFPLLEKLRNSVVVDCGHIIISGTSKKYRFGLKGNCSEGELLSFRTGINLVSSLRQLNKKAMLNLYLSDLSGISGGNEERYAIYEKIKSEDKCQFIPKEYVSLLEDAGFNEHDIEINLQSKGNERFKKIIKKRCQGYPVKKVTMTIESHFTLNMALYFSQIKPRRFFQSPHPFYLII

SEQ ID NO: 11024 - protein, 106 aa, Xenorhabdus bovienii
  Coding DNA sequence: Name=SeqID_4916
LHTRFIGLFIITTTARPFGIWRDWVFKKFKISNEDKGIKPYLVDTLAYLSFEMPLYITNLTISGASLEQMIKSILFFAFIAGMVGRPYGIYRNFIRCRIFKLNSSL

SEQ ID NO: 11025 - protein, 52 aa, Xenorhabdus bovienii
  Coding DNA sequence: Name=SeqID_4917
MQIYQKENLFFFYCEVELLFLPCFYSSTILKYINKLVVVLQVRLLVTITVFL

SEQ ID NO: 11026 - protein, 437 aa, Xenorhabdus bovienii
  Coding DNA sequence: Name=SeqID_4918
  Gene classification: Function=Na+-dependent transporters of the SNF family; Function class=R General function prediction only
  Homolog annotation: Query=4..434bp; Hit=8..444bp; Blast score=272; Percent Identity=40.0; E value=7e-73; Homolog= BS_yhdH COG0733
MSQQWTSRLGHVLAATGSAVGIGAIWKFSYVSATNGGGAFLVVFLLFSFVIGLAILLAENILGSSTGEVAINAFKKLLGKHWGWVGFIGIFSSWCIYSFYSVVGGWTIGYTVMASTGKLNITDISQLTSIFTNFISDPWWPIIAHLIFSGLTCFVVLSGVQKGLEKSVKVMMPLLFLIMIVLIIVGIRLPGSSEGLKLFLYPDFSSLTGKGVLDALGLAFFSLSIGLGIHITYSSYLPNNKGIGKSSIWVVILSCLVCILAGLMIFPALAAAGLKPNAGPGLTFMTMPIYFANLPGGSILAVTFFLLLLMAALTSSISLLEHIVAYVQTRFQWSRRKASLIVTASIMLMGIPVSLSFGPLSHVTLGGKSIFDMLDFITSNVLMPLFGIIICLVFGWSRKVNALIPDNMSSWNRQCLLFIWRYVGPLCIGVILVHGLI

SEQ ID NO: 11027 - protein, 85 aa, Xenorhabdus bovienii
  Coding DNA sequence: Name=SeqID_4919
VPQTGCPLLTHANPRIDTVSAHVLRPTAVSKKPAAFETCLPACRPIIGGEMIFPAPMNRAKVIKPNAQIFLDDKRYVIIIVNLLL

SEQ ID NO: 11028 - protein, 50 aa, Xenorhabdus bovienii
  Coding DNA sequence: Name=SeqID_4920
MIVVITARIANNCSQVKLLSAKRHAPTPCEVSKIITPLQLIMLLTVNATK

SEQ ID NO: 11029 - protein, 44 aa, Xenorhabdus bovienii
  Coding DNA sequence: Name=SeqID_4921
MIYLFLVIIIDKTRADKIDKITIPNVTTNTDFNFSSLFNDDVIT

SEQ ID NO: 11030 - protein, 33 aa, Xenorhabdus bovienii
  Coding DNA sequence: Name=SeqID_4922
MMMSSRRKNLAKKKEEPKNEQILRLQSFFNMRQ

SEQ ID NO: 11031 - protein, 43 aa, Xenorhabdus bovienii
  Coding DNA sequence: Name=SeqID_4923
MKENKNFSRILGFTVTPLVQVEHRKSGNKVEHLKYHSSLKEHI

SEQ ID NO: 11032 - protein, 34 aa, Xenorhabdus bovienii
  Coding DNA sequence: Name=SeqID_4924
MDAYLYLIDNYLYQSEIFLIFTRYLGLYWCNYFQ

SEQ ID NO: 11033 - protein, 88 aa, Xenorhabdus bovienii
  Coding DNA sequence: Name=SeqID_4925
  Gene classification: Function=Transposase; Function class=L DNA replication, recombination and repair
  Homolog annotation: Query=1..84bp; Hit=1..87bp; Blast score=63; Percent Identity=41.0; E value=3e-11; Homolog= insA_g6 COG3677
MAKVDVYCRYYHISELVKGHGKGNGGHRCYACCKVFQLEYTYQACKPGVKEQIINMAMNNGGIRDTARVLQVATSTVMTTLKNSSPET

SEQ ID NO: 11034 - protein, 72 aa, Xenorhabdus bovienii
  Coding DNA sequence: Name=SeqID_4926
  Gene classification: Gene name=InsB; Function=Insertion element IS1 protein InsB, putative transposase; Function class=L DNA replication, recombination and repair
  Homolog annotation: Query=1..50bp; Hit=43..92bp; Blast score=61; Percent Identity=56.0; E value=2e-10; Homolog= insB_g4 COG1662
MDEQWSFVGNKKNQRGLWYAWEPCLKRIVAHVFGDRSRKTLDKLLALLSPLILGFIVRMIMLCMTASQRKNT

SEQ ID NO: 11035 - protein, 57 aa, Xenorhabdus bovienii
  Coding DNA sequence: Name=SeqID_4927
MKVPITLSCISADLEYPIVLRFSLFIRVRCVKLFLSQRWVNVFPVRCSSSGRRSYTA

SEQ ID NO: 11036 - protein, 42 aa, Xenorhabdus bovienii
  Coding DNA sequence: Name=SeqID_4928
MKELLPNELTIISGAGDSLNKLTENVAWGAGIGAATDRVLNS

SEQ ID NO: 11037 - protein, 99 aa, Xenorhabdus bovienii
  Coding DNA sequence: Name=SeqID_4929
MSFISFSFSPIWLSFISFIIFIHVNENKSSITVNIIALVIISFSICFVYPFTNIFITEKYFYFDKFIIFCLLSAAISMFINLIILYIYRIMINERAITK

SEQ ID NO: 11038 - protein, 46 aa, Xenorhabdus bovienii
  Coding DNA sequence: Name=SeqID_4930
MKIIKLIKDSQIGENEKEINDIDNPYECILHIIHVDIFLCKKIINS

SEQ ID NO: 11039 - protein, 50 aa, Xenorhabdus bovienii
  Coding DNA sequence: Name=SeqID_4931
MVWRRFKLSGETSLAALSHKCPKLFYALTVSACTKTLFLEQALRQFLIQN

SEQ ID NO: 11040 - protein, 786 aa, Xenorhabdus bovienii
  Coding DNA sequence: Name=SeqID_4932
  Gene classification: Gene name=HsdM; Function=Type I restriction -modification system methyltransferase subunit; Function class=L DNA replication, recombination and repair
  Homolog annotation: Query=5..516bp; Hit=2..508bp; Blast score=563; Percent Identity=59.0; E value=1e-160; Homolog= CC0620 COG0286
MSDTNFSQTAAFIWSVADLLRGDFKQSQYGRVILPFTLLRRLECVLAATKDAVVAEAEKLKTSLLPEEAKEKFLLRASGLTFFNSSPMDLGKMGQNDIKDNLENYIQSFSKDAREIFGHFNFSEFVSLLQDANLLYKVVKKFATTDLSPKKISNHDMGMVFEELIRRFAESSNETAGEHFTPRDIVRLTTSLVFMEDDEALSKDGIIRTIYDPTAGTGGFLSSGMEYVHELNPNAVMRAFGQELNPESYAICKADMLIKGQDVSRIKLGNTLSNDQLPLDQFDYMLSNPPFGVDWKKIEGEINNEHQQKGFNGRFGPGLPRVSDGSLLFLLHLISKMRDSHNVDGTVTNGGRIGIILNGSPLFTGGAGSGESEIRRYILEADLLEGIVALPTDMFYNTGIATYVWILSNKKSSERKGKVQLIDGTNLCGKMRKSLGSKRNLMGEDDIKLITRTFGNFEVVNATPLQELGLEKAAEQKSNRGRQSATAKVEAPKTFASKIFNSTDFGYRRLTIERPLRLSAQVTDEVIATLRFAPKPFNAPMERLYEEFVTQWQDDNYGDFAEIEAEARTIIKAEFAELKEKQIKDLLDSKLWLAQRTLMEKAQQIQTALGVQAGGKTQVSDDFNHFQLTLKGALKTAGVKLDTKENKQFIGAITTKNPAAEPVVKKVLKETALPLYGAFEYKGKVVEFDQDGDLRDNENVPLNPSVSTSDLIENYFKAEVLPHVVDAWINTDKRDEKDGEVGIVGYEIPFNRHFYVYQPPRPLEEIDADLDAVSAEIMKLLQEVHS

SEQ ID NO: 11041 - protein, 420 aa, Xenorhabdus bovienii
  Coding DNA sequence: Name=SeqID_4933
  Gene classification: Gene name=HsdS; Function=Restriction endonuclease S subunits; Function class=L DNA replication, recombination and repair
  Homolog annotation: Query=7..405bp; Hit=3..444bp; Blast score=153; Percent Identity=30.0; E value=3e-37; Homolog= CC0621 COG0732
MAGLNKYKAYPEYKDSGVEWLGEIPKHWAVCRLKNLATIKNGQDYKSVQAECGYPVIGSGGQFMFASKYMYDKPSVLLGRKGTIDKPLYINEPFWTVDTMYYTELNDDVDAKYFYYLALTIQFSRYSTNTALPSMTQEHLSNYKFAAPKVESDRKQITDFLDHETAKIDNLIEKQQQLINLLKEKRQAVISHAVTKGLNPDVPMKDSGVKWLGEVPEHWIVSPIKHVLANQDFRRIPLSSEERGKRSGEYPYYGASGIIDYIDNYIFDEPTVLVGEDGANLVARNTSLAFSAVGEYWVNNHAHILKPYDGLVDYWAEAIEHIDINPIVSGSAQPKLTAEALNNLKIAYSPQLEERSQIEGCINVQKNKYKKLISIAAEQVILLQERRTALISAAVTGKIDVRNWVAPDMSDIEESQEAAA

SEQ ID NO: 11042 - protein, 1082 aa, Xenorhabdus bovienii
  Coding DNA sequence: Name=SeqID_4934
  Gene classification: Gene name=HsdR; Function=Restriction enzymes type I helicase subunits and related helicases; Function class=L DNA replication, recombination and repair
  Homolog annotation: Query=3..995bp; Hit=1..931bp; Blast score=715; Percent Identity=42.0; E value=0; Homolog= CC0623 COG0610
MSMDTTKELVFQNEMIAQMVDRGWIVGKSDGYDRERALYLQDALAFVQTTQPQEWEKFSKIYPTDTERHFLDALVAQLKKADINATDMLSRTYGTLGVLRHGIKSHNARFSLCQFKPEHNLNPETLARYKQNICRIVPELVYSPHASKAAFEESGVKAKKWRIDLVLFVNGLPVATLELKSEFKQAVQNAIKQYKKTRLPKDPGTNKPEPLLTFKRGALVHFAVSQYEVFMATKLDGDKTFFLPFNKGTKDGGAGNDIPEDENEYATNYLWNEVLLPDNLLNILANFVHLQIEEKEEWNGLKGKKESLIFPRYHQWDVVNKLITAAAIEGTGNKYLIQHSAGSGKSNSIAWTVHQLSRLYDEKGEKQFHSVIVVTDRTVLDDQLQDTIYQFEHQDGVVGRINNKEGDGSKSEKLASALENSQPIIIVTIQTFPFVLKAIENSVSLKQRKYAVIADEAHSSQSGSTARQLKEVLMTDEADDDVVLSSEDILDATVAARKGSNNLNYYAFTATPKAKTLELFGRLPNPLEPASKTNMPKAFHVYSMRQAIEEGFILDVLKNYTNYKVAYKLLQKLDDPDREVDSKKAKVKLNQWVALHEHNVSQKVKIIVEHYRKHVMHLLGGQAKAMVVTSSRKAAVRYKLAFDKYIAENSYQKINAMVAFSGEVEFVDSDHNSLALLNQKFTEISMNPGLKGRDMRKAFDSDDYQVMLVANKFQTGFDQPKLCAMYVDKALGGVECVQTLSRLNRTYLGKAESGTFVLDFYNEPDDILAAFQPYYQTAELTDVSDPQLVFELYEKLRSSGIFLWNEVEQFCEAFFTKNKSNAAISNICKPAVERWKQRYSSAIDAYVLAKEMFERTKKTGDVVLITNAENNFKASKQEKDKLDIFKKDLGSFVRFYEFISQIVDYDDKDLERLSLFARHLRPLLHEQRIEEDEIDLSNVEMSHYRLSKLHEQHLKLQEDAEEYKIKPGNDIGTAKPKDKKEEFLSNILVRLNDLFITDNLTDKDMINYVFTVRDKLSENQAVMTQIANNTREQAMLGDFPKAIDDAVMDSNDAQQEMMMQYLSNPELAKGFARVVFDMLKGA

SEQ ID NO: 11043 - protein, 49 aa, Xenorhabdus bovienii
  Coding DNA sequence: Name=SeqID_4935
MGDPCRRGITEITKKILNDCINNGQTLTHTNLGHAFNPLIDIEYSSFVQ

SEQ ID NO: 11044 - protein, 100 aa, Xenorhabdus bovienii
  Coding DNA sequence: Name=SeqID_4936
MQSFNIFFVISVIPRLQGSPIGRRNKNSRSLKGSVSIAVHLHTFGSRYLRTPNPPSDDESFPVLFTTPAIHPAGQNRLCLTLNDTVFIGTPFTDIFNASR

SEQ ID NO: 11045 - protein, 190 aa, Xenorhabdus bovienii
  Coding DNA sequence: Name=SeqID_4937
MHHDKRPENCAASLVLKHSDYQVTPPGGQRPEHVRPDFTTDLIHILLNKTSLKHTIYRPRRIRAQPPPRPVPVVVQSCRISLLTRVTNSLITRFRLVPRRPHCCASVRVVFFHTDNLSVSVHLQTTAAHQIIVAIAHLIVTDVVRFSAFPMQYLVYGRSGITGAGHSPGCAAVAVSFVGGEETIRSYLEQ

SEQ ID NO: 11046 - protein, 110 aa, Xenorhabdus bovienii
  Coding DNA sequence: Name=SeqID_4938
  Homolog annotation: Query=6..108bp; Hit=19..132bp; Blast score=104; Percent Identity=48.0; E value=4e-22; Homolog= ref|NP_458745.1|
MSSGFPLSQCSTWFMGEAVLPEQVTHRDVLRWRYHSLVEKKQSGHTWNNKVAHLRTIFNFGMARTLLPQTENPFNDAAVKKEKKKKKILSKSQIIHLYLLMRQYEEEERR

SEQ ID NO: 11047 - protein, 170 aa, Xenorhabdus bovienii
  Coding DNA sequence: Name=SeqID_4939
  Homolog annotation: Query=1..168bp; Hit=162..323bp; Blast score=183; Percent Identity=57.0; E value=1e-45; Homolog= ref|NP_928358.1|
MRQNQLLHLRLQDISLEGNYIVLRVEGSKNHSEWRVPMIRQLKPRLAQLAGQARACGEKDDDPLFDLTRLRFRHHGRTISYQYNYDKEMQHIRSFFNRLSKECGFSVSSHRFRHTLATELMKAPDRNLQLVRSLLGHRSLATTMEYIDIDMEIAGKTLENELAIYLDISV

SEQ ID NO: 11048 - protein, 55 aa, Xenorhabdus bovienii
  Coding DNA sequence: Name=SeqID_4940
MKKWLIPILHPVKSSPDLTSESITEIITLNEKRVLANAGTLYSLFTAFLKIEYAD

SEQ ID NO: 11049 - protein, 295 aa, Xenorhabdus bovienii
  Coding DNA sequence: Name=SeqID_4941
  Gene classification: Gene name=Soj (BS); Function=ATPases involved in chromosome partitioning; Function class=D Cell division and chromosome partitioning
  Homolog annotation: Query=1..285bp; Hit=1..273bp; Blast score=154; Percent Identity=36.0; E value=1e-37; Homolog= XF1785 COG1192
MIILPIISPKGGEGKSTHAANLAGFFADADLRVLLIDADYSQPTASSIFPLNYEAPAGLYELLMQTVDLHQPEQIISRSAINNLDVLISNDPDELLPTAMLHAPDGRLRLRNVLQHPLFSQYDIIFIDSKGATGVMSELVVLAATQGVLGVIKPILPDVREFLRGTLRMLTRLRPFENYGIRLPAIQILVNGIEGTNLDRDTLSELADIINNQRYDASALGGRQVYQLLETRIDLLDIYKLGHVRAQPVHRLEYKTTRKSPAAAQTMHRLACELVPLWAEKFDAVLTVQPTGEAQ

SEQ ID NO: 11050 - protein, 143 aa, Xenorhabdus bovienii
  Coding DNA sequence: Name=SeqID_4942
MGGKIRRGIDCATDRRGAMNVIWRAVCFRYERVELLFSDDEWFVFVDAPDRETAQAKLQILLPAVPDVSPERVEHYYPRMRRQAMRPDAFPDLALLECGWENDQPQYLTHKEVLFWVSSPHLQQRLIAALNAISREVADESAA

SEQ ID NO: 11051 - protein, 466 aa, Xenorhabdus bovienii
  Coding DNA sequence: Name=SeqID_4943
  Gene classification: Gene name=DnaB; Function=Replicative DNA helicase; Function class=L DNA replication, recombination and repair
  Homolog annotation: Query=24..456bp; Hit=25..459bp; Blast score=395; Percent Identity=49.0; E value=1e-110; Homolog= VC0371 COG0305
MRSAGRSPMNLPHEHLQIISEEAPSYAYAEVGVLGGLVLENECWDSVVQLLAADDFYFPAHRIIFQAIAELSEKNCPFDLITLTDRLTQRGQIDRACGFAYVAEVCKNTPSAANIEEYARIVAEKSRLRQLLALGKSLSADVFQPNIQSDTLIEKAESQLFNLAEKGSTRQHQEMTLLQGADSLIAHLERIQGAQGITGTPTGFQDLDEKTCGLQAGDLILLAARPSMGKTALGLACCLGALRHRDDAVVQIFSLEMPAAQLMLRLTAMEGGVSLGALRSGMLDDEQWGRISQSLDQFARWDHRLVIDDCSHQTPALLRARARRYTRKYGKPALIMVDYLQLMSAPGQENRTQEIADISRNLKALGKELGCPVLALSQLNRQVENRSDKRPNNGDLRDSGSLEQDADLILHLYRDEVYHPDTPDTGTAEIIIGKQRQGPTGVVRVGFDGQYTRFSDLSADSDGYGE

SEQ ID NO: 11052 - protein, 526 aa, Xenorhabdus bovienii
  Coding DNA sequence: Name=SeqID_4944
  Homolog annotation: Query=2..503bp; Hit=1..549bp; Blast score=434; Percent Identity=48.0; E value=1e-120; Homolog= ref|NP_928361.1|
MMARQHLNMGNALLQQGRQATATLSEQPPVSEMPMVLTLDQLRPNPDNPRTSRNPRYEDIKASIKVRGLDTVPKVTRDPEGEDVYIFSDGGNTRYQVLSELWQETGDERFYRVHCLFKPWPGRLQCVIGHLAENELRGELSFIEKALGVCKARTLFEVQKQQKITQSELSALLGEAGFPVSRSYISRMEDTVQYLYPWMPDLLNSGLKVPQIRLLLALRQDAEAVWLQHVVSAISEPACSFDAIFGACCRKFDSPESWSPEMFRDELIGDLLQVLPHPQLNYDRWVLELDPKESNRRQLFGEQATPVDPVPEKPDTPKADRARAPDREPNRRIMSQPVTDAEQASETTCAPVDKTPVPAPSSRNNPVLPPYQPDSPSEPALSEPEADDLHFARTGLEPVSSVWHISPMQDDIEHLQNMAFRLAFELAEVMGCDRDLLPVSDERSAGFCLIDGPDVHPFSCLLHSLTGEISIDRHELTLTAVLLGTAGRKAVPLLDDSQTVKFLRLLRIIRRLRELQREIVPEILTM

SEQ ID NO: 11053 - protein, 193 aa, Xenorhabdus bovienii
  Coding DNA sequence: Name=SeqID_4945
  Homolog annotation: Query=1..178bp; Hit=1..177bp; Blast score=201; Percent Identity=59.0; E value=7e-51; Homolog= ref|NP_928363.1|
MNHLSQATNSLLLQLVMDLKNGYIRRCEALGLAPSEMLMLQSLTIEDLHYLGNSPVSVLSVQIHHANLARILHQARIEQQRIQRIDRALALSGSIDLMHYFFGLSSLEVAARRRIAGIAVKSGRVSVLTEAENRDLWQRWQAAKMRDADSADGLDIMMDVAEHHDISLTSVWNAVKEWQQQGASGSVSVKKQV

SEQ ID NO: 11054 - protein, 109 aa, Xenorhabdus bovienii
  Coding DNA sequence: Name=SeqID_4946
MAATGCIRIGLCEKTGIKRVIQETMSGKLTEIMPGLHVPVTAPLSFRRKAQYQVKCYRRGQRNYVRLKEKGTGYLKINVGLFWRLLSRDSGQSWELMHHERYNNEIRKS

SEQ ID NO: 11055 - protein, 407 aa, Xenorhabdus bovienii
  Coding DNA sequence: Name=SeqID_4947
  Homolog annotation: Query=4..396bp; Hit=17..424bp; Blast score=395; Percent Identity=57.0; E value=1e-109; Homolog= ref|NP_928364.1|
MINLSADSLIAHTIAKMKSRLEQRTGDDVSQLRSGLLFMGNIQDAYPRRLLLDDRLSPLDKTGWMMIRLYAQQNKGAVFPSYDELQLLLASPYKGKASRETVSRVLLMLRITGWLSLCKRIRDEHGRVRGNIYAQHDEPLTCRDAEILDPHWLDTVAEACRSKNRTISQTAREVLTDIQEDPLMRHRHSHIRLLEARLNAVQTPQQRVMRQALQQGKQQTELREMKPGSETESGQLKGQNKPNSETELSLKSTVYRQTTKPNCYVRSFTQSVNKKTYVDTPSAIFLPEKLCRQLEPEDGGMLNSQLQALPAEQAQTVLTCLDKALQAGKIGNPVGWLLAMMKRAREGKLYVQAEPAVTTTAAAKKPVEFTRETARSVPSSSQAHVSSVVKDIRQRLAQAKYHRDDMG

SEQ ID NO: 11056 - protein, 82 aa, Xenorhabdus bovienii
  Coding DNA sequence: Name=SeqID_4948
MTWGKNRVVLPGTAMIENYTGVPGAQATKNCTSLFEAGKSENLPYCLRQQWLKIILVCPGHRRLKIVLPCLRQASLKIYRIA

SEQ ID NO: 11057 - protein, 52 aa, Xenorhabdus bovienii
  Coding DNA sequence: Name=SeqID_4949
MVNADFSAPARRGGDGAVFSSGSDIKSNSCLVGLCLWDYQGKGVCDSIDNQL

SEQ ID NO: 11058 - protein, 241 aa, Xenorhabdus bovienii
  Coding DNA sequence: Name=SeqID_4950
  Homolog annotation: Query=15..232bp; Hit=11..226bp; Blast score=224; Percent Identity=55.0; E value=7e-58; Homolog= ref|NP_928365.1|
MSEPDEKTAPSPPRRAGALKSALTIELHTHYAIRLWEGRKKEDLIGRRQYPDIIGMPQVIKRAGTISVDAAADNPYADSWLLKLEQALVTASASLQQSIATLQEILNALPAQITLSSVSSVEPLNIGVYSHSPLGYRCVWLLVGYDQLAMKTFQAFHYGFISRSERDTLLHNGSRVIRQIYGLVRSYRPLKVTRADIEEKTPAGLEAIKWLGEPDPDILSGRLRSDFSPPLRPVAQDAGRG

SEQ ID NO: 11059 - protein, 670 aa, Xenorhabdus bovienii
  Coding DNA sequence: Name=SeqID_4951
  Gene classification: Gene name=TopA; Function=Topoisomerase IA; Function class=L DNA replication, recombination and repair
  Homolog annotation: Query=92..668bp; Hit=34..613bp; Blast score=514; Percent Identity=46.0; E value=1e-145; Homolog= XF1776 COG0550
MRGGDDMPLYLCEKPSQARDIARVLGVKQRGQGYLFGDSITVTWAIGHLLEMAAPEYYGEQFGPPWRMEPLPVLPVQWQWTVKKETADQFAVIRQLLKQADEVIIATDADREGEVIARELLEFCRFTGPVRRLWLSALDETSIRQALAAILPGEKTESLWQAGLGRARADWLMGINLTRLYTLKAQAQGFGEVLSIGRVQTPTLALVVNRDNDIARFEPKPYWQVIAALQKDDISFRVKWLPAPDDCDEEKRCIREDIAQSVVQRCQQAQDAVVTELTQKREKTPPPLCFDLGTLQQVASRQWGMGAGQVLTIAQSLYETHKATTYPRTDCGYLPVSMREGIPAVFTALTRTDPAMNAIISQLDASTLSRVWNDSQITAHHAIIPTRHPFDMTKLTADELKVYQLIRHYYLAQFLPVQETDVTEVTFTIGGQFFQAKGRISVVRGWKALFADEKQAQEQDDNTALPALKKAETCPVLRAEIQPRQTRPPAPFTEGTLIATMKNAAAFISDPQLKKVLRESAGLGTEATRAGIIEALFKRQLLARKKKNLHATQLAQELIAGLPDVLTHPGMTALWEQSLDDIAQGRATLDGFMQKQAQWLAHLVEKGKTQPIRFTLPKTPACPRCGGPMQKRAGKTTPFWGCTCYPACKGMLNANAVTGSRKTRRGNSPD

SEQ ID NO: 11060 - protein, 38 aa, Xenorhabdus bovienii
  Coding DNA sequence: Name=SeqID_4952
MRLTPGGKNHSRQGTGFSPSHLIFYSMENIECLRTPYP

SEQ ID NO: 11061 - protein, 154 aa, Xenorhabdus bovienii
  Coding DNA sequence: Name=SeqID_4953
  Homolog annotation: Query=9..154bp; Hit=6..152bp; Blast score=216; Percent Identity=71.0; E value=1e-55; Homolog= ref|NP_928367.1|
MSENTVSLTKNDYFNLNIKGLGYLNNIRHVSTASGTFLSCVINALNGPGDNPVYVRFDITVVGKEATSLIGRCQKSVDEDKKVLLGFTLSNPSTDIFTLKRGDHAGEQRVSLKARLIKVDWIKIGQEKVYQAEQSDSMPPQNGITQKEYAENSF

SEQ ID NO: 11062 - protein, 69 aa, Xenorhabdus bovienii
  Coding DNA sequence: Name=SeqID_4954
  Homolog annotation: Query=7..66bp; Hit=10..69bp; Blast score=69; Percent Identity=60.0; E value=1e-11; Homolog= ref|NP_458626.1|
MNVAPIGVLALQYCHKQLPLIVLRRRAGFYIGTMDEGIPCSRESVEYFARREQAEFALKQGQWTQRHPR

SEQ ID NO: 11063 - protein, 183 aa, Xenorhabdus bovienii
  Coding DNA sequence: Name=SeqID_4955
  Gene classification: Gene name=Ssb; Function=Single-stranded DNA -binding protein; Function class=L DNA replication, recombination and repair
  Homolog annotation: Query=14..183bp; Hit=1..171bp; Blast score=186; Percent Identity=53.0; E value=1e-47; Homolog= BU545 COG0629
MDTTSPPITGENKMSSRGVNKVILLGYLGQDPEIRYLPTGGTVATLSLATSENWKDKQTGELREKTEWHRVVIFGKLAEIAEEYLQKGAQVYIEGQLQTRKWQDNQGQDRYSTEVVVNVNGSIQMLGSRNDSKSMAPQQAGHKPAQKQPSPKPANQERKNTRALQPLALPVKEDADWDSEIPF

SEQ ID NO: 11064 - protein, 254 aa, Xenorhabdus bovienii
  Coding DNA sequence: Name=SeqID_4956
  Homolog annotation: Query=33..248bp; Hit=14..222bp; Blast score=124; Percent Identity=36.0; E value=2e-27; Homolog= ref|NP_930524.1|
MRKIFLNGSKTIHWVNYGLRTSSPEGQLMSNYIEVMAIVEGKTEQIFIEKMLQPYLAEKMIFISATQVSKPGQKGGDVRFSRVKKDIEMHLKQRPTTYVTTFIDYYGTNEWPGLETLNRHWEPKQIAEHLHLSTQNEVRQFLPAQRVDERFIPYIVMHEFEALLFSDKEILANELNIDEQEVEQVLQECREPESINNSPQTAPSKRLGKWSANGVFAKTTTGIAIAEKIGIPKMREKCPLFDEWLHKLEILITI

SEQ ID NO: 11065 - protein, 392 aa, Xenorhabdus bovienii
  Coding DNA sequence: Name=SeqID_4957
  Homolog annotation: Query=24..392bp; Hit=1..377bp; Blast score=435; Percent Identity=57.0; E value=1e-121; Homolog= ref|ZP_00042882.1|
MHDLSSIVIPLSDTEVKHFKGGDMTTSLDKLTIKGFKSIHELNEFELKSLNVIVGANGAGKSNLISFFKMLRALIDGTLNRYVRDSGGASDLLFNGNKVTQKMEFDTRFGERGFRFKLVPTPADSCAIEDEARYYIKSAGDGWWELGDSDDGRSRMVAEIEKKSLDARHSKPVYDAIASWQIYHFHDTSATAGMRKYEIIQDNKTLRTDASNIGAFLLKLKNDAPNEYKSIVNAIRLVTPFFDNFILEPRQSGSKEEVNISWTQKGSDYPMQPYHLSDGSIRFICLATALLQPNPPSTIIIDEPELGLHPAAIVILAELIQQTAQRTQVIIATQSPILIDQFSAADIVIVNRKKGASSFERLNEEDFSQWLENYSLGELWAKNVIAGGPTYE

SEQ ID NO: 11066 - protein, 42 aa, Xenorhabdus bovienii
  Coding DNA sequence: Name=SeqID_4958
LIHRFIHSTIPKLKLKCLSLTVSITKETLDSENSAPAISGLC

SEQ ID NO: 11067 - protein, 94 aa, Xenorhabdus bovienii
  Coding DNA sequence: Name=SeqID_4959
  Gene classification: Gene name=Nlp; Function=Predicted transcriptional regulator; Function class=K Transcription
  Homolog annotation: Query=9..82bp; Hit=7..81bp; Blast score=89; Percent Identity=65.0; E value=5e-19; Homolog= sfsB COG3423
MTMTHTQKDWHPAEIICALRKRGTTLAAVSREAGLSSSTLANTLSRAWPKGEWIIANYLDVHPSEIWPSRYFDQYGQLIERTVRKAVSAESSEQ

SEQ ID NO: 11068 - protein, 178 aa, Xenorhabdus bovienii
  Coding DNA sequence: Name=SeqID_4960
  Homolog annotation: Query=11..170bp; Hit=5..168bp; Blast score=117; Percent Identity=48.0; E value=7e-26; Homolog= gb|AAP84211.1|
MRITVLMGVLVTILTGCHAPSKQLPSKCTPEKAISATQLTRNIQPVSPDIYQQAPEVVRYGRYILVSTDPTAAQRDPLSQLIEVHIPASQNPTVADALRDVLRQSGYRLCTPEKTNDILYRQPLLSVHYQLAPIRLRTALQLMAGPAWQLEVDEVQREVCHHLRPGYQLPQPRQGKQP

SEQ ID NO: 11069 - protein, 231 aa, Xenorhabdus bovienii
  Coding DNA sequence: Name=SeqID_4961
  Homolog annotation: Query=12..231bp; Hit=22..245bp; Blast score=240; Percent Identity=55.0; E value=2e-62; Homolog= ref|NP_458644.1|
MRLHQIGLVTWIVLSSPTWAATPSPLTSQQAHTVESQKQTLRIQAGQWGLNADEYQRYQQLLNGPRGIQSPGLDPLTTLGIEAESDVERRRYAEQWVKAEFARTEKELRFQREVDAAWQRLFPDMLPVNMEKSGEAKERLALFVKINDCPPCDARLAEVLALMQPVDIYLVDSKGNDDTLRQWAKKHRIPVERVRNRQVTLNHDAGYWFRFGQGVMPVLLRQGEQGWHITS

SEQ ID NO: 11070 - protein, 180 aa, Xenorhabdus bovienii
  Coding DNA sequence: Name=SeqID_4962
  Homolog annotation: Query=1..178bp; Hit=1..177bp; Blast score=154; Percent Identity=47.0; E value=7e-37; Homolog= ref|NP_928399.1|
MAYHVMIMKGLRVFPIIGMLWFNTCHAELNVIADLGGKDASPFYESINAEQRDDPVSSVQNSSPEMAGEAAMLPVKTPELTPGKVASRPLQLPGIGALFLIGDDPGSRQWLSQNAATLTKLHAVGLVVNVSEMAGLQSLRVSAPDLLLSPASGTELAHRLPLQHYPVLITETALSQQLSP

SEQ ID NO: 11071 - protein, 687 aa, Xenorhabdus bovienii
  Coding DNA sequence: Name=SeqID_4963
  Homolog annotation: Query=1..683bp; Hit=1..682bp; Blast score=963; Percent Identity=68.0; E value=0; Homolog= ref|NP_458648.1|
MSRCYVVEALLRPAVELNTAVVSVVAAFVCIRAPWAIALAPSVSYVMAGGFTVLAMIRTWQGIQVIRYRRNLRRLPRYQMSTKQIPVSHRQLFLGRGFRWQQKHIQRLQDTRRPEVERFVQPARLYQLARALERRTEYRWPKLSALLRQDSPFNPVRPLPPVGGNLAIHGIGPQEADVFMDLRERVGHTLVMGTTRVGKTRLAELLITQDIRRGEVTIVFDPKGDADLLKRIWAEAHRVGRGNELSLFHLGWPEISARYNAVGRFGRVSEVASRLAGQLSGEGNSAAFREFAWRFVNIVARALVALGHRPDYQLITRYVNNISELYQRYATRVMEERMPALLSQINHYLGTLKEKDVPRNMQGQPDALRLWAMEMTLSSDTGKQLYDPILDGLRSAVRYDRTYFDKIVASLLPLLEKLTTGKIAELLSPDYLNMTDMRPIFDWEQVIRKNGIVYIGLDALSDSDVASAVGNSMFADLVSVAGQIYKYGMNAGLPVRHDGKLAINLHCDEFNELMGDEFIPLINKGGGAGMQVTAYTQTSSDIEARIGSPAKTAQVIGNFNTLIMLRVRDNRTAELLTSQLPEVEIYSKTLVSGHSDIADVEQGQDFTSSTQDRVGTVKTPLVTPAEMINLPKGQAFALLEGGQLWKIRMPLPTGNEDDALMPANLQKIAEQMRRYYRTSESWWEEKG

SEQ ID NO: 11072 - protein, 252 aa, Xenorhabdus bovienii
  Coding DNA sequence: Name=SeqID_4964
  Homolog annotation: Query=4..252bp; Hit=2..250bp; Blast score=245; Percent Identity=56.0; E value=4e-64; Homolog= ref|NP_928401.1|
MAQSENQSRPSSQPPRKHGLLYRVLWEWPWQLIGFMAMSWLFSLLLEYLGMAFFWPEEGATHSQNMMKAELNYLSSEFTRSLLLSEPSQTVSAWLAQAYQWVFVDSGFMGWVQGQSQYQFNSRNDFMREFNSVLQGVSSYLQEYWLATVFITMVTLTRIAILLLSVPLFVMVIFVALVDGLGRRDLRRYGAGYESSFVYHHAKRGIKPACTVPCVLYLSWPDVVYPTVILLPAAIVLGMAIVITTSMFKKYL

SEQ ID NO: 11073 - protein, 230 aa, Xenorhabdus bovienii
  Coding DNA sequence: Name=SeqID_4965
MLRIDLSVPDEEYEQARKLGAHWDAVEQIWYIDNSIDPTPFINWLPFYNVHAEYWYLAQTQTACPHCQENTTVTACMLPAGHKLLEADSDDEPNTEIDYTEQDRSAFLFYLADLPTLMRNVLPGFHHRLRKVVSQPLQRQHWINHCEHCDAPLDDTELFTEIGGAFFPASKEQAARIQLHRIDQPFVGYCEDISHHHYHFDPKQDNRICKACDWFEWMTQVVNAPSKYQH

SEQ ID NO: 11074 - protein, 31 aa, Xenorhabdus bovienii
  Coding DNA sequence: Name=SeqID_4966
MGQGKATAHKHSPRDGFQAIEDARFFTANQQ

SEQ ID NO: 11075 - protein, 111 aa, Xenorhabdus bovienii
  Coding DNA sequence: Name=SeqID_4967
  Homolog annotation: Query=28..109bp; Hit=7..89bp; Blast score=70; Percent Identity=50.0; E value=5e-12; Homolog= ref|NP_928403.1|
MFMRSCFSLSHSACLLSLILVCVPLAQAAEKDELASAKKLIEQVQMALERANIAEKPADTEKQPRYHFDYTRIKTDLNTIKTGIDHYLMPSRDQPDEPAPLSGQYRQERRQ

SEQ ID NO: 11076 - protein, 78 aa, Xenorhabdus bovienii
  Coding DNA sequence: Name=SeqID_4968
  Homolog annotation: Query=1..78bp; Hit=1..78bp; Blast score=80; Percent Identity=56.0; E value=9e-15; Homolog= ref|NP_928404.1|
MTPTQRNAFEVASGHFDITFLYLVCVGFFLATLFLWAAWAAVDVWNGWANEKVRNQTISQFAMRTAILLVVAVWMFAS

SEQ ID NO: 11077 - protein, 71 aa, Xenorhabdus bovienii
  Coding DNA sequence: Name=SeqID_4969
MKKYVTRPSASLLCEPPSYWWLRSGCLPADATNIMNKEWIEHEVNFYCLSSYQHEPDNQNKHLSFAVRFFL

SEQ ID NO: 11078 - protein, 138 aa, Xenorhabdus bovienii
  Coding DNA sequence: Name=SeqID_4970
MNSIPVGIMTQPANGIKGRLAISPNASPSKAASPISGVVNPRNTTGSAFKRSGKKGIVCISDTLKNNAGRFRQQPNHRNQQHHADHNNGAKLCPGGFAVPHFRKGFNRRRGDLKERDCRKDQPANHNAVLRIAFHLSQ

SEQ ID NO: 11079 - protein, 93 aa, Xenorhabdus bovienii
  Coding DNA sequence: Name=SeqID_4971
  Homolog annotation: Query=1..88bp; Hit=27..114bp; Blast score=84; Percent Identity=55.0; E value=4e-16; Homolog= ref|NP_928406.1|
MGLAALLGLAFGLMASLPFIPLAGWVMIPTGMLFMPLLLISFSGRWLVQLKRGKPENYLWLKLEEKKRRMGIGDPALIITAQGWSLRRSRSLR

SEQ ID NO: 11080 - protein, 218 aa, Xenorhabdus bovienii
  Coding DNA sequence: Name=SeqID_4972
  Homolog annotation: Query=1..217bp; Hit=1..217bp; Blast score=322; Percent Identity=73.0; E value=3e-87; Homolog= ref|NP_458653.1|
MSRFRHALKNRDQHILTLRLACGVLVLVLLITLTGWMMSPRNLTIHNPPDLRSGSTRPWWEVPAPSVYSFAFYLFQQLNAWPKNGAQDYPAKIAALSSYLTPACQDFLQADAKTRADSGELLDRVRVVYEIPGRGYGTKSVTVRNRDNWVVRLDLVADEYYHAEPVKRALVRYPLKVVRWEGDAERNPFGLALDCYDGMPQRLEAMPQPVEEKKGVFQ

SEQ ID NO: 11081 - protein, 278 aa, Xenorhabdus bovienii
  Coding DNA sequence: Name=SeqID_4973
  Homolog annotation: Query=1..277bp; Hit=1..298bp; Blast score=295; Percent Identity=55.0; E value=7e-79; Homolog= ref|NP_458654.1|
MKRYQSCSSACFWLGLVSLLLFSLGAKADELVKWERIPLSIALKVGQERIIFVDRNVRVGLSPSLSDKLRVQSAGGAVYLKASQSFPSTRLQLQDSENGEIILLDITATKMGSTEPVRILYPDEKNSAPKEGSPHQRKSALSAPAPVILTRYAAQQLYAPLRTVEPVTGIHPVNLHLPGSITTLYPSEPIAVSPLVGWGVQNYTVVALKLRNTAKRNITLDPRALQGQFVAATFQHRWLGEAGTPEDTTVLYLVTRGQPDNAFIPEPVTVKPGGRHAG

SEQ ID NO: 11082 - protein, 476 aa, Xenorhabdus bovienii
  Coding DNA sequence: Name=SeqID_4974
  Homolog annotation: Query=1..463bp; Hit=1..481bp; Blast score=479; Percent Identity=53.0; E value=1e-134; Homolog= ref|NP_928408.1|
MQVKSNSLVKILVPMVLMVGGFIGIKSCSSTDSTAPNTPQNNVLSTLSPEELQALGVGGDTPEDTLRTLVGTLNKVRSEQQRLGQQNADILKENDQLKNQRQDVAGQIDAAVAAIRQDDEQRRRELQDEQQGLLAQIDLLTERLNSTPLSAPDSPIPLGSGSIPYSANSGTGQNELIWITPADEKPADIQTPGSGKATAQFPASFLSEQPATGQNKPQSPSLQNPSKEESEQPIYTLPENATLVGSQAMTALLGRVPVNGTVTDPYPFKILIGKDNLTANGIELPEVEGAVVSGSASGDWTLSCVRGQVNSITVVFQDGTVRTLPGAGQNTHGSANGIGWLSDENGIPCISGERKSNAATYLPTLFALSAMNSAGDALSESQRTAQANGTGGITTALTGNAGQAALGKAMSGGMNDMSEWLKQRYSQTFDAVYVPPGARVVVHITQRLAIDYETKGRKVRYGVSEPAQRDNQEALD

SEQ ID NO: 11083 - protein, 118 aa, Xenorhabdus bovienii
  Coding DNA sequence: Name=SeqID_4975
MEKTPSQWIFSAGSPYCLQVSVMSLTEPARVQLYWRAVRKKECRLYLLTDRECQPLSDGDFTVFRLTETQRQAVVDGKVSMAPEQWVPLPFTLSELAVHPEFATFTVLGTPEAAVCGK

SEQ ID NO: 11084 - protein, 133 aa, Xenorhabdus bovienii
  Coding DNA sequence: Name=SeqID_4976
  Homolog annotation: Query=16..133bp; Hit=29..147bp; Blast score=149; Percent Identity=62.0; E value=1e-35; Homolog= ref|NP_458656.1|
MRKIKYYWLLGLAGLLVGCTTSKDALLPAGKQTVLAMWQGNKAGHATESARETLRRSLTVSERLRALEEPYHYSRSAAQEISQQFPRLPNPDMVMYVFPHLVAGNTPIPGYSTVFPFYQQVQYALPGERMEAL

SEQ ID NO: 11085 - protein, 921 aa, Xenorhabdus bovienii
  Coding DNA sequence: Name=SeqID_4977
  Homolog annotation: Query=7..914bp; Hit=40..939bp; Blast score=1361; Percent Identity=72.0; E value=0; Homolog= ref|NP_928410.1|
MNIPKALNRPGKLREVDEAAIYQANPSIIDYLPWVEYLEDGQCLLLDDGISVGAVYQIESIATEGRPAERLTEIRDQLEDAIQDSLEEDDISPWVVQFFCQDEDDPADYLNTLRGYVKPWAQGTLFTDAFLAESEHHLNSIARPDGIFQDSLITGQPWRGQQRQTRMVVYRWLPDGRRSPVNHLTLSAVAALNQVCERLVSSLASVGVIARRQHGGQIHRWLLRHFNPAPDWGMAKADFYRTVSYEAPTQSDLPVSNDFAESLWFTPPVSDPDAGVWWFDGLPHKAVLVERLRRPPEPGTLTGEVKRGDNINALVDMMPAGTVVSLTIVAQAQDRLEEDFTRLSKNAVGENTESLRVRQDVQEVKELLGRRHKLYRSALAFLVRGKDLDDINHRVHQLSSTLLTAGLQPVRPEFSVSPLNAYLRALPMCFNPQKDKKHWYSRLTWVQHLAGLLPVTGRSTGTGHPGFSFFNRGGAPLTFDPMNKQDRTQNAHLLLFGPTGAGKSATLCASLIQLMAVHRPRLFIVEAGNSFGLLADYYESLGLTVNKIGIRPGCGVSLALFADAHQLLQLSPEQLRINEADIPDTDEQQEEEADEQRDILGEMEIAARLMITGGEKREEKRLTRSDRGLIREAIMQAAQTSFDESRQMVASDLQNALYAIARNHQQDEHGQPLITAHRRARADEMASAMSMFTQGFEGELFNRPGTPWPEVDVTLIDLGTLARENYSAQMALAMVSLINKVNNLAERDQYQDRELQLVIDEGHITTTNPLLSPYMTKVVKMWRKLGAWLWLATQNLADYPDTAEKMLNMAEWWLCLTMPPDEVEQIARFKKLTEEQKAVLLSASKLPRCYTEGVVLAKKIEALFRVVPPSLYLALGMTEKEEKAERRALMREHQCSELEAAVWVVRKMDVARGLKVNSVEH

SEQ ID NO: 11086 - protein, 113 aa, Xenorhabdus bovienii
  Coding DNA sequence: Name=SeqID_4978
  Homolog annotation: Query=1..113bp; Hit=1..111bp; Blast score=183; Percent Identity=77.0; E value=4e-46; Homolog= ref|NP_927890.1|
MSLDDKIYAEIGQLLYNSAPDYAKKIIMDTELSPEGDCCQFKYDYINSADEMNWFSPQENDGLTNERIRELLVSLRQFFVENIHLKQPPHWSGCIVTVDVEKMKLNVDFKYED

SEQ ID NO: 11087 - protein, 111 aa, Xenorhabdus bovienii
  Coding DNA sequence: Name=SeqID_4979
  Homolog annotation: Query=4..111bp; Hit=4..111bp; Blast score=113; Percent Identity=48.0; E value=6e-25; Homolog= ref|NP_927890.1|
MINDDELYSEIGRILYEAAPDDAQTILLDAELSPGNDHVKFLYDYIDESGCKKWYFPPSPKTDRELIENLAMLRKYYVENNLTNDHPSWSGCLVTVDLKKMKINIEFKYED

SEQ ID NO: 11088 - protein, 1085 aa, Xenorhabdus bovienii
  Coding DNA sequence: Name=SeqID_4980
  Homolog annotation: Query=26..896bp; Hit=79..995bp; Blast score=336; Percent Identity=30.0; E value=1e-90; Homolog= ref|NP_290949.1|
VLQKFQFSLSNNANFLIIGLLSLLLSFQGQATSEQKNEGNLSAHKLADIASQLGQQLHQSQSPTDAAQSIAAQQLSSAVTATLTPWLNQLGNARISLPFDHAFSLKEAVLDWMLPWYTTPGYTAFSQWGVKAGHGQTTTHLGMGYRYLTDNWLWGANAFWDAEWPAQHHRYSIGAEAWRDNFKLSANLYRRLSGWKTSRKVTDYDARPANGWDIRVEGGLPVLPHWGGQVVFEQYYGQQVDLFGDSRRQYNPYSLTAGLTYTPVPLVTLGADFRHGKQDHRDNRFTLALNYQLGVPLAQQLDPNAVAPLRSLTFRRTDFVNREHNMVLDYRKQTLITLDFPVQLKGDAGKIITFTPRITSKYPLARLELRADELQQAGGKIIHQTPDKVRLLLPKAADKIIRLSGIAIDRHGNRSRPSETTLFIQPTETHVQVTANRTQARADGQDSVMYTVMVKDRDGEPVPDQTVSWSSDKGKLSQTTQKTDAQGLAAVLLSSHYDGEHSVQVSVGDNVTVALPVHFSAVLKLVITADKTQVRANGQDAVTFTVTVKGAAGVPVPQQSVKWQTSRGKFLTLSSTTNNHGQATAALVSLPSGIAEVSVTIGEETLMASPVEFLPALTHTLTCDKSTAIADGQDSVLCTVDVRDAADQPMVGREIVWSTDHGQIGDEQVITDSRGKARARVISRKAGVARVRADISGTIITADGVTFKRQLQSVIIADKTHANGNGQEAIVLTAIVEDALGLPVENQAVIWHTDSGVLSSAETRTDSQGVTQIQLTSTVAGEHRVWIQVDDKTVTAPTLWFDDVLTSTLHADKTRMIANGQDSVILTVTVKNLTGQPAVGIPVWWRSDNGHFTDAQIETDENGEARATLSSQKAGTASVTTIIDDQEVISPTVEFIPPLRIADTVAVDSQGGNANQKSFGTRGPSVFWRGAKFRIIIADNTGRVNWQSDSPAVTVSGDTVVVQQRPDGVRLTGTDEAGQQVVLTLTSDTWFERSGITKDFYFSATQICQSLGSQIAPKYALERLYEEWGNFYHYEGWVREFYVVSTDYLSASSGSMNAQTKWAFWAESDSWMRNAWHRLAFACGG

SEQ ID NO: 11089 - protein, 91 aa, Xenorhabdus bovienii
  Coding DNA sequence: Name=SeqID_4981
  Gene classification: Function=Transposase; Function class=L DNA replication, recombination and repair
  Homolog annotation: Query=1..87bp; Hit=1..87bp; Blast score=77; Percent Identity=43.0; E value=3e-15; Homolog= insA_g5 COG3677
MAKVDVDCRYCHKSEDVKGHGKGHRGYPRYRCYACSKVFQLAYSYQACKPGVKEQIIDMAMNNSGIRDTARVLKVAIATVMKTLKNSTPGT

SEQ ID NO: 11090 - protein, 140 aa, Xenorhabdus bovienii
  Coding DNA sequence: Name=SeqID_4982
  Gene classification: Gene name=InsB; Function=Insertion element IS1 protein InsB, putative transposase; Function class=L DNA replication, recombination and repair
  Homolog annotation: Query=1..139bp; Hit=27..166bp; Blast score=122; Percent Identity=43.0; E value=1e-28; Homolog= insB_g4 COG1662
VTTLPLDGDNIHLICEVDEQWSFVGSKKNQRGLWYAWEPRMKRIVAHTFGDRSRKTLEKLLALLSPFNIRFYCTDDYAVYDCLPEEVHLTGKIFTQRIERTNLTHRTRIKRLNRKTIGYSKSEEMHDKVIGTFIERENYI

SEQ ID NO: 11091 - protein, 30 aa, Xenorhabdus bovienii
  Coding DNA sequence: Name=SeqID_4983
MLSSLSKFFNKVTEIIITHYFSPYSDIILT

SEQ ID NO: 11092 - protein, 211 aa, Xenorhabdus bovienii
  Coding DNA sequence: Name=SeqID_4984
  Homolog annotation: Query=1..202bp; Hit=1..201bp; Blast score=172; Percent Identity=45.0; E value=3e-42; Homolog= ref|NP_792272.1|
MRDEFFECFIDDLGEATQHRPVPSESIDKWVGKLPGQLLYYWKHEGWNSYQDGMFSIVNPDDYEDIVDMWLEDTPFESMDSYHVIARSGFGKLYLCGEQTGINLTLDCVFNTFFYSPQRAYKKEKKELDHDISSFFAVKSIDDIDLKGSAKTGIFSKSVEKYGLLGEHEIFGFEPAIVLGGEIKLENVRKLDMHIHLDILRQFDDPDIFEI

SEQ ID NO: 11093 - protein, 424 aa, Xenorhabdus bovienii
  Coding DNA sequence: Name=SeqID_4985
  Homolog annotation: Query=181..420bp; Hit=244..504bp; Blast score =158; Percent Identity=40.0; E value=2e-37; Homolog= ref|NP_792271.1|
MAKKTKKTPPTVSDKPLLEQKARNDAPTGEGNTIGEIVGQPPQVTKAPGEASPILKPGPQNEKNFASQAYDSAKNVVVEAGKSAAEMGKGAAKDTWNFGVDIAELAYPAAQLEAARAMEDAARWHDIFGNKEQAKVLSEAAEEARGRAATGNLDELRVTLDNPEQELGAVLADLNPKGAVKGVVKGIVGGVKNIGKAIEKVTAKEGKKKTVNKVEKPKESAGKPNEPEKKGGKVKGAKLTKVPCFNPYNSKRYKRLKTEKERQAFLKEYSAQLRRQQDAINNMSPEEFKIARDAYKKNKRNSLAGKAQEDFRDSAKGEIKINIFNSQIKKGTSVKEAKIISQNKADEIFDGLAALHEPDMVAGGYGQYAPKKMGDTGINSAIGGSWRGKRIKSLDNAAKEAIDSGLGDAKMNVQLELCRGKGKK

SEQ ID NO: 11094 - protein, 124 aa, Xenorhabdus bovienii
  Coding DNA sequence: Name=SeqID_4986
  Homolog annotation: Query=7..123bp; Hit=1..117bp; Blast score=100; Percent Identity=47.0; E value=4e-21; Homolog= ref|ZP_00031153.1|
MARSCTMADNYFARTATQWMVVSIVPDVCKTPIGASTPPIPYPVVAKLAESSVSVKSVRANGKPMVVFAQSFVPQTLGDQPGVANGIKSGTVGGKCHPKEHSKSVRAGNKLLLRHGDKFWMNGA

SEQ ID NO: 11095 - protein, 397 aa, Xenorhabdus bovienii
  Coding DNA sequence: Name=SeqID_4987
  Homolog annotation: Query=6..368bp; Hit=17..327bp; Blast score=144; Percent Identity=32.0; E value=3e-33; Homolog= ref|NP_103717.1|
MHYKMLDTEDEEYHVVAMKIVYQFRPVGDGPYYQAVLTEPFGELALQDEFSGELNQSSVRQESDLAPLKPKCDVIVNGVAYAPGGIPAERVPVRLLVTTADWQPLIDKTLLVWGEREFQRTSEDEWQLTPPQKFTELPIDYQYAFGGQCRVYEDDVAAAAVVDEFRLSAEQLGQHPEKDSPPIAHATFEYNPIGRGFVAPWYAKAKALSRYPAPRIEHPDAPVIGEYFAPCSEPPTAITEPGYRPAGFGMIGRPWLPRRTKAGTYDETWLKERHPYLPDDFDFSYWNNAPEDQQIDHPDNNIRISLFHLTREGILRVQLPGHRPFILLRMLSGEMLPDLMYPDTLIIDSEALTLSMTYRYHAEMDESIRLMEARFEMNPDAPLVRVDLGDGKELHYG

SEQ ID NO: 11096 - protein, 613 aa, Xenorhabdus bovienii
  Coding DNA sequence: Name=SeqID_4988
  Gene classification: Gene name=VgrG; Function=Uncharacterized BCR; Function class=S Function unknown
  Homolog annotation: Query=11..570bp; Hit=12..568bp; Blast score=402; Percent Identity=39.0; E value=1e-112; Homolog= ZvgrE COG3501
MMKNIIDRLPAAKSGLRFTFQVAGLPGDTFSVGEFSLQEGLSELFILNLTLVKTHSLNPFKPLDEVDLTALLMQEAELQIFHGVQVQRKITGIISHADWAGTDGNKTLYTLTVRPALWRLTLNQESRIFHQQNVPAILNGLLKKHKVRADSKLYDPHQDREYVTQKRESDYGFFSRLAAEEGISFWFEDETLFFSDSHLGMTAGLPLTYSPQPETAHGIDTIYQVRLGVGMSPQRSLHKDFNYDNPRYHLSHMTSSEGFRDFGTQTPYTVFESYGRFQKDAAAKPFLKYRHEALDNQKKTGSGSSNCIKLMPGKIFEIKSHPHAPLNARWQIVGISHHGRCPQAMGDNSGDGTTLTNQFSFIDGLADWRPPFHYKPLADGDETATVVGPEGEEIFVNKDGAIKVHFHWNRYDKADDGASCWVRVAQGWNGNGFGFMAIPRIGQEVIVSYLNGDIDRPIVTGCVYNGLNRPPLDLPAQKTRTTFKTKTHKGKGFNELRFEDAKGSEEVFIHAQKDMNTKVLNDRDTHVLANHSETVEKNQTIDVHEHREETIGLTDTLDVGESLSITAGTVIELRCGSSVLRMDKLGNVTIQGNNFLFQASDAIQISAQDIDLN

SEQ ID NO: 11097 - protein, 585 aa, Xenorhabdus bovienii
  Coding DNA sequence: Name=SeqID_4989
  Gene classification: Function=Uncharacterized BCR; Function class=S Function unknown
  Homolog annotation: Query=5..563bp; Hit=3..568bp; Blast score=173; Percent Identity=26.0; E value=5e-43; Homolog= VCA0110 COG3519
MKNNKESMYLQERAYLRELAQRVAKESPHLADFLTSSHDPDTERVFEAFALLIARLRDKIEDDLPEITHGILSRIWPSALSPIPPTTVMQFHPTDGEHQGTVDIPAGTPVSADVNGQLLTFKTCRSLHIEPLIVRDRTVKKTGTHSEIVLTLCQTGTPSPVWQSGSLSFFLGTDNERAAQLTLWLDQHICDMHLRTQGEQRKLNSFPYGWHNLFDALLLPMGNRTYAGLQLLLEYYALPHLYNFMTVDISDSCREIPLNADGSFELVFRFEGELPLDNVDDAFILHCVPAIHLETLTSLPLPLNEGNHRYPLLLGESVQLFRLRDIQVVQQPDETQQRGSPYRYLPIDQFTPSSPSLAEDGEPETLYYLLQNERDLLGRLTHQLHFFDLTGKLAQHLPALSVVGDILGYHTQAITLKPGEITLTQEGSPAHLNVHNILPVSADYPSLLQDNSGWPLLSCLSSPPVLLFATDSLKQFLRLFDPYPELNRPLSRHIRRHIDGIARVEEHLTDRMKRGRPVRGHWVGLTLNPDCYHNSGEMYRFCRLINEAMACFISQSTFVRLDVYTPDTRGVLWTFKEVYGTRRDM

SEQ ID NO: 11098 - protein, 253 aa, Xenorhabdus bovienii
  Coding DNA sequence: Name=SeqID_4990
  Gene classification: Function=Predicted transposase; Function class=L DNA replication, recombination and repair
  Homolog annotation: Query=1..248bp; Hit=1..247bp; Blast score=184; Percent Identity=39.0; E value=5e-47; Homolog= mll8100 COG3293
MLRTRLTDPVWDKLSALMQHTGLVYHKAEHRLILEGILYRMRTGIPWRDLPLEFGRWNTVFVRFNAWSKKGVLNLIFKGLSGLADREWLFIDGSIVRAHQHSAGAATNEEEAIGKSRGGRSTKLHLAVDSQGLPVHFELSGGQTHDIKHAESLVNNSPASDFVIADKGYDSDAFRNIVEQTGATPVIPYRKNSRKSEEPIDKGLYRYRHLVENAFARIKHFRAIATRYDKLERNYASMLALAFTLVWLPMWAD

SEQ ID NO: 11099 - protein, 63 aa, Xenorhabdus bovienii
  Coding DNA sequence: Name=SeqID_4991
LHRRTVTPSIPSGAVNPAFSSCPFHVIKRQSSVKKAGTKVSKQFIFAECEKTLQSQCPFHHDG

SEQ ID NO: 11100 - protein, 123 aa, Xenorhabdus bovienii
  Coding DNA sequence: Name=SeqID_4992
  Homolog annotation: Query=6..118bp; Hit=13..125bp; Blast score=112; Percent Identity=50.0; E value=1e-24; Homolog= ref|NP_458660.1|
MGWMVSLSVGAKTVIYTDSQHLPVNLPPETRVIWLDAPEQQQRQIFAHLPADSQQAATQARAILQSPQWRGQEQQLINAYRAVVHAWQSGVRKYPAVVFDDRDVVYGTADMAKATALREQHQP

SEQ ID NO: 11101 - protein, 322 aa, Xenorhabdus bovienii
  Coding DNA sequence: Name=SeqID_4993
  Homolog annotation: Query=1..322bp; Hit=1..321bp; Blast score=430; Percent Identity=66.0; E value=1e-119; Homolog= ref|NP_458661.1|
MKTSRFAFPVVITLAVACAPVTQAAINTAQIVAGSVSPACIQWRVSGICYWLFCSWHGCTVKTSVKVTHFLPQAVVSTYHAPGGNPWSEMAQISPLSGGLENAVTGALSGLTTGGGNHTVQIAGKQSSRLRFKYADAIGHPATTLIGGQIPGYSCRSAATPLMPYFLSTLDTVAWRSGLPESLYPEALIPGLRELGSQPAGNMWGNLYPRSGFVTQVDEDKAAAVVAQRVADIITRTGQPHVYQPLAGQRRDGYWPPAPVTENTGTKNHQWQRLSPQLSQSCAVFPDGRHTAAADSNQAYALWQPYSCCQRRGQRFLGSTDI

SEQ ID NO: 11102 - protein, 479 aa, Xenorhabdus bovienii
  Coding DNA sequence: Name=SeqID_4994
  Homolog annotation: Query=31..472bp; Hit=27..468bp; Blast score=513; Percent Identity=63.0; E value=1e-144; Homolog= ref|NP_928413.1|
MIRKPGLLIAGGLALATAQVQASELSVSLPAVSHSALGYGAQSSGAVSDTLFYTLGGGSVISEPASRAGSTRLAGLELGWRSDLMCGNFDLKTTVSNQLNGITAGMKNLMSEVIQGATGAVASLPAMIIQRANPGLYDMLTNGVLQANVAFDKAQFNCQNMAKRMGDFAQNNKWTQSAAMQEYKAQVNSGDADAVRANNAGTKATGTGGHPWIGGRKQGGKGQSAIRPTRDLASAGFNMMNHQPVLSTATIRHQDCSGSSCTKFSSAREAAEAVVNVLGDRAIRTCANAAECISGGEAHQPGATVAGTGFAPMLEAQTQANMEQLVKLVNGTEKVTAANLAKLKTGSLTVTQGVIQALQRDPDNAALTARLAGELAMAETTETALLMRRMLITGMSEPNAAAQAEALNEGERRIAALDREINALKNEMTLKRELAHNAILTIIERENHRIETHPQKHVTESSDKRFYQLENPANRVTGR

SEQ ID NO: 11103 - protein, 114 aa, Xenorhabdus bovienii
  Coding DNA sequence: Name=SeqID_4995
MTGNAKASSRLKKGAGIVLAIAAVIILTLLTGWAGMRYPEHLFAFRHRMENHQSLWLVWRLSLYALLGWGSRKIFQATQHKPAYRTPLIRMMTASLLFILLCEYALSGSMGGSA

SEQ ID NO: 11104 - protein, 504 aa, Xenorhabdus bovienii
  Coding DNA sequence: Name=SeqID_4996
  Homolog annotation: Query=1..500bp; Hit=1..503bp; Blast score=671; Percent Identity=66.0; E value=0; Homolog= ref|NP_928415.1|
MTTNSYLEYFLTLLGWVVNNGLWQVLIATGLFTVPLLFKIMALWLKIREDSVEEGNAGLQSLSRLENILYGAFFVMIACCVPLVQVSLSTLQYDPSRAKTCGTWTPKSPQETGYAPVISSLGEHTAAVPVWWAVVHRLSKGLTQAAIASVPCRPDLRQLRFEVQHTRIANAALAAELQDFTHDCYALALYQWKQRDQGQTGDPAVLQDIDWLGSQTFLSGDYTTLQSRTPRAHFPWMASRDSGRPDTGRGGYPTCKVWWSAPQTGLEARVLAQADPGLWLRLSAALKMLGKGSREYKEAVIRRLVSPVNLTVSQEGYVYAGYGGNADFTVWNGSNRAGASAGVMLGGLLAYPMLDAVRQALPMVQAVLLMALYILLPLILLLAAYEFKTVLTLTFVIFALNFLTFWWELARWLDSYLLDALYGSETHSLFNLAGLQNTSDDLIMALVMGMLFIVLPMVWLGALAWAGVRMGDISGMMNQGVGQVRQSAGMFGQIVMQKMMSKGK

SEQ ID NO: 11105 - protein, 54 aa, Xenorhabdus bovienii
  Coding DNA sequence: Name=SeqID_4997
MINRLNRRKNKTHTPFTLCLRDNALSLKFSPGLTTFLSTSSSASLSVRTSRLTA

SEQ ID NO: 11106 - protein, 34 aa, Xenorhabdus bovienii
  Coding DNA sequence: Name=SeqID_4998
MTLSYLLFVMYFMNIELIQFQYEKTEKEYKTALN

SEQ ID NO: 11107 - protein, 72 aa, Xenorhabdus bovienii
  Coding DNA sequence: Name=SeqID_4999
MTYTKNVILEMFYYINSLVFGSRQFIEASMVEAIEASPFMIMKINKAGPGLPIQFSFFAIELIMKSVKLEHL

SEQ ID NO: 11108 - protein, 136 aa, Xenorhabdus bovienii
  Coding DNA sequence: Name=SeqID_5000
MSDTDKKDKSKKIQKQSSHFIPYKTTYDLRLNKREPNLINILMQIQGYEYGFLTVLGVRPLSQRGNHKNSAIYVVRCRCGKYAVRTLKAIRNPANVTDMCEHCLHLYNLRRRNLFLTEGKEVGLSELTGIKYKKPL

SEQ ID NO: 11109 - protein, 31 aa, Xenorhabdus bovienii
  Coding DNA sequence: Name=SeqID_5001
LRFDVECPAYTLFSLRKISLSEMIKGTFDPA

SEQ ID NO: 11110 - protein, 34 aa, Xenorhabdus bovienii
  Coding DNA sequence: Name=SeqID_5002
MYRNLALPCRLREFCFRHSEEVILAGDQITGSHI

SEQ ID NO: 11111 - protein, 40 aa, Xenorhabdus bovienii
  Coding DNA sequence: Name=SeqID_5003
VTPQSGQRPEHVRSGFTTDLNPALLSETTKNRPLTTLLFD

SEQ ID NO: 11112 - protein, 305 aa, Xenorhabdus bovienii
  Coding DNA sequence: Name=SeqID_5004
  Homolog annotation: Query=1..301bp; Hit=1..301bp; Blast score=329; Percent Identity=57.0; E value=4e-89; Homolog= ref|NP_458670.1|
MAQGSTRSKVELFRKAFITHARQAGGSFVTVADRERMARQFLDYLKNNGIKLRQMDSLKVKYIERYMAERKANNLSHRTLQNEMSVLRAILTQAGKHKLADPENDRLSNRALGIAETSRKGTKITLTPAAFRDIFQQVEQKDRSVAAVMQLAYVLGLRTKEAVEAYKSLATWKKALENGHTSVRVVFGTKGGRSRQTTILDRAALQHAIAYAEQEQAGHSGKLIDKPTITQAIDRYRYIVRRAGLSGNKAPHSMRYHFAQQSGEHYIAQGFSEREALALVSMDLGHGDGRGRYIRQVYYQNIEGE

SEQ ID NO: 11113 - protein, 1039 aa, Xenorhabdus bovienii
  Coding DNA sequence: Name=SeqID_5005
  Gene classification: Gene name=HsdR; Function=Restriction enzymes type I helicase subunits and related helicases; Function class=L DNA replication, recombination and repair
  Homolog annotation: Query=5..957bp; Hit=2..919bp; Blast score=345; Percent Identity=29.0; E value=1e-94; Homolog= L0308 COG0610
VTYTSEAQFEQDVITELCKKGWEDKVLTNLTETDLLKNWADILYQNNNSIDRLNNVPLSQSEVQQIIEQIIALKTPLKLNGFINGKTVSIKRDNAADTLHYGKEISLNIYDRQEIAAGKSRYQIVQQPRFERKSAVQHDRRGDLLLLINGMPVIHLELKRSGVPVIEACNQIEKYTHEGHFSGGIMALVQVFVAMNPDNTLYFANPGKDGIFNHDYHFQWADFSNEPINHWQKVIEGLLSIPMAHQLIGFYTVADNADGILKVMRSYQYYAANAISSKVASLDWSIKNKGGYIWHTTGSGKTMTSFKSAQLIANSGDADKVVFLMDRIELGTQSLEEYRSFADASDDVQGTENTHVLIAKLKSIKPSDGLIVTSIQKMSNIHDEGQLKTADIDCINQKRIVFIVDEAHRSTFGDMLSIIKATFPNAVFFGFTGTPIQEENQKKDSTTSTIFGDELHRYSIADGIRDGNVLGFDPCKVMTYRDDDLREAVALEKAKATSVAEVFADTAKTKIYEKYMDSARVPMATQEINGKKVRGIEELLPATQYDRIEHKQQVINDILANWVRFSRGNQFHGIFATHSITDALQYYRLFKQQAPQLKITALFDPNLDNKGNAVTKEAGLVEVIEDYNKTYNTTYTLPTHAQFKKDIATRLAHKKPYQYVEQQPDQQLHLLIVVAQMLTGYDSKWVNTLYLDKELEYANIIQAFSRTNRLFGIDKPFGNIRYYRKPHTMELNINKALKLYSGDRPYGVFVEKLEDNLHSLNEKFAEIEIIFKNAKISDFSQLPKDEETRAKFASLFNEFSKTLEAAKVQGFNWQENSYSFEETGNTVDIDFDENQYQAMLQRYKELSSSSGNGGSAPAVPYAILGYLTKQNTGRIDHNYMNAQFTKFLKQCDQPNVTSEEMQQTLDELHKSFATLSQAEQKQANKLLLDVQAGNLIIEAGRSLQDYITRAQAEEEDKALQVMVDALGLDGKQLKKLTKGNLTAANLNDYGRFDALKATVDKAKAKAYLEDKLGTKLTPPKVNIELNKLLREFILQGATD

SEQ ID NO: 11114 - protein, 389 aa, Xenorhabdus bovienii
  Coding DNA sequence: Name=SeqID_5006
  Gene classification: Gene name=HsdS; Function=Restriction endonuclease S subunits; Function class=L DNA replication, recombination and repair
  Homolog annotation: Query=3..389bp; Hit=2..407bp; Blast score=112; Percent Identity=27.0; E value=6e-25; Homolog= L0310 COG0732
MSKEKTFQPALRFNRFEGDWQELPLSQIALSFEYGLNASAVKYDGVHKYIRITDINDDTREFDKDSLTTPETNLALADNYKLEYGDLLFARTGASVGKTYYYKQTDGLVYYAGFLIRAKIRPDHDVRFIFQNTLTYDYERFIKVMSQRSGQPGVNANEYGQFEIKIPGLKEQTQIGTFFQHIDQQLKLHQSKHTKLQQLKKSMLGKMFPKAGAKVPEVRFAGCDGDWKPTSLADVVDVRSGRDYKHLNKGSIPVYGTGGYMLSVNKALSYNEDAIGIGRKGTIDRPFVLRAPFWTVDTLFYSVPKLNNELQFTYALFQKVNWKDKDESTGVPSLSKVAINGIPVISCSLREQTKIGKYFQNLDRLIELQQQHINKLKNIKQACLEKMFV

SEQ ID NO: 11115 - protein, 864 aa, Xenorhabdus bovienii
  Coding DNA sequence: Name=SeqID_5007
  Gene classification: Gene name=HsdM; Function=Type I restriction -modification system methyltransferase subunit; Function class=L DNA replication, recombination and repair
  Homolog annotation: Query=6..471bp; Hit=8..473bp; Blast score=348; Percent Identity=42.0; E value=2e-95; Homolog= SPy1906 COG0286
MNKQQLAAKIWESANQMRSKIEANDYKDYILGFIFYKFLSDKQIQFLIQNEFDEQSIKELNEGDTDTLKYIQDELGYFIAYDNLFSTWISDGKDFDIAYVRDALSAFSRLINPDHKDLFDGIFTTLETGLSKLGESAAAQTKAAMNLIHLIDGIPMKDKHDYDVLGFIYEYLISSFAANAGKKAGEFYTPHEVSVLMSEIMAEHLKNHKHIKIYDPTSGSGSLLINIGQSVERRLDGENNIRYYAQELKQNTYNLTRMNLFMRGILPNNIITRNADTLEDDWPLDEDKTHEPMRVDAVVSNPPYSQKWDPEFKDKDPRYSPFGLAPKTKADYAFLLHDLYHLKPDGIMTIVLPHGVLFRGGDERKIRENLIEKNHIDAIIGLPANIFFGTGIPTIILVLKQTRNNDDVLIIDASKGFVKEGKNNKLRACDIKRIVDAVVTRKPQEKFAALVSRDTIRDNGYNLNIPRYVDSSDAAESWDIYASMFGGIPNNELDALKHYWQSMPNLKASLFKLTSSNYSALKVADVRAEIEADCDVQQFMATYQKAFSDFEAYLTKSLIKELLQVKPSRQQDIISEEIFRRLEGIALIDKYDAYQLLDDQWQQLSADLEMIQTEGMNTCKVVEPNMVTKKQKGKDVQVQDGWFGRIFPFALVEKTYFVEDLAKIQIMAERLQSIESEVQEIFDSLSEDDKEAEYVNDDKTAFVNATLNKEVKQIKADKKKGETLDNDSFESKLLAVDKLQTEDKSLKVNLKAANEALLEATRKKIENLTQDEIDHLLLLKWIKPIVNSLGKLPNQVLQQLTSKLEALAGKYTQTYADIAQETRQVEQSLAAMMGELQGNEFDMQGLKELQQFLFGEKLQGGTDE

SEQ ID NO: 11116 - protein, 314 aa, Xenorhabdus bovienii
  Coding DNA sequence: Name=SeqID_5008
  Homolog annotation: Query=1..312bp; Hit=1..317bp; Blast score=241; Percent Identity=41.0; E value=1e-62; Homolog= ref|NP_931447.1|
MKKLKDQFLEVSDALELGNPAIIEKDYWVVALLAELAKLAFDTHQMVFSGGTALAKSNVKILRMSEDVDIKLIPTDAFNSFGRDKRKATRKALVQQIEKSLTHQSSHFSIKEKKARDEYRYVEYELKYPQQFRQAPCLRPIIKLELMETIPLLQIEQRSIQSLVAELYHQPHEVNAFSCISVQSTLVEKVISMLRRTMLVKRDFERKDDATLIRHIYDVHCIDAEQKLDFETLMPLFQTVLQEDVMRFGNQHAEFVANPVQELQLGLQELESNQLFRKRFTDFVTPMVFDTETPDFDTCFASFKRIAQSLMNSN

SEQ ID NO: 11117 - protein, 134 aa, Xenorhabdus bovienii
  Coding DNA sequence: Name=SeqID_5009
  Homolog annotation: Query=1..134bp; Hit=17..150bp; Blast score=223; Percent Identity=84.0; E value=4e-58; Homolog= ref|NP_762163.1|
MTAADRINQKLKRSRRYVFERKDFEDIASYDQIGRALNQLIKQGELMKIGYGLYTKARKNSLTGRLMPTNPGGTDAILREILKMKGVDFEVDSLSLQSLSGNSTQIPSSVQYSWNPKQFNRKLVVGNRVLNSPS

SEQ ID NO: 11118 - protein, 51 aa, Xenorhabdus bovienii
  Coding DNA sequence: Name=SeqID_5010
  Gene classification: Gene name=XerC; Function=Integrase; Function class=L DNA replication, recombination and repair
  Homolog annotation: Query=1..50bp; Hit=158..207bp; Blast score=72; Percent Identity=64.0; E value=7e-14; Homolog= CC1766 COG0582
MRRTKATLIYARTKNIRAVQLLLGHVKLDNTIRYLGVEIEDALKLSENIDS

SEQ ID NO: 11119 - protein, 73 aa, Xenorhabdus bovienii
  Coding DNA sequence: Name=SeqID_5011
  Homolog annotation: Query=11..72bp; Hit=35..96bp; Blast score=61; Percent Identity=53.0; E value=3e-09; Homolog= ref|NP_762607.1|
MILVGMVLSINRVFYRQNKTDRDVQFEITSRTAQSITLWVSLRRLTTSDYLFPSPRKIGNPMSYSYYASIIRR

SEQ ID NO: 11120 - protein, 62 aa, Xenorhabdus bovienii
  Coding DNA sequence: Name=SeqID_5012
LKCISRHSNLTWQLAIYFLIIVRSLPTFGLTHLCPRTYRGMIIASMFLPHNHLSQPLPLGFT

SEQ ID NO: 11121 - protein, 63 aa, Xenorhabdus bovienii
  Coding DNA sequence: Name=SeqID_5013
MCVMFFHKYLLCALKPTSSADEIKKLQVRLTKEGIDQHKAPVSTNLWSPKRFEYPPMFMLSLI

SEQ ID NO: 11122 - protein, 53 aa, Xenorhabdus bovienii
  Coding DNA sequence: Name=SeqID_5014
MKKHNAHQDQQVNQKTRPKKWETVFSIIKFILVWIYRIWLLLRMLEGTERGDE

SEQ ID NO: 11123 - protein, 106 aa, Xenorhabdus bovienii
  Coding DNA sequence: Name=SeqID_5015
  Homolog annotation: Query=5..95bp; Hit=1..90bp; Blast score=67; Percent Identity=37.0; E value=5e-11; Homolog= ref|NP_487002.1|
MDYLMIHKALKLIRQYHELTVSDLANEFGLTPLYLKELESGNRPIESELLEMYSSKFDIPVTSLVMFSQNIHKEGKLAKKFRQLMVGKVLVIADWAINKNDKKIKA

SEQ ID NO: 11124 - protein, 316 aa, Xenorhabdus bovienii
  Coding DNA sequence: Name=SeqID_5016
  Homolog annotation: Query=12..266bp; Hit=7..264bp; Blast score=151; Percent Identity=35.0; E value=1e-35; Homolog= ref|NP_487001.1|
MTKKSKLKIVTRKKSYTLQDSPFYKLKSKKKLTNLLKVDMETLLRMMNDTENYNEFEEKGKKGKVRKIQHPVGELDVVHTRIASLICRIATPSFLHSGKKQHSNVGNARIHCNSFPLMTTDVCSFFPSTKRSMVFSFFYTVMECSSDVADILSHICTIHGHLPTGSRISMPLAYWANCRMFSELEQLAIKHNVTMTLYVDDLTFSGNHVNPLFKSITRQIIERHGHQMHPTKTKLYRGKEPKLVTGIVIKDEIVFVRNEQRMKLVSDITCWKSIKDIPNAINMQITLTLLGRLYALSSIDPKFKDRARTIKANTQK

SEQ ID NO: 11125 - protein, 460 aa, Xenorhabdus bovienii
  Coding DNA sequence: Name=SeqID_5017
  Homolog annotation: Query=1..460bp; Hit=1..460bp; Blast score=872; Percent Identity=97.0; E value=0; Homolog= ref|NP_927691.1|
MFSTCAEQWANDTFQHAELGDKRRTNRLVKVACSLANHIGQSLVQSLDSPADVEAAYRLTRNSAIVPQAIAEAGFTATVAHAQRYHCLLALEDTTTLSFSHASVADELGYTTSKKKSRGMQAHSVLLFAPEEQQVVGLIEQQRWCRDVSDYGKSRQRDTRPYEGKESYKWERASQAVDSRLGEQMANVISVCDREADIIEYLRYKTSQKQRFVIRSMHSRRIEESQDRLYDFISQLQSAGARLVQVRQKGGRQARVAHCDISYAEVTLKIPEGKSGEAVRIFYVGCYEKGTEDGLCWHLLTSEPVNSQEDAHKIFSYYERRWLIEEFHKAWKTGGTQVEALRMQSKDNLERMIVLLAFIAVRIHPLRFMGLNKEEAEKESCETVLSPLAWKLLWSKQEKRRPPKKAPSLHWAFINLGKLAGWYDSKRTGRVGWERLWEGWFRLQTLIDGYLLAKSVDLEI

SEQ ID NO: 11126 - protein, 198 aa, Xenorhabdus bovienii
  Coding DNA sequence: Name=SeqID_5018
  Gene classification: Gene name=XerC; Function=Integrase; Function class=L DNA replication, recombination and repair
  Homolog annotation: Query=5..197bp; Hit=15..207bp; Blast score=160; Percent Identity=44.0; E value=8e-40; Homolog= CC1766 COG0582
MVVSNKSRRSGIKKPFRLEEIWHIRTRLEIENNLMQLALLNLAIDSKLRASDLLTLKVCDVSSQGMVFDRVRHAQRKTDIEVQFEITSKTQNSLIKWMLSASLTAGNYLFPSLRRKQQPISYSYYRHLVRTWASNLGLDPNFYGTHSMRRTKATLVYAKTKNIRAVQLLLGHAKVDNTIRYLGVELEDALRLSEGTDG

SEQ ID NO: 11127 - protein, 590 aa, Xenorhabdus bovienii
  Coding DNA sequence: Name=SeqID_5019
MSEMIHSSLLPSQSFNSIRVISAKEFGIESGVCNRKLLQDLQDRSELLRIPIDFSGIREICFDGYISIGDWFHWRSSGRFDTTIKPVSLTRATVGSNGYGIYAWFTRKDPEQNLTYAMLEDIGMDGQYQGGYEIKVESLIRGFCWHADRDSVLTDITALRCHFKNMPHEAWEGYTTNGGTIDGIRYLYCSSEGEDPEKTSVGFNAFKCMNGSIDSPSEYGIYTIRNIVSRGNTARGHRTLTDLKRGCEKWSISLCNTYDMNDCHHSTDGSRDGIFSDNIGEQTGKSYRNKNFLEIQGENITVTSSIFKGAPDDKRAGVAGILITNYQYPSLPGSNESKNIHISNCQVNNIDNGAIRIINASNVKVNGLSINNCKNGVSFERNLGMNKPLFNTIEDIVTHDSDTGLIVSTDYPLLINTPPINGKMACKINNGTIIYRFKKPYFCNYPPSIENSDILLKNIAGTSSDDRPIGIPYAIELDDSEPLSVREYSAALIPVLEDDIIYFSCHVKELGSPESSFLIREYIDNEIKYSEFIRTGARNDWNEFFVIYHPSVQGVNKIEILLCPATDDLGNTSLQGKTLFSKMIISKRPI

SEQ ID NO: 11128 - protein, 346 aa, Xenorhabdus bovienii
  Coding DNA sequence: Name=SeqID_5020
  Gene classification: Function=Predicted transposase; Function class=L DNA replication, recombination and repair
  Homolog annotation: Query=15..299bp; Hit=1..281bp; Blast score=306; Percent Identity=55.0; E value=2e-83; Homolog= Z4330 COG3335
MPIIAPIPRSERRQMKKFIHKTRDKDYARRLIALLMLHEGKTVSGISRTLHCSRSSVNRWINWFTLYGLEGLKSLPSGRPTTWNLAPLFSLLSFLLQHSPQDFGCLRSRWSIELITRIINELFGLSLSQSTFYRDFCQVGIVWRRAAPTVKKPDPEYDEKRAKITEALSSVSEQHPVFYEDEVDIDLNPKIGADWCLKGQQKRVMTPGKNQKHYLAGCLDAQTGQVTYVSGIKKNSDLFIKMLKKLNGQYRHAKNITLILDNYGIHKSRKVSAWLQQNPKFNLLFLPVYSPWINKIERLWQSLHETVTRNHCCQYMWQLLKCVEAFINAFSSGQQPGMRKMSVSLL

SEQ ID NO: 11129 - protein, 592 aa, Xenorhabdus bovienii
  Coding DNA sequence: Name=SeqID_5021
  Gene classification: Function=Predicted ATPase; Function class=R General function prediction only
  Homolog annotation: Query=457..579bp; Hit=405..522bp; Blast score=63; Percent Identity=29.0; E value=7e-10; Homolog= APE0107 COG0433
MSIAIGEVISVKGTNITVELYEESNNETLFYNGEKFNGVSIQEFILIRRGFKDIVARVQGEYLDERLKDEESGCYIRKVELVPIGHFQFNEFHEGIKHLPMIRDIAYLMSDTQVKSIFGKPDDNFVVGETLTEEIPISLPWVKLFNTHIGIFGNTGSGKSNTLTNIYTTLFRNKLDKLINKSHFVVIDFNGEYTNNQLISKDKYKKVYQLDTRNDDGDKFPLTSDVFWDEELFGILFKATENTQKPFLKRIVSGRNRFKDNPDSLQKYVKSTIERALTSTAQKKEFVALIEEIAKLVGSQDLEKKVREIGWHGERSRLYFPNTPHPNYFNGGDNDLTYNHHCRAYVDDINIRELSPFNELKLRINTQLLSDLISGYVQFDHIQPLLKRVEASLTALDRVFDVREERPANMLLSVVSLRRTNQEIKKVMPLLLAKFYYGEHKQKVMNQSPPEQTFHMIIDEAHNILSTQSSRESESWKDYRLELFEEIIKEGRKFGFFLTLSSQRPADISPTIMSQLHNFFIHRLVNERDLKLLENTISSLDELSRQMIPNLSKGCSIIIGTSFDVPMVVQFNVMPDGSRPDSDDIDIESLWN

SEQ ID NO: 11130 - protein, 400 aa, Xenorhabdus bovienii
  Coding DNA sequence: Name=SeqID_5022
  Homolog annotation: Query=17..348bp; Hit=20..366bp; Blast score=152; Percent Identity=32.0; E value=1e-35; Homolog= ref|NP_816004.1|
MTAEFNLHQIYDHNLNFLVGAGASNGFLPTLALEVKGLDGSKCTFETLAKKYESNKEMTTLLFMLYYRECIKPGLPSVPAKGIPAPPRPPHEESVIQEYKRFMTTLIHLLNKQKPSAKKANIFTTNYDNCFEIASEELMAERTSQFEVNDGSTGFQARTFHTRNFNNRIVNKGVFDRHEQFLPQVNLLHAHGSVHWMKGNKDGDIELNYGTSCYNIDFNQDENNILDACKVILYDTNKSLNDLSVFEAHTDFTKLRSEQFGQDYNKMPIVNPTKWKFHETVFEEAYYQILRHLSYELERPHSVLIAFGFSFADEHILSLVQRALSNPSLTMYVMCYDESTKDRMSEIFRKYPNVKLIYSEDRKLDFTLFNDEYFTVNKLNKPMPEETMKPMLEAVVGGVK

SEQ ID NO: 11131 - protein, 54 aa, Xenorhabdus bovienii
  Coding DNA sequence: Name=SeqID_5023
MSIERLNSHRIRRHRLATQIQNLTHIDSLAKFGQREKLKRMTFWSIKQFGAKAS

SEQ ID NO: 11132 - protein, 30 aa, Xenorhabdus bovienii
  Coding DNA sequence: Name=SeqID_5024
MICQSKSEISQYIYFILVQLTPYRASISSD

SEQ ID NO: 11133 - protein, 303 aa, Xenorhabdus bovienii
  Coding DNA sequence: Name=SeqID_5025
  Gene classification: Function=Uncharacterized ACR; Function class=S Function unknown
  Homolog annotation: Query=3..302bp; Hit=1..299bp; Blast score=416; Percent Identity=66.0; E value=1e-116; Homolog= jhp0648 COG1912
MDIRTTLRAASLSLALVSTVTVANEALVFQTDFGLKDGAVSVMKGISFKVNPSQPIYDLTHEIPPYNIWEASYRLYQTLPYWPKGTVFVSVVDPGVGTDRRSVVLKTQSGHYIVSPDNGTLTLVAEHFGIESVRQIDEKFNRVPGSEKSYTFHGRDVYAYTGARLASGIISYEQVGPLLPNKVVKIPYQTGVAERDGTLKGTIPVLDVRFGNVWSNINDSQVSKVGIHKGDQVCIKISEGDKIRYEGKAPYVSSFGEVPEGQPLVYLNSLLQVSVALNMDNFAARYQVQSGDNWRISLKKCSD

SEQ ID NO: 11134 - protein, 42 aa, Xenorhabdus bovienii
  Coding DNA sequence: Name=SeqID_5026
LGESERGCQYEVTRSGRLSKSFMPQNVLHTTPVKKVKLDGVT

SEQ ID NO: 11135 - protein, 82 aa, Xenorhabdus bovienii
  Coding DNA sequence: Name=SeqID_5027
VRRCTTQCVLPCRLQECCCRCPKVILTSDRIMDKSDYANKRKSLGQWVIHFSGQKIMSGTRRDFGGVRERLSIRGDPFWSFV

SEQ ID NO: 11136 - protein, 94 aa, Xenorhabdus bovienii
  Coding DNA sequence: Name=SeqID_5028
MIRSLVRITFGQRQQHSCSLQGSTHCVVHLRTFGSRYRQSDDDEGLLISSMMANRPVTQRGTHFPLGQVFSVVLSGEYHATKYNPGHGAHCVPG

SEQ ID NO: 11137 - protein, 144 aa, Xenorhabdus bovienii
  Coding DNA sequence: Name=SeqID_5029
MQQNTIPATVHTVSPAELSPFAEIFPHTGSLELMLLEHTFIKAAAVLCDDDRCDRWQYRKVSDSIAYIVPMRPDSSVVNVDTTDFKGEVSADAFGLMVTLSVLGYLAALMKLDGYAERFCDLREYALQHPQASCIRAALGLKGA

SEQ ID NO: 11138 - protein, 153 aa, Xenorhabdus bovienii
  Coding DNA sequence: Name=SeqID_5030
MPNNELIMLDSLALSVVFPDKTPLERLFLGFLLANTASTLCGDYQPEQWTSRQVSESLTYMVPTRAKTYSVYLPVTQLTVTLSADAFGLAVTAIVSARIAVPDTQNEEAYRFCALQAYAQQHLESGLIASVMTLKPEEDVISPSLIPNKNNHH

SEQ ID NO: 11139 - protein, 41 aa, Xenorhabdus bovienii
  Coding DNA sequence: Name=SeqID_5031
MEFMVLFLDFMSMKENTRPIPGRCFGFPGQALKKSVNSLMG

SEQ ID NO: 11140 - protein, 185 aa, Xenorhabdus bovienii
  Coding DNA sequence: Name=SeqID_5032
MNSIFLPAPDETDTALREELFTAQVTGLRQHPKAPQSLPPETLMVCEASTVTEVVQRLKVIHLLGDWPVPERLSAQVAGAFFPLTVMIFDAQDRKVLGGRFDEEIIWAQPVTLTSERLSLEQQQQRLCQAAMLEQSWQNTPAARALWHKVHLLSLHGVSSCYQQCHEVRDILRYGVSVSAFSEGA

SEQ ID NO: 11141 - protein, 98 aa, Xenorhabdus bovienii
  Coding DNA sequence: Name=SeqID_5033
MATLHLTVWQVIAAALLKRHFGLSLTDTALCETDTVAELIAGGVRPSEAINELVDKYDLTRLNTQVIPRSTPYLDIHDELTVIFDSGLAEMLFRQTRP

SEQ ID NO: 11142 - protein, 307 aa, Xenorhabdus bovienii
  Coding DNA sequence: Name=SeqID_5034
  Homolog annotation: Query=1..269bp; Hit=1..271bp; Blast score=196; Percent Identity=39.0; E value=6e-49; Homolog= ref|NP_928474.1|
MAEWCTNQLEITGKSVCLDVMQQWVCGEEVPRYRQAVLQSLRLFLAGCAGILKPTKPQTYTPYPALVRGTAVPTAQHLAFEQWLLLLQNNVPLNTDNIKRIDNLYRQSGLSLMSWDKVPEAARDIMARLLTRQYTDWFGMVGWSDTPDIGACWDKLNAYPQAAQPCDMLMMMSTNLATEINGNSTLLKGIATTAQFYDEQYGMEWPFGHHVRWERRNVSSLTVRFDSPWAPPSAELMGELSAMFDCEIRHWYSEASGQLKGYDCYDQGEHVDSGHGQSGRENRPALYLVTGEQAETALALPAIAVGQ

SEQ ID NO: 11143 - protein, 228 aa, Xenorhabdus bovienii
  Coding DNA sequence: Name=SeqID_5035
  Homolog annotation: Query=6..222bp; Hit=15..230bp; Blast score=237; Percent Identity=53.0; E value=1e-61; Homolog= ref|NP_928475.1|
MASRTDHQKEFISLFKQTARYHTRYQVFRDFCNCAMAAIHNKHCFSEELEQYYLKTINKYERADVDRIVQLFSHVVLGLAQEPGDFLGSVFMRLELGDKDLQQFFTPWSVARMMVQMQLQDAAGLLQTQPFVTLCEPCCGAGCITLAAAEVLRELGHDPLCSLWVYAIDIDPLAAVMAYIQLSLTGIPAAVTIGNALHDGGDKRTRYTPAHYLGNWSQRLREAELIAA

SEQ ID NO: 11144 - protein, 352 aa, Xenorhabdus bovienii
  Coding DNA sequence: Name=SeqID_5036
  Homolog annotation: Query=79..328bp; Hit=26..275bp; Blast score=200; Percent Identity=44.0; E value=3e-50; Homolog= ref|NP_928477.1|
MVLIQWVMVKIKLILSVSQGMNRVRLIFIFAKRVVPCFRPGFTDTEPNLNRKRKTMFQRFKSRFTRDLSPSQKAPGLAPERVRGAGGYFRPQSAEVLLVTSERGQYLRQLWENSALPAGLYQQFYLDPLRQLCARVQHVPATQEGIWSYRGGFIDLTLQFTACAVRLAKGHMLPPGVAPETQAAQSLLWQSVVFWAALFYHLPLLRQLEGELEDGHHWQPGLWIPERRFRFRFQAPRPELPVLYKTLLAARLLPEEAVTWLSLVPGAWQCLMLHLGGHPSSVPLTDSLLQSAAEQVQSPLLNPVESAKPATDTRLSSSEPDPVIPPVTPGTVPAPDTTEDTRRLLSLFQAEE

SEQ ID NO: 11145 - protein, 40 aa, Xenorhabdus bovienii
  Coding DNA sequence: Name=SeqID_5037
MTFCTLQKQGLPALMRCVRTISNRYRYHLHSFSSKFHSSA

SEQ ID NO: 11146 - protein, 335 aa, Xenorhabdus bovienii
  Coding DNA sequence: Name=SeqID_5038
  Homolog annotation: Query=6..333bp; Hit=2..323bp; Blast score=329; Percent Identity=55.0; E value=4e-89; Homolog= ref|NP_928478.1|
MLNNEEKMGWDALLDEYFFSRMLRPATEWSYRKVVRVFIRYMGETGLPESVTHRDVLCWRRHLLMEKNQSGYTWNNKVAHLRAIFNFGMERKLLSHPKNPFNDAAVKKEKKQKKTLSKAQITGIYLRMQQYEEEERLQTAPRGGRCALYPTGYWLTVLDTFRLTGMRLNQLLHLRLRDINLDNSYIELRVEGSKNHSEWRVPMIPQLKPRLAQLVEQAKACGAKEDDPLFDLTRLRFCHHGRHVSHQYHHDREKQHLRSFFNRLSKECGFAVSPHRFRHTLATELMKAPDRNLQLVRCLLGHRSVATTMEYIDIDMEIAGKTLANELAFYLDLAV

SEQ ID NO: 11147 - protein, 91 aa, Xenorhabdus bovienii
  Coding DNA sequence: Name=SeqID_5039
  Homolog annotation: Query=1..84bp; Hit=582..670bp; Blast score=138; Percent Identity=75.0; E value=2e-32; Homolog= ref|NP_405916.1|
MRYSYDNLVGSSGLEVDGDRQIISMEEYYPYGGTAVWTARNQTEAGYKTVRYSGKERDATGLYYYGYRAGRWLSPDPAGTVNSVFERGFIE

SEQ ID NO: 11148 - protein, 96 aa, Xenorhabdus bovienii
  Coding DNA sequence: Name=SeqID_5040
  Homolog annotation: Query=1..94bp; Hit=39..132bp; Blast score=101; Percent Identity=54.0; E value=3e-21; Homolog= ref|NP_458745.1|
MGEAVLPEQVTHRDVLRWRYHSLVEKKQSGHTWNNKVAHLRTIFNFGMARTLLPQTENPFNDAAVKKEKKKKKILSKSQIIHLYLLMRQYEEEERR

SEQ ID NO: 11149 - protein, 137 aa, Xenorhabdus bovienii
  Coding DNA sequence: Name=SeqID_5041
  Homolog annotation: Query=1..123bp; Hit=144..260bp; Blast score=112; Percent Identity=52.0; E value=1e-24; Homolog= ref|NP_928358.1|
LYLTGYWLTVLDTFRLTGMRQNQLLHLRLQDISLEGNYIVLRVEGSKNHSEWRVPMIRQLKPRLAQLAGQARACGEKDDDPLFDLTRLRFRHHGRTISYQYNYDKEMQHIRSFFNRLSKECGFPSPLTVFVIHWQRN

SEQ ID NO: 11150 - protein, 357 aa, Xenorhabdus bovienii
  Coding DNA sequence: Name=SeqID_5042
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=1..357bp; Hit=2..359bp; Blast score=549; Percent Identity=77.0; E value=1e-156; Homolog= ZmltC COG0741
MKRLLALILLTPLLISCSSKKDIEYNEAYVKDTNGFDILMGQFAHNIENIWGLQEVLIAGPKDYVKYTDQYQTRSHINFDAGTITIETLSPIEPSEHLRKAIITTLLMGDDPGSVDLYSDINDIQISKEPFLYGQVLDNAGETIRWEWRARHFANYLLQNKLQKRQSGLHMIWTVTIQLVPNHLDKRAHKYLPMVRKAAIKYGVDESLILAIMQNESSFNPYAVSRSDALGLMQVMQHTAGRDVFKMQGKSGQPSRSYLFDPENNIDAGTAYLSILQNIYLGEINNATSRRYAVITAYNGGAGSVLRVFSSDKKKAAQIINTMAPGDVYETLTNKHPASESRRYLMKVNNTQKVYRR

SEQ ID NO: 11151 - protein, 90 aa, Xenorhabdus bovienii
  Coding DNA sequence: Name=SeqID_5043
  Gene classification: Function=Uncharacterized BCR; Function class=S Function unknown
  Homolog annotation: Query=1..90bp; Hit=1..90bp; Blast score=139; Percent Identity=83.0; E value=4e-34; Homolog= yggX COG2924
MSRTIFCTFLQREAEGQDFQLYPGELGKRIFNEISKEAWQQWMSKQTMLINEKKLNTINPEHRKLLEQEMVKFLFEGHDIKIDGYTPPEK

SEQ ID NO: 11152 - protein, 345 aa, Xenorhabdus bovienii
  Coding DNA sequence: Name=SeqID_5044
  Gene classification: Gene name=MutY; Function=A/G-specific DNA glycosylase; Function class=L DNA replication, recombination and repair
  Homolog annotation: Query=1..344bp; Hit=1..344bp; Blast score=532; Percent Identity=73.0; E value=1e-151; Homolog= mutY COG1194
MEAEQFSQAVLEWYHRYGRKTLPWQLEKTSYHVWLSEVMLQQTQVATVIPYFQNFISRFPDVASLAAAPLDEVLHLWTGLGYYARARNLHKAAQQIVAIHSGQFPTTFDGVIALPGVGRSTAGAILSLSQGKHFPILDGNVKRVLARCYAIAGWPGKKEVENQLWDISTHVTPEQGVEYFNQAMMDLGAMVCTRSKPKCEICPLNTGCIAYANHSWASYPGKKPKQTIPEKTAYFLLMQHGDTVWLEQRPLSGIWGGLFAFPQFTDQASLEQWLKDSGISHSKPDQLIAFRHTFSHFHLDIVPIKIDILSFDSCMDESKGLWYNLRQPATIGLAAPVEYLLQQLG

SEQ ID NO: 11153 - protein, 240 aa, Xenorhabdus bovienii
  Coding DNA sequence: Name=SeqID_5045
  Gene classification: Function=Predicted S-adenosylmethionine -dependent methyltransferase; Function class=R General function prediction only
  Homolog annotation: Query=1..239bp; Hit=1..239bp; Blast score=371; Percent Identity=73.0; E value=1e-103; Homolog= yggH COG0220
MINNVISPEYDENGRALRRVRSFVRRQGRLTSRQQQALDDVWPKMGMDYQPELFDMSELFGREAPVVLEIGFGMGASLVMMAGQNPEKNFFGIEVHVPGVGACLASAEDENLSNLRVMCHDAIEVLENMLPEQSLEMVQLFFPDPWHKARHNKRRIVQPEFAQLIRSKLKIGGVFHMATDWQPYAEHMLKVMSVAEGYCNVSENSDYVPRPDSRPVTKFEMRGQRLGHGVWDLMFKRVKY

SEQ ID NO: 11154 - protein, 216 aa, Xenorhabdus bovienii
  Coding DNA sequence: Name=SeqID_5046
  Gene classification: Function=Predicted S-adenosylmethionine -dependent methyltransferase; Function class=R General function prediction only
  Homolog annotation: Query=1..216bp; Hit=24..239bp; Blast score=331; Percent Identity=72.0; E value=3e-91; Homolog= yggH COG0220
VRRQARLTSRQQQALDDVWPKMGMDYQPELFDMSELFGREAPVVLEIGFGMGASLVMMAGQNPEKNFFGIEVHVPGVGACLASAEDENLSNLRVMCHDAIEVLENMLPEQSLEMVQLFFPDPWHKARHNKRRIVQPEFAQLIRSKLKIGGVFHMATDWQPYAEHMLKVMSVAEGYCNVSENSDYVPRPDSRPVTKFEMRGQRLGHGVWDLMFKRVK

SEQ ID NO: 11155 - protein, 30 aa, Xenorhabdus bovienii
  Coding DNA sequence: Name=SeqID_5047
LTAQLMPLLKNWLNQTVWRWMPAAIYSGKV

SEQ ID NO: 11156 - protein, 41 aa, Xenorhabdus bovienii
  Coding DNA sequence: Name=SeqID_5048
  Gene classification: Function=Uncharacterized BCR; Function class=S Function unknown
  Homolog annotation: Query=1..41bp; Hit=78..118bp; Blast score=59; Percent Identity=65.0; E value=8e-10; Homolog= ZyggL COG3171
LICLQKIGKCTEEHRQLVEKWLKDRGMEDVALSELFDVWWD

SEQ ID NO: 11157 - protein, 36 aa, Xenorhabdus bovienii
  Coding DNA sequence: Name=SeqID_5049
MCGGIDSLLHKNSVLYRNNAVYRGSFGALVCLEKKW

SEQ ID NO: 11158 - protein, 308 aa, Xenorhabdus bovienii
  Coding DNA sequence: Name=SeqID_5050
  Gene classification: Gene name=GlsA; Function=Glutaminase; Function class=E Amino acid transport and metabolism
  Homolog annotation: Query=3..308bp; Hit=3..308bp; Blast score=434; Percent Identity=67.0; E value=1e-122; Homolog= yneH COG2066
VKVRFSNSLLADILDEVRPLIGQGKVAGYIPALAEVAVNNLAMAICTVDGQVFKAGDAEKRFSIQSISKVLSLTLAMTRYQEQDIWQRVGTEPSGQPFNSLVQLELEKGIPRNPFINAGALVICDMLQSRLSAPKHRMLEFVRSLTGQKHICYDDIVARSEMDHSSRNAAIAYLMKSFGNFENDVLTVLQTYFHYCALKMNCVELAQCFIYLANQGRMIGSGQQILSLRQTRQINALMLTCGMYDGSGEFAFRIGMPGKSGVGGGIVCVVPGEFTVAVWSPELNSSGNSLAGCAALEKLAERIGRSIF

SEQ ID NO: 11159 - protein, 240 aa, Xenorhabdus bovienii
  Coding DNA sequence: Name=SeqID_5051
  Homolog annotation: Query=1..240bp; Hit=1..240bp; Blast score=275; Percent Identity=64.0; E value=6e-73; Homolog= ref|NP_928485.1|
MLRRIAIAASLLFVAQVQAGSDCQTTIQDDIIVTSKSVQIVGASGNLRILPDGSMLRNGKALSLNSEQRGKAQQYQQAIRQDLPWVKTEALSHLTSARQALDKVVVNTMGKESNIRNRLSQLESGLNKQIDKVLETRSDGVAFNSQAIKKVESEGQNLIQQSLGGILQDSINEMSRKKSEQNGDGKQMLMSLLGGLGGMQNGFDAEWKKQEQELNRFKGEVCSKANQLEQLRTNLMNSIK

SEQ ID NO: 11160 - protein, 55 aa, Xenorhabdus bovienii
  Coding DNA sequence: Name=SeqID_5052
VTESSDAKTTGRIFFIVTPELRMLVISDSHSRWQHYDVNQIRINFILILIFSDVQ

SEQ ID NO: 11161 - protein, 321 aa, Xenorhabdus bovienii
  Coding DNA sequence: Name=SeqID_5053
  Gene classification: Gene name=FecB; Function=ABC-type cobalamin/Fe3+- siderophores transport systems, periplasmic components; Function class=P Inorganic ion transport and metabolism
  Homolog annotation: Query=48..321bp; Hit=37..315bp; Blast score=197; Percent Identity=39.0; E value=2e-50; Homolog= BS_yclQ COG0614
MRNSGVTMKKILPVVLASLLSVTSYSAFSQPSVLFTPNSVIVQSGDFVTVKHLSGETQVKKNPERIVLFDFGIYDSLVKLGLSDRVIALPVGNAPEYVRGNMSANMQNAGGMKEPDLEKLAGMKPDLIVITGRQGNFYPSLSKIAPTVNLDTDSKNYLSSVESNLKLLGELFNKQDAVKAQIVDLEKTIATAQEKAKSSDSKVLVLLHNAGNLYPNNQAIVYDVVKAQRAELPLPTDKEKSRVVTAEMIAQANPDAIFIIDRSKAIGAGELTKDQFENDQVKSTNAYKNGKIVYLQPDLWYLSGGGLDSMTRQINAVADVL

SEQ ID NO: 11162 - protein, 34 aa, Xenorhabdus bovienii
  Coding DNA sequence: Name=SeqID_5054
MPCKNCFKSRLFLMVMISIPTNSLEFSIHFPRLI

SEQ ID NO: 11163 - protein, 376 aa, Xenorhabdus bovienii
  Coding DNA sequence: Name=SeqID_5055
  Gene classification: Gene name=HemN; Function=Coproporphyrinogen III oxidase and related Fe-S oxidoreductases; Function class=H Coenzyme metabolism
  Homolog annotation: Query=1..376bp; Hit=1..376bp; Blast score=633; Percent Identity=79.0; E value=0; Homolog= yggW COG0635
MLKLPPLSLYIHIPWCVQKCPYCDFNSHALKGDVPHQEYVDHLLADLRADLPMIENREVSTIFIGGGTPSLLSAEGMQRLLDGVRASLPLSAQAEITMEANPGTVEAGRFSAYQKAGINRISIGVQSFGSDKLIRLGRIHGPDEAKRAAHLAADLGLRSFNLDLMHGLPNQTLNEALDDLRQAIELSPPHLSWYQLTIEPNTSFASRPPVLPDDDALWDIFSQGHQLLTAAGYQQYETSAYAKAGYQCQHNLNYWRFGDYLGIGCGAHGKISFEDGRILRTVKTKHPAGYMQGRYLDQQNQVDNEDRPFEFFMNRFRLLEAMPRHDFSDFTGLPESAIRPQLDEALAKGYITENATHWQITKHGKLFLNSLLELFL

SEQ ID NO: 11164 - protein, 197 aa, Xenorhabdus bovienii
  Coding DNA sequence: Name=SeqID_5056
  Gene classification: Function=Xanthosine triphosphate pyrophosphatase; Function class=F Nucleotide transport and metabolism
  Homolog annotation: Query=1..196bp; Hit=1..196bp; Blast score=316; Percent Identity=78.0; E value=8e-87; Homolog= ZyggV COG0127
MQKVVLATGNAGKVRELADLLTDFGLDIVAQTELGVDSADETGLTFIENAIIKARHAAAITGLPAIADDSGLSVNALGDAPGIYSARYAGIDASDRNNLEKLLEAMRDIPDEERQAQFNCVLVYLRHAEDPTPLIFHGRWSGIITHEPAGNGGFGYDPIFYVPEFSCTAAELSREQKSAVSHRGQALKMLLEAMLNA

SEQ ID NO: 11165 - protein, 190 aa, Xenorhabdus bovienii
  Coding DNA sequence: Name=SeqID_5057
  Gene classification: Function=Predicted integral membrane protein; Function class=S Function unknown
  Homolog annotation: Query=1..181bp; Hit=1..181bp; Blast score=156; Percent Identity=53.0; E value=1e-38; Homolog= VC0459 COG0762
MQFLNFIFLTILDLYIAVLLLRVWMQWVRCDFYNPFAQFIVKITQPVVRPLRRVIPAIGPLDTASIVFAYLIVLLKMLIPAWLATGQFVIPLAILFPVGLIELLTAAGKLIFWLVIARALLSWISQGRNPVDYVLIQLTEPLMSPIRRIIPAMGGIDFSAMIVILVLYALNALRYDVMGVVNFNDKRLIR

SEQ ID NO: 11166 - protein, 318 aa, Xenorhabdus bovienii
  Coding DNA sequence: Name=SeqID_5058
  Gene classification: Gene name=ProC; Function=Pyrroline-5-carboxylate reductase; Function class=E Amino acid transport and metabolism
  Homolog annotation: Query=46..318bp; Hit=1..272bp; Blast score=306; Percent Identity=58.0; E value=2e-83; Homolog= VC0460 COG0345
MIWKPLSPAALHWCALERQFSVPVSTILNPKLTGQNQLINMRDYLMENRKITFIGAGNMAHAIIAGLVRTGYPAGLITVCSPNTTRRDVLAKEYGINSENDNIRYAQEADVIVLAVKPQMMEEVCDSLRSQIDFSHKLVLSIAAGIPVSRFYTLLQDQLNIIRIMPNTPALVGQGLSGLFAPEHVTQPDRQFTESLMCGVGKVCWVNDENGINNIIAVAGSAPAYFFLFMESMQQEAERLGFDSQTARELVLQAVTGSAKLAESQADLPFAILREQVTSKGGTTAEALRIFYEGHLPEIVSRAMQAAIRRAQEMEKLF

SEQ ID NO: 11167 - protein, 233 aa, Xenorhabdus bovienii
  Coding DNA sequence: Name=SeqID_5059
  Gene classification: Function=Predicted enzyme with a TIM-barrel fold; Function class=R General function prediction only
  Homolog annotation: Query=1..230bp; Hit=1..232bp; Blast score=317; Percent Identity=68.0; E value=7e-87; Homolog= yggS COG0325
MNNIKQNLHDVRNRIALTAQNCGRSPQEITLLAVSKTKPADAIAKAIATGQREFGENYVQEGVEKVQHFANHHDLVWHFIGPLQSNKSRLVAEHFDWCHTIDRLKIAQRLSEQRPENMAPLNILIQINISGEDSKSGIILESLPELAKTINALPNLVLRGLMAIPAPESDFERQMAIFHQMEQAFIELKTQYPRVDTLSMGMTDDMEAAISCGSTLVRIGTAIFGARQYNTQP

SEQ ID NO: 11168 - protein, 336 aa, Xenorhabdus bovienii
  Coding DNA sequence: Name=SeqID_5060
  Gene classification: Function=Predicted ATPases involved in pili biogenesis, PilT homologs; Function class=N Cell motility and secretion
  Homolog annotation: Query=1..325bp; Hit=16..335bp; Blast score=322; Percent Identity=54.0; E value=5e-88; Homolog= ZyggR COG2805
MNMEKLVALSVKHNASDLHLCVGKVPVLRINGVLYPQMQLAEMQGDTLMAWSRKILTEEQQQQLQEYGHVDFVVEMPDKQRLRGNLFYQQCQVSLVLRLIADKCPTLEQLYAPDIIQRLILQEKSGLVLVTGATGSGKSTTLSAIINAFNNHGNKHIITLEDPIEFVHQSRNCLIQQRQIGRDVQDYQTALKGALRQDPDVILLGELRDKETIRLALTAAETGHLVLSTLHTRGAIQALDRLVDVFSAEEKGWICSQLAGSLKAVISQQLLLAREGGRVAIYEVLVVNQAVSHLIREGKNHQIATLMQTGAACGMQTHEQSRQQRELLGLLAVVPQ

SEQ ID NO: 11169 - protein, 141 aa, Xenorhabdus bovienii
  Coding DNA sequence: Name=SeqID_5061
  Gene classification: Function=Predicted endonuclease involved in recombination (possible Holliday junction resolvase in Mycoplasmas and B. subtilis); Function class=L DNA replication, recombination and repair
  Homolog annotation: Query=5..139bp; Hit=4..138bp; Blast score=216; Percent Identity=74.0; E value=5e-57; Homolog= ZyqgF COG0816
MKNRTIIAFDFGTHSIGTAIGQEITGTARALSAFKAKEGSPSWELIEKLLKEWQPDLVIVGLPLNMDGTEQLVTAQARKFANRLHGRFGVQVELHDERLTTIEARSHLFDHGGYKALDKGKVDSASAVVILESWFEQQYSQ

SEQ ID NO: 11170 - protein, 187 aa, Xenorhabdus bovienii
  Coding DNA sequence: Name=SeqID_5062
  Gene classification: Function=Putative transcriptional regulator; Function class=K Transcription
  Homolog annotation: Query=1..187bp; Hit=25..211bp; Blast score=270; Percent Identity=65.0; E value=9e-73; Homolog= yqgE COG1678
MNLQHHFLIAMPSLSDPYFNRSVVYICEHDQNGAMGLVINKPIAQISIQSILEKLDITPEDRDDSINLNKPVMAGGPLSEEHGFILHTPQSGFSSSIQISDETMITTSKDMLEALGTPRQPENVLMTLGYSSWEKGQLEQEIMENSWLTVSAESSIIFHTPVADRWYEAASLLGINIYNLAPQAGHA

SEQ ID NO: 11171 - protein, 319 aa, Xenorhabdus bovienii
  Coding DNA sequence: Name=SeqID_5063
  Gene classification: Gene name=RimK; Function=Glutathione synthase/Ribosomal protein S6 modification enzyme (glutaminyl transferase); Function class=H Coenzyme metabolism
  Homolog annotation: Query=1..317bp; Hit=1..316bp; Blast score=520; Percent Identity=78.0; E value=1e-148; Homolog= gshB COG0189
MIKLGIVMDPISSIKIKKDTSFAMLLEAQKRGWEIHYMEMNDLYLYQGEARARTRLLTIEENPQQWYQFGSEQEIALDTLQVILMRKDPPFDTEYIYATYILERAEAKGSLIVNKPQSLRDCNEKLFTAWFPELTPDTLVTRNAKTLREFHQKHGDVIFKPLDGMGGASIFRLKQDDPNTGVIIETLTEHGSRYCMAQNFLPAIKDGDKRVLVVDGEPVPYCLARIPAQGETRGNLAAGGRGEARPLTESDWAIAHAVAPVLKEKGLIFVGLDIIGDRLTEINVTSPTCVREIEAAFPEISITGMLMDAIEKRLEKQPA

SEQ ID NO: 11172 - protein, 243 aa, Xenorhabdus bovienii
  Coding DNA sequence: Name=SeqID_5064
  Gene classification: Function=Uncharacterized BCR; Function class=S Function unknown
  Homolog annotation: Query=1..243bp; Hit=10..252bp; Blast score=393; Percent Identity=78.0; E value=1e-110; Homolog= yggJ COG1385
MRIPRIYHPERLSVETEIYLSDEAANHVGRVLRMSNGQPLQLFDGSNQVFDAELIEANKKTIKVRITDGKLSDHESPLNLHLGQVMSRGEKMEFTIQKSVELGVNTITPLLSERCGVKLDAERLEKKLQQWKKIVISACEQCGRNRIPEIRPVMSLEAWCAENDGSLKLNLHPRASQSINTLPLPVEKVRLLIGPEGGLSAEEIEMTANHQFTDILLGPRVLRTETTALTAITALQVRFGDLG

SEQ ID NO: 11173 - protein, 45 aa, Xenorhabdus bovienii
  Coding DNA sequence: Name=SeqID_5065
LITQSALIYHGDESALYYGYCVIPEKRRKEEICEFPASITLNGSP

SEQ ID NO: 11174 - protein, 34 aa, Xenorhabdus bovienii
  Coding DNA sequence: Name=SeqID_5066
MSADCVIKLSLKPQGTRYALASRLAYLFHNDCFN

SEQ ID NO: 11175 - protein, 48 aa, Xenorhabdus bovienii
  Coding DNA sequence: Name=SeqID_5067
MKIFDMALVNNIPVIIFLIYFSDRNQNTRNINLSLNWLAIKNQLKQSL

SEQ ID NO: 11176 - protein, 172 aa, Xenorhabdus bovienii
  Coding DNA sequence: Name=SeqID_5068
  Gene classification: Gene name=PppA; Function=Signal peptidase, cleaves prepilin-like proteins; Function class=N Cell motility and secretion
  Homolog annotation: Query=24..159bp; Hit=134..266bp; Blast score=90; Percent Identity=40.0; E value=8e-19; Homolog= NMB0332 COG1989
VPCRIFSWMIIKDGLANMDNIMIMIFCSALIFLSMIDIRIYQLPDIITQPLLWIGLVFNSSENLVSIKSAIYGAISGYLFLWLLNRVCRYTLKKEGIGYGDLKLTAAIGAWLGMETIPVLMLLSSTSGLFGFMIVWFKRKTYPDFIAFGPYICLSAIVLMGFRVSGINIMGI

SEQ ID NO: 11177 - protein, 292 aa, Xenorhabdus bovienii
  Coding DNA sequence: Name=SeqID_5069
  Gene classification: Function=Metal-dependent hydrolases of the beta -lactamase superfamily II; Function class=R General function prediction only
  Homolog annotation: Query=22..291bp; Hit=4..272bp; Blast score=120; Percent Identity=31.0; E value=2e-27; Homolog= PAB0518 COG1237
LQVLCKKFILSLYLLEKRISIMVLKITALLENQVFAPYKTVLTGKPGLSLLIQDQDTTILFDTGPDGSFIDNAKKLNIDLSKVSAVVISHGHFDHCGGLPFFSTDAKVICHPEVKNERYYGWVITDNKALTFKKLSKQVDYGKFDTFFSKGETYINDNFIYSGEIKKEENKRYGVIVGEKSEGKYSPDFVKDEGVLIYKSKHGLIIFIGCGHCGVIEIIKFCKQITGIDQVYAVIGGLHLRYASPFKLLPIRKYIKKENIQHVYACHCSGMWGRLWLPNAKSLSTGQSIEID

SEQ ID NO: 11178 - protein, 294 aa, Xenorhabdus bovienii
  Coding DNA sequence: Name=SeqID_5070
  Gene classification: Gene name=GloB; Function=Zn-dependent hydrolases, including glyoxylases; Function class=R General function prediction only
  Homolog annotation: Query=1..293bp; Hit=1..295bp; Blast score=330; Percent Identity=57.0; E value=1e-90; Homolog= PA0057 COG0491
MARKTTLNIALAATLSLGIASLAQAANLKLDIYNPGETGIFPVSSEIISGDHEVVLIDAQFKKSDAQALVKMIQQTGKKLTTIYISQSDPDFYFGLDVITTAFPEAKVIASPETIKAINETKDGKLAYWGGILQDQAPKKVIVPEPLKGNTFTVDGEKLIVEGLDGPAADRTFVWVPKLKAVVGGVTVSGNIHVWIADTQTKVSRQHWMQTLDRIKSLKPDTVVPGHYVGSAPMTLESVTFTQKYLTTLEKELPKAKDSEALIAAMKKHYPNLADESSLELSAKVLKGEMKWPQ

SEQ ID NO: 11179 - protein, 43 aa, Xenorhabdus bovienii
  Coding DNA sequence: Name=SeqID_5071
MLFPEKGSPPERYLMLFCEPLLNSCIKMFICLNGTYNKLHISI

SEQ ID NO: 11180 - protein, 304 aa, Xenorhabdus bovienii
  Coding DNA sequence: Name=SeqID_5072
  Gene classification: Gene name=LysR; Function=Transcriptional regulator; Function class=K Transcription
  Homolog annotation: Query=1..299bp; Hit=1..299bp; Blast score=326; Percent Identity=56.0; E value=2e-89; Homolog= PA0056 COG0583
MDRITAAQVFVTIVEQGSLVAAAERLDMSRAMVSRYLAEMEKWAGVRLLHRTTRKISLTSAGENAYQRSLKLLELAETMPVQQSLESQTLRGLLRVSCSQSLGTSALSVAIPEFMRRYPQIAVNLQINNRVINLVEERIDLAIRITNNLEPNLIARPLSICHSVVCAAPSYLDGKIIPQKPTDLASHNCLTYNFFGKSLWLFEKQHEQYSVPVSGTLSANESTVLMEATLQGAGIAMQPYYSAAPYLISGQLVELLPDYQPQAMGIYGIYASRQNMPVTLRALLDFLVDWFANAPHWQQLMLKS

SEQ ID NO: 11181 - protein, 309 aa, Xenorhabdus bovienii
  Coding DNA sequence: Name=SeqID_5073
  Gene classification: Gene name=LysR; Function=Transcriptional regulator; Function class=K Transcription
  Homolog annotation: Query=1..298bp; Hit=1..294bp; Blast score=374; Percent Identity=65.0; E value=1e-104; Homolog= lysR COG0583
MHSCSWRHIEIFHAVMTTKNLTDAAVLLKTSQPTVSRELARFEQLLKFRLFDRIKGRLFPTAQGLRLFEEVQRSYYGLERILNAAESIRQFEHAQLSIACLPVFSQSLLPKACHSFIQRYPEAKLTIVPQESPLLEEWLSAQRHDIGLTEHLQAPAGTEQETLITLNEVCVLPASHPLSQKSRLMPEDFHEQKFISLSITDSYRQLIDTIFSEHHVNRNMIMETHSAASICAMISEGIGMSVVNPLTALDYLDKNAGICVRPFSIDIPFTVSLIKPIHRPFSEPVEIFITHLKQQTGLFPRKLALAFQH

SEQ ID NO: 11182 - protein, 47 aa, Xenorhabdus bovienii
  Coding DNA sequence: Name=SeqID_5074
MSSLKFLTRPADASLLTAIRQEEKYPFSYSLFIYDIVLIVFQTNHVM

SEQ ID NO: 11183 - protein, 427 aa, Xenorhabdus bovienii
  Coding DNA sequence: Name=SeqID_5075
  Gene classification: Gene name=LysA; Function=Diaminopimelate decarboxylase; Function class=E Amino acid transport and metabolism
  Homolog annotation: Query=13..418bp; Hit=11..411bp; Blast score=597; Percent Identity=69.0; E value=1e-170; Homolog= ZlysA COG0019
MTTSTFTGFSGENFTPENLLRLPVDYGTPLWVYDSDIIIRKINKLKRFDIIRFAQKACSNTHILRLMRAQGVKVDAVSLGEIERALYAGYQPGRDRSEIVFTADLIDEATLNRVIELDIPVNVGSIDMLEQMGTRQSGHPIWLRINPGFGHGHSQKTNTGGENSKHGIWFQDLPLAIEKVRQYGLKLVGLHMHIGSGVDYQHLANVCNAMVEQVILCGEDIQAISAGGGLSIPYKMGDEVVDTEHYYSLWHEARQRIERHLGHHVKLEIEPGRFLVAESGILMAEVRAVKSMGNRHYVLVDAGFSDLMRPTMYGSYHHISVLSVDSKHIDEANSQDAELHETLVAGPLCESGDVFTQSAGGDVIPRLLPHVRVGDYLVFHDTGAYGASMSSNYNSRPLIPEILFIEGDARLIRRGQTIEELLALEAV

SEQ ID NO: 11184 - protein, 826 aa, Xenorhabdus bovienii
  Coding DNA sequence: Name=SeqID_5076
  Gene classification: Gene name=CaiA; Function=Acyl-CoA dehydrogenases; Function class=I Lipid metabolism
  Homolog annotation: Query=8..826bp; Hit=9..826bp; Blast score=1331; Percent Identity=78.0; E value=0; Homolog= yafH COG1960
MSHLRLTGVFTMTALSIILFLVLIGGLCYRKVSLAASSLLLVAYTLVMGITGLWSYWLLLPLAIILFPLIFTPTRISLFSAPGLKAFRKVMPSMSTTEKEAIDAGTTWWEGELFRGNPDWKKLHNYPKPQLTAEEQAFIDGPVEEACRMANDFQISHELADLSPELWTYLKENRFFAMIIKKEYGGLDFSAYAQSQVLQKLSGVSGILAITVGVPNSLGPGELLQHYGTDEQKKHYLPGLARGEEIPCFALTSPEAGSDAGAIPDTGVVCMGEWQGEQVLGMRLNWNKRYITLAPIATVLGLAFKLYDPEHLIGNTESLGITCALIPTSTPGVEIGNRHFPLNVPFQNGPTRGKDIFVPIDYIIGGPKMAGQGWRMLVECLSVGRGITLPSNATGGLKSAAMAIGAYSYIRRQFKLPIGKMEGIEEPLARIAGNTYLMDAAATMITGGIMLGEKPAVLSAIVKYHCTHRGQRSIIDAMDIAGGKGICLGPSNFLARVYQGAPIAITVEGANILTRSMIIFGQGAIRCHPYVLAEIAAAENNNVKAFDKALFGHLGHVASNTLRSLWLGITNGRTSRTPVSDATRRYYQHINRLSANLALLSDVSMGVLGGSLKRRERISARLGDILSQIFLATAALKRYEDEGRQKEDLPLLQWAVEDSLYQAEQALNDLLRNFPNRLVAGLMRVMVFPLGRSHTAPSDKLDHKLAQILQTPSATRSRIGRGQYLTPSEHNPHGLLEEALHDIIAAEPIHARLSREAGKNLSFTRLDQLAERALADHKITQEEADILKRAENSRLRSINVDEFEPDAFAVPHSAKKPESQHQTKAA

SEQ ID NO: 11185 - protein, 50 aa, Xenorhabdus bovienii
  Coding DNA sequence: Name=SeqID_5077
MRKTYLSIYLHLNYNVAHKVIAVCGVIISRRCDGIFFRERESVTLIGRFY

SEQ ID NO: 11186 - protein, 196 aa, Xenorhabdus bovienii
  Coding DNA sequence: Name=SeqID_5078
  Gene classification: Gene name=GmhA; Function=Phosphoheptose isomerase; Function class=G Carbohydrate transport and metabolism
  Homolog annotation: Query=4..194bp; Hit=1..191bp; Blast score=338; Percent Identity=87.0; E value=3e-93; Homolog= gmhA COG0279
MSPMYQDLIRSELSEAADTLAKFLNDDANIDAIQQAAVLLADSFKAGGKVLSCGNGGSHCDAMHFAEELTGRYRENRPGYPGIAISDPSHLSCVSNDFGYDYVFSRYLEAVGQKGDVLLGISTSGNSSNIIKAIEAARAKGMKVITLTGKDGGKMAGTADVEIRVPHFGYADRIQEIHIKVIHILIQLIEKEMVTA

SEQ ID NO: 11187 - protein, 255 aa, Xenorhabdus bovienii
  Coding DNA sequence: Name=SeqID_5079
  Gene classification: Function=Predicted glutamine amidotransferase; Function class=R General function prediction only
  Homolog annotation: Query=1..255bp; Hit=1..255bp; Blast score=412; Percent Identity=74.0; E value=1e-115; Homolog= yafJ COG0121
MCELLGMSANVPTDIVFSLSGLIQRGGYTGPHKDGWGITFYEGLGYRTFKDHQSSYHSPVARFVQSYPIKSEVIVAHIRQANRGNVSLVNTHPFTRELWGKYWTYAHNGQLQGYRNLKTGNYRPVGETDSEWAFCWILQQLSIKYPKRPSNWPAVFRFIASLAGELRKKGVFNMLLSDGQFVMAYCSTQLHWITRRAPFGMAKLLDQDVEIDFQQHTHPDDVVSMIATQPLTGNEDWQRIEPGCYELFHLGERIV

SEQ ID NO: 11188 - protein, 246 aa, Xenorhabdus bovienii
  Coding DNA sequence: Name=SeqID_5080
  Gene classification: Function=Uncharacterized BCR; Function class=S Function unknown
  Homolog annotation: Query=1..231bp; Hit=1..228bp; Blast score=223; Percent Identity=48.0; E value=1e-58; Homolog= yafK COG3034
MKKTAFYLSLFLLFHMPCSALAQSTPSWLQSPNERLRLKQLGAEIFIQIFKEEKVLELYTKDNTGHYQLAQSYPICNYSGGLGPKTLTGDFKSPEGFYHVSLKQLKPNSRYYRAINLGFPNEFDKFRGYSGNNLMIHGGCKSIGCYAMTDRYMDEIYRYAESAISYGQDEIKINIYPFRMTQQNIQRYRNNDNYSFWVQLQPAYEYFAKNGKLTTISIINGQYIVSVKPESSSFFSKSTQTMRSPR

SEQ ID NO: 11189 - protein, 36 aa, Xenorhabdus bovienii
  Coding DNA sequence: Name=SeqID_5081
LPCIDNELNTNIAAMFGICEMVERPINALLSGKMKL

SEQ ID NO: 11190 - protein, 39 aa, Xenorhabdus bovienii
  Coding DNA sequence: Name=SeqID_5082
MLQITLRYSLGNIATSVIKNALSCIYLKLFTPIIVTIFS

SEQ ID NO: 11191 - protein, 447 aa, Xenorhabdus bovienii
  Coding DNA sequence: Name=SeqID_5083
  Gene classification: Gene name=NqrA; Function=Na+-transporting NADH; Function class=C Energy production and conversion
  Homolog annotation: Query=1..447bp; Hit=1..447bp; Blast score=596; Percent Identity=65.0; E value=1e-170; Homolog= NMA0752 COG1726
MIKIKKGLNLPIAGAPAQVIEDGPTIRHVALLGEEYVGMRPSMLVKEGEHVKKGQILFEDKKNPGVIFTSPASGKIITIGRGERRVLQSVVIEVSGDEQVMFDRYDRAELAGLTREQVETNLLVSGLWTALRTRPFSHSPVPGSTPKAIFVTAMDTQPLAADPLVVIATQEEAFVDGLNILSTLTEGKVHVCHGAGNIPNAGNNTQITYNQFAGPHPAGLVGTHIHFIEPVSVKKSVWHLGYQDVIAIGKLFTTGELYTDRVVSLAGPQVKSPRLVRSRLGADLQELTQDQLKEGENRIVSGSVLCGTKSDEVRHYLGRFHTLVSVLAEGREKELFGWIAPGVNKFSITRTTIGHFLKNKRFAFSTSTNGGERSMVPIGNYERVMPLDIMATHLLRDLLAGDSDSAQALGCLELDEEDLALCTYVCPGKYEYGPVLRDVLTKIEQEG

SEQ ID NO: 11192 - protein, 412 aa, Xenorhabdus bovienii
  Coding DNA sequence: Name=SeqID_5084
  Gene classification: Gene name=NqrB; Function=Na+-transporting NADH; Function class=C Energy production and conversion
  Homolog annotation: Query=1..411bp; Hit=13..423bp; Blast score=600; Percent Identity=75.0; E value=1e-172; Homolog= VC2294 COG1805
MGLKNLFEKVEHHFEAGGKLEKYYPLYEAVSTVFYTPGTVTRGRAHVRDAIDLKRMMILVWLSVFPAMFWGMYNVGNQAIPALTHLYSGEALQQILASDWHYVVAQYLGASLTPDAGWGSKMLLGATYFLPIYAVVFAVGGFWEVLFAMIRRHEINEGFFVSSILFALIVPPTLPLWQAALGITFGVVIAKEIFGGTGRNFLNPALAGRAFLFFAYPAQISGNMVWTAADGFSGATPLSQWANEGSHGLMNTITGQPVTWMDAFIGNIPGSIGEVSTLMIFIGGAIILFARIASWRIVAGVMVGMIAMSSLFNAIGSSTNPMFAMEWYWHMVLGGFAFGMIFMATDPVSAAFTDKGKWAYGILIGVMCILIRVVNPAYPEGMMLAILFANLFAPLFDYLVVQANIKRRKARG

SEQ ID NO: 11193 - protein, 264 aa, Xenorhabdus bovienii
  Coding DNA sequence: Name=SeqID_5085
  Gene classification: Gene name=NqrC; Function=Na+-transporting NADH; Function class=C Energy production and conversion
  Homolog annotation: Query=8..261bp; Hit=4..256bp; Blast score=278; Percent Identity=54.0; E value=4e-75; Homolog= VC2293 COG2869
VANEKPKNNDSVGRTFLVVFVLCLICSIVVAGSAVGLKAQQQEQKLLDKQRNILDVAGLLKPNMTTAEMKETYSSRIQPELLDLKTATLEKGDGKFDLKNALRSDETSMTLSSEQDLARIHRRADMAEIYLVKDDQGKTTELVLPVYGSGLWSMMYAFISIDVDGVTSRGITYYSHGETPGLGGEVDNPQWRRQWVGKKLYNSQGVPAIKIVRGGAGDNPYGVDGLSGATLTSNGVQHMFDFWLGDNGFGPFLKKVREGALKDG

SEQ ID NO: 11194 - protein, 209 aa, Xenorhabdus bovienii
  Coding DNA sequence: Name=SeqID_5086
  Gene classification: Gene name=NqrD; Function=Na+-transporting NADH; Function class=C Energy production and conversion
  Homolog annotation: Query=1..208bp; Hit=1..208bp; Blast score=289; Percent Identity=75.0; E value=1e-78; Homolog= NMB0566 COG1347
MADSKEVKRVLLGPLFDNNPIALQVLGVCSALAVTTKLETALVMTIAVTLVTAFSSFFISLIRNYIPGSVRIIVQMAIIASLVIVVDQILQAYAYEISKQLSVFVGLIITNCIVMGRAEAYAMKYPPVESFMDGIGNGLGYGVILLLVGFLRELFGSGKLLGMTVLESVKNDGWYQPNGLFLLAPSAFFIIGMLIWGLRTLKPAQVEKE

SEQ ID NO: 11195 - protein, 198 aa, Xenorhabdus bovienii
  Coding DNA sequence: Name=SeqID_5087
  Gene classification: Gene name=NqrE; Function=Na+-transporting NADH; Function class=C Energy production and conversion
  Homolog annotation: Query=1..198bp; Hit=1..198bp; Blast score=274; Percent Identity=84.0; E value=4e-74; Homolog= VC2291 COG2209
MEHYISLFVRAVFIENMALAFFLGMCTFLAVSKNVKTAFGLGVAVTVVLGISVPANNLVYNLVLRDGALMDGVDLSFLNFITFIGVIAALVQILEMILDRYVPALYNALGIFLPLITVNCAIFGGVSFMAQRDYNFSESVVYGFGSGMGWMLAIVLMAAIREKMKYADVPAGLKGLGITFVTTGLMALGFMSFSGVQL

SEQ ID NO: 11196 - protein, 408 aa, Xenorhabdus bovienii
  Coding DNA sequence: Name=SeqID_5088
  Gene classification: Gene name=NqrF; Function=Na+-transporting NADH; Function class=C Energy production and conversion
  Homolog annotation: Query=4..408bp; Hit=3..405bp; Blast score=654; Percent Identity=80.0; E value=0; Homolog= NMA0747 COG2871
MDIIILGVVMFTLIVLALTAMILFAKSKLVNTGDIKIEVNGDEEKSFTAPAGDKLLNMLSSQGVFVSSACGGGGSCGQCRVKIKEGGGDILPTELSHINKREAKEGCRLACQVNVKQDLKIELPEEIFGVKKWECEVISNDNKATFIKELKLKIPDGEVVPFRAGGFIQIECPPHVARYADYDVPEEYREDWDKFNLFRYVSEVKEPTVRAYSMANYPEEHGIIMLNVRIATPPPRNPDVTPGIMSSYIWSLKAGDKVTISGPFGEFFAKDTEAEMVFIGGGAGMAPMRSHIFDQLNRLNSKRKISFWYGARSKREMFYTEDFDQLAAENENFNWHVALSDALPEDNWDGYTGFIHNVLFENYLKDHPAPEDCEFYMCGPPVMNAAVIKMLKDLGVEDENIMLDDFGG

SEQ ID NO: 11197 - protein, 343 aa, Xenorhabdus bovienii
  Coding DNA sequence: Name=SeqID_5089
  Gene classification: Gene name=ApbE; Function=Membrane-associated lipoprotein involved in thiamine biosynthesis; Function class=H Coenzyme metabolism
  Homolog annotation: Query=3..341bp; Hit=31..367bp; Blast score=414; Percent Identity=63.0; E value=1e-116; Homolog= VC2289 COG1477
MLSKKIIHWGVLMFAVLLLSACGGPEQQNLSGQTMGTYYSVKYVADSSIPSPENLQKEIDRLLEEVNDQMSTYRPNSELSRFNQSREVNTPFLVSAATAKVVKEAIRINQLTDGALDVTVGPLVNLWGFGPEGRITKAPTDEELVMRRAWTGIDKLSVEGNSLIKSIPELYVDLSSIAKGYGVDVVAEYLASQNIKNYMVDIGGEVRTLGNNGKGAPWRIAIEKPSDSGIEQKAQEIIEPGSMSIATSGDYRNYFEQNGVRYSHTINPKTSRPITHNLVSITVIAPTSMSADGFSTGLDVLGPDKGMEVAETLNIPVFMIVKTQDGFEERYSSAFKPYIQQKK

SEQ ID NO: 11198 - protein, 139 aa, Xenorhabdus bovienii
  Coding DNA sequence: Name=SeqID_5090
MALKSAIVQPLSHTYNRRNEEERLWKSLLQPLSFSCWLLQEWHWATFLSVKVFREVVVVWGVLVWRKFVIAQNPAIPVKNAWQGKLLVMRSWKKTEFFEGVFAVKQFSAKKCNPLSDTQRVFVGCSDDVERVTFAVSLL

SEQ ID NO: 11199 - protein, 171 aa, Xenorhabdus bovienii
  Coding DNA sequence: Name=SeqID_5091
  Gene classification: Gene name=RpoE; Function=DNA-directed RNA polymerase specialized sigma subunits, sigma24 homologs; Function class=K Transcription
  Homolog annotation: Query=10..166bp; Hit=8..164bp; Blast score=140; Percent Identity=43.0; E value=4e-34; Homolog= PA3899 COG1595
MAVPKSTCGHNDIAQKFYFEYHHWLCNWIRQNSVCPSHAEDLTHDTFIKLMQSADLENIRHPRAFLITIARRTLANYYRRKKLEDNYREYVNTMPKTTTNSSEFRLVLLEQLERIDKTLDELPKKARRAFLLTQLQGMRYKEVAKNLDVSMSSVKNYLQQAHSKCHSLNII

SEQ ID NO: 11200 - protein, 30 aa, Xenorhabdus bovienii
  Coding DNA sequence: Name=SeqID_5092
MKIIIIIVFILPLQAVSSWRYQKAHADTMT

SEQ ID NO: 11201 - protein, 783 aa, Xenorhabdus bovienii
  Coding DNA sequence: Name=SeqID_5093
  Gene classification: Gene name=CirA; Function=Outer membrane receptor proteins, mostly Fe transport; Function class=P Inorganic ion transport and metabolism
  Homolog annotation: Query=60..783bp; Hit=26..744bp; Blast score=714; Percent Identity=49.0; E value=0; Homolog= HI0113 COG1629
MQYFIQLCFRKFMANNSQNLGKRPIMAIIRKILRSTFSGTLVLGSAFSSQVLAAENPSDQKSEKQNEVVKLPSLSVVGSLHNSISAGSSVLKKTDIERTQADNVAQLLDQLPGVSMSGSPRPGGQTLNIWGMGESEDIKITLDDAPKGFEKYLQGSIFIEPELIKRIDVDKGPHNLLNGNGGFGGSVKIVTKDAGDLLRPDENFGGLIKQSYHTNDRQWINSGTIFGRDPNGFVDGLLYVSKRDGHNIKRPDGTHFEYSQNNQTSYLWKTNVYPNDTHTLSFSAMRSESDGWQPWAAKRDGISAPSASDIERYGWNEAWKRKLVFRDQIDQNYSAKWNIAPEDNPWLNLTLTSAYSITKQNDRRLDNKDIKPTSAGLMGQKSWVKYIDTMVDINNKSVFSTGSIEHKLLVGTRWHKNDRDVLMFDKNTVNDQEFNYGYYQPNYMPAGEQQIYSIYMQDSLKLGSVTVTPSVRYDHIKNIGEENKAPRYNNTSPKINHDYSGVTYAGWSPHLGIMWRTNKNLSLFADISRTWRAPVVDEQYEVQSYKTSLPGSSRNLEVEKMTGIRLGAILDFDNLMLENDSLQIRTTLFRNRGKDEIFKTRGVYCKAQADGASPTSCEKPIANHRNLPGYTIEGLEIETFYDSNKLFGKLSFSTMRGQRDASMRDPWIGHKTWVAEIPPTSAHAMLGFKIPQWQMSMGWKGDFIRKQDRSPVDGDPKAGSWSLPASKGYALHGLFASWRPPYMKGFEARVTIDNLFNRDYYPYLGEATSGIGRNFKFSISQQF

SEQ ID NO: 11202 - protein, 40 aa, Xenorhabdus bovienii
  Coding DNA sequence: Name=SeqID_5094
LHCYKSPKKSNRVNKNENYFYKHVLRSVMEMKCTVIDHVV

SEQ ID NO: 11203 - protein, 92 aa, Xenorhabdus bovienii
  Coding DNA sequence: Name=SeqID_5095
MHCDRSCCLTFLRVYCWMIEMIIRVVMLSQLLTALAVRSKCLWDVVAPNGQNTHWRGHFCKCNFLKYKGLVNEEKDSQFSDFCRYRSIACWL

SEQ ID NO: 11204 - protein, 173 aa, Xenorhabdus bovienii
  Coding DNA sequence: Name=SeqID_5096
MKKKILSSLIFAGIVALLAGCDDGSQKVEDSTQQAEESTTQMKNDAEQKTTGIVDSAKEKSQEVKEGAMREGHSLVDKSKEVQNQISHSANHLADQVKSKAADVQNEVTKSVNDTLDKVKTKTDDIQHQATDKANQLKDDVKSKAEEIKSDVNKQADDFINSFKNDGDKTEES

SEQ ID NO: 11205 - protein, 54 aa, Xenorhabdus bovienii
  Coding DNA sequence: Name=SeqID_5097
MSISRLMILSIASKMTAIKQRKVNSTIQYPVSKNKLILKGDLKKVALIFPLLST

SEQ ID NO: 11206 - protein, 145 aa, Xenorhabdus bovienii
  Coding DNA sequence: Name=SeqID_5098
  Gene classification: Gene name=WecD; Function=Histone acetyltransferase HPA2 and related acetyltransferases; Function class=K Transcription
  Homolog annotation: Query=13..140bp; Hit=11..138bp; Blast score=81; Percent Identity=42.0; E value=3e-16; Homolog= TM1720 COG0454
MEIKYSVGRENPELIQQAFAIRKQVFTDEQGFDAEIDIDEYDDIALHVLIFDGEKPIGVLRAVPMDNNMLKVGRVAVLKEYRGKGIGRKVMEFIEDYGRKNGVVAIGLSSQCHAQPFYESLGYQARGEIYLEEGAEHIFMTLDLA

SEQ ID NO: 11207 - protein, 87 aa, Xenorhabdus bovienii
  Coding DNA sequence: Name=SeqID_5099
VSYSTTTQSGKILCCQWRTSSQIGTEYAISELIFANIKSTTSTGKLDICNTVCTTIFLVLVFKTSQILMDTYFQYQDIFLKKEATKK

SEQ ID NO: 11208 - protein, 571 aa, Xenorhabdus bovienii
  Coding DNA sequence: Name=SeqID_5100
  Gene classification: Gene name=BetA; Function=Choline dehydrogenase and related flavoproteins; Function class=N Cell motility and secretion
  Homolog annotation: Query=11..561bp; Hit=5..555bp; Blast score=936; Percent Identity=79.0; E value=0; Homolog= PA5372 COG2303
MTETEEITMVFDYIIIGAGSAGNVLATRLTEDRDVTVLLLEAGGPDYRFDFRTQMPAALAYPLQGTRYNWAYETDSEPHMNNRRMECGRGKGLGGSSLINGMCYIRGNALDFDNWATLSGLEDWAYLDCLPYFRKAETRDIGANDYHGGDGPVSVTTPKPDNNELFHVMVEAGIQAGYPRTDDLNGYQQEGFGPMDRTVTPEGRRASTARGYLDQARARSNLTIITHALTDTLEFEGKMAVGVNFYQGNDSTLTQARARKEVLLCAGAIASPQILQRSGIGPEEVLNEFGIPAVQILPGVGQNLQDHLEMYLQYECLKPVSLYPALKWYNQPKIGAEWLFKGTGIGASNQFEAGGFIRTSEKFAWPNIQFHFLPVAINYNGSNAVNEHGFQAHVGSMRSPSRGRVKITSRDPRQHPSILFNYMSTAQDWQEFRDAIRITREIMTQPALAPYCGREISPGTDIQTDEQLNTFIRERAETAFHPSCSCKMGTDEVAVVDGQGRVHGVKNLRVIDASIMPEIITGNLNATTIMIAEKIADKIRCRTPLPRSQAKYYVANGAPARKSAQNTPSVN

SEQ ID NO: 11209 - protein, 492 aa, Xenorhabdus bovienii
  Coding DNA sequence: Name=SeqID_5101
  Gene classification: Gene name=PutA; Function=NAD-dependent aldehyde dehydrogenases; Function class=C Energy production and conversion
  Homolog annotation: Query=1..492bp; Hit=1..490bp; Blast score=769; Percent Identity=76.0; E value=0; Homolog= PA5373 COG1012
MTRFGLQKLYIHGTYVNSVNPDKNTFDAINPANGEVIAQLQSATEQDVELAVKSAQKGQKIWATMTAIERSRILLKAVNILRERNDELAELETLDTGKPLSETQYVDIVTGADVLEYYAGLIHSLEGQQIPLRESSFVYTRREPLGVVAGIGAWNYPIQIALWKSAPALAAGNAMIFKPSEVTSLTALKLAEIYTEAGVPDGVFNVLTGAGHEVGHTLTVHPKIAKMSFTGGIVTGKKVMANASGSNLKEVTMELGGKSPLIIFDDADLDRAADIAMMANFFSSGQVCTNGTRVFVPKGLAPQFEAKIVERVKRIRIGSPLDPNTNFGPLVSFPHMESVLRYIESGKSTHARLLCGGERLLEGELAKGAFVAPTVFSDCTDDMLIAQEEIFGPVMCILTYETEDEVINRANNTDYGLAAGLVTQDLSRAHRVIHQLEAGICWINTWGESQAAMPVGGYKHSGIGRENGLVTLQNYTQTKSIQVELGNFESLF

SEQ ID NO: 11210 - protein, 198 aa, Xenorhabdus bovienii
  Coding DNA sequence: Name=SeqID_5102
  Gene classification: Gene name=AcrR; Function=Transcriptional regulator; Function class=K Transcription
  Homolog annotation: Query=1..194bp; Hit=1..194bp; Blast score=240; Percent Identity=65.0; E value=6e-64; Homolog= ZbetI COG1309
MPKIGMQSIRKQQLIDATLAVVNEVGMQDASIAQIARKAGVSNGIISHYFKDKNGLLESTMRYLLHQLGVAVARRLRLLDNATPAQRLKAIVEGNFDASQISNAAMKTWLAFWASSIHQPNLYRLQQVNERRLYSNICVEFRRVLPKTEARLAAQGLAALIDGIWLRSALSSKPFDIKSAFTITIDYIEQKLGTPYTA

SEQ ID NO: 11211 - protein, 56 aa, Xenorhabdus bovienii
  Coding DNA sequence: Name=SeqID_5103
LLFSYRLHSNFWHVFMLRKSIIRQLLNFFLIECSIKIKYVLLQYFHNGRLNLFDIA

SEQ ID NO: 11212 - protein, 680 aa, Xenorhabdus bovienii
  Coding DNA sequence: Name=SeqID_5104
  Gene classification: Gene name=BetT; Function=Choline-glycine betaine transporter; Function class=M Cell envelope biogenesis, outer membrane
  Homolog annotation: Query=5..678bp; Hit=3..676bp; Blast score=1029; Percent Identity=76.0; E value=0; Homolog= betT COG1292
MNIPDSPKNTQKDTLNSVVFFTSAGLIIVFTLFTIFFTDATSIWIKNTLNWVSKTFGWYYLLAATLYIVFVIFVAASRFGSIKLGPEQSKPEFSLLSWAAMLFAAGIGIDLMFFSVAEPVTQYMRPPTGEGETIEAARQAMVWTLFHYGLTGWSMYALMGIALGYFSYRYNLPLTIRSALYPIFGNRIKGPIGHAVDIAAVIGTIFGIATTLGIGVVQLNYGLKVLFGLPQGLGVQGGLILLSVVMAIVSVTSGVNKGIRFLSELNVLLALGLILFILCVGNTEFLLNGLVQNVGDYISRFMGMTLNSFAFERPTEWMNNWTLFFWAWWVAWSPFVGLFLARISRGRTIRQFVMGTLIIPFVFTLLWLSIFGNSVLYEILHGNRQLAETVLEHPEQGFYGLLALYPAFTFSASVATITGLLFYVTSADSGSLVLGNFTSNLSDINNDAPNWLRVFWSVAIGVLTLGILMTDGISALQNMTVIMGLPFSFVIFFVMAGLYKSLRVEDFRKASSLQNTSPTLVHDNGSLNWKQRLSRMMNFPGTKSTQRMLDVVCRPAMQEVAKELELRGAKVQFNALPSEGDERLSPLELIVDLGDEQNFVYQVWPQRYSVPGFTYRARSGKSYYYRLETFLMEGTQGNDLMDYTKEQIISDILDHYEKHLNFIHLNREAPGQTLIFPNGG

SEQ ID NO: 11213 - protein, 49 aa, Xenorhabdus bovienii
  Coding DNA sequence: Name=SeqID_5105
MIDIGRLEFVNLISNYRQGKKQKNCQQLNILQAASVINLYYPPFGKINV

SEQ ID NO: 11214 - protein, 33 aa, Xenorhabdus bovienii
  Coding DNA sequence: Name=SeqID_5106
LLIKLTNSSLPISIIFKNINHIQEYQHKSPFYI

SEQ ID NO: 11215 - protein, 32 aa, Xenorhabdus bovienii
  Coding DNA sequence: Name=SeqID_5107
LDCIAFEIDMDELPEPSLRRDDYKLPIKVQHH

SEQ ID NO: 11216 - protein, 397 aa, Xenorhabdus bovienii
  Coding DNA sequence: Name=SeqID_5108
  Gene classification: Gene name=AraJ; Function=Arabinose efflux permease; Function class=G Carbohydrate transport and metabolism
  Homolog annotation: Query=11..392bp; Hit=1..381bp; Blast score=171; Percent Identity=33.0; E value=1e-42; Homolog= mlr2770 COG2814
MSISNAMQSKIPIAVYLLGLSLFAMGSSEFLIAGVLPKIAEDLQVSLPSAGMLISAFAVGVLFGAPSLAVATLRWPRRATLLLSQALFVAATAIGMLSPDYWPLLIARVVSGIAYAGFWAVAATTAVNLVTQDRTARALAVVVSGLSLAMVVGGPLGTVISDIAGWRAGFWAVAAATSVMAIALWFMLPEIQPNQVEVPVLDTELKTMAQPKLWVAYTTTMLTTAAYMATFGYLGALLIDISKLAVVWVPAVLALFGIGAFIGLTIGGRTADKYPFKTLMIGTIGIIVSSIALTFLAENVIATTCLVFLLGVSGFVVNPAVMNRVYTIAANAPTLAGATNVSAFQLGITLAPLLAGFAIGAGYGLSSVAGVGALLAIIALVPILIDARLHHKNCHND

SEQ ID NO: 11217 - protein, 36 aa, Xenorhabdus bovienii
  Coding DNA sequence: Name=SeqID_5109
LTRVYIIKIVTTIKNFVPSRININKTSYRALTCSRN

SEQ ID NO: 11218 - protein, 35 aa, Xenorhabdus bovienii
  Coding DNA sequence: Name=SeqID_5110
MNNFAHFTSPCLFSHQNNCINIQPHVIERYLFFKN

SEQ ID NO: 11219 - protein, 351 aa, Xenorhabdus bovienii
  Coding DNA sequence: Name=SeqID_5111
  Gene classification: Gene name=DinP; Function =Nucleotidyltransferase/DNA polymerase involved in DNA repair; Function class=L DNA replication, recombination and repair
  Homolog annotation: Query=1..349bp; Hit=1..349bp; Blast score=524; Percent Identity=71.0; E value=1e-149; Homolog= dinP COG0389
MRKIIHIDMDCFFAAIEMRDNPSLRDIPMAVGGSADRRGVISTASYSARRFGVHSAMSTAMALKLCPQLKVIPGRMASYKEVSQHIRQIFSRYTELIEPLSLDEAYLDVTDCQHCHGSATLIAQQIRQVIFDELQLTASAGVAPVRFLAKIASDINKPNGQYVISPEQVEVFVKSLPLRKIPGVGKVTSKRLSDIGLETCADVQNYDKVALIKKLGKFGLALWERSHGIDERQISPDRLRKSVGVEKTLAQDIHEWRDCVELIEKLYPELEKRLGKVKPDLRIARQGIKLKFDDFQLTTQEHLHPLLDKSDLIQVAKQAWEMRREGRGVRLVGLHVTLQNPQLERQLLLEW

SEQ ID NO: 11220 - protein, 524 aa, Xenorhabdus bovienii
  Coding DNA sequence: Name=SeqID_5112
  Gene classification: Gene name=PepD; Function=Di- and tripeptidases; Function class=E Amino acid transport and metabolism
  Homolog annotation: Query=39..523bp; Hit=1..485bp; Blast score=759; Percent Identity=75.0; E value=0; Homolog= ZpepD COG2195
MISSGMAWALGQLKMTKAPNASDITISISSRCSYRRFAVSELSTLSPQPLWDIFAQICSIPHPSYHEEALASHIIKWAKSKNFHVERDEVGNILIRKPATKGMENRQSVVLQAHLDMVPQKNNDTQHDFTKDPIRTYIDGDWVTAEGTTLGADNGIGMASALAVLADESVKHGPLEVLLTMTEESGMDGAFGLQSGWLQADVLINTDSEEEGEIYMGCAGGINFVSTLPLSRETLPAGYQTLQLTIKGLKGGHSGGDIHLGLGNANKLLARFLAAHSDELNLKLIDFQGGTLRNAIPREGSTVIAVPATQLEKLYQLKDDYLNTLKNEYAVVEANLIILLDEIETSSQALTTDCQTRFLSMLNTMPNGVIRMSDVAEGVVETSLNVGVVTMEEDKVEIICLIRSLIDSGKAYVVDMLNSLAKLADAETAASGNYPGWQPDANSPVMHLVRETYQQLFDKIPNIMVIHAGLECGLFKKPYPDMDMVSIGPTIRGAHSPDEKVHIKSVGQYWQLLTAILKAIPVKE

SEQ ID NO: 11221 - protein, 75 aa, Xenorhabdus bovienii
  Coding DNA sequence: Name=SeqID_5113
MPMPCPRISFSCLRCAVRIRISLVFYWFLPIQITIIPRNLFFRKKLFSEIFLVSRIKSYERKICCNVGYVANACP

SEQ ID NO: 11222 - protein, 153 aa, Xenorhabdus bovienii
  Coding DNA sequence: Name=SeqID_5114
  Gene classification: Gene name=Apt; Function=Adenine/guanine phosphoribosyltransferases and related PRPP-binding proteins; Function class=F Nucleotide transport and metabolism
  Homolog annotation: Query=1..152bp; Hit=1..152bp; Blast score=283; Percent Identity=89.0; E value=7e-77; Homolog= gpt COG0503
MSEKYVVTWDMLQMHARKLAQRLLPVEQWKGIIAVSRGGLVPGALLARELGIRHVDTVCISSYDHNNQRELTVVKKAEGDGEGFIVVDDLVDTGGTAQAIRNMYPKAHFVTIFAKPAGRPLVDDYVIDIPQDTWIEQPWDMGVVFVPPICNKP

SEQ ID NO: 11223 - protein, 415 aa, Xenorhabdus bovienii
  Coding DNA sequence: Name=SeqID_5115
  Gene classification: Function=Hydrolases of the alpha/beta superfamily; Function class=R General function prediction only
  Homolog annotation: Query=1..413bp; Hit=1..412bp; Blast score=484; Percent Identity=56.0; E value=1e-137; Homolog= ZyafA COG1073
MTKQNLSESLFKPRLKQQETSTLVKYIRPQSTAASDRILSGERREHWYRMIDWLAWIWRGINPLEIQDVLSRIAAIDAERSDDHLLDTVIGYRKGNWAFEWTQQAMYWQQEALRAEQTSEAGTSWLKAAMLYSIAAYPHLRGDELAEQAAALASKAYENAAHCSDYELKKLEFQLEEGKSVTGLLHLPPNVQEPCPTILVCTSLDNVQSDFWRLFRDHLAPLGFAMLTVDMPAVGYSAKFKLTQDTCILHQQVLQQLNQIPWIDHTRVGVMGFRFGANIAVRLAYLEPQLIKGVAVIGPIVHTLLNDEKRQQNIPSMYIDVLANRLGLYHVDEAALRLELSCYSLKNQGLLGRRCSVPMLSVYWKDDVFSPREDSKLIAMSSMDGSLLAIPSTPVYSGFNKALHETSVWLKDKAS

SEQ ID NO: 11224 - protein, 133 aa, Xenorhabdus bovienii
  Coding DNA sequence: Name=SeqID_5116
  Homolog annotation: Query=1..121bp; Hit=1..121bp; Blast score=144; Percent Identity=55.0; E value=3e-34; Homolog= ref|NP_454931.1|
MTLPVNYSRNKLLKSFSALGPYIRELKCQNGYFFFDCLAVCVSAKVVPEKREFWGWWLELEEDEKGFVYNYQIGLFDKNGEWQPMGIKKIADLEHLESTLQAFHKRLTDSFNTFKLTLIPSKNTIALQTQVMA

SEQ ID NO: 11225 - protein, 138 aa, Xenorhabdus bovienii
  Coding DNA sequence: Name=SeqID_5117
MFPSCCNRTRGHNDNTVAFFMLLSTLPNQFHNMSTIQTTRATSQYTRSQFHNQCLAAIHHISAITVSLKKTSLKKQCSVLTGEERYANRHNAKLKKSGLRTNSCHNLSLKSDGVFGRDQRKFESIKRISQTFVKCLQS

SEQ ID NO: 11226 - protein, 368 aa, Xenorhabdus bovienii
  Coding DNA sequence: Name=SeqID_5118
  Gene classification: Gene name=ProB; Function=Glutamate 5-kinase; Function class=E Amino acid transport and metabolism
  Homolog annotation: Query=2..366bp; Hit=1..365bp; Blast score=579; Percent Identity=82.0; E value=1e-165; Homolog= proB COG0263
MMNGSQTLVVKLGTSVLTGGSRRLNRAHIVELVRQCAQQHEKGHRIIIVTSGAIAAGREHLGYPDLPATIASKQLLAAVGQSRLIQLWEQLFSIYGIHVGQMLLTRADLEDRERFLNARDTLQALLDNHIIPIINENDAVATAEIKVGDNDNLSALAAILGSADKLLLLTDIEGLYTADPRNNPEAKLIPEVHDISDELKMMAGDSVSGLGTGGMATKLQAAGIAGRAGIDVIIAAGNKPDVVADVIEGKSVGTRFHGQASPMENRKRWIFGAPPAGEIIVDHGAEAAILEKGSSLLPKGMKNVKGNFSRGEVIRIRSLSGKELARGVCRYNSDALRLIAGHHSQQISQILGYEYGAVAVHRDDMIVS

SEQ ID NO: 11227 - protein, 417 aa, Xenorhabdus bovienii
  Coding DNA sequence: Name=SeqID_5119
  Gene classification: Gene name=ProA; Function=Gamma-glutamyl phosphate reductase; Function class=E Amino acid transport and metabolism
  Homolog annotation: Query=1..416bp; Hit=1..416bp; Blast score=585; Percent Identity=72.0; E value=1e-167; Homolog= ZproA COG0014
MLEQMGKAAKAASWQLAQLSTSQKNQALSHIADLLEKETEVILAANQQDMEQAREQNMSEALLDRLLLTPERLRAIADDVRQVCRLADPVGQVIDGQSLDNGLQLSRRRVPLGVIGVIYEARPNVTIDVASLCLKTGNAVILRGGKETHHTNQAMVKVIQQALEQSGLPATAVQAISKPDRELVAELLKMDSYVDMLIPRGGAGLHKLCREQSTIPVITGGIGICHTFVDESVDVEKALDVITNAKVQRPSACNSLETLLVHEKIASDFLPALSTRMKEQGVTLHAGVSAMALLKDGPAEVVEVIEEDYCDEWLSLDMNVEIVSGINQAISHIRTYGTAHSDAILTESLQQADYFVSHVDSSAVYVNASTRFTDGGQFGLGAEVAVSTQKLHSRGPMGLDALTTYKWIGYGDYLSRR

SEQ ID NO: 11228 - protein, 174 aa, Xenorhabdus bovienii
  Coding DNA sequence: Name=SeqID_5120
  Gene classification: Gene name=AroK; Function=Shikimate kinase; Function class=E Amino acid transport and metabolism
  Homolog annotation: Query=1..164bp; Hit=1..164bp; Blast score=161; Percent Identity=47.0; E value=3e-40; Homolog= aroL COG0703
MKQTLFIVGARGAGKTTIGKLLAEALSYTFIDTDESIQASCGMTIADLVEQYGWTHFRELESQILKTVSQNKCVISTGGGMILSSENRQYMQQNGIVIYLQAPAEVLIKRLSLNPENTQRPSLTGKSITEEIESILTEREQLYRECANFIVDANSSTENISSLINGYILNQEIG

SEQ ID NO: 11229 - protein, 47 aa, Xenorhabdus bovienii
  Coding DNA sequence: Name=SeqID_5121
LIYPNIFVLIFLYSRKILYLRLLIPIIVSFYLLTLILFNYIEIWICS

SEQ ID NO: 11230 - protein, 717 aa, Xenorhabdus bovienii
  Coding DNA sequence: Name=SeqID_5122
  Gene classification: Gene name=CaiC; Function=Acyl-CoA synthetases (AMP-forming)/AMP-acid ligases II; Function class=I Lipid metabolism
  Homolog annotation: Query=200..716bp; Hit=1..516bp; Blast score=734; Percent Identity=69.0; E value=0; Homolog= Zaas_2 COG0318
MDMFVKFIRLVVRVLFRVTVEGDDKQFNHPKCIITPNHISFLDGLLIGLFLPVKPVFAVYSHLATPAFLRLIKPYADVVPLDPNNPMAVRTLVKEVDNGRPIVIFPEGRITITGSFMKIYDGAAFVAAKSGAKVVPVRIDGAEQSIFGRLKEIMKLHWFPKITIKVLPAVDFPMPDAPNSSTRRRLAGEHLHAIMMDVRMQTRPKETLFSAYLAAQKRFGRFKPCIEDVTFKEDSYHALLKKILGVSRILERFTQKNERVGLLLPNATVMAAAIYGASLKGRVPALLNYTAGTNGIKNAMKAATIKTIVTSRQFLEKGQLTHLPEQVTEANWVYLEDLKDTITREDKLWILWHLIFPAKAITPSQKPDDDALILFTSGSEGAPKGVVHSHASLLANVEQIKTIADFTPQDRFMSSLPLFHAFGLTVGLFTPLMTGSRVFLYPSPLHYRIVPELVYDRNCTVLFGTSTFLGNYARFAHPYDFARLRYVVAGAEKLSENTKRVWLDKFGIRILEGYGVTECAPVVAINVPMAAKMGTVGRILPGMEARLLPVQGIEGGGRLQLRGPNVMKGYLRVEAPERLEPPTAEDAEGNTHIGWYDTGDIVSVDDEGFCTIKGRVKRFAKLAGEMVSLEAVEQIAARVSPDALHAATAKSDLSKGEALVLFTTDANLNRNTMSGVAREMGMPELAVPRDIRYVKQLPLLGSGKPDFVTLRKMAEQE

SEQ ID NO: 11231 - protein, 398 aa, Xenorhabdus bovienii
  Coding DNA sequence: Name=SeqID_5123
  Gene classification: Gene name=ProP; Function=77 Permeases of the major facilitator superfamily; Function class=G Carbohydrate transport and metabolism
  Homolog annotation: Query=1..392bp; Hit=1..393bp; Blast score=431; Percent Identity=67.0; E value=1e-121; Homolog= ygeD COG0477
MNGTVETQPLLNKGMKAVLLSQFLTAFADNALFFAILAQLKAEAYPGWSLPALQIVFVLTYIVLAPFVGQIADRFSKGRVMLFANGIKLLGAISICIDMNPFLGYTLVGIGAAAYSPAKYGILGELTDGGRLVKANGVMEASTIAAILIGSVAGGFLSDISLALALGLCALMYSAAVVANFYIPRLAAARQGKGWNPKKMLVDFMAVCSVLWRNQETRFSLVGTSLFWGAGVTLRFLLVAWVPVVLGIEGNTTPTLMNAMVAVGIIVGAGLAARFITLKTVRRCMPAGILIGIMVIVFAVQQSIWSSYLILTVLGVFGGLFVVPLNALLQEHGKREMGAGNAVAVQNFGENSAMLVMLGLYLISIMLGASVVAVGIGFGILFSLTMGGVWIWDLLRKN

SEQ ID NO: 11232 - protein, 167 aa, Xenorhabdus bovienii
  Coding DNA sequence: Name=SeqID_5124
  Gene classification: Gene name=CinA (BS); Function=Uncharacterized protein (competence- and mitomycin-induced); Function class=R General function prediction only
  Homolog annotation: Query=1..167bp; Hit=1..164bp; Blast score=193; Percent Identity=59.0; E value=6e-50; Homolog= ZygaD COG1546
MDEKILNQLSIELGKKLQRKKLSLTCAESCTGGWIAKVITDIAGSSAYFNRGFVTYGNDSKNEMLGVSQASLVQFGAVSEQVVKEMAVGALKAARADFAVSVSGIAGPDGGSEEKPTGTVYFGFTYRNGEDVHTVTYRQHFTGDRNAVRLQAVIFSLKTLLEEIIKN

SEQ ID NO: 11233 - protein, 358 aa, Xenorhabdus bovienii
  Coding DNA sequence: Name=SeqID_5125
  Gene classification: Gene name=RecA; Function=RecA/RadA recombinase; Function class=L DNA replication, recombination and repair
  Homolog annotation: Query=1..358bp; Hit=1..353bp; Blast score=586; Percent Identity=85.0; E value=1e-167; Homolog= recA COG0468
MANDENKQKALAAALGQIEKQFGKGSIMRLGENRSMDVETISTGSLSLDIALGAGGLPMGRIVEIYGPESSGKTTLTLQVIASAQREGKTCAFIDAEHALDPVYAKKLGVDIDNLLCSQPDTGEQALEICDALSRSGAVDVIVVDSVAALTPKAEIEGEIGDSHMGLAARMMSQAMRKLAGNLKNSNTLLIFINQIRMKIGVMFGNPETTTGGNALKFYASVRLDIRRTGSVKNGDEVVGSETRVKVVKNKIAAPFKQAEFQILYGEGINTFGELVDLGVKHKMVEKAGAWYSYNGDKIGQGKANATIYLKEHPEVSAELDKKLRELLLNNTGGFSSAVSDYVADYEDNGEEVKNEEF

SEQ ID NO: 11234 - protein, 65 aa, Xenorhabdus bovienii
  Coding DNA sequence: Name=SeqID_5126
LSSQFQYPCINDVDYSYKNKNHIPTGCGSSENSLSQQSERVIRTLRFSLLHRYLHNRLHNQRLHY

SEQ ID NO: 11235 - protein, 887 aa, Xenorhabdus bovienii
  Coding DNA sequence: Name=SeqID_5127
  Gene classification: Gene name=AlaS; Function=Alanyl-tRNA synthetase; Function class=J Translation, ribosomal structure and biogenesis
  Homolog annotation: Query=13..887bp; Hit=1..875bp; Blast score=1400; Percent Identity=78.0; E value=0; Homolog= alaS COG0013
MNLFFQLDFGTIMSKSTAEIRQAFLDFFHTKGHQIVPSSSLVPNNDPTLLFTNAGMNQFKDVFLGLDKRPYSRATTAQRCVRAGGKHNDLENVGYTARHHTFFEMLGNFSFGDYFKQDAIKYAWELLTGKEWFNLPKEKLWVTVYETDDEAYDIWHKEVGVPAEKIIRIGDNKGVPYASDNFWQMGDTGPCGPCTEIFYDHGEHIWGGTPGSPEEDGDRYIEIWNIVFMQFNRHADGTMEPLPKPSVDTGMGLERLTAVLQHVNSNYDIDLFSDLIASVAEVTGTTDLTNKSLRVIADHIRSCAFLICDGVIPSNENRGYVLRRIIRRAIRHGNMLGAKETFFYKLVAPLIKIMGAAGDELKHQQSLVEQVLKTEEEQFARTLERGLQLLDEELAKLSGDILDGETAFRLYDTYGFPVDLTADVCRERNIKVDEAGFDVAMENQRRRARESSGFGTDYNEQIKVDGRSDFSGYEHNSQQATVIAIFRHGEAVDQIHSGEEAIVILDKTAFYAESGGQVGDTGKLSNGNGVFEVADTQKYGQAIGHIGKLINGTLSVNCTANAEINIVRRDSIRLNHSATHLLHAALRQILGEHVSQKGSLVNDKYLRFDFSHFEAMKPEQIRQVENLVNEEIRKNSSIVTELMELEEAKTKGAMALFGEKYDEQVRVLSMGGFSTELCGGTHASRTGDIGLFRISSESGTAAGIRRIEAITGQTALNSVYQQTDLLQDIAHLVKGDISSLNEKVKTTLDRTKQLEKELQQLKSQQAAQESSSLANQTKEIQGVRLLVTQLGDTEPKMLRTMVDDLKNQLGSAIIVLSTVTGDKVTLIVGITKDLTARIKAGDLISFVAQQVGGKGGGRPDLAQAGGTDAAALPSALASVEEWVTLRL

SEQ ID NO: 11236 - protein, 32 aa, Xenorhabdus bovienii
  Coding DNA sequence: Name=SeqID_5128
MRPTFQQFHNKKTSGTIKNTFMVPWLSRQYQL

SEQ ID NO: 11237 - protein, 52 aa, Xenorhabdus bovienii
  Coding DNA sequence: Name=SeqID_5129
MFFCCEIVEMLGAYLYFSYPIDIGNVFKTAYTLSRYHCFTFSRCLMDNSGET

SEQ ID NO: 11238 - protein, 80 aa, Xenorhabdus bovienii
  Coding DNA sequence: Name=SeqID_5130
VDAILELKSCRLRFLCLNPLINFFTVNRNFLGRIHTNANLVAFNSQYCDCYLIAYHERFTNSTSQNKHSLLLENLKESGL

SEQ ID NO: 11239 - protein, 39 aa, Xenorhabdus bovienii
  Coding DNA sequence: Name=SeqID_5131
LGATLLPRYSASPSFQIEVIHASLLPYFLFSHVFLFSIC

SEQ ID NO: 11240 - protein, 30 aa, Xenorhabdus bovienii
  Coding DNA sequence: Name=SeqID_5132
MLSLTAKGMFYQQHNPLNLAKIYENDYSPL

SEQ ID NO: 11241 - protein, 519 aa, Xenorhabdus bovienii
  Coding DNA sequence: Name=SeqID_5133
  Gene classification: Gene name=GshA; Function=Gamma-glutamylcysteine synthetase; Function class=H Coenzyme metabolism
  Homolog annotation: Query=1..517bp; Hit=1..518bp; Blast score=744; Percent Identity=68.0; E value=0; Homolog= gshA COG2918
LIPDVSKALSWLEANPTVLNGICRGIERETLRVTPDGHLAMTGHPEPLGASLTHKWITTDFAESLLEFITPVDSDIERTVAFLKDLHRYTAQNLGNEKMWPLSMPCFIDKEENITLAQYGTSNVGRFKTLYREGLKNRYGALMQTISGVHYNFSLPISFWQAWLGIKDAESGKEQISDGYFRLIRNYYRFGWVIPYLFGASPAICSSFLRGRETALPFEETEKGTCYLPYATSLRMSDLGYTNKSQSDLNITFNNLHSYVEGLKKAIHKPSTEFAALGNKKDGKYLQLNTNVLQIENELYAPIRPKRVTQESESPSDALLRGGVEYIEVRSLDINPFTAIGVNEIQIRFLDLFLIWCALADAPEMSSKELDCCRQNWNKVILEGRKPGLNIGIGYGIEQQPLKTVGQELFKDLERVAEVLDTCSGTQYQSACKELVGMFEDPSLTFSARVLGNMKAQGIVGFGLELATKYHRELLEEPYSILSEECFSVERHASIERQNSLEQQNSMDFEDYLKLHAGY

SEQ ID NO: 11242 - protein, 171 aa, Xenorhabdus bovienii
  Coding DNA sequence: Name=SeqID_5134
  Gene classification: Gene name=LuxS; Function=LuxS protein involved in autoinducer AI2 synthesis; Function class=T Signal transduction mechanisms
  Homolog annotation: Query=1..171bp; Hit=1..171bp; Blast score=301; Percent Identity=85.0; E value=2e-82; Homolog= luxS COG1854
MPLLDSFTVDHTRMEAPAVRVAKTMKTPHGDTITVFDLRFCVPNKEVMPEKGIHTLEHLFAGFMRNHLNGDGVEIIDISPMGCRTGFYMSLIGEPAELRVAESWKAAMADVLKVKDQNQIPELNIYQCGTSEMHSLQEAQDIARHILDADVRVNLNDELALPEEILVELQV

SEQ ID NO: 11243 - protein, 142 aa, Xenorhabdus bovienii
  Coding DNA sequence: Name=SeqID_5135
  Homolog annotation: Query=1..131bp; Hit=153..283bp; Blast score=160; Percent Identity=61.0; E value=5e-39; Homolog= ref|NP_927686.1|
LVINDCGELLAVKLTSGNKDDRHPVKARVQGLTGCLYGDKGYLSQALCDELEAEGITLITHVRSNMKAKALSLWDKLMLRKRFLIETVVDQLKNISQIAHSRHRSQLGFLLEIVAGLIAYTFQPKKPSLNLRDCDIAIFKRS

SEQ ID NO: 11244 - protein, 126 aa, Xenorhabdus bovienii
  Coding DNA sequence: Name=SeqID_5136
  Gene classification: Gene name=Tra8; Function=Transposase, IS30 family; Function class=L DNA replication, recombination and repair
  Homolog annotation: Query=1..83bp; Hit=1..84bp; Blast score=56; Percent Identity=40.0; E value=5e-09; Homolog= BH2524 COG2826
MAYTQLTEIERYQISSLKEAGFTQRFIATSLNRNPSTISRELKRNQAVQKYCPQQAQLKASERRHSALKAVKVTPEILIQPKLLFVTTSVFPVIAYLRASHSEGKRVQAGFMALNFIWLSMIVVNF

SEQ ID NO: 11245 - protein, 328 aa, Xenorhabdus bovienii
  Coding DNA sequence: Name=SeqID_5137
  Gene classification: Function=Transposase; Function class=L DNA replication, recombination and repair
  Homolog annotation: Query=3..320bp; Hit=2..310bp; Blast score=139; Percent Identity=31.0; E value=5e-33; Homolog= NMB1750 COG3547
MHYVGIDVSKNKLDICLLYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELSELEALIAEHINQHPNLKKDFELLTSIKGVGTQIGLNMLIILRTNTFTRATQVAAYLGVIPIAKQSGTSVHGRVRLSKTGPTKIRAKLFMSALTAVRFNPHINDLYNRLVNKGKAKMLALGAAMRKLVHLCYGVLNTQQSYDENYAIRT

SEQ ID NO: 11246 - protein, 427 aa, Xenorhabdus bovienii
  Coding DNA sequence: Name=SeqID_5138
  Gene classification: Function=Hemolysins and related proteins containing CBS domains; Function class=N Cell motility and secretion
  Homolog annotation: Query=9..419bp; Hit=1..411bp; Blast score=572; Percent Identity=72.0; E value=1e-163; Homolog= yfjDm COG1253
LENVSTSTLIIILVIMVIISAYFSASETSMMTINRYRLRHLARQGSHPARRVESLLHRPDRLISLILIGNNLINILASSLATIVGMRLYQDAGVAIATGILTFVILVFAEVMPKTIAALYPEKVAFPSSLLLRPLEKIMFPLVWAFNKISLLLMRCLGIKTSDIRNDAVSKDELRTIVNESNTNLSRRNQDMLISILDLEKVTVGDIMVPRNEIVGIDINDDWKSVIRQLTHSPHGRIVLYRDSLDDAIGMLRVREAYRLMMEKKAFTKRNLIKAADKIYFIPVSTPLNTQLVNFQRNKQKAGLIVDEYGDIQGLVTVEDILEEIVGDFTTSMSPTLAEEVLPQSDGTVLVDGTANIRELNKAFGWALPSDGPRTMNGMILEELGEIPELNAQVQINKYNFEILSVHGNVIKQVRVTPINQAAKISE

SEQ ID NO: 11247 - protein, 185 aa, Xenorhabdus bovienii
  Coding DNA sequence: Name=SeqID_5139
  Gene classification: Gene name=CcmC; Function=ABC-type transport system involved in cytochrome c biogenesis, permease component; Function class=O Posttranslational modification, protein turnover, chaperones
  Homolog annotation: Query=1..183bp; Hit=105..287bp; Blast score=214; Percent Identity=65.0; E value=5e-56; Homolog= ypjD COG0755
MTVVAFRGRAWFLQPIVYSFAMINLMLASMVPGAFITHLEDSIELFIHIGLALLGYATLLIAALYALQLGWLDHLLKKKKFSFSSGMPPLMTIERKMFHITQVGVILLTLTLCAGIMYMDNIFGKENIHKSVLSIIAWFVYVILLWGHYHEGWRGKRVIWFNLIGAFILTLAFFGGRLLQEIMVY

SEQ ID NO: 11248 - protein, 62 aa, Xenorhabdus bovienii; identical to SEQ ID NO: 7756
  Coding DNA sequence: Name=SeqID_5140
  Homolog annotation: Query=3..47bp; Hit=70..115bp; Blast score=84; Percent Identity=89.0; E value=3e-16; Homolog= ref|NP_667667.1|

SEQ ID NO: 11249 - protein, 36 aa, Xenorhabdus bovienii
  Coding DNA sequence: Name=SeqID_5141
VNIFASLIKITLPGDSRLSPQKFNSTASPIIPTTSS

SEQ ID NO: 11250 - protein, 249 aa, Xenorhabdus bovienii
  Coding DNA sequence: Name=SeqID_5142
  Gene classification: Gene name=Tra8; Function=Transposase, IS30 family; Function class=L DNA replication, recombination and repair
  Homolog annotation: Query=3..234bp; Hit=81..312bp; Blast score=257; Percent Identity=56.0; E value=9e-69; Homolog= NMA1481 COG2826
MWIKQLIWQDLSPEQTVGYLKSENIISLHHETVYRLIYKDKLNGGDLWQHIRIAKKPYRKRYGSYERRGKIKNRVSIDKRPKLVDKKQRIGDWEGDTIVGKDHKSALLTLVERKSLFTIIIKLEDKTAEGVAKAATRHLSLIKHKIKTMTFDNGLEFAEHELISENLETKIYFAHPYSPWERGINENTNGLIRDYFPKGTDFNKVSELEINLVANRLNNRPRKTRDYKTPNELFKGIPTHLLRSLRCCA

SEQ ID NO: 11251 - protein, 49 aa, Xenorhabdus bovienii
  Coding DNA sequence: Name=SeqID_5143
LGRVFLSVPPSCIASNQVNPRHISTTYSSNMTCQLLISIYYVQKPNISA

SEQ ID NO: 11252 - protein, 281 aa, Xenorhabdus bovienii
  Coding DNA sequence: Name=SeqID_5144
  Gene classification: Function=Uncharacterized BCR; Function class=S Function unknown
  Homolog annotation: Query=22..280bp; Hit=3..260bp; Blast score=314; Percent Identity=61.0; E value=6e-86; Homolog= yafD COG3021
VTGVNLVRSYARRRHAKKNSAQKNYAMRYVADQPVELVLPTSKRLLEDNSLPHGQPLPARNHELCVAIWNIYKQQRPSWQEVLGSLIESSQLILLQEAQTTPDLLKFVTASGLVADQVPAFSIPQHPSGVMTLASSSPVYCYPLREKEPILRLSKSSLITIYPLPDDRQLMVINVHAINFSLGVDVYSRQLNNIGIHINLHHGPVIFAGDFNAWSRRRLRVLVRFAQRMQLKEVYFNDDHRTIVFGKPLDFVFYRELKVLNAAVLTTMASDHNPLIVNFSL

SEQ ID NO: 11253 - protein, 462 aa, Xenorhabdus bovienii
  Coding DNA sequence: Name=SeqID_5145
  Gene classification: Gene name=AnsP; Function=Gamma-aminobutyrate permease and related permeases; Function class=E Amino acid transport and metabolism
  Homolog annotation: Query=4..457bp; Hit=3..458bp; Blast score=553; Percent Identity=67.0; E value=1e-157; Homolog= PA5097 COG1113
MQHNENQLKQGLSVRHIRFMALGSAIGTGLFYGSAAAIQHAGPAVLLAYLIGGAAVFMVMRALGEMAVHHPVSGSFSQYASHYLGPLAGFLTGWIYVLEMLFVCLADITAFGMYMRLWFPHVDQWIWVLGIVCFIGALNLCHVKIFGEMEFWLSIVKVTAIIAMIIGGIIIMIYGFGQSTEHATGISNLWEHGGFMPNGISGVIASFAIVMFAFGGIEVIGITASEAKNPEKTIPKAINAVPFRILIFYVLTLCILMCIYPWNQIDQNASPFVQIFSNLGINSAANILNVVVITAAISAINSDIFGAGRMMYGMAQERQAPEAFKKLTRNGVPWMTVLVMTMVLLLGVWLNFLIPNDIFILIASVATFATVWVWLMILISHVAMRRQMSAEDIKSLKFPVPMWPIAPAITIVFMVGVIVLLGYFEQTRDALYVGIGWVLVLTLAYSFCVKKKLSTDHRSTNQ

SEQ ID NO: 11254 - protein, 59 aa, Xenorhabdus bovienii
  Coding DNA sequence: Name=SeqID_5146
MPHAQALFKLIFIMLHSLFPSIFHAKEYFRHTMLCLASNTSKSNPVQYHKDGCSRDRYL

SEQ ID NO: 11255 - protein, 223 aa, Xenorhabdus bovienii
  Coding DNA sequence: Name=SeqID_5147
  Gene classification: Gene name=NrdG; Function=Organic radical activating enzymes; Function class=O Posttranslational modification, protein turnover, chaperones
  Homolog annotation: Query=1..223bp; Hit=1..223bp; Blast score=349; Percent Identity=70.0; E value=1e-96; Homolog= ZygcF COG0602
MIYPINEIFQTLQGEGVFTGVPSVFIRLQGCPVGCSWCDTKHTWEKEADKQQPMENILVKSQDSDTWGAATARQIINLFIRQGYTARHIVVTGGEPCLYDLRPLTETLESEGYQCQIETSGTHAIQCSEKTWVTVSPKVKMRGGYQVLPEAMNRANEIKHPVGRERDIEALDELLTMLDEKADPVIALQPISQKEEATRLCIETCIARNWRFSMQTHKYLNIA

SEQ ID NO: 11256 - protein, 120 aa, Xenorhabdus bovienii
  Coding DNA sequence: Name=SeqID_5148
  Gene classification: Function=6-pyruvoyl-tetrahydropterin synthase; Function class=H Coenzyme metabolism
  Homolog annotation: Query=1..120bp; Hit=2..121bp; Blast score=218; Percent Identity=83.0; E value=8e-58; Homolog= ygcM COG0720
MSTTIFKDFQFEAAHRLPHVPEGHKCGRLHGHSFMVRLEITGEVDPLSGWIMDFADVKSAFKPIWERLDHNYLNEIPGLENPTSEVLAKWIWEKLKPTLPQLSAVMVKETCSAGCIYRDE

SEQ ID NO: 11257 - protein, 611 aa, Xenorhabdus bovienii
  Coding DNA sequence: Name=SeqID_5149
  Gene classification: Gene name=CysJ; Function=Sulfite reductase flavoprotein subunit; Function class=P Inorganic ion transport and metabolism
  Homolog annotation: Query=12..611bp; Hit=1..599bp; Blast score=840; Percent Identity=68.0; E value=0; Homolog= cysJ COG0369
MDIGYSKGHGIMTTKPPSTVLLPVSPEQLSRLQSAIGDFSPYQLAWLSGYFWGMVNQKPQTEVVTPAAPISETVTLISASQTGNARRLAEQLRDSLLAEKLNVNLVNAGDYKFKQIAQERVLIIIASTQGEGEPAEEAVALYKYLNSKKAPSMKETAYAVFGLGDTSYENFCQAGKDFDHRLNELGAQRLLERIDADVEYQEQAAQWRQQITEVLKQRLPAQTQAGITVNQVGSVSEIIFSPYTKDAPLTASLLTNQRITGRGSDKDVRHIEIDLGNSGLHYQPGDALGVWFENDPALVDELIELLWLTGSELVNVHGKSLPLRQALISHVELTQNTGLIVEKYAVLAKDQKLLALIADKQALQQYAQKTPIVDMVRQAALHPEAQQFIDLLRSLTPRLYSISSSQAEVENEVHVTVGVVRYEIEGRARTGGASGYLADRLQEDDNIRIFIEHNDNFRLPANPQTPVIMIGPGTGVAPFRAFLQQRDNQGAEGKNWLFFGNPHFVEDFLYQVEFQRYAKDGLLTRIDLAWSRDQQHKIYVQDKLREQGKEIWRWIQNGAHLYVCGDANRMAKDVEQALLDIISQQGDMDAEQADEFLSELRLERRYQRDVY

SEQ ID NO: 11258 - protein, 576 aa, Xenorhabdus bovienii
  Coding DNA sequence: Name=SeqID_5150
  Gene classification: Gene name=CysI; Function=Sulfite reductase hemoprotein beta-component; Function class=P Inorganic ion transport and metabolism
  Homolog annotation: Query=1..571bp; Hit=1..570bp; Blast score=965; Percent Identity=78.0; E value=0; Homolog= ZcysI COG0155
MNNEKKGLLKVEGKLADSERMKSDSDYLRGTISEDLNNGLTGGFEGDNFLLIRFHGMYQQDDRDIRAERAEQKLEPRHAMMLRCRLPGGIITPSQWLGIDQFATEDTLYGSIRLTNRQTFQFHGILKNNLKPAHQLLAKMGLDSLATANDVNRNVLCTSNPVQSALHQQAYEWAKKISEHLLPRTSAYAEIWLDKEKVATTDEEPILGSTYLPRKFKTSVVIPPQNDVDLHANDLNFIAIAENDQLIGFNVLVGGGLAMTHGDKNTFPRLASEFGFIPLEHTLSIAEAVVTTQRDWGNRTERKNAKTKYTLERVGVETFKQEVEKRAGVHFEAIRPYEFTGRGDQIGWLKGIDDQWHLTLFIENGRLLDYPNKPIKTGIAEIAKIHKGDFRLTANQNLIVAGVPESEKARIEEIARTHGLIDNSVTFLRHHSMACVSFPTCPLAMAEAERFLPAFVDHVDALMEKHGVSDEHIVLRVTGCPNGCGRAMLAEIGLVGKAQDRYNLHLGGNRVGSRIPRMYRENITSAEILVILDELIGRWSAERNTHECFGDFLVRTDIIKPVLNSALDFYDWQEAL

SEQ ID NO: 11259 - protein, 244 aa, Xenorhabdus bovienii
  Coding DNA sequence: Name=SeqID_5151
  Gene classification: Gene name=CysH; Function=3'-phosphoadenosine 5' -phosphosulfate sulfotransferase (PAPS reductase)/FAD synthetase and related enzymes; Function class=E Amino acid transport and metabolism
  Homolog annotation: Query=1..243bp; Hit=1..243bp; Blast score=366; Percent Identity=73.0; E value=1e-101; Homolog= ZcysH COG0175
MSQLHLAELLALNHGQRAEALADINQQLELLDARQRVSWALEHLSGEFVLSSSFGIQAAVCLHLVTREYQDIPVILTDTGYLFPETYQFIDKLTDKLKLNLTVFRAEHSPAWQESRYGKLWEQGIEGIERYNQINKVDPMNRALKLLHAQSWFAGLRRQQSESRANLPVLAVQRDVFKILPIVDWDNRRVHQYLAQQGLEYHPLWEQGYLSVGDTHTTQKWQTGMSEEQTRFFGLKRECGLHES

SEQ ID NO: 11260 - protein, 486 aa, Xenorhabdus bovienii
  Coding DNA sequence: Name=SeqID_5152
  Gene classification: Gene name=CysG; Function=Uroporphyrinogen-III methylase; Function class=H Coenzyme metabolism
  Homolog annotation: Query=224..465bp; Hit=8..249bp; Blast score=297; Percent Identity=63.0; E value=2e-80; Homolog= NMB1156_2 COG0007
VDYLPLFVELKSRPVLLVGGGEVASRKASLLLRAGAALTIVAPELHFELQQRYQKAEFAWEQGGFRTEYLDGVFLVIAATDDHDLNQHIFTEANARAILVNVVDDQPLCSAIFPSIIDRSPIMVAISSAGKSPVLTKLLREKLESLLPFHLGIMAEIAGRWRERVKQRLTSIRQRRHFWEKALNGRFATLVANGQLQQAEAQLDEQLIDEQRVNEQLASAGKQGELALVGAGPGDPGLLTLKGLQVIQQADVVLYDHLVSAEILELVRRDADQICVGKRAGNHSVAQEETNALIIKLSRQGKKVVRLKGGDPFIFGRGGEELQAAAEAGITFQVVPGITAAVGAAAYAGIPLTHREHSQSVTFITGHCRENGDELDWPALARGNQTLAIYMGIIKAALISQKLISHGRDANTPVAVIGCGTRPEQQVLTGTLSELERLAQKAPSPALLVVGEVAQLHHQIAWFGQQSVDQKQSVAQISRPAVIDLV

SEQ ID NO: 11261 - protein, 302 aa, Xenorhabdus bovienii
  Coding DNA sequence: Name=SeqID_5153
  Gene classification: Gene name=CysH; Function=3'-phosphoadenosine 5' -phosphosulfate sulfotransferase (PAPS reductase)/FAD synthetase and related enzymes; Function class=E Amino acid transport and metabolism
  Homolog annotation: Query=1..302bp; Hit=1..302bp; Blast score=536; Percent Identity=85.0; E value=1e-152; Homolog= cysD COG0175
MDEKKLTHLQQLEAESIHIIREVAAEFANPVMLYSIGKDSSVMLHLARKAFYPGKLPFPLLHVDTGWKFREMYDFRDHTAEKYGFELLVYRNPQGEALGINPFIHGSAKHTDIMKTEGLKQALDKYRFDAAFGGARRDEEKSRAKERIYSFRDRSHRWDPKNQRPELWRNYNGQINKGESIRVFPLSNWTELDIWQYIYLEQIDIVPLYFAKPRPVIQRDGALIMVDDARIDLKSGEVISQRKVRFRTLGCWPLTGAVESEAETLPEIIEEMLISTTSERQGRLIDSDQSGSMELKKRQGYF

SEQ ID NO: 11262 - protein, 480 aa, Xenorhabdus bovienii
  Coding DNA sequence: Name=SeqID_5154
  Gene classification: Gene name=CysN; Function=GTPases - Sulfate adenylate transferase subunit 1; Function class=P Inorganic ion transport and metabolism
  Homolog annotation: Query=7..480bp; Hit=2..475bp; Blast score=676; Percent Identity=70.0; E value=0; Homolog= cysN COG2895
MPALAHNETIASQIKQQGGVEAYLRIQQEKGLLRFLTCGSVDDGKSTLIGRLLHDTRQIYEDQLATLQNDSKRLGTQGEKLDLALLVDGLAAEREQGITIDVAYRYFSTEKRKFIIADTPGHEQYTRNMATGASTSDLSILLIDARKGVQEQTRRHSFISTLLGIRHLVVAVNKMDLVDYRQDIYEQIKQDYWDFAGQLPTDLHIYFVPISALEGDNIVSRSEKMAWHTGETLLDTLETVDVKKKAMDQPLRFPVQYVNRPDLDFRGYSGTLSSGILRQGQQIKVMPSGVISTIERIVTFDGDLPFSVPGEAITVVLKDEIDISRGDLLIAVEDHMTVARHALVDVVWMSEQPLIQGQSLDIKVAGKKSRGKVDNVQYQVDITNLTQKVAVELPLNAIGLVEFSFDEPLLIDSYPQNADTGGIILIDRLTNVTVGAGLVREIQTEVYEEPKEYSEFELEFNRLVRRHFPHWGARDLLGGK

SEQ ID NO: 11263 - protein, 205 aa, Xenorhabdus bovienii
  Coding DNA sequence: Name=SeqID_5155
  Gene classification: Gene name=CysC; Function=Adenylylsulfate kinase and related kinases; Function class=P Inorganic ion transport and metabolism
  Homolog annotation: Query=11..203bp; Hit=7..199bp; Blast score=280; Percent Identity=70.0; E value=9e-76; Homolog= cysC COG0529
VSQIKEHTSSNVVWHSHTLDRKQREAVNGHPALVIWFTGLSGSGKSTIAGALEQALFSRGIRTYLLDGDNLRHGLCSDLGFSETERRENIRRIGEVSKLMVDAGLVVLTAFISPHRAERQKLRELMGEDRFIEVFVDTPLAICEARDPKGLYKKARAGELINFTGIDSAYEVPEQPDIYLDGSLPVESLIEKLLAALHNHGFLPI

SEQ ID NO: 11264 - protein, 106 aa, Xenorhabdus bovienii
  Coding DNA sequence: Name=SeqID_5156
  Gene classification: Function=Septum formation initiator; Function class=O Posttranslational modification, protein turnover, chaperones
  Homolog annotation: Query=1..105bp; Hit=1..103bp; Blast score=115; Percent Identity=66.0; E value=7e-27; Homolog= ygbQ COG2919
MGKLTLLLLVLLGWLQYSLWFGKNGIHDYVWVKDEVARRNSADITLRARNNQLFAEIKDLKKGQEAIEERARNELGMIKPGESFYRLVPDTSKHNAQQSLKENSKQ

SEQ ID NO: 11265 - protein, 259 aa, Xenorhabdus bovienii
  Coding DNA sequence: Name=SeqID_5157
  Gene classification: Gene name=IspD; Function=4-diphosphocytidyl-2 -methyl-D-erithritolsynthase; Function class=I Lipid metabolism
  Homolog annotation: Query=12..252bp; Hit=3..229bp; Blast score=279; Percent Identity=59.0; E value=2e-75; Homolog= ZygbP COG1211
MNNPIFHSPADTSLADIVALIPAAGIGSRMKSDCPKQYLPLAGKTIIEHTLTALLEHPRIQRVIVALNSADNQFGRLAIASDPRITTVVGGSERADSVLAGLDYLASLSTDSSVWVLVHDAARPCLHRDDLDNLLQLINRSAPSPAVCGGLLAAPVRDTMKRMVMPSEEEPSTIDYTVDRRGLWHALTPQLFPLQLLRDCLAKALAEQACITDESSALEYCGYHPVLVHGRADNIKVTQPEDLALAEFYLSRKSKEHIV

SEQ ID NO: 11266 - protein, 157 aa, Xenorhabdus bovienii
  Coding DNA sequence: Name=SeqID_5158
  Gene classification: Gene name=IspF; Function=2C-methyl-D-erythritol 2,4-cyclodiphosphate synthase; Function class=I Lipid metabolism
  Homolog annotation: Query=1..156bp; Hit=1..156bp; Blast score=251; Percent Identity=85.0; E value=3e-67; Homolog= ygbB COG0245
MRIGHGFDVHKFGGEGPLVIGGVSIPYEQGLIAHSDGDVALHAATDALLGAAALGDIGKLFPDTDPAFKGADSRELLKEAYRRIRKKGYRIGNLDITIIAQAPKMLPHIPQMRVNLAEDLECHMDDINVKATTTEKLGFVGRKEGIACEAVALLVKE

SEQ ID NO: 11267 - protein, 349 aa, Xenorhabdus bovienii
  Coding DNA sequence: Name=SeqID_5159
  Gene classification: Function=Uncharacterized ACR; Function class=S Function unknown
  Homolog annotation: Query=6..338bp; Hit=7..339bp; Blast score=400; Percent Identity=60.0; E value=1e-112; Homolog= ygbO COG0585
MTLSELHWLYGQPEATGVVKASPEDFIVREDLGFSPDGEGEHLMIHIRKIGCNTQFVADYLARFAKIPARSVSYAGLKDRNAVTEQWFCVHLPGKQDPDLTAFQLEGCEVLTTSRQKRKLRIGALKGNDFTLVLRQISDRQSVEKRLQQIAQTGVPNYFGEQRFGRDGQNLVQAQRWADNEIQVKERSRRSFYLSASRSAMFNTIASLRIAQDTHQQVLNGDALQLTGRGSWFVADELELPVLQQRIMDGELQITAPLPGDKALGTQHQALDFEQHCLLDYASLWSLVKRERVESVRRAILVQPLNLNWEWLDEQTVTLHFSLPSGSFATSVVRELINQDQNNAADIAQ

SEQ ID NO: 11268 - protein, 400 aa, Xenorhabdus bovienii
  Coding DNA sequence: Name=SeqID_5160
  Gene classification: Gene name=XerC; Function=Integrase; Function class=L DNA replication, recombination and repair
  Homolog annotation: Query=1..391bp; Hit=18..403bp; Blast score=296; Percent Identity=40.0; E value=2e-80; Homolog= Z0324 COG0582
MPLTDTKIKNAKPKDKPYNLPDGNGLYLEIRPTGAKFWRYRFWLTPTKDSRYTIGEYPYIGLADARKERDWAKEQVKKGFNPTEVRKQEKYLVEIERENTFRSIALEWISKKAPNWESGTLEQVKMFLDKNCYPAFGDKPIKEVSAHDILKVLKSMEARGSASSALKIRQWCSAIFCYAVSTLRAEYDPAAALKGAIIRPKTQHSRCLPNEEIKLYFDRLEKARVYSQTKLALGLLPFVFVRQTELRQATWDEIDFDNQIWVIKAERMKMKRAHSVPLTDRMLECFRRLEVLFGDNEQGLIFPGINTPSKPIGESTLNRAIEYMGFGSKYITCHDFRATASTTLYEMGFRREVIEKQLAHAEQNRSVAAYNHAEYLNERREMMEAWERHLLSITSGIILS

SEQ ID NO: 11269 - protein, 82 aa, Xenorhabdus bovienii
  Coding DNA sequence: Name=SeqID_5161
MCGLFGRRLRMDNLLNRKQVCNVLSLSRATLYRKIKNGLIPKPLKDGRSSKWKESDLQPYINSLDRGFSAKISRKNDATCNA

SEQ ID NO: 11270 - protein, 72 aa, Xenorhabdus bovienii
  Coding DNA sequence: Name=SeqID_5162
MNTQNEFENGRRQVAKECLKELNNLPQYDDKAVAAILDKYTPKFKPLNHMRFSAKSVLGYYVRIIRKEIKNG

SEQ ID NO: 11271 - protein, 61 aa, Xenorhabdus bovienii; identical to SEQ ID NO: 7548
  Coding DNA sequence: Name=SeqID_5163

SEQ ID NO: 11272 - protein, 193 aa, Xenorhabdus bovienii; identical to SEQ ID NO: 7554
  Coding DNA sequence: Name=SeqID_5164
  Homolog annotation: Query=5..185bp; Hit=8..197bp; Blast score=137; Percent Identity=40.0; E value=1e-31; Homolog= ref|NP_759080.1|

SEQ ID NO: 11273 - protein, 74 aa, Xenorhabdus bovienii
  Coding DNA sequence: Name=SeqID_5165
  Homolog annotation: Query=1..58bp; Hit=1..58bp; Blast score=60; Percent Identity=55.0; E value=7e-09; Homolog= ref|NP_759081.1|
MKNKLEDLNNHLFAQLERLSDENILNEQLEKEFRRSKSISDIAIQIVNNGKLALDVKKAIGNQDVDSLPKFLGG

SEQ ID NO: 11274 - protein, 179 aa, Xenorhabdus bovienii
  Coding DNA sequence: Name=SeqID_5166
  Homolog annotation: Query=8..171bp; Hit=15..178bp; Blast score=201; Percent Identity=59.0; E value=4e-51; Homolog= ref|NP_753464.1|
MKTDYGGSNTPKELKDLWQTPLPLFLALDLEFKFKLDAAADAQNTLCAHYLTERDNALESDWESYGSIFCNPPYSKITPWIKKATIECRKQCQSIVMLVPNDTSVGWFKLAMESVDETRLITGGRIQFVPAGVRGKNSSNPKGSMLLIWRPFITPRKTITTVDKEYLFDIGNEKLRKIA

SEQ ID NO: 11275 - protein, 126 aa, Xenorhabdus bovienii
  Coding DNA sequence: Name=SeqID_5167
MSGRIGKMDYSELSDFEINKLVAEKYLSCEYRFNDELQYIELLFDYPHREFRKGIEMRKEVLGIYDPCNKSSQAMPIIIKYGISLLFRDRKFHYASNDGEMECFLDNPYKAAMVIFLHMKDKENEN

SEQ ID NO: 11276 - protein, 64 aa, Xenorhabdus bovienii
  Coding DNA sequence: Name=SeqID_5168
MDIIDTANDAVELTVSHALQNRKPPLTSINGMCRWCETEPAKYGAFCSRECGEDYERENRKNGL

SEQ ID NO: 11277 - protein, 84 aa, Xenorhabdus bovienii
  Coding DNA sequence: Name=SeqID_5169
MSNNLIEKINTTLESAEKLKSEGASIITLDLDVYITILKRLAEYENMEPIAIYNLADGEIYKSINDIGDGKSVFAVNLYPHPNK

SEQ ID NO: 11278 - protein, 143 aa, Xenorhabdus bovienii
  Coding DNA sequence: Name=SeqID_5170
  Homolog annotation: Query=1..139bp; Hit=1..137bp; Blast score=173; Percent Identity=59.0; E value=4e-43; Homolog= ref|NP_930173.1|
MQFTPWNPNPKAAQRVNDPLPVPTQCRHCRSHVKIAHHTEVLGKTRHDDKWPWFYVCWSCDARVGMHPETNIPLGYLADEPTRMARRNGKQEFEQMRKRGNFERTEAYRWLAWRLGISFRKCHFGWFNAEMCQRATNICRGFK

SEQ ID NO: 11279 - protein, 162 aa, Xenorhabdus bovienii
  Coding DNA sequence: Name=SeqID_5171
  Gene classification: Gene name=Ssb; Function=Single-stranded DNA -binding protein; Function class=L DNA replication, recombination and repair
  Homolog annotation: Query=1..162bp; Hit=1..171bp; Blast score=203; Percent Identity=60.0; E value=6e-53; Homolog= BU545 COG0629
MAQRGVNKVILIGNLGQDPEVRYLPNGGAVANITLATSEQWRDKQSGEMREKTEWHRVVIFGKLAEVAGEYLRKGSQVYIEGALQTRKWQDQQGQDRYTTEVSVNVGGTMQMLNSRQGSQQGQQPQQHSGQQQSQFWGAPQQPPGQQQQSPPPIDFDDDVPF

SEQ ID NO: 11280 - protein, 293 aa, Xenorhabdus bovienii
  Coding DNA sequence: Name=SeqID_5172
  Homolog annotation: Query=5..229bp; Hit=2..225bp; Blast score=200; Percent Identity=50.0; E value=2e-50; Homolog= ref|NP_203495.1|
MKFAKAMRKQAKLRLALTGPSGSGKTYGALTIAKGLGGTTAVIDTEKGSASLYSDRFNFDVLELDPPFTPERFIEAITAAQAAGYDNLIIDSITHEWNGTGGCLEMLDGVAKAKYHGNTWSAWSDITPRHNKFLDAILRSDVNIIATMRSKTETAQVDKGNGKKRVDKLGMKSEQRDGVEYEFTTVLDLNHETHTATASKDRTGLFSNADFTVIDEGTGKRLMDWLNDGRSKAEIDLTHFTESAGKAQNMDELKAAFAEAYKSLRGTPEQGEAQEKYELRKSEFEPIEPKEVA

SEQ ID NO: 11281 - protein, 113 aa, Xenorhabdus bovienii
  Coding DNA sequence: Name=SeqID_5173
MTSNHWRSYGCFVPKDPIEKKRYLKELVFATMINNTPHPASKKLSERVREERAGQANHEAALNHPPLPRHMAEQRAKLERQAWRDYYATHHIEYDHYKGHSPTRRHGGIWTGD

SEQ ID NO: 11282 - protein, 68 aa, Xenorhabdus bovienii
  Coding DNA sequence: Name=SeqID_5174
MSASDCWSCEIPREILSTDGQSLHTQHLPLIFQFLVLGYLFIRVFPFMLLILSVIGAVVVSHTTSRSS

SEQ ID NO: 11283 - protein, 68 aa, Xenorhabdus bovienii
  Coding DNA sequence: Name=SeqID_5175
MAAKFYINDGRFKTEPDGRGGTVIIVDDYTKWQVEGEGKEIMRNSIGLEREDIISILNDHYQDEREVV

SEQ ID NO: 11284 - protein, 40 aa, Xenorhabdus bovienii
  Coding DNA sequence: Name=SeqID_5176
MQINKRLLCQAQELALEAVRLRSRDVWRSAMKILKRSYGR

SEQ ID NO: 11285 - protein, 313 aa, Xenorhabdus bovienii
  Coding DNA sequence: Name=SeqID_5177
  Homolog annotation: Query=3..313bp; Hit=5..300bp; Blast score=110; Percent Identity=45.0; E value=2e-23; Homolog= ref|NP_930167.1|
MANELVIIEPATALDLFTAPDKVQVLISGIKDKAYAEQSELDTDLSKAKNRDAIKSLAYKVTQTKTYIDKAGKAVVDELKSLPKKVDANRKQFRDELDVLSDEIRKPVTEWEDAEKARVAAEELARQIERDHDEALQMNELYDLRKAEEERKRIEHENEIKRQAAEQARIEAEQKAQREREAAELKAKQEREAAELKARQEVEAATKREREAREAQERAEREKQEAIAKAEREKLAAIEAERRKAEEAEKARLAEIERQKQEAANRQADTLHRSAVNNQAMQDLIIAGIPEECAKACVIAIAKGSVTNIKITY

SEQ ID NO: 11286 - protein, 132 aa, Xenorhabdus bovienii
  Coding DNA sequence: Name=SeqID_5178
  Homolog annotation: Query=2..131bp; Hit=4..137bp; Blast score=69; Percent Identity=31.0; E value=9e-12; Homolog= ref|NP_930166.1|
MSKPHVHADLMMKAVGIAQENEKWWEYFEVLHDDADRWLSLAGEFYFDPDKEYRLKPRTVKIGSVDVPEPVREPLEEGQDYYFLDLGGESYYDETFWLGDLDDVDRLNRCLIHLDRESAEIHAKALISLTQK

SEQ ID NO: 11287 - protein, 71 aa, Xenorhabdus bovienii
  Coding DNA sequence: Name=SeqID_5179
MSEITLTIKQIQDVCDMAGISYEKVEESRLSEEFTICENLPMEDIHGRPYKGKGVYCTDYPEDGAMSLEDR

SEQ ID NO: 11288 - protein, 74 aa, Xenorhabdus bovienii
  Coding DNA sequence: Name=SeqID_5180
VNSSLNLLSSTFSYDIPAISQTSCICLIVSVISDIVILLSVVEASASSGLRIHEITSNDRHFRYERNNHHLLYY

SEQ ID NO: 11289 - protein, 92 aa, Xenorhabdus bovienii
  Coding DNA sequence: Name=SeqID_5181
MRGFLLPEYRKMKMSEKIKIHVDAFAKVHYSQELEILKTEFDRMLEIENSDMRNHEIDRALEDIIHRNGFFREKAWVDEDSLEDIEFTALDE

SEQ ID NO: 11290 - protein, 68 aa, Xenorhabdus bovienii
  Coding DNA sequence: Name=SeqID_5182
MAAIISYLFWGYIAVFGLVFGYITFPIGLLFTFMAYKKTRSKILYSILSALFLIPPIAAAIIVKQLHS

SEQ ID NO: 11291 - protein, 79 aa, Xenorhabdus bovienii
  Coding DNA sequence: Name=SeqID_5183
MNAITIDQVKSIFEAAGAMKSYEYLEEITVHCNKEAEYDLNYSGNFPRVKKTAEQYAIEHAKEVAEWQQSNKIRHIYSY

SEQ ID NO: 11292 - protein, 40 aa, Xenorhabdus bovienii
  Coding DNA sequence: Name=SeqID_5184
MKRDRQSAIRFRHDSFLRKHCVQAALNKRRSIRELMAIYG

SEQ ID NO: 11293 - protein, 111 aa, Xenorhabdus bovienii
  Coding DNA sequence: Name=SeqID_5185
  Homolog annotation: Query=7..73bp; Hit=18..84bp; Blast score=76; Percent Identity=55.0; E value=8e-14; Homolog= ref|NP_640294.1|
MKLTELQKQIHQQNVEAGWWDKPRERGTLLCLIHSEISEAMEGERKNLMDDHLPHRPMAEAELADAVIRILDYAEAFGYDIEGAIAEKLAYNRHRADHKRENRAKSGGKAF

SEQ ID NO: 11294 - protein, 91 aa, Xenorhabdus bovienii
  Coding DNA sequence: Name=SeqID_5186
MNSRQRYKLRRKQNRMEARAAAPRTTGEIWDSIFGQPVDEIDALANLFAQLKTDTSDNNGGSCCMSDVALYSTKQRASNRILESGGVTARG

SEQ ID NO: 11295 - protein, 112 aa, Xenorhabdus bovienii
  Coding DNA sequence: Name=SeqID_5187
LLVRQFHRPADRKYCPRFPQSFWEQQPELPCGFASVSIYNVVVSSYVLRKLILVVWWSVFTSTIATLKPPRIKIGVEPVAAALFLRWSSPSCHHTPKPTCFGLPVSRRKLNC

SEQ ID NO: 11296 - protein, 241 aa, Xenorhabdus bovienii
  Coding DNA sequence: Name=SeqID_5188
  Gene classification: Function=Predicted transcriptional regulator; Function class=K Transcription
  Homolog annotation: Query=1..239bp; Hit=1..236bp; Blast score=171; Percent Identity=37.0; E value=6e-43; Homolog= PA0906 COG2932
MTLKDRLKIILCQENLKQKQLAEALSVSAQTVNNWLSRNAISRDAAQSISEQFGYSLDWLLNGMGDQKLESAVKHHYAKSDVPPENEWVGVSTWDSYTPLDDNEVEVPFLKDIEFACGNGSVISVDYNGYKLRFSKATLRRIGAPTDGSTIICFPAKGDSMEPVIPDGAAVAIDIANKHIADGKIYAIEQDGLKRLKVLYRRPAGKILIRSYNRDEYEDEIADEEKVNIIGKLFWHSVLHY

SEQ ID NO: 11297 - protein, 38 aa, Xenorhabdus bovienii
  Coding DNA sequence: Name=SeqID_5189
MLIFFILKINIMLILYTWSYSYGFLANTIADSCECCWW

SEQ ID NO: 11298 - protein, 68 aa, Xenorhabdus bovienii
  Coding DNA sequence: Name=SeqID_5190
  Homolog annotation: Query=4..66bp; Hit=8..70bp; Blast score=73; Percent Identity=61.0; E value=6e-13; Homolog= sp|P14816|VG30_BPPH8
MDFSQTPLQIAVNAVGGKQKTLAKLVGLTPQAISNLKKRGGNLPRTKITEFRKATGLPLEILYPEIAE

SEQ ID NO: 11299 - protein, 115 aa, Xenorhabdus bovienii
  Coding DNA sequence: Name=SeqID_5191
MKHASYRKLFRDKESELLNKIALTGSRNVAKIIDFHESQITRWQRPQKLDDISFIAKMARVLVAIEYDAPDTNVVINREDAKALIEALEYIRYPKRKTSKAATDEVLEMQLEIGI

SEQ ID NO: 11300 - protein, 52 aa, Xenorhabdus bovienii
  Coding DNA sequence: Name=SeqID_5192
MQRYSWRFPPVSSSRCSSRNLASSRASRSFSHPCSVTERVSRSRVRFLCTAL

SEQ ID NO: 11301 - protein, 327 aa, Xenorhabdus bovienii
  Coding DNA sequence: Name=SeqID_5193
  Homolog annotation: Query=206..324bp; Hit=154..270bp; Blast score =168; Percent Identity=67.0; E value=1e-40; Homolog= ref|NP_037739.1|
MSNVAYADFGANASSRSARMENQKQGHFALFRSLLSSGWADDTAKLALWVRLLGMAQYKPRRIEFGGVDWDLDTGQLVTKPRLLARKLRDAKGNEKTPKQVRDMLEFFSSEGMLTFSGNRHGTVITISNYTDYQLDVEVTNKPNNYKGSTQYEVTKQVDDFEVTKQVTNQVTNKPSHDADFSDGQVTKQVTKQVKQSKKLLEQELNTPLTPHEGNDGEVAKPKKRKPTPKINYDEYLNAYNEAVGDRLPHAVEINTPRQKALKKLIPKLLTPNVDGFGAYVRAFVGQARPFFFGGSDSGWTADFDYLLREKTLTGVREGKFAEKDHE

SEQ ID NO: 11302 - protein, 457 aa, Xenorhabdus bovienii
  Coding DNA sequence: Name=SeqID_5194
  Gene classification: Gene name=DnaB; Function=Replicative DNA helicase; Function class=L DNA replication, recombination and repair
  Homolog annotation: Query=2..432bp; Hit=29..461bp; Blast score=240; Percent Identity=37.0; E value=2e-63; Homolog= dnaB COG0305
MNNYDFESSVIGGLLISGLTPDASDVLATLEPEAFATPFYREAFKTIRSQAKTRGLIDSLMVADAMGENHFANVMMTAKNCPSAANLTGYANTVSANYERRLMIELMDEAKERILSGTVENAAESMDWFISQVAEVRKPRDEIRPLHVSELLDDYTEVLEKRLKNGEQSDTLKTGIEELDEITGGINPVDLVIVAARPGMGKTEFALKVAEGVANQTITGTKQKRGVLIFSMEMDSQQIIERQLAGAANLPVSVLRNPARLDDEGWDWVTVGLGRLQDLDVWIIDASKLTVEQIASISRRHKKVHPALSLIMVDYLGLIDKPKAERNDLAVAHISSSLKRLAKDLKTPVIALSQLSRNVETRPNKRPVNADLRDSGSVEQDADSIIMLYRDAVYNENSPAAPYAEIIVTKNRFGQLGTVYQRFRNGHFTPTDQEEAVRVCQNNDNKSHKRFAKGANV

SEQ ID NO: 11303 - protein, 83 aa, Xenorhabdus bovienii
  Coding DNA sequence: Name=SeqID_5195
MIKDYTDHLERLDKLVWVDETHIILNTDLGGTNNEYEIPLHDCDTSEKILWWTFHLSEKNWVTTDMLRRFIRLATVKAKIKID

SEQ ID NO: 11304 - protein, 120 aa, Xenorhabdus bovienii
  Coding DNA sequence: Name=SeqID_5196
  Homolog annotation: Query=1..117bp; Hit=5..129bp; Blast score=60; Percent Identity=32.0; E value=7e-09; Homolog= ref|NP_746046.1|
MKIKTSELTGRALDWAVALADGRGVKINELGYVFVNDNRSIGVYSPSTDWAKCGELIEKHHVELNFNSVSKEWPAYIFSFEELEYVLEDGESPTIAICRAVVAAQLGDEIDIPDELVEGV

SEQ ID NO: 11305 - protein, 72 aa, Xenorhabdus bovienii
  Coding DNA sequence: Name=SeqID_5197
MEIKPIFINGAPLLDGDFNPVRVTKNQARKKAGQMQSAMRKKSWGKSAVGIVCDAGAHFNVSVGFPEPNKVV

SEQ ID NO: 11306 - protein, 80 aa, Xenorhabdus bovienii
  Coding DNA sequence: Name=SeqID_5198
MLALTSMCQWDFLNLTRWFEMTEKTQELLSCPFCGSDVLSINGIRPCNFVECYGCGHSVYGADEHAVIQVWNQRANNDDR

SEQ ID NO: 11307 - protein, 124 aa, Xenorhabdus bovienii
  Coding DNA sequence: Name=SeqID_5199
  Homolog annotation: Query=3..120bp; Hit=31..150bp; Blast score=94; Percent Identity=47.0; E value=5e-19; Homolog= ref|NP_049537.1|
MTDNIITLKFGDDSKPSISTSVTPKTPEQSRCKHGAITVDEQYRIITCDQCGCNVDAFDHLLESARQAECVVREIQELYQRRDELRAACDNLLKEEKNTKVRLRGAKTQLQFLENDIKKVNNGG

SEQ ID NO: 11308 - protein, 163 aa, Xenorhabdus bovienii
  Coding DNA sequence: Name=SeqID_5200
  Homolog annotation: Query=4..146bp; Hit=36..178bp; Blast score=140; Percent Identity=47.0; E value=1e-32; Homolog= emb|CAC83141.1|
MTVKTYYLSNKSIQQNAIEAIKTLPLDPKKPYEIKLSEPKRTNAQNRKMWATLGDIAGQVQWDSEWYDSEDWKDLITVLNKQTKGEAQRSARGLGGGIVFFGMRTSKMKVGEIAEVIECAHWFGTDKGVVFSDKAKQELEWAQRFGDKLKKEMENEKTGTAKM

SEQ ID NO: 11309 - protein, 198 aa, Xenorhabdus bovienii
  Coding DNA sequence: Name=SeqID_5201
  Homolog annotation: Query=1..194bp; Hit=1..194bp; Blast score=246; Percent Identity=70.0; E value=2e-64; Homolog= emb|CAC95102.1|
MKKQVRRKCKICRGWFHPKHDHVWWCSPEHGAELGMRRQDKKYEKARQKLERERRQKEVEARDKLKTRRLAVKPRSYWIQQAQHAVNAYIRERDRDLPCVSCGTYTSSQWDAGHYRTTAAAPQLRFDERNIQRQCIVCNQHKSGNLVPYRVELIRRIGLEPVEAIESNHDRHRWTIEECKAIRDEYRQKLRELRQEAA

SEQ ID NO: 11310 - protein, 117 aa, Xenorhabdus bovienii
  Coding DNA sequence: Name=SeqID_5202
MTFDNFNEAISYARRRRRDERKHFAVRQRKDRLYVTRLTDCKRPAWSTLDDLRFEHYGVKPYPVVKLELSDTPLIIGLLAAGLSQRSVANKFDVTRGAVRRLVNRVKRQHTVLPEVR

SEQ ID NO: 11311 - protein, 278 aa, Xenorhabdus bovienii
  Coding DNA sequence: Name=SeqID_5203
  Homolog annotation: Query=1..277bp; Hit=1..270bp; Blast score=334; Percent Identity=65.0; E value=1e-90; Homolog= ref|NP_930145.1|
MNLESLPKYFSPKTAMFSDSPAATATDSYSITDVMASLGLASAQARMGIELFLAKQGINKPDESVESLYHYALTQVHKHPAIAKLDEDIKQSILQILANYAFQDYARSAASKKPCSELHCEDGFIEAEVFTTKWSKPAFLDIPDWAKEARAITPEEWYRKRQVREVVRVACKACSGKGEVSHSCRCNGRGEVLDKKQTKLIGIPVFKTCPKCSGRGYSRLPAEDVRRAICGEVMEMPETTWRRNFKPFYEALIEECFKEESRADSVLSKLTKRETISI

SEQ ID NO: 11312 - protein, 111 aa, Xenorhabdus bovienii
  Coding DNA sequence: Name=SeqID_5204
  Homolog annotation: Query=3..104bp; Hit=4..105bp; Blast score=114; Percent Identity=61.0; E value=3e-25; Homolog= gb|AAO18060.1|
MKMKENPDFWMHLGDWLISVREQGIWATLAGTMAFFRGRYNGGGWVKVSIDAFMCAMFAWFIRDVLNFMGLNPDLAYIGSVVIGYLGTDFIGQLLRKAADKRAGVSSDENQ

SEQ ID NO: 11313 - protein, 144 aa, Xenorhabdus bovienii
  Coding DNA sequence: Name=SeqID_5205
  Gene classification: Function=Phage-related lysozyme (muraminidase); Function class=R General function prediction only
  Homolog annotation: Query=3..142bp; Hit=42..181bp; Blast score=105; Percent Identity=46.0; E value=1e-23; Homolog= XF1669 COG3772
MKISKNGLEFIQQWEGLKLKAYPDPATGGIPWTIGYGHTKDVKPGQVITEQQAEAFLHEDLQPIYITLETAVKVPLTQGQFDALCSFIFNCGAGNFVRSTLFKKINAGDYAGAAAEFPRWNKAAGKVMNGLTRRRASEQQMFLS

SEQ ID NO: 11314 - protein, 153 aa, Xenorhabdus bovienii
  Coding DNA sequence: Name=SeqID_5206
  Homolog annotation: Query=3..148bp; Hit=7..148bp; Blast score=140; Percent Identity=52.0; E value=8e-33; Homolog= ref|NP_930139.1|
MRFYVICGMGIALGIALYIGGYYRTEYKKQLSINGDQITEIQQLTDTLNYQNTHIDMLHEMDTKHIRELDNAKSEIDTLRSDVAAGRRKLRIQAVCPVREATPSGSMGDAGTPQLTEAARQDYYDLLRMMAENERQTKYLQDYVNIECYKVKK

SEQ ID NO: 11315 - protein, 75 aa, Xenorhabdus bovienii
  Coding DNA sequence: Name=SeqID_5207
MSKLALPPHQQRVIDEKKELQERIEKLSNFIGDAIYYKLEEVDQILLDTQLSAMKMYSEILYERVKRFRLPPQSK

SEQ ID NO: 11316 - protein, 175 aa, Xenorhabdus bovienii
  Coding DNA sequence: Name=SeqID_5208
MSIATIHYRNLVIKKAGDSARKGIILAHGGYTPERGFFQPGSGRTYVPLRITLVCNCLHGKVSIGQKMADAILYPTPTNQTNYIPEDILGGSIIQNYSLTYNSKFEGYEPSKFVDVVTIKPNSKAHISDVFSAVTALNLHYERIYNVACRINKIDRNSLSISAINMIIQVSPMLP

SEQ ID NO: 11317 - protein, 194 aa, Xenorhabdus bovienii
  Coding DNA sequence: Name=SeqID_5209
  Gene classification: Function=Prophage antirepressor; Function class =K Transcription
  Homolog annotation: Query=4..110bp; Hit=113..216bp; Blast score=81; Percent Identity=41.0; E value=6e-16; Homolog= XF1645 COG3617
MNTALTFKEHEITPFDNSDNKIWFTGEHLAELLGYKDSKKVANLYSRHKDEFTESMSTVAKVRTSKESMAYGCLLSEVRLYSLRGAYLIGMFSRTKVAKELRIWLLDLAEKESNIDIGTLDMTAITQLTGQKMHDLIDVFNKASFKHRGQKGSGLMAQRKQDIKRIKEATKLALQLTQFSIPDLGDFPDEGEPA

SEQ ID NO: 11318 - protein, 71 aa, Xenorhabdus bovienii
  Coding DNA sequence: Name=SeqID_5210
MNNEQFIEKNVQAELTKLGFSSSIAGMASDRAVEHYRRSGSASRKGKKFEDCLSVAKAWASRYSVEKPKKK

SEQ ID NO: 11319 - protein, 47 aa, Xenorhabdus bovienii
  Coding DNA sequence: Name=SeqID_5211
LLRHGRVGIQSRSPRKNDYTKFCKASTFGCLIDYYLKMFVKYAAFSI

SEQ ID NO: 11320 - protein, 150 aa, Xenorhabdus bovienii
  Coding DNA sequence: Name=SeqID_5212
MKKIIAAIIFFGVIFGNANAAEFTCQLKNNKYVNVSVEQGKTPVYRYGTLSKTEITLPVKLNDSKNVFYGYQLLIGGSSTYVRFKNGDYSYVVYAGGSKYWDFSGLVVYKGDKIINKKSCKDSESLGLIDIGEYHIQEDPMIEKYSSAPN

SEQ ID NO: 11321 - protein, 174 aa, Xenorhabdus bovienii
  Coding DNA sequence: Name=SeqID_5213
MAKPDWEAIESAYREAGMPELLYSHFKKSGEAFLSGVIKVFLASSNAHIKLFDGQVAPIIRVESEFPVPRGRVDFFLVHDDGSASVCELKDGRNGLQSVLAGIGQVICYSVQVGMSNSGLRHIRKVLMFSRTNSISDDALIVEACLKAGVMPVPIGSEDEHKEAASAFIDIHRK

SEQ ID NO: 11322 - protein, 170 aa, Xenorhabdus bovienii
  Coding DNA sequence: Name=SeqID_5214
  Gene classification: Function=Phage terminase, small subunit; Function class=L DNA replication, recombination and repair
  Homolog annotation: Query=1..169bp; Hit=1..171bp; Blast score=104; Percent Identity=39.0; E value=5e-23; Homolog= mlr5477 COG3728
MALTDKQEMFCREYLVDLNATQAAIRAGYSERTANRTASENLSKPDIQSRIAELKADRNEEVGINATYVLKRLVEIDQMDVLDILTDGGELKPVKDWPKVWRTTLSGMEVVEMGSQDTTALLKKIKWPDKVKNLELLGKHISVQAFRDQVKNEHDVVGTLSDMMDDLAKG

SEQ ID NO: 11323 - protein, 490 aa, Xenorhabdus bovienii
  Coding DNA sequence: Name=SeqID_5215
  Homolog annotation: Query=7..473bp; Hit=15..482bp; Blast score=323; Percent Identity=41.0; E value=5e-87; Homolog= ref|NP_542306.1|
MKPEHLALLRNKLWRLNHLYWITDKEGKTIRFKMTPEQLEYFEGMHTRNIILKARQLGFTTEECIIQLDTALFEAGKCALIAHTLPDAKRFFREKIKFAYDKLPDEIKAANPARNDAAGELVFEKGGSLTVSTSFRGGTLKRLHISEFGKICAKNPDKAREIVTGALEAVPTDGCATFESTAEGRAGYFFDYCQTAEKAQLQGKQLSNLDWKFFFFSWWRNPLYAIDPVEPIPPRLVDYFAELSGKHGIQLNERQQAWYLAKEKTLGDDMKREYPSIPAEAFQQSVEGAYYAKQFRWLYENKRIGKLPDNSHLPVHTFWDIGVGDSTAIWFVREVGEEFHIIDYYENSGEGLRHYMKVLKDKGYTYGDHWGPHDIDNREFGADAKSRRELAREGYEIDGQKYSMIFKVVPKVGVDTGIESVREILSNCVFDEEKCSEGISHLESYRKEWDDKRGCWKDKPLHDFTSHGADGFRYFAVAKNNRKAVGAFFF

SEQ ID NO: 11324 - protein, 455 aa, Xenorhabdus bovienii
  Coding DNA sequence: Name=SeqID_5216
  Homolog annotation: Query=7..443bp; Hit=16..448bp; Blast score=388; Percent Identity=44.0; E value=1e-106; Homolog= ref|ZP_00134760.1|
MIYAAGGISGNTKRTNIYSEFGYPEQLRFREYYNVYERNAVAHAAVHRLLDGCWQDNPTIIDGEEKKESDVTSAWETKVTKLLKPFWAKIKDADRRNMIGNYSALLIQVRDSKNWSEPVDVTVVSRLKVDAVVNLIPVWEPQLTVAEWDQDIHSDTYGQPKMFNFDERPVGQVEMQGPAKQLLIHPSRVITLCEGAESGDIFSGTPLLRAGYNKLLDIEKVSGGSSEGFLKNASRQIGVEFDKETDMNSITTAAIQAGYEDLGAALEDKISKLNRGTDSAAVMQAGRLNVLSVAPGDPTPTWEVTAREFCASVQVPFTVLFGTQTGKLAGDKDDATWKVRLNGRRWGFLTQYVIRLITRLWEIGIIEPPSSGEVTIAWSDMLAASEKEKIDNMIKMAEAALKTQQAFGTPAFTPNEVRTVGELEPLKEEPEPQGATGDPLTDETDPNRNPDNTQK

SEQ ID NO: 11325 - protein, 323 aa, Xenorhabdus bovienii
  Coding DNA sequence: Name=SeqID_5217
  Homolog annotation: Query=161..316bp; Hit=3..157bp; Blast score=147; Percent Identity=48.0; E value=2e-34; Homolog= ref|ZP_00134761.1|
MKQTQIGTPIIPRNKRDPTQSYRPVNKMFRDIERRYYDIKKALRELFDQRLTGRVRENNAQLSYIMHGETLYQVNADTFIYDMTAQQLAALLERVQTILDDYLLEGIGQNIWALQYVSEEYQRGTLNAYTNLSVQSSVYEMQTTLSALLSSAAYQNQIAAAYVSTYSDWKGISDKARADLANVIADAIGRGVNPRETARIISKRLDVSMAQAKNIAQTEQVGALREANWNETEWASERLGLNTQLLWLSALKPTTRQWHAVRHGKIYTKQEVEEFYSRNGNRYRCYCAQQPIVLDDDGKLYNKGLTERLTEERKAWQKPEQIE

SEQ ID NO: 11326 - protein, 463 aa, Xenorhabdus bovienii
  Coding DNA sequence: Name=SeqID_5218
  Homolog annotation: Query=1..461bp; Hit=1..447bp; Blast score=390; Percent Identity=48.0; E value=1e-107; Homolog= ref|ZP_00134762.1|
MKLSSVHVKSLALNSSNISTETIDGDAHIVIRGVVPVVDDVVMNGGLYPAGEINKSYKSIEGKQMPLGHPSIDGQYVSADVPRAVNQFHVGAWAENVRKDGDRVVMDMKINRRYAESTEKGQVLLQRLDDMIANKEAEPIHISTGLLLQREQNGGKSKGKKYTWIARNMQFDHVAILSPDEPGAATPKEGVGIFVNSDGQKVEVEAVNLSDASDCTNEGLIDKAKFFFSNASNFSFDDIHSALRAKLRTVYPDDDWPYPEAVWPDKFIYYLSGKTYQQKYLMNDDGTAELVGESVEVVRKPTEYEVKTNKEHDPMKEIIINALKAKGKDVEGKSDAELLDAYSQMNADEAKVKETPEEKAAREKKEKEAATNTDAITTAINAAMKPLTDKITTLESQLTANADKEKSDKRAAVKTKFGLDDTAVNALDGAALDGFYAQCQTSAGLNSSFTNNNSSESFTSMPE

SEQ ID NO: 11327 - protein, 141 aa, Xenorhabdus bovienii
  Coding DNA sequence: Name=SeqID_5219
MAKGKHVIHAGGVFTNPMLNREGAAAVDTKPGTIGYFEKGIFKASVDGKEPAILYVANIDYLRCQTVDDSITAGSVVVSIHPMAGIFLNVRATEGTYKKGQPVTAANGQIAAAGDGVAAFAYVEEDSITAKAGDLVRVVFK

SEQ ID NO: 11328 - protein, 358 aa, Xenorhabdus bovienii
  Coding DNA sequence: Name=SeqID_5220
  Homolog annotation: Query=66..357bp; Hit=58..350bp; Blast score=70; Percent Identity=26.0; E value=6e-11; Homolog= ref|ZP_00134764.1|
MFYFSTKKATETGNLEANQAQFGELTLARNSSAQAVADFISRSRFRGEDAPRLDAVNAIDDIKRLYRAYDQTVLAEFEPNTEFTLLNDLAGLSRSVRLEESVYEYARTGGTGWAHTSMSGQIGAALDARSYSFDGTMVPIHDTGFKFNWRDPVFNKGSALASLSDAQADSVKVVRRKYLDFIWNGFRDSEGNFIKFDDKTWKGFRADERVAQVTLNVDHTTSTDGQAMRSEVMKVRDVLKLQNYQYGAQTWYVSGEVLSNWEKLYYDVNQTRTVLEEIKKITGISGIKEDFELKGNEMMIIPLGAGVIAPIVGQAFGTVADPRQFYNSDYVWRTWGAAGLMVKQDINEHFSVIHAKGK

SEQ ID NO: 11329 - protein, 129 aa, Xenorhabdus bovienii
  Coding DNA sequence: Name=SeqID_5221
MALVKILVTNLFAGASLQKLEVGHTYEIDDNIAVKWIDAGKAEASKDKKGEKLVFEVATPATMNFPENSELQAELDDANAKMLAMTDAAKAKETELTEALAAEKKRADDAEKALAEAARKAKKDGDNAE

SEQ ID NO: 11330 - protein, 158 aa, Xenorhabdus bovienii
  Coding DNA sequence: Name=SeqID_5222
  Homolog annotation: Query=40..158bp; Hit=4..121bp; Blast score=89; Percent Identity=37.0; E value=2e-17; Homolog= ref|ZP_00134766.1|
MLPRQKKLNSQKHWRLKKNELMMQRKLLRKRPERRKKMAITLNDIKPMIAELGFTLPDSVLELLLNQVNDKSECMVAHGYDESLQKLLLIYSTVRLASLSGARKIASQGSPSGGSRSFAYDSAGTDYLLKQIRVWDKRGCLSGLPLESKTVGFFDVVG

SEQ ID NO: 11331 - protein, 115 aa, Xenorhabdus bovienii
  Coding DNA sequence: Name=SeqID_5223
  Homolog annotation: Query=1..114bp; Hit=1..113bp; Blast score=107; Percent Identity=49.0; E value=6e-23; Homolog= ref|ZP_00134767.1|
MSSVANWAYTAPCTFWKRLGNDEYGKPLGYETPRTILCDYQGGLSSKISGVGAELVVKNTFWTEFADASIGDYILIGESSNLNPIVAGADEIKHIVRYADTFERTADDYALITGV

SEQ ID NO: 11332 - protein, 123 aa, Xenorhabdus bovienii
  Coding DNA sequence: Name=SeqID_5224
  Homolog annotation: Query=1..119bp; Hit=20..138bp; Blast score=108; Percent Identity=47.0; E value=2e-23; Homolog= ref|ZP_00134768.1|
MGVKVTGIREAKTKLNALIGDIRGRKVVRAMYKALYIGSAQAALYTPIDTATLINSQFRDVRFDGVRLTGRVGYSANYAVYVHDPKVKQNFRRATAKKEFLKRGFNEVRAQIDKAVMEELKSL

SEQ ID NO: 11333 - protein, 128 aa, Xenorhabdus bovienii
  Coding DNA sequence: Name=SeqID_5225
MRGNIIKDFLRSLDNRLWVVLSTDQNYLHIVIRTEIIQPPRSTRWLKNHVLRFPAIAFLFNPSDHLYRETINQPCRCQIMPELFKCTHSDFNSSMTALSICARTSLNPRFKNSFFAVALRKFCLTLGS

SEQ ID NO: 11334 - protein, 41 aa, Xenorhabdus bovienii
  Coding DNA sequence: Name=SeqID_5226
MRPDYDVQRNSNRMIYRFSCVGMGVGIPPRLKTAFRQSSSG

SEQ ID NO: 11335 - protein, 250 aa, Xenorhabdus bovienii
  Coding DNA sequence: Name=SeqID_5227
  Homolog annotation: Query=38..157bp; Hit=25..141bp; Blast score=79; Percent Identity=34.0; E value=5e-14; Homolog= ref|ZP_00134770.1|
MANCPVETNKLIGRNAIIRIAHGCPDAAPEQSVFFRIGALTTKSFDLSPNTLTSEADDSKGLVESVVTSMNLTISFDGEYRKRDKKDDFGPLRLLQEIPREVQAGRQPSYWVQMDFTGENAFVLQGYMVFTSWSSKFGANEVATYSGELKISDADTVEWLIEEVAVQSVTANPSSLTVPVGKTGSFVVNFTPADATNKNYTVTSDKTSIATVSKIGSVVTVKGVAEGSANVTVTSEDGSKTAKCAITVTA

SEQ ID NO: 11336 - protein, 229 aa, Xenorhabdus bovienii
  Coding DNA sequence: Name=SeqID_5228
  Homolog annotation: Query=3..213bp; Hit=4..221bp; Blast score=162; Percent Identity=41.0; E value=6e-39; Homolog= ref|ZP_00134771.1|
MTPIFEIGEMVIATDKVDFLFRPSFSAMTRIGTPQQIVEAYTLLNGAETQELINRAVIAYGSLPDWLIKLMRKPIFGRNILSTAMMVIQACCEDDAEELIGEWKPGRRGVVYRPGKMSINDIIVLATEIITHGVIGKVKIRKLQRNEGREEYSGQFVAIEYINAARAHFGMSREEAAQLTMTEFQMMLKAKFPDDKGFTREEYDAVIDADDKRTNELMSGKRRLVSMKK

SEQ ID NO: 11337 - protein, 47 aa, Xenorhabdus bovienii
  Coding DNA sequence: Name=SeqID_5229
MSLFELFGSVSWCTLYIQINHRLKTPIHEALDFIKHQIEVGRQKPAC

SEQ ID NO: 11338 - protein, 100 aa, Xenorhabdus bovienii
  Coding DNA sequence: Name=SeqID_5230
MKLLISSNIRLKLADKNPPVNEEDILQCFSNRVGYFLEDTREDNRTDPPTKWFISETDYGVKLKIVFIYYPEKGVAIRTAYAPNEDELRIYKKYGLGTEK

SEQ ID NO: 11339 - protein, 117 aa, Xenorhabdus bovienii
  Coding DNA sequence: Name=SeqID_5231
  Homolog annotation: Query=17..96bp; Hit=5..84bp; Blast score=81; Percent Identity=55.0; E value=2e-15; Homolog= ref|ZP_00134879.1|
MSKQTDKRTHLIASTNDAWDNGELGCSEAHVKVSDDITEDLINEALDLQPISIRLNKSLIEDLKMIADLSGLGYQPLIRQVLNRFANSEKKRILAEAHSRAMKNEKRKPPNKRHKAA

SEQ ID NO: 11340 - protein, 137 aa, Xenorhabdus bovienii
  Coding DNA sequence: Name=SeqID_5232
  Gene classification: Function=Prophage antirepressor; Function class =K Transcription
  Homolog annotation: Query=1..137bp; Hit=153..290bp; Blast score=72; Percent Identity=32.0; E value=1e-13; Homolog= Z1818 COG3617
MVHYEFGVNSINELTNDQFPSAIEYLATKAIEGEFLGKETLPTPEVKQQISDEDLQTLCWGWRFLARSIEHMANVYPVLKSAEHELAPIYCEIPREGAEIEKMVRKILENVTSHIEVTPTQDNNWNILNKLRTPNYH

SEQ ID NO: 11341 - protein, 47 aa, Xenorhabdus bovienii
  Coding DNA sequence: Name=SeqID_5233
MPLKCGFLRSFALIGWYCKQNLMMGMCDENNTNNYFGRFYIFYAIVC

SEQ ID NO: 11342 - protein, 113 aa, Xenorhabdus bovienii
  Coding DNA sequence: Name=SeqID_5234
MKIIPIITLVGFIYSMPSFADDCIGDGIYQVCTKSSQNTQGDDVIESYDSEGNSYSITSGLRESSDGSSEVFSVDSEGNQFSIKSWCDDAGCHSRDSDGNTCTVTMSGEMIGC

SEQ ID NO: 11343 - protein, 126 aa, Xenorhabdus bovienii
  Coding DNA sequence: Name=SeqID_5235
  Homolog annotation: Query=1..126bp; Hit=1..123bp; Blast score=72; Percent Identity=38.0; E value=1e-12; Homolog= ref|NP_767509.1|
MIKKLLAVVVLVSVSFFAKSAITDRPLTQQEISLVESEVKVSLKDPDSAKFKHVNLIQGSENSIDIYCGKVNAKNSYGGYVGFKPFMVILLTNQKNERKAMVLPEGEESSAIKEKAIMKQCANHGY

SEQ ID NO: 11344 - protein, 1093 aa, Xenorhabdus bovienii
  Coding DNA sequence: Name=SeqID_5236
  Homolog annotation: Query=5..775bp; Hit=27..802bp; Blast score=191; Percent Identity=28.0; E value=6e-47; Homolog= ref|NP_037710.1|
MADHQVGNIVYQVSMDVAQLLTAQRQLDSRMGQVEQRFNQTGRSVQGAEKALLSLSRAATAVTAALSIEKIASYADAWVVVNNKLVNAVKTNETLAEVTERVFNIAQNSRAGLDATAALYGRLERATRSYGMSANDVAKLTETVAKGLVVSGATATEASSTMIQFSQAMASGVLRGEEFNSMSENGSRLIAALSDHLGVNIGQLRKMAAEGKLTAEIVAKALLAQAGTITKEFDRTSATMSQSMEMAANNMTKFFGQSTTAQTALKAFNSTLVTVSENMDLVAGAATALAVVMGSRMVGAMTLAASKKITNVRASIALAQANKVEAERALYAANMTLRKAEMDKIAAIEALRHAQAEYAVVKGTDAATAALARLTAARATATTATATYGAAQNAVTVAQAGFTAAARAATIAVNGLKAAMSFLGGPLGVVMLAAAALYYFHQQAEDAKNEAKDLSNTVESLTGNLKELSKVQLEANKVKLERKLADQSEQVKKQEVKVSGIQWEVDNNGGFIYSKKSKEEMDKLREDLALAEGELENVQTVESNYKKAIDLTSKAIAENTKLTNENTDANKNRNGEVDQASDKAADFITKLKNENELLKTQKGLKRDLKAAEFKANELGASSGQKEVIAKEIKENNQLKAAEKEREDAAREAESAAKKAADDAKRRADDITEALSRQREGIDRLKTGYEEASLEMAKYDAAKAMPEGSSEEQIEKARRNAAERYELEKDADARKWDLEQDSLAKSKKAMDEELEHLRRVKAQGLLEEEDFNKRKQEIRERYKNKQTEDEINKKVDSSVGFNDGLLGKADPIQQLQNEYAQKMALLDAYNTHDIGEHERILQLKSDLTRKFNDDMTTAQWEQWKGQNEMYQFLGDAMESLGQRSANSITGLLTGTQSANDAMRNLALTITNEAVSALVQMGMQQIKNMVIGKTLATASTATTMVQAAAAQAAWAPAALSASIATLGAAAATGTTAYMSSLVASKAFAIAGARKNGGPVSPNGAYRIGEDNKPEIFKANNGHQYMIPGDRGQVISNRDMGKGGGGVSVGDINISFSVQTQGNFSEQDARLMSGMVKKSIYDVLIDERRPGGMLNE

SEQ ID NO: 11345 - protein, 111 aa, Xenorhabdus bovienii
  Coding DNA sequence: Name=SeqID_5237
  Homolog annotation: Query=1..111bp; Hit=1..110bp; Blast score=74; Percent Identity=36.0; E value=3e-13; Homolog= ref|NP_460017.1|
MTKTEFKWRPQDNYEVSHEPRVRVVKFGDGYEQRVKDGINNQLKRYQLSFVEKVDTGRAIDEFLRVRGAVESFTWRTSDDNQLRTFVCRSWTVNRQRVIWSISCTFEEVVA

SEQ ID NO: 11346 - protein, 234 aa, Xenorhabdus bovienii
  Coding DNA sequence: Name=SeqID_5238
  Homolog annotation: Query=1..233bp; Hit=1..230bp; Blast score=234; Percent Identity=48.0; E value=1e-60; Homolog= ref|NP_308866.1|
VRDIPKEMRIEVTELSQNAILNLYEIDLTAFGGDIYRFHDGLNGKLEPVAWQGMRYEAYPVEASGFEMNSKGPSARPKMIFANVNGFITAINQDFNDALGAVVTRHQVPEIYLDAVNFPNGNPQADPTREAVSKYLIEQKQDSNADFVTYVLALPSETDGALIPARVIQADICSWQYRSADCGYDGPPVADEKDQPTTDPLKDRCSKKPAGCIKRYPRPQPMPFGGFLGANKLG

SEQ ID NO: 11347 - protein, 237 aa, Xenorhabdus bovienii
  Coding DNA sequence: Name=SeqID_5239
  Gene classification: Gene name=Spr; Function=Cell wall-associated hydrolases (invasion-associated proteins); Function class=M Cell envelope biogenesis, outer membrane
  Homolog annotation: Query=114..236bp; Hit=2..126bp; Blast score=143; Percent Identity=52.0; E value=2e-34; Homolog= Z0978_2 COG0791
MIETDIIAHAKAEGVRESCGLISGNRYFPCRNISPDPEHYFEINPDDWITAECFADIDTIVHSHPNGKPRLSTGDREQQVKTGLPWWLACGDRVHKFKPVPRLLGREFIHGKQDCYSLIQDAYHLAGVELDDFSRDDEWWNTGQNLYLDNIASQGLEQVDEIQEGDVILICLGSQTPCHGAIYIGNQQILHHRPDRISKRDIYDGYWLKYTHSIWRHKQWSSYSLEAILEDLAVATN

SEQ ID NO: 11348 - protein, 197 aa, Xenorhabdus bovienii
  Coding DNA sequence: Name=SeqID_5240
  Homolog annotation: Query=1..196bp; Hit=14..211bp; Blast score=148; Percent Identity=43.0; E value=5e-35; Homolog= ref|NP_459900.1|
MVKLQLGGHLRRFGRRYELEVRDAAEAVRCLCYQLKGFQQAISDGHIRVRIAGRDMTEKSVPAGMNHPLNDGDIVTIVPVVGGAGGNGVGMAILGVVAVAAAFWTGGGSLAAWASASGAAATAATGLAIAGVALISAGLASMLTKMPKGPEMGSSKTDGNQYFNSLENRIGQGYPVPIAYGEMVVGSNVISQGLETE

SEQ ID NO: 11349 - protein, 1177 aa, Xenorhabdus bovienii
  Coding DNA sequence: Name=SeqID_5241
  Homolog annotation: Query=1..1080bp; Hit=1..1063bp; Blast score=755; Percent Identity=38.0; E value=0; Homolog= ref|NP_755036.1|
MGKGGGGGNTPTLVDDNLKNKQYLRIVDLIGEGQIEGPVGGLHGFRVNGTPVVDKNGNPNINGVTVQWRAGTQSQEPLSDYPFVESEIPVSVEVKNATPILRMVSNKDVDRVRFTLGVSQLVQTDSQGNQSNSTVQMAIAVNDGGGWVHAKTVQIGPGKISGQYLESHTIDAPKKKPFQIRVSRLTDDSKTDQLRNGTVWASYTEITDTLMSYPNSAVVGMRIDRSLFADTPKRTYHIKGIVVQVPDNYDPETRNYKGVWTGRFKPAYTNNPAWIFYDLVTNTRYGIGKLMGSFGCDKFALYAIAQYCDQPVPDGFGGTEPRFTCNAYIATQRKARDVLDDLASVFRGMQVWNGLQLTTFQDRPSDPVWTFTNANVVEGKFNVSSSAKKARHTAIEITWVNPENGWKDERELIQDDELVARLGINVKKVIAFGCTSRGQAHRVGRWIIETEKLETDSITFSTGREGINCIPGDIVEIADNSFAAARVGGRILSFSGKEVRLDAPVEFAKGESGYFSYMGSEGKFVRVDIDTVNGDVVTLKEVPAGLRQWGIFSISKKSLVTRLFRVMSIAEDNKTGNYNFTCIQHEPQKEAIVDNGVDFQGSPATQNVIRIPNIERLSVAYIQDSSQVQARAMWATTTINRNITFDVAVYRDNKVVSRGNTKELEYYFNGLDAGVYMVGVRARDDNGMLGDESKVQMVIGAPAAPSVVNIEPGFFELKAIPHISAPKTLDTQFEFWFSESRISNINEIEAKADFLGIAKFWIKGQLKADTPYWFYVRSINEFGKSHFVEAEGKPNDNAKDILEVVGEQFLSNKAGQRLQSQMDFNSEAIMEIAAVEGAIVQRQLKVNGELKAEILHVQTTQVTDREAFAEDMKKVQAEVGENAAAVQTKATAVFDIKGDGYALYDVGVGLKYKDQFHKAGMVMGSEVKNGQVTTSIGFSAENFGWFNPASGKMEPFMMAKNGQLLVRDGFIEDGSITNAKIGNYIQSRNYITGRAGWKIDKGGGAEFNHVTVRGEIHATSGTFSGTINGADGRFSGAVYATKIVGDVVSVTLGNVSLGNRDSIFFHKRLTESMPFDRVFIYGPIMTQLYVGSLGGSGGAFVSVYVNNAFVADQYFSMESSDRGPQCISGTLFTPPITIPANTTPTIKVVLTTHGAGTTYSTPGIGMLFKVSSQWSNM

SEQ ID NO: 11350 - protein, 482 aa, Xenorhabdus bovienii
  Coding DNA sequence: Name=SeqID_5242
  Homolog annotation: Query=317..478bp; Hit=262..426bp; Blast score =184; Percent Identity=54.0; E value=4e-45; Homolog= ref|NP_929297.1|
MIYSDGTTNLVSGSAIVRGTGTKWKSNINGIAAGQIISIQSGNTVIQNVIQSVNSDTELVLAFAPSVSLNNAKYVISTTVPDTVSDGVRHICAINAYIILFLQNMDRWMSENGKVEVEMPNGQKVTLDSIRALQAAMDGKLVKEQNGADIPNKPAFVENLGLSGTVELAKNALPKAGGWIDGDVAVRSRDAALRLWADGDSGLYMTYHQNSKRSAWMGYGSDGSKTFTISNEKAGSTISLDKNHAAIYGAQSFIISSGYEYSGINITKPSGTFFRLETDTDQSVSIVNFVDRNPDNSNRSVQSLPKGNGTLLSLGANCWSDNTGYIRPSSPIIQIYPDGTFITNDESEGATVTRLGLGHYQISGILGYNADGAWGVHGGISVPRDVNGNELVYVEDKVLPDGAIEIKVTHRQSAHMPARLQNRRIKSQDEQTHYTDDEPCDLPAGTRLDVRVQMPEDSIWNQKQVLASDPQQEHSATSAVNK

SEQ ID NO: 11351 - protein, 50 aa, Xenorhabdus bovienii
  Coding DNA sequence: Name=SeqID_5243
VRRNHKRHRLPSNHPTRQFTSLTSHTNPPNYPLISPIGYLLTADVALCSC

SEQ ID NO: 11352 - protein, 54 aa, Xenorhabdus bovienii
  Coding DNA sequence: Name=SeqID_5244
MIASHFVRFFPLYRQASSAKINRFLNSQTLSDYWSLQSNRTTYRTIYSIHLCYS

SEQ ID NO: 11353 - protein, 254 aa, Xenorhabdus bovienii
  Coding DNA sequence: Name=SeqID_5245
  Gene classification: Gene name=SurE; Function=Survival protein, predicted acid phosphatase; Function class=R General function prediction only
  Homolog annotation: Query=2..249bp; Hit=1..248bp; Blast score=363; Percent Identity=73.0; E value=1e-101; Homolog= surE COG0496
MLRILLSNDDGVTAPGIQTLAARLREHYHVQVIAPDRNRSGASNALTLDRPLRINTLNNGDIAVQEGTPTDCVYLGVNRLVLPRPDIVVSGINCGPNLGDDVIYSGTVAAAMEGRHLGLPALAVSLNGDKHYETAAEVTMRLLNLLQKFPLRAGNILNINVPDVPIEQIKGFRVTRCGSRCAAKEVYALEDPKGNMLYWIGPPGEKHDAGPETDFAAIEDGFVSITPLQVDLTAYKAQELINDWLVKVGDMGEC

SEQ ID NO: 11354 - protein, 208 aa, Xenorhabdus bovienii
  Coding DNA sequence: Name=SeqID_5246
  Gene classification: Gene name=Pcm; Function=Protein-L-isoaspartate carboxylmethyltransferase; Function class=O Posttranslational modification, protein turnover, chaperones
  Homolog annotation: Query=1..208bp; Hit=1..208bp; Blast score=295; Percent Identity=70.0; E value=3e-80; Homolog= pcm COG2518
MLSRSMKNLLTQLRQQGIQDEHLLEIIARVPRECFVDEALAHKAYENTALPIGHGQTISQPYTVARMTELLSLTPEANVLEIGTGSGYQTAILAHLARHVFSVERIKGLQWQAKRRLKQLDLHNISTRHGDGWNGWPSKGPFDAIIVTAAPPEIPQALLYQLADNGVMVLPVGERSQSLKVVHRYGSDFHSEVIESVRFVPLIQGELA

SEQ ID NO: 11355 - protein, 352 aa, Xenorhabdus bovienii
  Coding DNA sequence: Name=SeqID_5247
  Gene classification: Gene name=NlpD; Function=Membrane proteins related to metalloendopeptidases; Function class=M Cell envelope biogenesis, outer membrane
  Homolog annotation: Query=15..352bp; Hit=17..379bp; Blast score=303; Percent Identity=51.0; E value=3e-82; Homolog= ZnlpD COG0739
MNLGNSVKKIKWISSVMGVVLAGCSNTSDRPAPIVSIDKQEQNRGIPSRTSSISTPMSSSPSTISVNRSSEHRASENRYLVNRAVENGSHQGRIVYNRNYGNIPKGSYSGSTYTVKSGDTLFYVAWITGIDFRDLSHKNNISEPYNLNVGQVLRMGNVNSSNGVLLASNSTQSKIEQVDFQKSNAYPANIDRQSSEKMLPRKAISVSENSALKSSPATDISPSSTISSNSSSWGWPAEGKVFEGFSDSKGGNKGIDIAGSRGQPVFATASGKVVYAGNALRGYGNLIIIKHNDDYLSAYAHNDTMLVRDSQDVQAGQKIATMGSTGTSLVKLHFEIRYKGKSVNPLRHLPQR

SEQ ID NO: 11356 - protein, 331 aa, Xenorhabdus bovienii
  Coding DNA sequence: Name=SeqID_5248
  Gene classification: Gene name=RpoD; Function=DNA-directed RNA polymerase sigma subunits (sigma70/sigma32); Function class=K Transcription
  Homolog annotation: Query=1..330bp; Hit=1..329bp; Blast score=482; Percent Identity=82.0; E value=1e-136; Homolog= rpoS COG0568
MSQSTLKVNELYDEADLDEHGMEADDFDEALLKDGDDLTNVDEDLDLLQGVNQRVLDATQLYLGEIGFSPLLTAEEEVLFARRALRGDIAARQRMIESNLRLVVKISRRYSNRGLALLDLIEEGNLGLIRAVEKFDPERGFRFSTYATWWIRQTIERAIMNQTRTIRLPIHIVKELNVYLRTARELAHKLDHEPSVEEIAEKLDRPVDDVSRMMRLNERITSVDTPISGDSDKALLDILSDENDSGPETTIQDDDMKQSIVKWLFELNAKQREVLARRFGLLGYEAETLEDVGREIGLTRERVRQIQVEGLRRLRDILHTQGLNIESLFRT

SEQ ID NO: 11357 - protein, 875 aa, Xenorhabdus bovienii
  Coding DNA sequence: Name=SeqID_5249
  Gene classification: Gene name=MutS; Function=MutS-like ATPases involved in mismatch repair, family 2; Function class=L DNA replication, recombination and repair
  Homolog annotation: Query=26..875bp; Hit=2..853bp; Blast score=1330; Percent Identity=79.0; E value=0; Homolog= ZmutS COG0249
MGWLSVDGPTESTGIVKLNAINMKESPAKDLDSHTPMMQQYLRLKAQHPDILLLYRMGDFYELFFDDAKKAAKLLDISLTKRGQSAGQPIPMAGVPYHAIENYLAKLVQLGESAALCEQIGDPATSKGPVERKVVRIVTPGTVTDEALLHERQDNLLAAIWHDSQGFGYATLDITSGRFRVSEMADEDTIAAELQRTHPAELLYPESFGPMALIERCNGLRRRQMWEFELDTARQQLNLQFGTRDLIGFGVEKSTLALRAAGCLLQYVKDTQRTALPHIRNITVERQQETVIMDAATRRNLELTQNLAGGTENTLASVLDQCVTPMGSRMLKRWLHTPIRDRKVLENRQQAISALQEIGFKLQPFLRQVGDLERVLGRLALRSARPRDLARMRHAFQQLPDIHQIMASSDSPYIQALQQRVGHFDELQTLLEKAVVETPPVLVRDGGVIAPGYHAELDEWRALADGASDYLDRLEIRERDKLGIDTLKVGFNAVHGYYIQVSRGQSHLVPIHYVRRQTLKNAERYIIPELKEYEDKVLTSKGKALAIEKALYEELFDLLLPHLAELQTSAEALSELDVLANLAERAETLNYTCPTLSDKTGIQITGGRHPVVEQVLSEPFISNPLTLSSQRRLLIITGPNMGGKSTYMRQAALITLLAYIGSFVPAEKVLIGPVDRIFTRVGASDDLASGRSTFMVEMTETANILHNATEHSLVLMDEIGRGTSTYDGLSLAWACAESLANRIKAMTLFATHYFELTTLPEKLEGVVNIHLDAVEHGDTIAFMHSVQEGAASKSYGLAVASLAGVPRDVIKRARQKLKELESLSNNATAGHVDTPQLTLLTEEASPAVEALENLNPDTLTPRQALEWIYRLKDMV

SEQ ID NO: 11358 - protein, 33 aa, Xenorhabdus bovienii
  Coding DNA sequence: Name=SeqID_5250
MNLILGENVILSLIIGVIIKASNQPAVTKYGKT

SEQ ID NO: 11359 - protein, 44 aa, Xenorhabdus bovienii
  Coding DNA sequence: Name=SeqID_5251
MAKRDRESLGGRLSGLQLRMYRIFWLLMRIGKRLDFIFTPKNSS

SEQ ID NO: 11360 - protein, 106 aa, Xenorhabdus bovienii
  Coding DNA sequence: Name=SeqID_5252
  Homolog annotation: Query=2..90bp; Hit=9..97bp; Blast score=60; Percent Identity=40.0; E value=6e-09; Homolog= ref|NP_406246.1|
MKKQDKQTLASLKQLDNRAVLGFFAIALILGMIGGKKLARSVLVLWPLYSVIYIVMFRKLSQRLHDSGLRGLVNFGNSYPFYQFCWVVIIFAMFFLFLFLIHLIML

SEQ ID NO: 11361 - protein, 54 aa, Xenorhabdus bovienii
  Coding DNA sequence: Name=SeqID_5253
MGLFIIFWHSTALTHHFTNNGEQSKIAKPVSNFFHVIFKNSCYQSSMKMGFWIG

SEQ ID NO: 11362 - protein, 156 aa, Xenorhabdus bovienii
  Coding DNA sequence: Name=SeqID_5254
  Gene classification: Function=Alkyl sulfatase and related hydrolases; Function class=Q Secondary metabolites biosynthesis, transport and catabolism
  Homolog annotation: Query=3..156bp; Hit=503..657bp; Blast score=121; Percent Identity=38.0; E value=4e-28; Homolog= VC0783 COG2015
MTGYQAESASARNFYLTGTKELREGIKATVTPKTVSPDMIKGMTLPMFFDFLAIHLNGPKVGDHHYAFNLIFPDVGEKYTLTVKNGVMNYLPGTAEKVDSTIILDRKTLVKVALGELTLDELLESGQAQIDGQKGKFKEMLSYMDNFYFWFPISEP

SEQ ID NO: 11363 - protein, 103 aa, Xenorhabdus bovienii
  Coding DNA sequence: Name=SeqID_5255
  Gene classification: Gene name=InsB; Function=Insertion element IS1 protein InsB, putative transposase; Function class=L DNA replication, recombination and repair
  Homolog annotation: Query=14..102bp; Hit=77..166bp; Blast score=84; Percent Identity=46.0; E value=2e-17; Homolog= insB_g4 COG1662
LGTPAEANTSPCFDRSRKTLDKLLALLSPFDIRFYCTDDYVVYDSLPEKERLTGKTFTQRIERTNLTHRTRIKRLNRKTIGYSKSAEMHDKVIGTFIEREHYF

SEQ ID NO: 11364 - protein, 44 aa, Xenorhabdus bovienii
  Coding DNA sequence: Name=SeqID_5256
LSNVFLLRSKHGLVFASAGVPKHTKASVDFSCSPQTTLARLFRR

SEQ ID NO: 11365 - protein, 91 aa, Xenorhabdus bovienii
  Coding DNA sequence: Name=SeqID_5257
  Gene classification: Function=Transposase; Function class=L DNA replication, recombination and repair
  Homolog annotation: Query=1..87bp; Hit=1..87bp; Blast score=77; Percent Identity=44.0; E value=2e-15; Homolog= insA_g5 COG3677
MAKVDVYCRYCHQSESVKGHGKGNGGHPRYRCYICCKVFQLEYTYQACKPGVKKQIIDIAMNNGGIRDTARLLKVATATVMKTLKNSDPEM

SEQ ID NO: 11366 - protein, 62 aa, Xenorhabdus bovienii
  Coding DNA sequence: Name=SeqID_5258
MSQKEYKGGCLCGNIKFIATGIPDFPHTCSCTMCQRHSGALTLCWVEFPKEAVQWIGGSCIK

SEQ ID NO: 11367 - protein, 38 aa, Xenorhabdus bovienii
  Coding DNA sequence: Name=SeqID_5259
MNLILPHKHPPLYSFWLIITPYAMLYFCLYYFYSDKEK

SEQ ID NO: 11368 - protein, 52 aa, Xenorhabdus bovienii
  Coding DNA sequence: Name=SeqID_5260
MNVTNQKLSELYSCLRENKKPKRANLIIVKNIRPTTSFQPTPPLSSHPEKRE

SEQ ID NO: 11369 - protein, 80 aa, Xenorhabdus bovienii
  Coding DNA sequence: Name=SeqID_5261
MENSTFCPSSKVLKSLPWIAEKCTNTSLLPSSGEIKPKPLPASNHFTKPVILLDIDISFNFEPLYVANMACFAEIYLLGT

SEQ ID NO: 11370 - protein, 46 aa, Xenorhabdus bovienii
  Coding DNA sequence: Name=SeqID_5262
MKAVLVKQSSVQALSIDILLHEPPPKCPISKSLQNRPCSPHKVAQN

SEQ ID NO: 11371 - protein, 48 aa, Xenorhabdus bovienii; identical to SEQ ID NO: 6457
  Coding DNA sequence: Name=SeqID_5263

SEQ ID NO: 11372 - protein, 48 aa, Xenorhabdus bovienii
  Coding DNA sequence: Name=SeqID_5264
MIFNLKYRVAVIYVIHIAPLVQRSIAAKADRLKSVVLTFHMENLTTTY

SEQ ID NO: 11373 - protein, 142 aa, Xenorhabdus bovienii
  Coding DNA sequence: Name=SeqID_5265
  Gene classification: Function=Predicted transposase; Function class=L DNA replication, recombination and repair
  Homolog annotation: Query=7..136bp; Hit=8..138bp; Blast score=149; Percent Identity=56.0; E value=6e-37; Homolog= DR1927 COG1943
MDYIYDSHTVFQIEYHFVWVTKYRYKVLTGEVALRVRELVRQTCEAFEIRILEGVVSQDHVHILVSSPPTLAPSEIMRRLKGRTANKLFEEFSHLKKRYWGRHFWGRGYFCTTVGQLTEEMIKGYLAHHFEPNPDDKFRMDN

SEQ ID NO: 11374 - protein, 257 aa, Xenorhabdus bovienii
  Coding DNA sequence: Name=SeqID_5266
  Homolog annotation: Query=57..247bp; Hit=13..203bp; Blast score=223; Percent Identity=54.0; E value=2e-57; Homolog= gb|AAL59717.1|
MSSKLNWLLQNTAPGSLVLQSWLTKHGISPSLANKYMHSNWLQKLRTGVYVRAGRDPEWWDVVLCLQNQLGFPVHLAGLTSLGYQGRSHYLQFKQQAIWLYVQDKAALPKWFKEFPNIEWLLLSNQKLAKHDEKYLTEVEIKGEQLRTSVPELAAYEIANAVPGILSFEHAAELFQGLVNLSPRKVEALLQSSRAVQTNRLYLFLADYYAHAWAKRLDQTNIDLGAGKRQIVSGGKLDRKYQITVPEKFVSHGLLHG

SEQ ID NO: 11375 - protein, 309 aa, Xenorhabdus bovienii
  Coding DNA sequence: Name=SeqID_5267
  Homolog annotation: Query=1..308bp; Hit=1..310bp; Blast score=363; Percent Identity=59.0; E value=2e-99; Homolog= gb|AAL59716.1|
MGYYMDKYSPYYRQVALLISALLVVASERCFALKGGTAINLFVRDFPRLSVDIDLVYVPLESRDVALANVRAALTRITGLLQQQVGVSAILQTNNHDEMRIIVSSQEAQIKIEVSPVARGTLYPSQDLDVAEAVEDEFGFATIQVVSMADLYGGKLCAALDRQHPRDLYDVKMLLETQGIDRHIFNGFITYLLSHPRPLSEVLNPRWKDISELYAHEFSGMTFDNVSLEELNVVPEFMISALKSQFTQQDFDFLISFKSGEPDWQLVPESQIQHLPAVKWKLHNIGRIPEEKHIQALEKLERVLNDWMG

SEQ ID NO: 11376 - protein, 345 aa, Xenorhabdus bovienii; identical to SEQ ID NO: 7895
  Coding DNA sequence: Name=SeqID_5268
  Gene classification: Function=Predicted transposase; Function class=L DNA replication, recombination and repair
  Homolog annotation: Query=165..332bp; Hit=20..184bp; Blast score=77; Percent Identity=29.0; E value=3e-14; Homolog= BH2520 COG3335

SEQ ID NO: 11377 - protein, 201 aa, Xenorhabdus bovienii
  Coding DNA sequence: Name=SeqID_5269
  Homolog annotation: Query=2..196bp; Hit=3..197bp; Blast score=239; Percent Identity=59.0; E value=3e-62; Homolog= ref|NP_928112.1|
MEKFYQLKITLTETEPVIWRRFVVPSNISLDRLHDVIQAVMGWEDSHLHEFIFSAKRFTEMPDGMSDCQEEGRFKLDSLIKRKGSKFAYLYDFGDDWEHEIVLENSNYSPEKLPMPIFCLEGEQACPPEDSGGVYGYMELLSILKDPTHEDYQDMFEWVNGEADISPNNVFSPEKFDVEEINNRLALYYRWSRDRYLSMFE

SEQ ID NO: 11378 - protein, 522 aa, Xenorhabdus bovienii
  Coding DNA sequence: Name=SeqID_5270
  Gene classification: Function=Predicted membrane-associated, metal -dependent hydrolase; Function class=R General function prediction only
  Homolog annotation: Query=2..516bp; Hit=8..521bp; Blast score=283; Percent Identity=34.0; E value=4e-76; Homolog= ybiP COG2194
MSFFDKNKKASCFVALFFLIFLIHQCFGYQLKLIYVFSAFALFLLLAAVSKRVYLFLITFFSLVAILYAPVGLNYGFPDINAVGSLLYTNQNETLEYISGFPVSTYLTVMGIFALMMFSFRLNVNLSGKNKKWLFFLFFIPAFWSPAKGYIKSGFENGTELLNTSLPEVRFFSDAYQSYTKVMSENSRFAKIIKLQDDWQPVVKEEKYDTYIMVIGESVRKDFLGAYGFPDKNTPWLDNANATLLTHYISAAPSTQLSLTNSLAIRQSNGINLNNSVVTLANKAGFETYWLSNQGMKGGFDSPVAMIGQQAKHSMFLKEGSSDDRSYMPDENLLPYIRNALKNDQHDKKKKLVVIHLMGSHPQPCARTNNQYGTDFHSKNISCYVQSIYNTDSLLAEIENIANQNQLNWTMLYFADHGLSFVHKGTDNENLTHGDENQQNYQVPFIITSHDYSARNKIDAQRSGLHLLPMLSLWLGIEEPRLVSECDWFSNQKCQNQHTVISFDGKHMDFNRLNNDAIHFGL

SEQ ID NO: 11379 - protein, 717 aa, Xenorhabdus bovienii
  Coding DNA sequence: Name=SeqID_5271
  Gene classification: Gene name=CstA; Function=Carbon starvation protein, predicted membrane protein; Function class=T Signal transduction mechanisms
  Homolog annotation: Query=1..717bp; Hit=6..721bp; Blast score=1160; Percent Identity=87.0; E value=0; Homolog= ZyjiY COG1966
MNNNKFLKHIPWMILGIIGAFCLGVVALRRGEHVSALWIIVASVAVYLVAYRYYSLYIATKVMKLDATRATPAVVNNDGLNYVPTNKNVLFGHHFAAIAGAGPLVGPVLAAQVGYLPGTLWLLAGVVLAGAVQDFMVLFISSRRNGASLGEIIKEEMGQVPGTIALFGCFLIMIIILAVLALIVVKALAESPWGVFTVCSTVPIALFMGIYMRYIRPGRVGEVSVIGVLMLVAVIWFGGVVAADPYWGPALTFKDTTITYTLIGYAFVSALLPVWLILAPRDYLATFLKIGVIVGLAIGIVILNPDLKMPAVTQFVDGTGPVWKGTLFPFLFITIACGAVSGFHALIASGTTPKLLANEKDARFIGYGAMLMESFVAIMALVAASIIEPGLYFAMNTPPAALGITMPDLHNLGTAEAPMIMASLQEVTAHAAATVSSWGFVISPEQILQTAKDIGEPSVLNRAGGAPTLAVGIAYVFHQIIPAANMGFWYHFGILFEALFILTALDAGTRSGRFMLQDLLGNFVPFLKKTDSLVAGIIGTAGCVGLWGYLLYQGVVDPLGGVKSLWPLFGISNQMLAAAALVLGTVVLIKMKRAKYIWVTVIPAIWLLICTTWALGLKLFSDDPRLEGFFFLAKEYKQRIAEGGAELTAQQISNMNHIVVNNYTNAGLSILFLVVVYSIIIYGIKTAIKASKNPARTDNETPYVPVPEGGVKVSSTH

SEQ ID NO: 11380 - protein, 119 aa, Xenorhabdus bovienii
  Coding DNA sequence: Name=SeqID_5272
MGFIFVSYFTDNDFLSFDLLLTKTLTAAHAAFAITTIARILTLTEKLFIGHVRFIWVILLHVLDISVIVRNAHQHAGSLPQIFTRLAKITKHTVLQRKIPHIIQRRLCGVSLLQYSRYR

SEQ ID NO: 11381 - protein, 317 aa, Xenorhabdus bovienii
  Coding DNA sequence: Name=SeqID_5273
  Gene classification: Function=Putative GTPases (G3E family); Function class=R General function prediction only
  Homolog annotation: Query=35..317bp; Hit=1..282bp; Blast score=377; Percent Identity=69.0; E value=1e-105; Homolog= Z5951 COG0523
MKPISVTILAGFLGSGKTTLLRHILNAEHGYKIAVIENEFGEVPIDHELIGDRATQIKTLSNGCICCSRSSELEDALLDLLDGIDKGQIDFDRLIIECTGMADPGPITQTFFSHEILCQRFLLDGIITLVDAMHADQQLNRFSIAQSQVGYADRILLTKTDVAPEHDALLERLQRINAKAPIYKVVHGEVDLSLLFDIEGFMLNDKLTVSNPVFRFIPKQQNTIQSIVVNLKHSVGLAEVSDLMEELLLSFADNLLRYKGILAIKEEPRRLLFQGVQRLYSADWDRAWHDNEERLSVLVFIGMDLPEQKIREKFAEL

SEQ ID NO: 11382 - protein, 183 aa, Xenorhabdus bovienii
  Coding DNA sequence: Name=SeqID_5274
  Gene classification: Gene name=XerC; Function=Integrase; Function class=L DNA replication, recombination and repair
  Homolog annotation: Query=2..183bp; Hit=8..189bp; Blast score=222; Percent Identity=57.0; E value=2e-58; Homolog= fimB COG0582
MKQRKFLTRYEIDAILEQTKQGRHAERDYCMLLMCFIHGFRVSELCNLCLSDLDLNSAIIHIRRLKGGLSTTHPLIPKEIEALKKWLDVRQKWRDADAPWVFLSQKSGPISRQQVYGLLKRYGKQASVSVSPHPHMLRHACGYALADLGRDTRLIQDYLGHRNISHTVIYTASNVKRFSRIWE

SEQ ID NO: 11383 - protein, 55 aa, Xenorhabdus bovienii
  Coding DNA sequence: Name=SeqID_5275
VFAYSGNPCLIHHNFDNLCIRLLHRVVSEWTKLIVIHLSHVKKRLEKEKYITKSR

SEQ ID NO: 11384 - protein, 441 aa, Xenorhabdus bovienii
  Coding DNA sequence: Name=SeqID_5276
  Gene classification: Gene name=SdaC; Function=Amino acid permeases; Function class=E Amino acid transport and metabolism
  Homolog annotation: Query=7..441bp; Hit=6..443bp; Blast score=636; Percent Identity=82.0; E value=0; Homolog= ZyhaO COG0814
MKTATKNNEVTTHTSPAAKRANMTEVEWKKAIKFDSTDTGWTIMSIGMAIGAGIVFLPVQVGLMGLWVFLLSSIIGYPAMYLFQRLFINTLAESPECKDYPSVISGYLGKNWGILLGILYFIMLVIWMFVYSTAITNDSASYLHTFGITSELLSKNPFYGLILICILVAISSRGEQWLFKISSLMVLTKLFVVAALGLSMIGMWHLYNIGVLPPFAILIKKAIITLPFTLTSILFIQTLSPMVISYRNRQQNREVARYKALRAMNMAFGVLFCTVFFYAISFTLAMGHDEAIKAYEQNISALAIAAQFFPDGWVVTVSVILNIFAVMTAFFGVYLGFREASQGIAMNILGRLMPTEKINEKWVQKGIMIFAILLAWGAIILNAPVLSFTSICSPIFGIVGCLIPSYLVYKVPSLHHYKGASLILIIFTGILLCISPFLAFS

SEQ ID NO: 11385 - protein, 52 aa, Xenorhabdus bovienii
  Coding DNA sequence: Name=SeqID_5277
MTQISSVKLHLIKNLINQKNKFIYNTMQSYLMELILKCDSSNKVLFTVKHNL

SEQ ID NO: 11386 - protein, 348 aa, Xenorhabdus bovienii
  Coding DNA sequence: Name=SeqID_5278
  Gene classification: Gene name=FabH; Function=3-oxoacyl-[acyl-carrier- protein] synthase III; Function class=I Lipid metabolism
  Homolog annotation: Query=2..343bp; Hit=8..319bp; Blast score=67; Percent Identity=20.0; E value=3e-11; Homolog= XF1817 COG0332
MKIIGISGLLPSRCVTNSDVLDLIEQNSKETFQGDLPKTLRTIQRLLDKTGLESRYWLGEGEKPMRLMKEAFEQALKQANIRKSEIDLLIYPNVTRGFTEPANSTFIAKALGLNCRNYDVLDACNGWVTAMDIINSKMKAGEIRYAAIINMEFGMSEGGPFRKNFSLNSASELAYKYPSFTIGEAASVTILSNEDTDNFKFDYISRPDLSDICNISLPNWELFCNDSDVELISPLGGKYQFNSYAAALHEYAGEEVPKVFKQHNIASSDIHKIFIHTGAPNMWDGFGKAVDAADKMHNIGQKTGNIITASIPFGIADALEKDRVERDKLCMGWAGSGGMVFSAMSFKL

SEQ ID NO: 11387 - protein, 223 aa, Xenorhabdus bovienii
  Coding DNA sequence: Name=SeqID_5279
  Gene classification: Gene name=CsgG; Function=Uncharacterized protein involved in formation of curli polymers; Function class=M Cell envelope biogenesis, outer membrane
  Homolog annotation: Query=4..223bp; Hit=7..227bp; Blast score=300; Percent Identity=69.0; E value=1e-81; Homolog= PA0045 COG1462
MKSKFTLASLCLASLMLTGCATESSSTLQVQKVSSYNTIYQGIRSPIAVGKFENRSSYQNGIFSDGIDRLGNQSKTTLVTHLQQTGRFNVLERTNMAELQAEAGLQGKAQKLKGANYVITGAVTEFGRKEVGDHQLWGILGRGKSQVAYAKVMLNVVNVETSEVVFSSAGAGEYKLSSREIIGFGGASGYDSTLNGKVLDLAIREAVNDLVAGIENGAWKPVN

SEQ ID NO: 11388 - protein, 115 aa, Xenorhabdus bovienii
  Coding DNA sequence: Name=SeqID_5280
  Homolog annotation: Query=1..113bp; Hit=4..116bp; Blast score=159; Percent Identity=74.0; E value=1e-38; Homolog= ref|NP_931166.1|
MKKTLILLGVLLLAGCVKALKTIYEWGDYQPTVYQYYQQDKMGLQEQIQALQKVIELAKAKDKSVPPGLHAQMGLLYSQTGKIDEAFQQFAIEKNLFPEAAPYMDFLLSKSKGVK

SEQ ID NO: 11389 - protein, 89 aa, Xenorhabdus bovienii
  Coding DNA sequence: Name=SeqID_5281
  Homolog annotation: Query=1..89bp; Hit=1..89bp; Blast score=132; Percent Identity=73.0; E value=1e-30; Homolog= ref|NP_931165.1|
MNRFWGAIAALLLLTLTGCVQQKPYDYTALRESQPKSILVLPAVNKSVEIQAGGSLISQVTYPLAESGYYVFPVAVVEETFRQNGVTEA

SEQ ID NO: 11390 - protein, 52 aa, Xenorhabdus bovienii
  Coding DNA sequence: Name=SeqID_5282
  Homolog annotation: Query=1..50bp; Hit=167..216bp; Blast score=81; Percent Identity=80.0; E value=4e-15; Homolog= ref|NP_931165.1|
MLVSAAISQIANTITDRGHDIAGITSNRLLSAGQYGRLLYGPRSEHYGKEKL

SEQ ID NO: 11391 - protein, 446 aa, Xenorhabdus bovienii
  Coding DNA sequence: Name=SeqID_5283
  Gene classification: Gene name=NorM; Function=Na+-driven multidrug efflux pump; Function class=Q Secondary metabolites biosynthesis, transport and catabolism
  Homolog annotation: Query=10..444bp; Hit=7..437bp; Blast score=332; Percent Identity=45.0; E value=5e-91; Homolog= Cj0619 COG0534
MHQSDVVDRSLFSLSWPIFIDIFLHMATLLINTYMVSHISSAYLAAMGGGNLVFDLCITIFNFISVGCSVVIAQYLGSGKRDKASQAIHISIAFNFVLGLGCALVTVFFGYKILHIMNLPENLMEDGGAYLRVLGICLIPEAMSIILAACLRVYGKSKAAMYVTLIANLLTIVGNMIVLYGFFGLPKYGLEGVAWSTVFGRTVAIILLGGLLFYGLKIKFNPRLLIHWSKNMLGKILHIGLPAAGENLVWILQYMAAQAFIGLMGETSLAAQTMYFQLSLFIMLFGISISIGNEIMVGYLVGAKRFEDAYIRGLNSLKIGVIVTSGVVLVFWMLREPLLNMMTEDKKIIELLLPLFLLSVFLEPGRTFNIVMVNALRASGDARFPLYTALIFMWCISIPVGYFLGIVMNMGILGIWIGFFCDEWMRGLVNAWRWKSKRWQSKRLDI

SEQ ID NO: 11392 - protein, 65 aa, Xenorhabdus bovienii
  Coding DNA sequence: Name=SeqID_5284
MHCKTYRLKWNEWSFYGVTYLESVGNSTRFIGHLVGGLRDWYRWHCASMTCSRISTFGRPCIFSP

SEQ ID NO: 11393 - protein, 213 aa, Xenorhabdus bovienii
  Coding DNA sequence: Name=SeqID_5285
  Gene classification: Gene name=RhtB; Function=Putative threonine efflux protein; Function class=E Amino acid transport and metabolism
  Homolog annotation: Query=2..198bp; Hit=1..197bp; Blast score=91; Percent Identity=31.0; E value=6e-19; Homolog= VCA0355 COG1280
MLDVNWILFLVTALTINAIPGADVIYVTSNYHRIGWKAAASSAIGLAIGYYFYVFITWAGITSILMSLPALYTIIQTAGALYLIWMGYNIYRSKPSEITASSEKNDRNINRKKSSSYLLNGLLISILNPKVGIFFVSFFPQFVHQNSPDYLLLVLGTIFCIGATFFNILYCLITAQLKRISPEKTNFILGRIPGLILIILGVMMILESIKSII

SEQ ID NO: 11394 - protein, 266 aa, Xenorhabdus bovienii
  Coding DNA sequence: Name=SeqID_5286
MFTVITETFFHTSFLHKKLSHFQLNWMIRNARKLDISTLNNIHYELSKKDKITDGDINKLEISYKGLSEPEKYLAKNYGVPETHALSSANIIDTEKLGINFFQDYLNNECSKYNDGALIFLDVILAPFWLNHFEKKIVNAHSAVLPYARGMYAIEQLTATGNKDAVERAAGATLHYVDTGIDTGAIIERKKLLSLWSLETIWAVKGESYLLAFELMKDYLERSKPFNFIDTLSVEYGTDSPLFTSKTFTDKVKRQSEYCFLKMKGI

SEQ ID NO: 11395 - protein, 60 aa, Xenorhabdus bovienii
  Coding DNA sequence: Name=SeqID_5287
MEEVYNGFIFSQTIVYFCYEIKLTIYSFKPISLLLCVIFYWGFLSVFNDLITIFSHDKGD

SEQ ID NO: 11396 - protein, 311 aa, Xenorhabdus bovienii
  Coding DNA sequence: Name=SeqID_5288
  Gene classification: Gene name=CysK; Function=Cysteine synthase; Function class=E Amino acid transport and metabolism
  Homolog annotation: Query=24..300bp; Hit=18..291bp; Blast score=136; Percent Identity=32.0; E value=3e-32; Homolog= TM0665 COG0031
MLFDDISSLINDRCFININGWIPDSAVSLKVEGISVTGSIKIKPALYMISALEDSGVLRTGKKLIESSSGNLGLALSMICAWKGYPFICVSDPNIAPLTERTIRAYGTNLIIAKSKDNNGGYLGERIRIIESMLKEDQNLIWINQYENKNNVLSHYSMTGKSILEKYPYPDYVFIGAGTTGTLGGVSNYIRKYSPSTKIIAVDTKGSVTFGGEPSKRRIPGLGTSKAPEIKKYSQFDEIIYIDEKETVFTCRELASMGLLLGGSTGTVLAAVRHYESIIGKNKIVVAISPDMGEKYIDTIYNDDWVNKFYN

SEQ ID NO: 11397 - protein, 335 aa, Xenorhabdus bovienii
  Coding DNA sequence: Name=SeqID_5289
  Gene classification: Function=Predicted ornithine cyclodeaminase, mu -crystallin homolog; Function class=E Amino acid transport and metabolism
  Homolog annotation: Query=8..316bp; Hit=5..307bp; Blast score=94; Percent Identity=25.0; E value=2e-19; Homolog= AF1665 COG2423
MTDNKFTIISGNDVEVWIKENKEKIIEIIKKTYCLFSDGMVTNPDSHFLRFPDSDKNRIIALPASIEHGNKVAGIKWVSSFPDNIQHGLNRASAVVILNDRNTGYPIACIEGSQISSARTATSAIIGAEYLHQEKRCDQLAVIGTGLISFSIVEYLYSTGWKIENIVVSDLSETNAAKFISYCKQKLGIEAKYLDTTDAISQSDLIIFATSAVSPHIVDPALFSHNPTVLHISLRDLSTDIILKAENYVDDISHAVKAHTSLHLTAEETRDTKFIKGSISDLIRGKVKPDKTKLRIYSPFGMGMLDIAVAENIYSDLKDISGITISDFHPLPVMR

SEQ ID NO: 11398 - protein, 179 aa, Xenorhabdus bovienii
  Coding DNA sequence: Name=SeqID_5290
  Gene classification: Gene name=PncA; Function=Amidases related to nicotinamidase; Function class=Q Secondary metabolites biosynthesis, transport and catabolism
  Homolog annotation: Query=2..174bp; Hit=3..168bp; Blast score=141; Percent Identity=46.0; E value=4e-34; Homolog= TVN0771 COG1335
MKALIVIDMLNDFVTGVLANEESAMKITPPIQRMIKHARNNPDWLVVYVNDAHHADDREMDIWGKHAMVGTWGADVIDELAPIGMEREIVFPKRFYNAFDGTDLENVFAQYGVTEVVLVGQHTHCCVRHTAYGAFTRGYAITVLSDAVCVSPGIDQQAALDYLKTIYGAEITTSKAFGV

SEQ ID NO: 11399 - protein, 115 aa, Xenorhabdus bovienii
  Coding DNA sequence: Name=SeqID_5291
  Homolog annotation: Query=1..115bp; Hit=1..115bp; Blast score=169; Percent Identity=75.0; E value=6e-42; Homolog= ref|NP_928187.1|
MQKIALLTYILVLFSFAQPAKALSEEEAESLADMTAVYIYLKYDCGYSQIPDREIRRAVIYFAQRNKWDLNNYNSQLMEELNQSGYNDLKGINLPQKAKCQALARPSLSLLAYVK

SEQ ID NO: 11400 - protein, 91 aa, Xenorhabdus bovienii
  Coding DNA sequence: Name=SeqID_5292
LPFFLWRTDAANTWVKGKVTLVIDDHHNGNGHCHQCDEPRYGDGLDLVARTKVISITEAAKVVADVLALPLPEPKSTRQTREDKHIASAWF

SEQ ID NO: 11401 - protein, 56 aa, Xenorhabdus bovienii
  Coding DNA sequence: Name=SeqID_5293
MSFFNQNQIITYFKFHVIQQIKTMLTRYACLLWFVWLTWVLAKATPAHQQRLLPPQ

SEQ ID NO: 11402 - protein, 55 aa, Xenorhabdus bovienii
  Coding DNA sequence: Name=SeqID_5294
MLLVPVRIIPPQLVLSPTVKKCPITIFLSPYADTILLIEQFMSAMLYQKNLIIPL

SEQ ID NO: 11403 - protein, 415 aa, Xenorhabdus bovienii
  Coding DNA sequence: Name=SeqID_5295
  Homolog annotation: Query=130..411bp; Hit=7..286bp; Blast score=285; Percent Identity=50.0; E value=1e-75; Homolog= ref|NP_407423.1|
MVIGHFLTVGDKTSCGGIILTGTSNITFYGRDAAIEGSFVTCGKHSGNFSIVGGVNCFFDMEAKLAGTLDSQSTCPCRANLINSIPDSYQNEAHFSNFTSQDVTKDTESTTAQSSHNTTNKSSSDSYAQSEQKIKPEPLPLPAVIFKTKRKMDDYDAEDMIYADLSEEQLKHKVGLTDVGVPCHNYSLIDFIAQAELPKENIMQWCNPYTMEDRDTSARMLFDKFRELSDLYSFVGEYQGVMRKMISHMQGNTGEKFTDPLLDKAMSERILEDTSDQSSLLVIKRTLIKNIDWDNGYYPLDKKGKLYEAIIGSVLPKFDNIEDRVNGLGITVHDTWATHITLQSLEVNGNAFKATIHYHIQDHFGLDKSDVTHYFYKKFRIFRIWFLLQHWNQYGYKPFITEMNVTQVIEGSCNE

SEQ ID NO: 11404 - protein, 154 aa, Xenorhabdus bovienii
  Coding DNA sequence: Name=SeqID_5296
  Homolog annotation: Query=3..149bp; Hit=5..159bp; Blast score=145; Percent Identity=50.0; E value=2e-34; Homolog= ref|NP_407422.1|
MNKYKLFLSLIVIFVVYGVWWLLQPVEIIGVHHRSSGYNDVLVKHFPITDRGKIDWWEKNKSMLKNKYGIPVTDKDGNFDISIWDIGDGYKEMPNTDQNSDLLCFDDMKVKANCIEKNRVLEVSRFDGGKISFVMRHSAYLQRKEGGEINPYQW

SEQ ID NO: 11405 - protein, 123 aa, Xenorhabdus bovienii
  Coding DNA sequence: Name=SeqID_5297
LGNILTDIDLCEALSYVFVDNEVDYEYIASVAKHFPLEHVEMVFFEWVAPICYTNGLILVPPVWTFFDREQLWEDVHELRRKQITGGKIEKIKENIRRCFLRKYLEKEWQRLKKKLTDDIFWR

SEQ ID NO: 11406 - protein, 56 aa, Xenorhabdus bovienii
  Coding DNA sequence: Name=SeqID_5298
MLNLVNFIHFTIKFHNIEPALITLGKMAKFRLQKEINNINYLLQKHEETDDSFLWE

SEQ ID NO: 11407 - protein, 56 aa, Xenorhabdus bovienii
  Coding DNA sequence: Name=SeqID_5299
MAETFSFDHLRYQEHLASLELIQNRSIKIIHYLKSDWWRGVLCLYAQSCEFYSFHN

SEQ ID NO: 11408 - protein, 170 aa, Xenorhabdus bovienii
  Coding DNA sequence: Name=SeqID_5300
  Homolog annotation: Query=1..167bp; Hit=74..242bp; Blast score=172; Percent Identity=56.0; E value=1e-42; Homolog= ref|NP_404706.1|
MQNEMSALRNIFRMAGWEKLETSPRLSNQVLGLSGASRAGMKQAIPDATSQVVYQKALERDAGFAVTLKLARLMGYVLKKRCSASLKSWRKQLEQPEPKLHVVFGTKGGRPRQTRVLDVAAVKEAVEQAIAIAEQRGGKLIDKSDLKQAMTYWRVHTTRIGLNGRGSRND

SEQ ID NO: 11409 - protein, 93 aa, Xenorhabdus bovienii
  Coding DNA sequence: Name=SeqID_5301
  Gene classification: Gene name=Nlp; Function=Predicted transcriptional regulator; Function class=K Transcription
  Homolog annotation: Query=13..77bp; Hit=7..71bp; Blast score=80; Percent Identity=66.0; E value=3e-16; Homolog= sfsB COG3423
MEGVAGMIDVRNDWHSADIIAALRKRGTTLAAISRDAGFNSSTLANTLSCPWPKGEWIIANYLDTHLSEIWSSRYFDMNGNLIERKIRDKSSK

SEQ ID NO: 11410 - protein, 33 aa, Xenorhabdus bovienii
  Coding DNA sequence: Name=SeqID_5302
MRWHNWLSVTAIFNTFRRNASQPPITRPERLVY

SEQ ID NO: 11411 - protein, 47 aa, Xenorhabdus bovienii
  Coding DNA sequence: Name=SeqID_5303
MCLFTKSDTPIDIPFTTQRRTHKKHENKIFCKAYQNSPPTVKEGLNL

SEQ ID NO: 11412 - protein, 181 aa, Xenorhabdus bovienii
  Coding DNA sequence: Name=SeqID_5304
  Gene classification: Gene name=Hpt; Function=Hypoxanthine-guanine phosphoribosyltransferase; Function class=F Nucleotide transport and metabolism
  Homolog annotation: Query=5..181bp; Hit=6..182bp; Blast score=286; Percent Identity=81.0; E value=9e-78; Homolog= hpt COG0634
MSKPKHIVEVMISEQEIKQRIAELGQQITEHYRNSGRELVLVGLLRGSFIFMADLCREVQVPHEVDFMTASSYGNEMNSTRDVKILKDLDEDIRGKDVLIVEDIIDSGNTLNKIREIFALREPNSLAICTLLNKPSRREVDVPVEWIGYSIEDKFVVGYGIDYAQHYRHLPYIGHVTLLEE

SEQ ID NO: 11413 - protein, 217 aa, Xenorhabdus bovienii
  Coding DNA sequence: Name=SeqID_5305
  Gene classification: Gene name=CynT; Function=Carbonic anhydrase; Function class=P Inorganic ion transport and metabolism
  Homolog annotation: Query=2..216bp; Hit=1..215bp; Blast score=326; Percent Identity=72.0; E value=1e-89; Homolog= yadF COG0288
MMRKIEELFARNKQWSQSVNEENPHFFKELSKVQKPHFLWIGCSDSRVPAEKLIDAAPGDLFVHRNVANLVIHTDLNCLSVVQYAVDVLQVEHIIICGHYGCGGIEAAVDGTELGLINNWLLHIRDLWYKHSSMLGELPPNDRLNRLCELNVIEQVYNLGHSTIMQAAWKRGQKVMIHGWVYGLKDGELHDLDVTADSREKLELNYRQAISKLAHKK

SEQ ID NO: 11414 - protein, 308 aa, Xenorhabdus bovienii
  Coding DNA sequence: Name=SeqID_5306
  Gene classification: Gene name=CcmA; Function=ABC-type multidrug transport system, ATPase component; Function class=Q Secondary metabolites biosynthesis, transport and catabolism
  Homolog annotation: Query=1..305bp; Hit=1..305bp; Blast score=473; Percent Identity=78.0; E value=1e-134; Homolog= yadG COG1131
MAYALELTQLTKTYAGGMKALRGIDLRVEEGDFYALLGPNGAGKSTTIGIISSLVNKSSGKVKVFGYDIDTDLVNAKRQLGLVPQEFNFNPFETVIQIVLNQAGYYGVPRNVAYNRAETYLTQLDLWGKRNERANRLSGGMKRRLMIVRALMHQPKLLILDEPTAGVDIELRRSMWEFLKALNAQGTTIILTTHYLEEAEMLCRNIGIIQHGELVENTSMKDLLSQLECETFLFDFMPRGAMPVVEGYDYRLVDAATLEVDVKRGRGLNDIFSQLSMQGIQISSMRNKANRLEELFVGLTNNNQGASQ

SEQ ID NO: 11415 - protein, 256 aa, Xenorhabdus bovienii
  Coding DNA sequence: Name=SeqID_5307
  Gene classification: Function=ABC-type multidrug transport system, permease component; Function class=R General function prediction only
  Homolog annotation: Query=1..256bp; Hit=1..256bp; Blast score=325; Percent Identity=75.0; E value=2e-89; Homolog= yadH COG0842
MIQLYWVALKTLWMKEITRFGRIWVQTLLPPVITMSLYFVIFGNLVGSRIGEMGGFSYMQFIVPGLIMMSVITNSYANVSSSFFGAKFQGSIEEVLVAPVPTHIIIAGFVGGGVTRGVCVGILVTLVSQLFVPVQIHSWSMVVITLLATSILFSLAGLLNAIYAKTFDDISIIPTFVLTPLTYLGGVFYSLTLLPEFWQIVSKLNPIVYMISGFRYGFLGITDVSLTMTLGMLGMFIFVFYLLAWYLIESGRGLRT

SEQ ID NO: 11416 - protein, 44 aa, Xenorhabdus bovienii
  Coding DNA sequence: Name=SeqID_5308
LVFDRVRARAENLKTRICKYNAPPLFTAEWRNSESVIGGNGYAT

SEQ ID NO: 11417 - protein, 126 aa, Xenorhabdus bovienii
  Coding DNA sequence: Name=SeqID_5309
  Gene classification: Gene name=PanD; Function=Aspartate 1 -decarboxylase; Function class=H Coenzyme metabolism
  Homolog annotation: Query=1..126bp; Hit=1..126bp; Blast score=189; Percent Identity=78.0; E value=3e-49; Homolog= panD COG0853
MLRTMLQGKLHRVKVTQADLHYEGSCAIDQDFMDAAGILEYEAIDIYNVDNGERFSTYAIAAERGSRIISVNGAAARRAAVGDKLIICSYVQIADELTRFHRPKVAYFDGDNVMSRLAKAVPVQVA

SEQ ID NO: 11418 - protein, 36 aa, Xenorhabdus bovienii
  Coding DNA sequence: Name=SeqID_5310
MIFAPKSGICASRYDSTNTHIPSLKSANQIDLLIVN

SEQ ID NO: 11419 - protein, 285 aa, Xenorhabdus bovienii
  Coding DNA sequence: Name=SeqID_5311
  Gene classification: Gene name=PanC; Function=Panthothenate synthetase; Function class=H Coenzyme metabolism
  Homolog annotation: Query=1..283bp; Hit=1..282bp; Blast score=372; Percent Identity=63.0; E value=1e-103; Homolog= panC COG0414
MLIIETIPILRREIRRWHQAGKRIAFVPTMGNLHDGHMSLVDTAKAQADVVIVSIFVNPMQFEHEDDLVNYPRTLQEDCEKLSHRKVELVFAPNANEMYPNGSNSSQTFVEVPELSYLLEGANRPGHFRGVTTVVSKLFNLIQPDLVYFGEKDFQQVQIIRKMIADMAYDITLVSVPIVREKSGLALSSRNNLLSAEEKKIAPVLHQIMQCIAEKLTHGERATEQLLELASTHLREEGFMPDELFIRDAENLLPLTSQSKKAVILMAAWLGRVRLIDNQQVDLVG

SEQ ID NO: 11420 - protein, 274 aa, Xenorhabdus bovienii
  Coding DNA sequence: Name=SeqID_5312
  Gene classification: Gene name=PanB; Function=Ketopantoate hydroxymethyltransferase; Function class=H Coenzyme metabolism
  Homolog annotation: Query=12..273bp; Hit=1..263bp; Blast score=397; Percent Identity=73.0; E value=1e-111; Homolog= ZpanB COG0413
MGQALTIQEITMKPTTLADLSQLKKEKRKFATITAYDASFAHLFAEQGINVMLIGDSLGMTLQGFDSTLPVTVEDIAYHTRCVRAGAPHSFLISDMPFMSYATPEQSFSSAATLMRSGANMIKIEGGSWLCETVKMLTERAVPVCGHLGLTPQSVNIFGGYKVQGRDETSAQQLLNDAMALEKAGIQLLVLECVPTALGQRVSEALEIPVIGIGAGNLTDGQILVMHDALGITARPPKFAKDFLKETGNIRDAIRLYIEQVESGAYPGQAHSFK

SEQ ID NO: 11421 - protein, 160 aa, Xenorhabdus bovienii
  Coding DNA sequence: Name=SeqID_5313
  Gene classification: Gene name=FolK; Function=7,8-dihydro-6 -hydroxymethylpterin-pyrophosphokinase; Function class=H Coenzyme metabolism
  Homolog annotation: Query=1..144bp; Hit=1..144bp; Blast score=202; Percent Identity=71.0; E value=1e-52; Homolog= folK COG0801
MARVYIAIGSNLADPLQQVDNALAALHVIPDTSFVMRSSFYRSKPMGPQDQPDYLNLAVALETKLQPEALLDHTQAIELAQGRIRKDERWGPRTLDLDIMLFGDCIIKTERLTVPHYGLKQREFMLYPLAEIAPNLVFPDGETLAARLKHVPENGLTFWL

SEQ ID NO: 11422 - protein, 503 aa, Xenorhabdus bovienii
  Coding DNA sequence: Name=SeqID_5314
  Gene classification: Gene name=PcnB; Function=tRNA nucleotidyltransferase/poly(A) polymerase; Function class=J Translation, ribosomal structure and biogenesis
  Homolog annotation: Query=53..479bp; Hit=5..430bp; Blast score=619; Percent Identity=72.0; E value=1e-177; Homolog= pcnB COG0617
MIRENKTKRDTQAASERPVTISDHTAQIESSTLPKHRREHHSSSSNADNATMKKKSAKAKPSDPPITVLPRDQHPISRKDISDNALKVLYRLNKSGFQAYLVGGGVRDLLLHKKPKDFDIATNATPEQVRKLFRNCRLVGRRFRLAHIMFGPDVIEVATFRGSHEQVESNDRNQSQKAQSGMLLRDNIFGSVEEDAVRRDFTINSLYYGIEDFALRDYVGGMADLQAGIIRLIGDPETRYREDPVRMLRAVRFASKLDMTIEKTTAEPIPQLAFLLKDIPSARLFEESLKLLQSGHGYSTYKLLREYNLFQLLFPMMQRGFTPNNDSPLEKLLEQVLKNTDYRLQNDKRVNPAFLFAAMLWYPLIEHAEKLSQEGGLPYYDAFALAMNDILDEQCGSIAIPKRHTTTMRDIWLLQLRLPRRQGKRANKLMEHPKFRAAYDLLELRANVEPRHELKELVLWWSEFQQATAPQQRGMISELGTDPVRRRTRPRRSSRPRQFKDNG

SEQ ID NO: 11423 - protein, 298 aa, Xenorhabdus bovienii
  Coding DNA sequence: Name=SeqID_5315
  Gene classification: Gene name=GlnS; Function=Glutamyl- and glutaminyl-tRNA synthetases; Function class=J Translation, ribosomal structure and biogenesis
  Homolog annotation: Query=10..297bp; Hit=16..303bp; Blast score=383; Percent Identity=64.0; E value=1e-106; Homolog= ZyadB COG0008
MTQSEHSALYIGRFAPSPSGDLHFGSLVTALGSYLQAHACHGKWLMRIDDIDPPREVPGAASRILQSLEHYGLCWDGEVLYQSQRHEAYRAILAQLQQQGSSYYCTCTRQRIQQLGGFYDDHCRHSYLPADNAAVRLKQRHPIYRFHDKLQGYITVPAKMAEEDFTIYRKDGLFAYNLVVVVDDNHQGVTEIVRGADLIEPTVRQLSLYQHLNFAIPDYVHLPLVLNQEGNKLSKQNHAQPIPLDDPRPLLIDALSFLNQPTIAGWQDLTTDQVLRQAIVGWNINPVPQKNITYRQFK

SEQ ID NO: 11424 - protein, 151 aa, Xenorhabdus bovienii
  Coding DNA sequence: Name=SeqID_5316
  Gene classification: Gene name=DksA; Function=DnaK suppressor protein; Function class=T Signal transduction mechanisms
  Homolog annotation: Query=1..151bp; Hit=1..151bp; Blast score=253; Percent Identity=94.0; E value=5e-68; Homolog= dksA COG1734
MQEGQKRKTSSLSILAIAGVEAYQEKPGEEYMNDAQLTHFKLILEAWRNQLRDEVDRTVSHMQDEAANFPDPVDRAAQEEEFSLELRNRDRERKLIKKIEKTLKKVEDDDFGYCESCGVEIGIRRLEARPTADLCIDCKTLAEIREKQMAG

SEQ ID NO: 11425 - protein, 41 aa, Xenorhabdus bovienii
  Coding DNA sequence: Name=SeqID_5317
MARMLKDEVLRFCPSCIMLLLTHALSNDPPNNGGKKIGRYK

SEQ ID NO: 11426 - protein, 236 aa, Xenorhabdus bovienii
  Coding DNA sequence: Name=SeqID_5318
  Gene classification: Gene name=SfsA; Function=Sugar fermentation stimulation protein (uncharacterized); Function class=G Carbohydrate transport and metabolism
  Homolog annotation: Query=1..231bp; Hit=1..231bp; Blast score=311; Percent Identity=63.0; E value=5e-85; Homolog= sfsA COG1489
MEFSPPLKSATLIRRYKRFLADVLTPEGETLTIHCANTGAMTGCAMPGDTVWYSTSDNPKRKYPNSWELTQTQNGHLICVNTLRANELVYQSIEKNAISELSDYEQIRREVVYGKEKSRIDLLLQSKQRVNCYIEVKSVTLLQENKGYFPDTVTIRGQKHLRELSLIAQQGQRAVLFFAVLHSGISQVAAAKHIDHDYACLLEQACNSGVEVICYGASITEDRMVLSHKLPFVSIG

SEQ ID NO: 11427 - protein, 821 aa, Xenorhabdus bovienii
  Coding DNA sequence: Name=SeqID_5319
  Gene classification: Gene name=HrpA; Function=HrpA-like helicases; Function class=L DNA replication, recombination and repair
  Homolog annotation: Query=3..820bp; Hit=19..823bp; Blast score=932; Percent Identity=63.0; E value=0; Homolog= ZhrpB COG1643
LLLPIYDVLDSVITKLKTSKQVLLHAPTGAGKSTGLPLAILNKAQLTERIIMLEPRRLAARSVAERLAEQLNEPVGVTVGYRMRAETKVSASTRLEVVTEGILTRMLQQDPELSDVSLVILDEFHERSLQADLALALLLDVQEGLREDLRILVMSATLDNQRLSSLLPDAPVIVSEGRSYPVARSYHPLPIHQHFEQSVASAVLRLLQQETGSLLLFLPGVGEIQRVLAQLEQKINDDTLLCPLYGALSLSDQRKAIAPVPAGMRKVVLATNIAETSLTIEGIRLVVDSGLERTSRFEPKSGLTRLMTQRISQASMVQRAGRAGRLEEGVCWHLFSREQAERATEYSEPEILHSDLSSLLLSLLQWGCRDSNQLNWLDNPPQPALAVAQSLLLRLGALDDNQQLTARGWQMAEAGSEPRLAAMLCAGKERGDEALATAAKLVAILEEPPRSGLPDLTHWINSNQPHWQQRANQLIRNLASKTAKIGSKKISTEKINAALVPELLVQGFPDRIAKNRDNLGRFQLANGLGVALEHDDPLSGEQWLIAPTLQQNSKNPDARVLLACPLNIEHTIHQYPSLFTEQAAVEWDNNKGTLRAWKRLQCGRLTVRAQLLAKPSQAELQEALLNWVRQEGLAALNWSSEALQLRIRLQRATEWLPEIEWPAVDDDSLLDSLEQWLLPMLEGVGDLKGLRQIELSCALLGLLDWQQRQILDNELPTNYTVPTGSRITIQYFHDKPPVLSVRMQEMYGEQQNPVLAKGRVPVVVELLSPAHRPLQITQDLAAFWQGAYREVQKEMKGRYPKHLWPDDPANTTPTRRVKKYM

SEQ ID NO: 11428 - protein, 820 aa, Xenorhabdus bovienii
  Coding DNA sequence: Name=SeqID_5320
  Gene classification: Gene name=MrcA; Function=Membrane carboxypeptidase (penicillin-binding protein); Function class=M Cell envelope biogenesis, outer membrane
  Homolog annotation: Query=1..801bp; Hit=1..800bp; Blast score=1073; Percent Identity=69.0; E value=0; Homolog= mrcB COG0744
MSDDDRQPIGRKGKKPELRRGRPAKKRHRQDDYENDENNDFDDDDEEEVMTKKGKKPRPPRSRWLGFWLLLLKVFIVLAVLMAIYGFYLDNKIRHRIDGKVWDLPAAVYGRMVNLEPGMNYSKNEMIRLLEGMQYRKVTKITRAGEFVVRGNNIEMLRRPFDFPDGKEGQIQARLVFSDNHIASIENMENQRQFGFFRLDPKLITMMQSPNGEQRLVVPRSGFPDLLVQTLLETEDRYFYEHDGVRPLSIARAVLANLIAGRTVQGGSTLTQQLVKNLFLSNERTFSRKANEAYMALLMDARYSKDRILELYLNEVYLGQSGDEQIRGFPLASLYYFGRPIDELSLDQQALLVGMVKGASMYNPWRNPKLALERRNVVLKILLNRQIIDQELYDLLSARPLGVKPKSGVITPQPAFMQLVRQELQENLGDKINDLSGVKIFTTLDPVSQDAAEKSVEEGVADLRKTRKVDDLEGAMVVVDRFSGEVRAMVGGSQPEYAGFNRALNARRLIGSLAKPATYLTALSQPDKYRMNTWLADEPISIPLSGGKSWQPRNFSRNFSGRVMLVDALARSINIPTVNLGLGVGLDRITSTLISLGIPAKEIQQVPSMLLGAINLTPMEMAQEFQTIASGGNRAKLSALRSILAEDGTVIYQSYPQAERAVPPEAAYLTLYGMQQVVARGTGSSLTKKYGKYNLAGKTGTTNDLRDSWFTGIDGKEVAIVWTGRDNNGLTNLTGATGALKIYLRYLENETPLVLNNRPPEGIVDMSVNEDGSFNCTGNGIRMLPVWTDDPQSLCQQSTPQPVEDNKEEAPGWLQEMFDQ

SEQ ID NO: 11429 - protein, 69 aa, Xenorhabdus bovienii
  Coding DNA sequence: Name=SeqID_5321
LSCYILNKLAALINNVKSLKVKITHLKSIKIFNYFMVCFFIKYTHNKLHSKVNYIYLKKLFSATNPALY

SEQ ID NO: 11430 - protein, 352 aa, Xenorhabdus bovienii
  Coding DNA sequence: Name=SeqID_5322
  Homolog annotation: Query=120..343bp; Hit=164..413bp; Blast score=68; Percent Identity=24.0; E value=2e-10; Homolog= ref|NP_868167.1|
MYKYSNDMGEIKNDRLLDLYNKQHKFKLDEPELLIKIESALSLSNADFDLPIIVLREGVLVAFCLAHLSYRENINGLGCLNFSNVISSGDVEALRFMFRQIFFVAEIKMLIQGKDSILYGPIHNSILIDRGCRTFAGEPFTYKMPDNNLELCDMLDKIRCQKEKDLIEIIYDYDSRDKLLISLDDDLLMRTPKVDYYSVDGKEIFKLRKELAEFYNSSWQENWGYSPITDVEMGIAAENINNIMGMIARKNGKIIGCTMMQFIVESSNKVGRAFLSGVLPEYRGTGLSIVLTSKLSKIAIENNIKRFSLSWMLEDNKIIIGTMQRFMQYGNSNTRHYRIYSLSQGMFEGNLL

SEQ ID NO: 11431 - protein, 389 aa, Xenorhabdus bovienii
  Coding DNA sequence: Name=SeqID_5323
  Gene classification: Gene name=BioF; Function=7-keto-8 -aminopelargonate synthetase and related enzymes; Function class=H Coenzyme metabolism
  Homolog annotation: Query=4..385bp; Hit=5..387bp; Blast score=179; Percent Identity=30.0; E value=3e-45; Homolog= PM1901 COG0156
MNLYEIVHSDNKAQTLNYFPQVRSACERVLTLADGTTKLNFSSCDYLGMANNALMKNAAINAIQEYGTNISGPMIFCGYTRYHEELEKRYAELFQVNHALMYTTSYQANIGALPVIAEDIELIIMDKLCHVSLYDAVKLSGKPFRVYQHNNMKKLADIIKNNMGKRILIVSDGVFSADGDFCNIPELCKLKSIYSDIMLYIDDAHGVGTLGENGCGLVEVSGCLGEVDIIIGTMSKSFGSTGGFCIIRDDILAQKVKYKSSTYNASRSVSPGVAAASCTALQINQWEGKARRAKLVELVTYAHQRLEGTRVNKQLSVSAVIPVIFETVEQAIAVNSYLLRHNIMVSLFVPPYVEKNKSRLRITIIYHHTKEDIDTLVTVLDNAIEKVIC

SEQ ID NO: 11432 - protein, 246 aa, Xenorhabdus bovienii
  Coding DNA sequence: Name=SeqID_5324
MLIHIIFSIVILVCSYWLLCAILGTLAKQHNIKINYTRKIGHFSMFIFPGIVYAFFNIIETADNLVIASLSSIIFFISLSQMFRRRFKYLASSFHAIDRPEDRPYTLIWIFSQTIVGFLILAVFSVFWGILGIPYELMYMTILTTTIGDGLAEPIGVRFGKHKYAVKGFLIDKVFYRSYEGSFTVFITALILGLVFMYRFSPLGAALMILCFPLGMALTEAKSPHTWDTPFLFFVGNLIITVAYLL

SEQ ID NO: 11433 - protein, 205 aa, Xenorhabdus bovienii
  Coding DNA sequence: Name=SeqID_5325
MGYTISIFCRKFNYNGGLFIMIILIRHATPKIDYSTCNSKLAQQRLLSYNETRDIDESEMDGFMASSLYQKIKDANPVVYSSPVGRAERTCQVLFQQPNNYFIKGELKEVDLEICHLPFIKMKVRSWFFFSRLVWILGIGKEKEKMKHAAIRANRVFKLLDENKNIVIVSHGYLIHYVKKELKKHHYNNIEKYKKGCFTVELYDK

SEQ ID NO: 11434 - protein, 297 aa, Xenorhabdus bovienii
  Coding DNA sequence: Name=SeqID_5326
MRKILIIGASGFIGKKVADYLSHSGDFDVIRYSRFQQEGYFSCLIGDSDWVNMIDSCEAIINCSGVGLAKLKKNQRANEDIAKQIVRSIPDSSDRKYKILHLSSVKAYNANNYKDIYSIDKCRSEAVFFRGKHKLFGELLRIPAVFGQDDKNLQPLVRLARKGQLPGINSHISDWHCITNNDVAYYIYCWLNKDNLSTLNISYLLSEKRYSINDLVESINHSVHGNGYQARKKSLMYIKLIYSLLAVKSYISSGFKSSNFPYARYQDLFERDWKIDDSDGIDIHTIDVNLADIWNSL

SEQ ID NO: 11435 - protein, 203 aa, Xenorhabdus bovienii
  Coding DNA sequence: Name=SeqID_5327
  Homolog annotation: Query=88..202bp; Hit=79..194bp; Blast score=63; Percent Identity=35.0; E value=2e-09; Homolog= ref|NP_385695.1|
MRKFRYSLFIIFLIPIIISWWSSYVSGYRNTVPYFVASIAVLNELFFLNEVSNVKSKDQGIVSALVVSAMMSLLLYFSAGRAVMYLHLLLSTVLILIGSGMRTLSKITLGIYFSHTLRIINNHKLINHGVFRLIRHPAYSVTIIIMSGFGFFVSISMGLVCFFIFFILSMRRIESEENMMMEKFGSEYLDYRKNTWKLFPFII

SEQ ID NO: 11436 - protein, 87 aa, Xenorhabdus bovienii
  Coding DNA sequence: Name=SeqID_5328
MSFNSVNEKIKKIVAEILEMNSCELSDNAIFTKEYGADSITAIEILAAIESEFEIKLPENFADKMISLNSIYTVMQEISISYPEENS

SEQ ID NO: 11437 - protein, 404 aa, Xenorhabdus bovienii
  Coding DNA sequence: Name=SeqID_5329
  Gene classification: Gene name=FabB; Function=3-oxoacyl-(acyl-carrier- protein) synthase; Function class=I Lipid metabolism
  Homolog annotation: Query=1..399bp; Hit=1..414bp; Blast score=183; Percent Identity=31.0; E value=4e-46; Homolog= sll1069 COG0304
MNNVERERIVVTGLGPVHALGVGKSAFFSALSKGINGAKETRSIDVQNYKYHYSCEVENIDPLLYGVSELPAGIGKASLYAIVGSQLAIEDAGLSLADLENKLVGCFLGTTDGESQLIDGIVKGIQGGDAVPAGTFDNALHSRISRNVSSYLKSRGPAYTIGNACSASNASIISAVEYLQDSDAEFAICGGSDVVCRKTFSIFHRLSAISEKLCTPFDVQRKGIIPAEGASILLLEKLSSARARGVHIYGEIVGYGMSCDATHMTNLNPDKIRDCLNTCLESAGLSTFDVDYISMHGTGTMANDFNEYQALQKVFTDNIPICGSIKSMIGHAMGAAAGFGAIACMFSFHHGIPPTINVSEQDPEINITITDKLLPKDVKIAINNAFAFGGNNSIIAFKKVNDNE

SEQ ID NO: 11438 - protein, 318 aa, Xenorhabdus bovienii
  Coding DNA sequence: Name=SeqID_5330
MSEFSLTIRNWCSLKDGIQTGNSPALTSDDCAQIDEKVVLAGKKLRNIDTQTTKVLCCFDAIKRAGNYDPHAAIISATSMGAFDSVCKLLEESYQNALPYQISPGNIPNTVINSTAGFAAIHYEVDGPNISLCASELSFYEALTKAFAIGKRRPANKIFVSAVESWGGLYGRALNEIRQDEHFPVDYYAALFMLSPAAWNVVDDIAGDKILAVTTGRLGAEEDITAKAVDFINSVGIRPELVHTLNIWAVSQNNLSSFNRYFPHTSITQLSSSAKVLMSGLGAWQLEHLLTKTAANKYGVQIAVDDEGFYGLSIIEKL

SEQ ID NO: 11439 - protein, 108 aa, Xenorhabdus bovienii
  Coding DNA sequence: Name=SeqID_5331
MLKNKLNKTCFYGHHHQAFLGHFPGNSLLPGVYYLREVLALLPEEITRFSYIVKYAKFIKMVTPNIYLNYTILIDENNSGEHIDISSTIQEVDGDIVAKIKITFKISE

SEQ ID NO: 11440 - protein, 148 aa, Xenorhabdus bovienii
  Coding DNA sequence: Name=SeqID_5332
MDCDTKSNIEIVGKNLHRYPMVLIDKVIQQGEIVITEKYISLNDFVFRNSDFNQHNDFIYPSYLIIESFFQSAGLFICECDILPYVILCKNVEVKRQIYAGEIIRHHVTLSSRKGSLIIVSGESRSQGESVIYYEQVYIGFQRQGIKS

SEQ ID NO: 11441 - protein, 35 aa, Xenorhabdus bovienii
  Coding DNA sequence: Name=SeqID_5333
MTPQSCGVLYSSSFNLLPVVGLAHLPPLCGLKSIR

SEQ ID NO: 11442 - protein, 427 aa, Xenorhabdus bovienii
  Coding DNA sequence: Name=SeqID_5334
  Gene classification: Gene name=HemL; Function=Glutamate-1 -semialdehyde aminotransferase; Function class=H Coenzyme metabolism
  Homolog annotation: Query=1..426bp; Hit=1..426bp; Blast score=753; Percent Identity=86.0; E value=0; Homolog= ZhemL COG0001
MSQSEILYSQAKQVIPGGVNSPVRAFNGVGGTPVFIQRADGAYLYDVDGNAYIDYVGSWGPMVLGHNHPAIRNAVIEAAERGLSFGAPTAAEVEMAKLVTKLVPSMDMVRMVNSGTEATMSAIRLARGYTGRDKIIKFEGCYHGHADCLLVKAGSGALTIGQPNSPGVPADFAKHTLTCVYNDLNSVREAFEKYPEEIACIIVEPVAGNMNCIPPRPEFLPGLRKLCDEFGALLIIDEVMTGFRVALGGAQEYYGVEPDLTSLGKIIGGGMPVGAFGGRQDIMEKLAPTGPVYQAGTLSGNPIAMAAGLACLNEVAQPGVHQRLSELTDQLASGLKKAASAAGIPLVVNHVGGMFGIFFTDAESVTCYQDVMACDVERFKQFFHLMLDEGVYLAPSAFEAGFMSIAHSDEDIQRTVDAAARCFARLN

SEQ ID NO: 11443 - protein, 114 aa, Xenorhabdus bovienii
  Coding DNA sequence: Name=SeqID_5335
  Gene classification: Gene name=IscA; Function=Uncharacterized ACR; Function class=S Function unknown
  Homolog annotation: Query=1..114bp; Hit=1..114bp; Blast score=204; Percent Identity=88.0; E value=1e-53; Homolog= yadR COG0316
MSDDAALPLQFTDAAANKVKVLVADEDNPNLRLRVYITGGGCSGFQYGFTFDDQMNEGDLTIQKQGAELVVDPMSLQYLVGGCVDYTEGLEGSRFIVTNPNAKTTCGCGSSFSV

SEQ ID NO: 11444 - protein, 282 aa, Xenorhabdus bovienii
  Coding DNA sequence: Name=SeqID_5336
  Gene classification: Gene name=FecB; Function=ABC-type cobalamin/Fe3+- siderophores transport systems, periplasmic components; Function class=P Inorganic ion transport and metabolism
  Homolog annotation: Query=21..278bp; Hit=5..263bp; Blast score=259; Percent Identity=51.0; E value=2e-69; Homolog= ZyadT COG0614
MKLWMKIISLRSIWLSFSFLLFSFLYSVSAPLHAAASRVISLAPSTTELAYAAGLGDRLVAISAYSDYPEAAKKLEQVADWQGINVERIIALKPDLILAWRGGNPQRPLEQLAALGIPIFYSDVKKVEDVATDLERLAVYSPRPDIAKKSAADIRQTFSRLKQTHATPNPKLVFLQFGMNPIFTSSGHTIQSEIVSACGGKNIFADSTVPWPQVNREQVLTRKPEVIVLGGTEDQKQRVADFWQPQLNVKIITLNDDWFSRAGPRIILATEQLCRELNLSGG

SEQ ID NO: 11445 - protein, 224 aa, Xenorhabdus bovienii
  Coding DNA sequence: Name=SeqID_5337
  Gene classification: Gene name=Pfs; Function=Nucleoside phosphorylase; Function class=F Nucleotide transport and metabolism
  Homolog annotation: Query=1..222bp; Hit=9..230bp; Blast score=284; Percent Identity=69.0; E value=5e-77; Homolog= pfs COG0775
MEQEVTLLRDQIEGLQTVSRGGCEIYTGKLNGVDIALLKSGIGKVSAALGTTLLIEHCQPDIVINTGSAGGLDPKLNVGDIVVSGEVRYHDADLTAFGYEPGQMAQCPPAFIADSQLITLAEKCIKSLDLNAVRGLICSGDAFINGAEPLARIRATFPQVAAVEMEAAAIGHVCHQYQIPFVVVRAISDVADQKSHISFDEFLVIAARESTRMVNAMLSELSQH

SEQ ID NO: 11446 - protein, 516 aa, Xenorhabdus bovienii
  Coding DNA sequence: Name=SeqID_5338
  Gene classification: Gene name=Dgt; Function=dGTP triphosphohydrolase; Function class=F Nucleotide transport and metabolism
  Homolog annotation: Query=5..513bp; Hit=1..501bp; Blast score=567; Percent Identity=59.0; E value=1e-162; Homolog= dgt COG0232
MGGLMTKIDFKQKLNYQRKYSNSSIHPDDEDQVNRQFESDRGRIINSAAIRRLQQKTQVFPLERNAAVRSRLTHSLEVQQIGRYISKTIIAELTKQNLLEKYGLSDRLLAFESLIEMACLMHDIGNPPFGHFGEAAIRDWFSRRLDPDYFSDCASESTARQDGCKVAALSYNGEAKKDLFRRQLRKDLCEFEGNAQAIRLAHNLLKLNLTYAQIGCILKYTCPAYRLEGSPEEFSYLMKKKGYYWSEDSFIHELRKELQLGDFCRFPLTYIMEAADDISYCIADLDDAVEKGIFNVEQLVEYLKKEWQENGGHRKGDLFEFTVMQAHKKTASNEARRSIHEQFFMYLRVFITGKLVPYTAKRFIENLPEIYAGTFNHALLEENGDEHRLLQILKSVTRKWVFNHPEVEELELQGYRIITGLLDVYSPLLELSRQDFMALHRDNFHKKYFIETRLLHKLSTKHRLAYEEAVENIVATDEAEKDVLEFYYRARLIQDYISGMTDHYAYEEYRKFMVSK

SEQ ID NO: 11447 - protein, 787 aa, Xenorhabdus bovienii
  Coding DNA sequence: Name=SeqID_5339
  Gene classification: Gene name=BaeS; Function=Signal transduction histidine kinase; Function class=T Signal transduction mechanisms
  Homolog annotation: Query=1..518bp; Hit=1..519bp; Blast score=508; Percent Identity=52.0; E value=1e-143; Homolog= barA_1 COG0642
MTKYSLRTRMMSLILVPVLLVGTLVSISFISYRYYELKNLIVRSGISIIEPLSIASEVGINLDNHRRVEVLVNSLHRRNSEIVKAIAIFDKNHKLFDISNDKYDANQLRLPAGEPIPKILLSQSGHDNNIILMMPLIAENTQENEWRNTTSKANPIGYIAIDLDLRTAQIQQYKEITTSIILLILCLGGTALFAHILVRKVTQPLGDMVRVVERIRQGQLNIRVTGAMPGELAALQNGINTVAESLSKYKDEMQLHIDQATSDLQITMEQLEIQNVELTLAKKRAQEAVKIKTEFLANMSHELRTPLNGVIGFTRQMLKTPITSQQAEYLYVIERSANNLLKIINDILDFSRLESNKLVLDQVPFLLRDTVNEVIELLTPAASEKNLPLHHRIDDKLPNLMIGDPIRLQQILTNLIGNAIKFTDKGSVILEVKLRQQQHHLVQIDFTITDTGIGIKPEYRPILFQAFNQADASITRHYGGTGLGLSITKRLVNEMKGEIDFISEPAKGTVFYFDLWLEKEAFLLGSLPERLPIPSVFPRLPITVMAVDDNPANLKLIGTLLDEQIENTLLCSSGLEALTTAQQHALDLILMDIQMADMDGIQTSEQIHQLPQHKETPIVAVTAFPCNETQNGGRSPFVGCLSKPLDERRLKTWLNQYSQKKKSQFIDWDMALKQTAGKESLAREVLEMLVQSLPEMKAMIEQILAADSDIDHKQFQHHVHQLHGSCCYNGVPKLQAICEFIEKQLKQAIPLADLEPELLEFIDEINHVIAAAPDVLRATAGPLTSIP

SEQ ID NO: 11448 - protein, 450 aa, Xenorhabdus bovienii
  Coding DNA sequence: Name=SeqID_5340
  Gene classification: Gene name=TrmA; Function=SAM-dependent methyltransferases related to tRNA (uracil-5-)-methyltransferase; Function class=J Translation, ribosomal structure and biogenesis
  Homolog annotation: Query=1..444bp; Hit=1..431bp; Blast score=522; Percent Identity=58.0; E value=1e-148; Homolog= ygcA COG2265
MVQFYSPNRRSVNRGIISVTADNLDAQGQGIARHQGKTIFIQGLLPGEQAQIQLTEEKRQFAKAKIVKRLSDSPSRVVPRCPHFNVCGGCQQQHVAIELQAKTKASVLEHLIQRETGTSISAHPIIHSPEYGYRRRARLGLQYDVKKNPARQQKLLMGFRQSQTNDLVAVAHCPVMRPELEQLLQPLSQCLNSLSAVKRLGHVELVLADNGPLMVLRHLDPLKCEDREKLCTFSVQHKTAVYLAGDEKSLEPLIEGQSAPWYQVDGLKLEFSPRDFIQINDEVNQQMVAQALAWLDLQPTDRVLDLFCGMGNFTLPMAPKVQAVVGVEGVAALVANGQYNAQLNELNNVDFFHENLESDIHQQPWAVLGFNKVLLDPARAGAAGVMSHIVKLAPERVVYVSCNPTTLARDSKVLLEAGYHLVSVRMLDMFPHTSHLESMALFSREPVAIE

SEQ ID NO: 11449 - protein, 745 aa, Xenorhabdus bovienii
  Coding DNA sequence: Name=SeqID_5341
  Gene classification: Gene name=SpoT; Function=Guanosine polyphosphate pyrophosphohydrolases/synthetases; Function class=T Signal transduction mechanisms
  Homolog annotation: Query=1..745bp; Hit=1..744bp; Blast score=1246; Percent Identity=80.0; E value=0; Homolog= relA COG0317
MVAVRSAHLTPAGEFAVDKWITSLNITNPQSSEKLAETWHYCHEKVQDHPDAALLLWRGVEMVEILSTLSMDNDSMRAALLFPILDAKLLDNETVTETFGTAITNLVHGVMEMDAIRQLKATHTDSTSSVQVDNVRRMLLSMVEDFRCVIIKLAERIAHLREVKDASEDERVLAAKECSNIYAPLANRLGIGQLKWELEDFCFRYLHPDEYKKIAKLLHERRIDREQYIGKFVTTIRKYMLKEGISVEIYGRPKHIYSIWRKMQKKSLAFDELFDVRAVRIVVERLQDCYAALGIVHTHYRHLPDEFDDYVANAKPNGYQSIHTVVLGPNGKTLEIQIRTRQMHDDAELGVAAHWKYKEGTAIGGGKSGSYESRIAWLRKLIAWQEEMADTGEMLDEVRSQVFDDRVYVFTPKGDVIDLPAGSTPLDFAYHIHSDVGHRCIGAKISGRIVPFSYQLQMGDQIEIITQKHPNPSRDWLNPNLGYVTTSRGRAKIHNWFRKQDRDKNIIAGRQMLDNELTHLGITVKEAEKELIARYNVHSLEEVLAGIGVGDIRIHQLMNFLQSKFNKTTAEEADRKALRNLENKTYTPRNVKQDNGRIVVEGVGNLMHHVARCCQPIPGDEIVGFITRGRGISIHSADCEQLAELEISAPERIVDAVWGENYSSGYSLVVRVLANDRSGLLRDITTILANEKVNVLGVSSRSDVKQQLATIDMNIEIYNLQVLGRVLAKLNQLSDVIEARRLHGN

SEQ ID NO: 11450 - protein, 266 aa, Xenorhabdus bovienii
  Coding DNA sequence: Name=SeqID_5342
  Gene classification: Gene name=MazG; Function=Predicted pyrophosphatase; Function class=R General function prediction only
  Homolog annotation: Query=9..265bp; Hit=4..260bp; Blast score=329; Percent Identity=67.0; E value=2e-90; Homolog= mazG COG1694
MDKIKTTSIERLKGIMTQLRHPQQGCPWDKVQTSATIAPYTLEETYEVIDAIERNDANALKEELGDLLFHIVFYAQMGQEQQLFDFDDICDAVCDKLERRHPHIFDQQAGISSEEAIGSWEQRKTAERAEKDQHSVLDDIPASLPALMKAYKIQKRCASVGFDWDTLGPVLGKVYEEIDEVMDEARQAVVDEARLEEELGDLLFSVVNLSRHLGHKPEMALQKACGKFEKRFRSVEKRVLDQGLSLETATLEEMEQMWQQVKKQQS

SEQ ID NO: 11451 - protein, 54 aa, Xenorhabdus bovienii
  Coding DNA sequence: Name=SeqID_5343
MNLKRKTSAGFALSLISRHFILPRWFVAHLRLGYTAFPSCYIHHPFKPKLSGSA

SEQ ID NO: 11452 - protein, 545 aa, Xenorhabdus bovienii
  Coding DNA sequence: Name=SeqID_5344
  Gene classification: Gene name=PyrG; Function=CTP synthase (UTP -ammonia lyase); Function class=F Nucleotide transport and metabolism
  Homolog annotation: Query=1..545bp; Hit=1..545bp; Blast score=947; Percent Identity=84.0; E value=0; Homolog= pyrG COG0504
MKTNYIFVTGGVVSSLGKGIAAASLAAILEARGLKVTIMKLDPYINVDPGTMSPTQHGEVFVTEDGAETDLDLGHYERFIRTKMTRRNNFTTGRVYSEVLRKERRGDYLGATIQVIPHITNEIKDRIIRGAEGYDVVLVEIGGTVGDIESLPFLEAIRQMAVEVGREHTLYMHLTLVPYLAAAGEVKTKPTQHSVKELLSIGIQPDVLICRSDRIIPANERAKIALFCNVPEKAVISLKDVDSIYKIPGLLKSQGLDDYICKRFSLGYPEADLSEWEQVVYEEANPSGEVTIGMVGKYVELPDAYKSVIEALKHGGLKKRLTVNIKLIDSQDVETRGVDVLKGLDAILVPGGFGGRGIEGKIMTARYARENKVPYLGICLGMQVALIEFSRNVAGMKEANSTEFEPECKLPVVGLITEWRDENGNLEVRSEESDLGGTMRVGGQLCRLSEGSLVRKLYGQDDIIERHRHRYEVNNLLLKRIEEAGLRIAGRSIDNRLVEIIENPAHPWFVACQFHPEFTSTPRDGHPLFAGFVEAAGKYQKGQLK

SEQ ID NO: 11453 - protein, 433 aa, Xenorhabdus bovienii
  Coding DNA sequence: Name=SeqID_5345
  Gene classification: Gene name=Eno; Function=Enolase; Function class =G Carbohydrate transport and metabolism
  Homolog annotation: Query=1..433bp; Hit=1..433bp; Blast score=707; Percent Identity=88.0; E value=0; Homolog= PM1871 COG0148
MSKIVKVLGREIIDSRGNPTVEAEVHLEGGFVGLAAAPSGASTGSREALELRDGDKSRFMGKGVLKALSAVNGPIAQALVGQDAKDQANIDKIMIELDGTENKSNFGANAILAVSLANAKAAAAAKGMPLYEHIAELNGTPGRFSMPLPMMNIINGGEHADNNVDIQEFMIQPIGASTLKEAVRIGSEVFHHLAKVLKAKGMSTAVGDEGGYAPNLESNAAALAAIKEAVEQAGYVLGKDITLAMDCAASEFYNKETGNYELKGEGRTFTSQEFTHYLEDLTKEYPIVSIEDGLDESDWDGFAYQTKVMGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRATFNGLKEVKGQA

SEQ ID NO: 11454 - protein, 34 aa, Xenorhabdus bovienii
  Coding DNA sequence: Name=SeqID_5346
MFWRKSICSFAISTKDNFIHISDYIHDDEMKSMK

SEQ ID NO: 11455 - protein, 34 aa, Xenorhabdus bovienii
  Coding DNA sequence: Name=SeqID_5347
MLKNYITCEIIRSINKEENTTCMILGSITWGLFN

SEQ ID NO: 11456 - protein, 461 aa, Xenorhabdus bovienii
  Coding DNA sequence: Name=SeqID_5348
  Gene classification: Gene name=CitT; Function=Di- and tricarboxylate transporters; Function class=P Inorganic ion transport and metabolism
  Homolog annotation: Query=19..461bp; Hit=14..463bp; Blast score=447; Percent Identity=58.0; E value=1e-126; Homolog= PM1167 COG0471
MDASESLTPAIGPNPSNKRGLIILALDIILLVALLKFLPYGEKTNAGLALMAFVGVLWLTEAIHVTITALCIPILAVGMGLMNTGDALQSFANPIIFLFFGGFALATALHIQGLDRLIANRLLMIARGRLSVAVLLIFGITAVLSMWISNTATAAMMLPLILGILANLDVRTERNTFVFVLLGVAYSASIGGLGTLVGSPPNAIAAAQLGMDFFTWMKYGVPMVIILLPVMVAVMYIMLRPNLKHKFDLKLEHLEWNSKRIITMAIFLLTVFSWIFSSIISDAFGGIKDLDTIIAVSAAILIGITGVSTWSQIQNNTEWGVLMLFGGGLTLSAVLKNSGASEVMANGMAATFGASHWFVIILAVTAFIIFLTEFTSNTASAALLVPIFATVAEALGMPVMVLTMIIGIGASCAFMLPVATPPNAIVYGSGYIKQIEMVRVGMVLNVVCIAIISVVAWFFWL

SEQ ID NO: 11457 - protein, 45 aa, Xenorhabdus bovienii
  Coding DNA sequence: Name=SeqID_5349
MYRHYLCGCLVLLVVIHINKKLIIKIATRKGGDCLGTYNYSFVLI

SEQ ID NO: 11458 - protein, 493 aa, Xenorhabdus bovienii
  Coding DNA sequence: Name=SeqID_5350
  Gene classification: Gene name=PutA; Function=NAD-dependent aldehyde dehydrogenases; Function class=C Energy production and conversion
  Homolog annotation: Query=17..490bp; Hit=54..532bp; Blast score=458; Percent Identity=46.0; E value=1e-129; Homolog= VC0819 COG1012
MKKLHDIAKEMLPAKSYNMLINGEWVDSVSKETRKSYNPATGELLTEYAAGNAQDVELAVKAAQKALPAWSKKSAAEKQSLLLKIADLLEAESERFITLEALDAGKTLNLCRTFDIPFAVDHFRYFAGVIRAHSDEADVIDADTLSLVIREPIGVVGQIIPWNFPLLMAAWKLAPALAAGNTIVINPASLTSISLLELGRILNQVLPAGVVNIVTGRGSSVGQAILDHEGIDKVAFTGSTEVGYNVAAAAAKRIIPATLELGGKSANIIFPDANMKKAVKYAADGILLNQGQACESGARLFLHKDIHDEFLKSLKAAFESVRVGDPMMAETEMACQISQEQMDFILGYIDLAKQEGATVLTGGNRITGAGYDDGFFVQPTIITNVTNKMRVAQEEIFGPVLCVIPFSSEEEVVEMANDSEYGLGGAVWTQDINRALRVAKAVQTGRMWVNTYHALPAHSPFGGYKKSGLGRETHKMSLDAYTQVKNIYISTKE

SEQ ID NO: 11459 - protein, 50 aa, Xenorhabdus bovienii
  Coding DNA sequence: Name=SeqID_5351
LRYHVVFSLYSPSTLVFPMLGHLSRMFYGINSYFSVRIVFKYKGPVSINK

SEQ ID NO: 11460 - protein, 446 aa, Xenorhabdus bovienii
  Coding DNA sequence: Name=SeqID_5352
  Gene classification: Gene name=GltP; Function=Na+/H+-dicarboxylate symporters; Function class=C Energy production and conversion
  Homolog annotation: Query=7..423bp; Hit=34..450bp; Blast score=543; Percent Identity=71.0; E value=1e-154; Homolog= mll5840 COG1301
MDNTSKKKPLYQVLYIQVIFAILLGIALGHFYPDIGESLKPLGDAFIKIVKMIIAPVIFLTVVTGIAGMNNMKSVGSVVGKSMLYFLTFSTLALIIGLVAANIIRPGDGLNISPESLDSSKVIGYVEKAHESSIVGFLMNIIPETVVSPLVNGNILQVLFIAVIFGIALASTGKKGEPILVFLQNFSEPVFKMVGILMKLAPIGAFGAMAFTIGKYGISSIGNLMMLIVTFYMTSLLFIFVVLGAVAKYNGFSIIKLIKYIKDELWLVLGTSSSEAALPSLMRKMENAGCEKSVVGLVIPTGYSFNLDGTNIYMTMAALFIAQATGIELSFTEQISLLLVAMISSKGAAGVTGAGFITLAATLSVVPSLPVAGMALILGIDRFMSECRALTNLVGNACASIVVARWENALDKDKMHQALNGNRQNPVEDISISLSSKKNMSPPENK

SEQ ID NO: 11461 - protein, 37 aa, Xenorhabdus bovienii
  Coding DNA sequence: Name=SeqID_5353
MILYAAKIKHFCHETIKRCKKSPIKTNNYINHRILYG

SEQ ID NO: 11462 - protein, 53 aa, Xenorhabdus bovienii
  Coding DNA sequence: Name=SeqID_5354
MLTNIKITPNACQKQALGSIEKPTGKTCRFRLRRYYLVVTQNTPLPSNAVNVL

SEQ ID NO: 11463 - protein, 378 aa, Xenorhabdus bovienii
  Coding DNA sequence: Name=SeqID_5355
  Gene classification: Gene name=FecB; Function=ABC-type cobalamin/Fe3+- siderophores transport systems, periplasmic components; Function class=P Inorganic ion transport and metabolism
  Homolog annotation: Query=20..373bp; Hit=31..356bp; Blast score=67; Percent Identity=25.0; E value=2e-11; Homolog= MJ0085 COG0614
MSVIHYSIKYFISVLFVLLPIYSQAENITVTDIAGREVTVNAPAQRVMLTDSRIIIALNILHPNDPLKGIVAWDNALEKKAPDLAAAYEKKFPQLREIPIFPNPYTSDFSVEKAMTYKPDLVIFDIGLKPKLDNSNTVKLLEKSGISVIFIDFRQYPLSNTIPSMELLGKVFKKEENAGKYIAFYESRLSLINKRIGTLYQEQIPSVFIEYHAGMLGAEDCCDTIGDNSFGEFVTTAGGDNVGSKWFSGMGGKVNEEQLLVSNPDTYLMTVADWDQVRAGSQSVPLGYTGNLEKSEKRLQNLLSRPNLKVLRSYREKRVMAIYHQYYDSPFNIIAVEAIAKWLHPELFKDIDPHADSIYVHKTFTALDGSGVFWVTTK

SEQ ID NO: 11464 - protein, 54 aa, Xenorhabdus bovienii
  Coding DNA sequence: Name=SeqID_5356
MKEDELWKNMACETKNIFDNHKTLISKEHWKTEFSVLLQVTVNHKVFIKNAIIQ

SEQ ID NO: 11465 - protein, 45 aa, Xenorhabdus bovienii
  Coding DNA sequence: Name=SeqID_5357
MAFVSFRIVLRNFVWLEQVSKLIIMVQKYISFFAVTIKLLGGWLA

SEQ ID NO: 11466 - protein, 115 aa, Xenorhabdus bovienii
  Coding DNA sequence: Name=SeqID_5358
  Homolog annotation: Query=1..109bp; Hit=1..104bp; Blast score=117; Percent Identity=60.0; E value=5e-26; Homolog= ref|NP_930943.1|
MKNLLAVCLLGFVLTGCDNHLKIDGTNEIAVKTSIEKIRDTLPEDKKLKFDDSLNIAMTNSIDFDDLFKESANGNIKHGDIEKLEQKFFRSLHGKTADQLIAEAEKIKAANFTSQ

SEQ ID NO: 11467 - protein, 45 aa, Xenorhabdus bovienii
  Coding DNA sequence: Name=SeqID_5359
LQKRKKLKQRTLPANELTSNRFQVAAHTMLAISASIEPDFLGKIL

SEQ ID NO: 11468 - protein, 190 aa, Xenorhabdus bovienii
  Coding DNA sequence: Name=SeqID_5360
  Gene classification: Gene name=SprT; Function=Uncharacterized BCR; Function class=S Function unknown
  Homolog annotation: Query=12..173bp; Hit=1..162bp; Blast score=200; Percent Identity=59.0; E value=8e-52; Homolog= ZsprT COG3091
MSEITIPYTAVMKLVRVPLALQQAVMRTLRQKLAQASDYLETTFPEPCVTYRQRGTIAGSARLQGWEIRLNPVLLIENQQSFIDEVIPHELAHLLTYHQFGKVAPHGKEWRFVMETVLKVSACRTHQFSVDSVRSKIFIYYCRCQQHELTIRQHNKVLRGKSCYLCQQCKERLKLLEQDKSNTPQSENFA

SEQ ID NO: 11469 - protein, 384 aa, Xenorhabdus bovienii
  Coding DNA sequence: Name=SeqID_5361
  Gene classification: Gene name=MetK; Function=S-adenosylmethionine synthetase; Function class=H Coenzyme metabolism
  Homolog annotation: Query=1..384bp; Hit=1..384bp; Blast score=726; Percent Identity=91.0; E value=0; Homolog= metK COG0192
MTTHLFTSESVSEGHPDKIADQISDAVLDAILEQDPKARVACETYVKTGMVMVGGEITTSAWVDIEEITRRTVREIGYTSSDMGFDANSCAVISAIGKQSPDINQGVDRADPLEQGAGDQGLMFGYATNETDVLMPAPITYAHRLVERQAQVRKNGILPWLRPDAKSQVTFQYDNGKIVGIDAVVLSTQHSEDIQQKELQEAVMDEIIKPVLPAEWLTPMTKYFINPTGRFVIGGPMGDCGLTGRKIIVDTYGGMARHGGGAFSGKDPSKVDRSAAYAARYVAKNMVAAGLADRCEIQVSYAIGVAEPTSIMVETFGTEKVPTSTLIQLVREFFDLRPYGLIKMLDLLHPIYRDTAAYGHFGREHFPWEATDKAEILRSAAGLK

SEQ ID NO: 11470 - protein, 37 aa, Xenorhabdus bovienii
  Coding DNA sequence: Name=SeqID_5362
MWLLAVNNQQIMVHNPIHPHMAYQNASRFSIEKQNTQ

SEQ ID NO: 11471 - protein, 53 aa, Xenorhabdus bovienii
  Coding DNA sequence: Name=SeqID_5363
MHHYLLIVNGQQPHYAIDVFTSSSFLFSMNSSRCYRKHSNRLVISSRHHIVTP

SEQ ID NO: 11472 - protein, 50 aa, Xenorhabdus bovienii
  Coding DNA sequence: Name=SeqID_5364
MLPKAFKQAGNIESAPYCHTVNNCLVPSKRFYNLRACCSLAFFNAQDTHY

SEQ ID NO: 11473 - protein, 634 aa, Xenorhabdus bovienii
  Coding DNA sequence: Name=SeqID_5365
  Gene classification: Gene name=SpeA; Function=Arginine decarboxylase (spermidine biosynthesis); Function class=E Amino acid transport and metabolism
  Homolog annotation: Query=1..634bp; Hit=27..658bp; Blast score=1067; Percent Identity=79.0; E value=0; Homolog= speA COG1166
MNDNIARKMRQTYNIAYWGGGYYYVNDLGNVSVCPNPDLPGAQVELTELVKKVQEEKKQLRLPSLFCFPQILQHRLRSINAAFKRARESYGYKGDYFLVYPIKVNQQRRVIESLANAGEPIGLEAGSKAELMAVLAHAGMTRTVIVCNGYKDREYIRLALIGEKLGHKVYLVIEKMSEIAMVLEEAERLSVIPRLGVRARLASQGAGKWQSSGGEKSKFGLAAAQVLQLVETLRSAGKLDSLQLLHFHLGSQLANIRDVATGVRESARFYVELHKLGVNIQCFDVGGGLGVDYEGTRSQSECSVNYGLNEYANNVIWGIGDACEEHGLPHPTVITESGRALTAHHTVLISNVIGVEHNEFTETTPPAEDASRPLTSLWDTWQEMQDGGYSRSLREWLHDSQFDLQDVHTQYAHGMLNLSERAWAEELYLNICRRIQRDLDPSNRAHRPFIDELQERMADKFYVNFSLFQSMPDAWGIDQVFPVLPIEGLDKPLDRRAVLLDITCDSDGIIDHYVDGDGIAATMPMPAYDPENPPLIGFFMVGAYQEILGNMHNLFGDTAAVDVYVSEHGEVTYQQSEEGDSVANMLQYVKLEPLVLMSRFRDQVKAADLDENLQEQFLQEFETGLYGYTYLEDE

SEQ ID NO: 11474 - protein, 308 aa, Xenorhabdus bovienii
  Coding DNA sequence: Name=SeqID_5366
  Gene classification: Gene name=SpeB; Function =Arginase/agmatinase/formimionoglutamate hydrolase, arginase family; Function class=E Amino acid transport and metabolism
  Homolog annotation: Query=3..306bp; Hit=1..304bp; Blast score=518; Percent Identity=82.0; E value=1e-147; Homolog= speB COG0010
MSISSLGNQIDNSLVSNAFGFLRFPLNFQPYSSDAEWVITGVPFDMATSGRAGSRHGPAAIRQVSTNLAWESCRWPWDFSLRKRLNVVDCGDLVFNFGDAQDMSDKLQAHAEKVLASGKKMLSFGGDHFVTLPLLRAHAKHFGKMAMIHFDAHTDTYPNGSKFDHGTMFYHAPNEGLIDPHRSVQIGIRTEHDTDNGFTVLDAAQVNDRSVDDVVEQIKNVVGDLPIYLTFDIDCLDPAFAPGTGTPVIGGLTSDRALKILRGLQPLNIVGMDVVEVAPAYDQSEITALAAATIGLELLYLQASKKAV

SEQ ID NO: 11475 - protein, 161 aa, Xenorhabdus bovienii
  Coding DNA sequence: Name=SeqID_5367
  Gene classification: Function=Phospholipid-binding protein; Function class=R General function prediction only
  Homolog annotation: Query=3..160bp; Hit=24..181bp; Blast score=166; Percent Identity=48.0; E value=1e-41; Homolog= ybcL COG1881
MIISSPEFKHNDFLHKYHEFNGFGVNGDNRSPELSWQNAPAETKSFAITVYDPDAPTGSGFWHWVAFDIPAETHALSANVGQADGSGLPAGTIQSRNDYGQTGFGGPCPPEGDKAHRYIFTIHALSVEKLGIDAETTNAVARFMIQANTLTTATLTGYYQR

SEQ ID NO: 11476 - protein, 259 aa, Xenorhabdus bovienii
  Coding DNA sequence: Name=SeqID_5368
  Homolog annotation: Query=5..259bp; Hit=8..262bp; Blast score=394; Percent Identity=72.0; E value=1e-108; Homolog= ref|ZP_00063576.1|
MSNKKIEWNNGLQQEAVEILSNEGGMIVCPTKVGYIIMTSDAQGLERKFEAKQRNRNKPGVVLCGSLEQLKELAQLNPEIEELYQKHWDADVLLGCILPWKEDAVARIPDDGSKELMMDGRGTSCFVIKFGKPGEILAKALWENYGKFSFASSANPSGKGNRGLVECIGERIEERADLIIDANDYVKSIQPNETDQTRYEQGVMISMVDDNGTLVPMQNGQRDITPCPVLIRKGLDVHKIMVIMSDIFTTWDYRHGNYY

SEQ ID NO: 11477 - protein, 306 aa, Xenorhabdus bovienii
  Coding DNA sequence: Name=SeqID_5369
  Gene classification: Gene name=LysR; Function=Transcriptional regulator; Function class=K Transcription
  Homolog annotation: Query=1..295bp; Hit=1..288bp; Blast score=155; Percent Identity=32.0; E value=4e-38; Homolog= PA3630 COG0583
MNNIENLTSMVIFARVVETLSFTEAAKSLRLSKSSVSREIAQLEVRLGTQLLNRTTRKIQVTEVGLSYYQYCSRILNEAKSAERFIRNFHDEPMGSLRLIAPVSFGSQCIVPALNNFIARNIHVSVDLELTDRTIDMTDDNYDIAIIVGREIPDHPLVMPLIDITWGLYATPDYMSQFPPIEKPEDLPRYDYLLFRGPAHTISLPFRKERQKLDIEVRSRFRINNSVALMSSALSGAGIAYLPDYIAHESVAEGKLVRLLPGWNMDIYQAWMMFKSENTLSSRVQLFADALQQKLRGDLGDIKRKE

SEQ ID NO: 11478 - protein, 33 aa, Xenorhabdus bovienii
  Coding DNA sequence: Name=SeqID_5370
MIYLGESPPNIPQMLWRKANIPLSDEGDILTKD

SEQ ID NO: 11479 - protein, 55 aa, Xenorhabdus bovienii
  Coding DNA sequence: Name=SeqID_5371
LLDALFLYWNSCSSEGKFLHSYSDTIFAAQFNLWLKYHLHLIEEYWPFSITSVVC

SEQ ID NO: 11480 - protein, 432 aa, Xenorhabdus bovienii
  Coding DNA sequence: Name=SeqID_5372
  Gene classification: Gene name=LeuC; Function=3-isopropylmalate dehydratase large subunit; Function class=E Amino acid transport and metabolism
  Homolog annotation: Query=1..430bp; Hit=1..420bp; Blast score=332; Percent Identity=41.0; E value=5e-91; Homolog= PAB0891 COG0065
MSQTMTQKILARASGREQVTPGEVVWAKVDILMSHDPCTPGVASVFKKEFGQDAKIWDPARFILIPDHFVYSADPQANQNIRVMREFAAEQNIKYFYDVGTPNYKGVCHIGLAEGGHTRPGEVLLGTDSHTVTAGAFGAFAIGLGITDAAYALGTGEIPLKVPTSIKVNFTGTKPSHVLAKDMILAVLSELTVDGATYEAIEFSGNVIDELSVEERMTICNMVVECGAKNGIMVPNQATFDYLAERNHLPFEIVYPDEDAEYSRVLNIDVSDMQPMIAKPHSPDNVVPIEKVTNVAISQAYIGSCTGGKLEDFIAAARVIKGNKVSIPTYAVPATKEVFHKTITTQIDGVSVYQILTDAGVTLSSESGCAACCGGPPDTFGRVNDPISVISTTNRNFVGRMGHKRANIYLASPYSVAAAAITGRITNPGEFL

SEQ ID NO: 11481 - protein, 183 aa, Xenorhabdus bovienii
  Coding DNA sequence: Name=SeqID_5373
  Gene classification: Gene name=LeuD; Function=3-isopropylmalate dehydratase small subunit; Function class=E Amino acid transport and metabolism
  Homolog annotation: Query=3..177bp; Hit=50..213bp; Blast score=114; Percent Identity=40.0; E value=6e-26; Homolog= aq_1398 COG0066
MSILQENIIRGTVYVLTDNIDTDQILTAEYLKVNPSTPEGYAQLASLAMCGLPEGSLPFIDEEQGKAKYPIIVAGQNFGCGSSREHAVAALGASGVKAVLAQSYARIFFRNCVSTGELLPVAAQERLCDKLVTGDRIEIDIENQTVTLLANSEKYPTDPVGELANIVAAGGLFSYARMTGRIK

SEQ ID NO: 11482 - protein, 156 aa, Xenorhabdus bovienii
  Coding DNA sequence: Name=SeqID_5374
  Homolog annotation: Query=11..153bp; Hit=33..175bp; Blast score=143; Percent Identity=48.0; E value=7e-34; Homolog= ref|NP_742441.1|
MRQALLVYEEIDGIIKKLPQMMQSVSDQLSPLALLFSACLEPVENEEDLKARMVIIDELYSYADDTEHVAAKFADFVTDRIYEYETKNRNVSNVSPREALAFFMKERRIRQADLCDIATQSVISEILHGKRSMTIQQVKGFAKFFGVPVETFMGTL

SEQ ID NO: 11483 - protein, 123 aa, Xenorhabdus bovienii
  Coding DNA sequence: Name=SeqID_5375
MRVITARVIIEAMRKHAQWKVGLKLWLDVFDKAALRFESYAQIRDLWLQTSAWNVDRIPHELLEAGNQKGPLDIYIFDIHKNKCRIIAWLNPKSGTFYIKDVCSHAKYDRWWREQTKSNRPKR

SEQ ID NO: 11484 - protein, 35 aa, Xenorhabdus bovienii
  Coding DNA sequence: Name=SeqID_5376
MKLLQTLPDKYQAGSQFYDNLTLILQQRVLTYIIE

SEQ ID NO: 11485 - protein, 30 aa, Xenorhabdus bovienii
  Coding DNA sequence: Name=SeqID_5377
MSKLDDKINQVAKSNLIIEVRHRGSISLPD

SEQ ID NO: 11486 - protein, 246 aa, Xenorhabdus bovienii
  Coding DNA sequence: Name=SeqID_5378
  Gene classification: Gene name=EntD; Function=Phosphopantetheinyl transferase component of siderophore synthetase; Function class=Q Secondary metabolites biosynthesis, transport and catabolism
  Homolog annotation: Query=31..246bp; Hit=26..241bp; Blast score=110; Percent Identity=33.0; E value=2e-24; Homolog= PA1165 COG2977
MKEITFTPVKTTAIDDPFFTVIQRGNLPKYPDIQVMQTYYDQACYQDILFDKYGITYPARLQNAVNKRKAEYLAARYCTQQILNSMDYPEFQVINAPDRSPVWPDKICGSLSHSANCAIVFAASREKYQIIGVDIEQEIKQDTIDSVSRTVINETEAELLKECTLSFAQAFTLTFSIKESLFKALYPHVKRFFDFHAAEITAIDCSHHTLSIKLLKTLSDEYQAGSQFHGNFVLMPQRQVLTYLIG

SEQ ID NO: 11487 - protein, 37 aa, Xenorhabdus bovienii
  Coding DNA sequence: Name=SeqID_5379
MQRFDKHDITFFHVPVSVSVTVSHNKNDNKKEYKKSQ

SEQ ID NO: 11488 - protein, 330 aa, Xenorhabdus bovienii
  Coding DNA sequence: Name=SeqID_5380
  Gene classification: Gene name=GalE; Function=UDP-glucose 4 -epimerase; Function class=M Cell envelope biogenesis, outer membrane
  Homolog annotation: Query=1..330bp; Hit=9..337bp; Blast score=472; Percent Identity=66.0; E value=1e-133; Homolog= VCA0774 COG1087
MGYIGSHTCVQMMEAGMTPIIIDNLCNANREVLARIATLTGVIPLFYEGDIRDESFLDTIFSRHQIQSVIHFAGLKAVGESVAKPIEYYDNNVNGTLVLMRSMHKAGVKSIIFSSSATVYGDPEIVPITEQSAVGNTTNPYGTSKYMVERCLSDLHHAESDWSVVLLRYFNPVGAHPSGTMGEDPQGIPNNLLPYIAQVAVGRREKLSVYGSDYSTHDGTGVRDYIHVMDLADGHIAALNAVGKKSGLHIYNLGTGKGTSVLEMVTAFSHACGKPVPYEICPRRPGDIAECWSSPEKAERELGWKASRTLVEMTADAWRWQSQNPNGYTQ

SEQ ID NO: 11489 - protein, 53 aa, Xenorhabdus bovienii
  Coding DNA sequence: Name=SeqID_5381
MTILLLLRWITTVGKEIGNNAEIHSICLTILPHLHADVTQERDSLLKPIGYNH

SEQ ID NO: 11490 - protein, 230 aa, Xenorhabdus bovienii
  Coding DNA sequence: Name=SeqID_5382
  Gene classification: Gene name=SmtA; Function=SAM-dependent methyltransferases; Function class=Q Secondary metabolites biosynthesis, transport and catabolism
  Homolog annotation: Query=12..222bp; Hit=5..218bp; Blast score=196; Percent Identity=48.0; E value=1e-50; Homolog= BH1828 COG0500
MSSNPQQETNPQQWTAVDHYLKKSLLKSAPHLEKTLEYNVSQELPAIDVSPLMGQFLRMMVQISGAKRILEIGTLGGYSSQCMAKELPDDGLLVTLEKEPRMAQVAQHNIDQAQLAHKIKIIVGDARETLPTLVTEPFFDLIFIDADKQSSELYLDWAIKLGHPGSIIIMDNVVRAGAILHQQRDEQVEGMRKSLDTMLNRPEITVTALQTVGEKGWDGFALLRINTENH

SEQ ID NO: 11491 - protein, 152 aa, Xenorhabdus bovienii
  Coding DNA sequence: Name=SeqID_5383
MKWRSYTYGAMLLAGSLFSSALWAKGEAHLLFHMGLGANGKFFVGGTLENKGDKPVAGGYLAVLPLNTKCEPQAPTVQSFESLAPGEKKEFRIPVNTQLSGYRLIGFGAYDDMGFSLPTVDETAKVIKDREPDERKACQLARKSEKTAVKKQ

SEQ ID NO: 11492 - protein, 301 aa, Xenorhabdus bovienii
  Coding DNA sequence: Name=SeqID_5384
MYTHTEAAKLASLIMYAYDMNEKYYNNPTPPADPRIKEDGWNLIAYISGDDTSFSVEKKMLFTLPKSICYGYIAEKKDAPGKYVIIFRGTDDTNLLEDLHDIIAIFTSPWSSAPERKVSRGFYSVYDSLKLIAFNSECDCDYSQLKLADAITQIIGINGQFTILAHSLGAAIASYLMCDIAFLAPNHSACLFACPRPGNNEFVEYVDNNFSHYEVFNYAKDIVPNLPPDFQGLDISQQWDYEYKSLPKITLLNSPEALSIADSIGCNHYLTSYIAILDPDEFTRVTTGNGAASRHCVNMNK

SEQ ID NO: 11493 - protein, 456 aa, Xenorhabdus bovienii
  Coding DNA sequence: Name=SeqID_5385
  Gene classification: Gene name=CysK; Function=Cysteine synthase; Function class=E Amino acid transport and metabolism
  Homolog annotation: Query=6..321bp; Hit=8..323bp; Blast score=435; Percent Identity=62.0; E value=1e-122; Homolog= PA0399_1 COG0031
MAVPRSVLELIGNTPLLELTHLDTGLCQLFIKLENQNPGGSIKDRVALSMIEKAEKQGLLQPGGTIIEATAGNTGIGLALVAAMKGYKLILVVPDKMSREKIYHLRALGTDVRLTRSDVGKGHPEYYQDYALRLSKQISGAYYIDQFNNSSNSLAHATTTGPEIWQQMEHNVDAVVVGVGSGGTLGGLSQYFREVSPDTEFVLADPKGSILADYVEHGRYDEAGSWFVEGIGEDFIPPLGDFSQVQNAYRITDSEAFSSARDLLLQEGILAGSSSGTLLAAALRYCRAQKTPKRVVTLACDSGNKYLSKMFNDYWLLEQGLRSQPQENDLSDYVTYRYRDGATVSVSPQDTLQIAHGRMRLYDISQLPVLENEQVVGIIDEWDLMHAIHSDSNNFSLPVSKAMTGQVNTLNKKAPLEQLTATFDAGHVALIVDDNNRFLGLVTRTDVLNAWRQQLN

SEQ ID NO: 11494 - protein, 386 aa, Xenorhabdus bovienii
  Coding DNA sequence: Name=SeqID_5386
  Gene classification: Gene name=MetC; Function=Cystathionine beta -lyases/cystathionine gamma-synthases; Function class=E Amino acid transport and metabolism
  Homolog annotation: Query=6..383bp; Hit=15..393bp; Blast score=491; Percent Identity=63.0; E value=1e-139; Homolog= PA0400 COG0626
MTTTKFDTKSVHAGYVPDHTGAVMPAIYATSTYAQPAPGQHTGYEYSRSGNPTRDALERAIAELENGTRGYAFGSGLAASSTILELLDKDSHIIAVDDLYGGTYRLLEKVRRRTAGLRVTYVEAGNTAALEAAIEPDTKMIWVETPTNPLLKLADLAAIAQIAQRHKIISVADNTFASPYIQRPLDLGFDIVVHSATKYLNGHSDVVAGLAVVGNNAELAEQVAFLQNSIGGILDPFSSFLVLRGIRTLALRMERHIDNAEKMAHWLEQQPQIEKVFYPGLASHPQHELAKRQMQGFGGMISVVLKGDDDYIRRVIKELKLFTLAESLGGVESLIGQPFTMTHASIPLEKRLASGITPQLIRISVGIENSEDLIADFAQALEKASL

SEQ ID NO: 11495 - protein, 168 aa, Xenorhabdus bovienii
  Coding DNA sequence: Name=SeqID_5387
  Gene classification: Gene name=Def; Function=N-formylmethionyl-tRNA deformylase; Function class=J Translation, ribosomal structure and biogenesis
  Homolog annotation: Query=1..167bp; Hit=1..167bp; Blast score=220; Percent Identity=66.0; E value=4e-58; Homolog= VCA0150 COG0242
MAILNILTIPDERLRQKCVDVTHVDEIQTLIDDMLDTMYDTDNGIGLAAPQVGRKEAVLIIDISPNRDQPMVLVNPKIVEKERRVVNQEGCLSIPGYYADVERFEKVKVEALDRHGKSITVESEDFLSIVMQHEIDHLNGIIFIDYLSPLKRQMALKKVKKFLSNKAS

SEQ ID NO: 11496 - protein, 161 aa, Xenorhabdus bovienii
  Coding DNA sequence: Name=SeqID_5388
MFIYLNFNKIIVNDIKEGMIVAGKNDITFYQQSNFTISLSLIDTTDAKIGAYLMILDAEGINNAQVFSIKSGSEMEYVHIPSTASSNQLTCSIYIKKVDNGSYPLVGTFYLRYHPASGIVDITEVKISPGALLNLEVDKVDNTKFHFKLQAKQCNQAITSI

SEQ ID NO: 11497 - protein, 226 aa, Xenorhabdus bovienii
  Coding DNA sequence: Name=SeqID_5389
  Gene classification: Gene name=MutH; Function=DNA mismatch repair protein; Function class=L DNA replication, recombination and repair
  Homolog annotation: Query=7..226bp; Hit=9..228bp; Blast score=317; Percent Identity=72.0; E value=9e-87; Homolog= ZmutH COG3066
MYFTPPSPPENEQQLLERANSLAGLSMGELAAQANLPIPPDLKRDKGWVGMLLEYYLGASAGSKPEQDFEHIGIELKTIPVDKKGSPLETTFVCVAPLTGNSGIRWENCHVKRKLSRVLWIPVEGEREIPLAERRVGSPLLWSPDPIEEELLRRDWEELMDLIVLGKVENITARHGEVLQLRPKAANSRALTEAIGEFGQPIMTLPRGFYLKKNFTAPLLARYFFL

SEQ ID NO: 11498 - protein, 69 aa, Xenorhabdus bovienii
  Coding DNA sequence: Name=SeqID_5390
MKEKYTRLTPVFFTYISTEKVNKIVAVRLKMFITLAFSVNYPCGGVNHADLKSNHPNVFIFTPLMLRCT

SEQ ID NO: 11499 - protein, 35 aa, Xenorhabdus bovienii
  Coding DNA sequence: Name=SeqID_5391
MQVDAVMPVRCYRIYLPCSGAKCWRLKFLLQYNVQ

SEQ ID NO: 11500 - protein, 146 aa, Xenorhabdus bovienii
  Coding DNA sequence: Name=SeqID_5392
  Gene classification: Gene name=LeuB; Function =Isocitrate/isopropylmalate dehydrogenase; Function class=E Amino acid transport and metabolism
  Homolog annotation: Query=13..146bp; Hit=231..364bp; Blast score=228; Percent Identity=84.0; E value=2e-60; Homolog= ZleuB COG0473
MLKSSTCISTTPTMQLIKNPAQFDVLLCSNIFGDILSDECAMITGSMGMLPSASLNEKGFGLYEPAGGSAPDIAGKNIANPIAQILSIALLLRYSFERDDAADAIEQAINHALEQGYRTTDLAGNDKAVSTDEMGDIIARYIAEEI

SEQ ID NO: 11501 - protein, 260 aa, Xenorhabdus bovienii
  Coding DNA sequence: Name=SeqID_5393
  Gene classification: Gene name=LeuB; Function =Isocitrate/isopropylmalate dehydrogenase; Function class=E Amino acid transport and metabolism
  Homolog annotation: Query=12..239bp; Hit=3..230bp; Blast score=411; Percent Identity=82.0; E value=1e-115; Homolog= leuB COG0473
MSNHPTTHKQKSGSYHIAVLPGDGIGPEVMKQAYKVLDAIRRRFNLHITTSEYDIGGIAIDHHGCPLPETTIAGCEKADALLFGSVGGPKWEHLPPAEQPERGALLPLRKHFKLFSNLRPARLYAGLESFCPLRQDIAERGFDILCVRELTGGIYFGQPKGREGKGKYERAFDTEIYHRFEIERIARIAFESARKRRHKVTSIDKANVLQSSVLWREVVSEVAKAYPDVEIQHMYIDNAHHAIDQKSGSVRCSAMLQYFW

SEQ ID NO: 11502 - protein, 530 aa, Xenorhabdus bovienii
  Coding DNA sequence: Name=SeqID_5394
  Gene classification: Gene name=LeuA; Function =Isopropylmalate/homocitrate/citramalatesynthases; Function class=E Amino acid transport and metabolism
  Homolog annotation: Query=1..529bp; Hit=1..522bp; Blast score=798; Percent Identity=74.0; E value=0; Homolog= ZleuA COG0119
MSQQVIIFDTTLRDGEQALQASLSVKEKLQIAYALERLGVDIIEAGFPVSSPGDFESVQTIAREIKNSRICALSRCVDNDIDVAAEALKVAEAFRLHLFLATSSLHVEHKLKKEFDDVVEMAVRSIKRARKYTDDIEFSCEDAGRSNIDNLCHIVEQAIKAGATTINIPDTVGYTTPYQFGGIIQNLFDRVPNIDKAIISVHCHDDLGMSVANSITAVQAGARQIEGTINGLGERAGNCSLEEVIMAIKTRQQILGVHTNINHKEIYRTSQLVSQICNTPIPANKAIVGSNAFAHSSGIHQDGVLKNRETYEIMTPESIGLKDTQLNLTSRSGRAAVKHRMSEMGYQEQDYNLDTLYKAFLRLADKKGQVFDYDLEALVFINQQQQENEHYRLDYFSTQSGTNIVPTATVRLACGDEIKSEAATGNGTVDAIYQAINRITGYSLELISYQLTGKGHGKDALGQVNIIVEHSGRRFHGMGLETDIIESSAKAMIPILNSIWQAEQVEKEKQRIQSNTSQNNFPNNNTKETA

SEQ ID NO: 11503 - protein, 39 aa, Xenorhabdus bovienii
  Coding DNA sequence: Name=SeqID_5395
MHSYLYDDNILISMNINTLCMNRNNSNYISHLRVKMRNQ

SEQ ID NO: 11504 - protein, 42 aa, Xenorhabdus bovienii
  Coding DNA sequence: Name=SeqID_5396
MILFFLSLLNYIQSLFHSTKFIAATSLNNGILAVSQCNILTQ

SEQ ID NO: 11505 - protein, 315 aa, Xenorhabdus bovienii
  Coding DNA sequence: Name=SeqID_5397
  Gene classification: Gene name=LysR; Function=Transcriptional regulator; Function class=K Transcription
  Homolog annotation: Query=7..311bp; Hit=63..370bp; Blast score=361; Percent Identity=58.0; E value=1e-100; Homolog= leuO COG0583
MTGYNSVTTRRKESCEVQLRSVDLNLLTVFDAVMQMQNITRAAQALGMSQPAVSNAVARLKTMFDDELFVRYGRGIQPTARAKQLFGPLRQALQIVHNELPGVGFEPDNSARVFNLSICSPLDIRLAAQIVGEIKKHSPNIEVVIKTQINGNIEKQLKYQEIEFVISYIQLDQPDFHNSPLFNDELVLAVSKTHPRIGKRINQQQLQEERHAIVALDNVDSFSKPYYESNELLRSVSYQGTDLNSVLNIVSQTYLVAIAPKWMVEHYSEQLNIRAIPLPNGRISRPCYLIWHGSTNRDKGHQWMKSLLSNLGEQE

SEQ ID NO: 11506 - protein, 611 aa, Xenorhabdus bovienii
  Coding DNA sequence: Name=SeqID_5398
  Gene classification: Gene name=FAA1; Function=Long-chain acyl-CoA synthetases (AMP-forming); Function class=I Lipid metabolism
  Homolog annotation: Query=20..611bp; Hit=6..597bp; Blast score=674; Percent Identity=54.0; E value=0; Homolog= VC2484 COG1022
MINLRLIQEYIVITDSLHSYHLINRLQQQTIEYPEKIAFRQWSPSEQLEMSWQDVTYRTESIAKALLSLGIEIQEKVAIFAHNCIAWSLADLAVLQLRAVTVPLYATSSRDQATFILKDAGVRVLFVGEQEQYNVAMTLLELCPQLNHLIVLDESVDLKGCPQAQHLSAFIANDHTQYQPELDNRIAGQDLNDLFTLIYTSGTTGEPKGVMLDYRNIASQLYLHDQRLTLTREDVSLSFLPLSHIFERAWSYYVMHTGALNVYLTDTNSVREAMAEVRPTVMCAVPRFYEKVHSAILEKVSRAPFLRRMIFRWAIKRGESRWMRQLQNKKACLFSLCSDQLADKLVLSKFRNILGGRVRFLPVAGARLDDSIARFFLSAGINIKYGYGMTETCATVSCWEEKNYLPGSIGTPLPSIDVRISAEDEIQVRGPIVMKGYFNRPEETVHAFTEDGWLRTGDAGGLDETGNLFITERLKDLMKTSTGKYIAPQMLEGTLGQDRFIEYIAVIADSRNFVSALIVPSYDALEDYAKSIHLHYRDRVELLNNRQIIELFEQRLVELQKNIAKYHQVKRFILLPEAFSMEKGELTPTLKLRRKVISQHYHDEIESMYRD

SEQ ID NO: 11507 - protein, 575 aa, Xenorhabdus bovienii
  Coding DNA sequence: Name=SeqID_5399
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=1..575bp; Hit=29..602bp; Blast score=961; Percent Identity=79.0; E value=0; Homolog= ZilvI COG0028
MEMLSGAEMVVRSLIDQGVKHVFGYPGGAVLDIYDALHTVGGIEHILVRHEQGAVHMADGYSRSTGKAGVVLVTSGPGATNAITGIATAYMDSIPMVVLSGQVASSLIGNDAFQECDMVGISRPIVKHSFLVKKAEDIPNTIKKAFYLATTGRPGPVVIDFPKDTVNPALKFPYVYPEKISMRSYNPTVQGHKGQIKRALKTLLDAKKPVIYVGGGAINSACSSELLKLAERLHIPVVSSLMGLGAFPATHRQSLGMLGMHGTFEANKAMHNSDLIFAVGVRFDDRTTNNLEKYCPEAIVLHIDIDPASISKTVSADIPIVGDAKQILGQMLELMNTLEDTQDPDALKDWWLSIEQWRSRKCLGYDRTTAKIKPQAVIETLYRLTEGKAYLSSDVGQHQMFAALYYPFDEPRRWINSGGLGTMGFGLPAALGVKLAKPDATVVCVTGDGSIQMNIQELSTALQYGLPVLVLNLNNRFLGMVKQWQDMIYAGRHSQSYMESLPDFVKLAEAYGHIGVSIQTYEELENKLAQALHEVTENQRLVFVDVTVDETEHVYPMQIRGGAMDEMWLSKTERT

SEQ ID NO: 11508 - protein, 163 aa, Xenorhabdus bovienii
  Coding DNA sequence: Name=SeqID_5400
  Gene classification: Gene name=IlvH; Function=Acetolactate synthase, small subunit; Function class=E Amino acid transport and metabolism
  Homolog annotation: Query=1..163bp; Hit=1..163bp; Blast score=249; Percent Identity=85.0; E value=7e-67; Homolog= ilvH COG0440
MRRILSVLLENESGALSRVVGLFSQRGYNIESLTVAPTEDPTLSRMTIQTKGDAKVLEQIEKQLHKLVDVLRVSELTAGAHVEREIMLVKLQASGYGREEIKRSTDIFRGQIVDVTSTLYTVQLAGTSEKLDAFLDAVRDVAEILEVARSGIVGIARGDKIMR

SEQ ID NO: 11509 - protein, 335 aa, Xenorhabdus bovienii
  Coding DNA sequence: Name=SeqID_5401
  Gene classification: Gene name=PurR; Function=Transcriptional regulators; Function class=K Transcription
  Homolog annotation: Query=1..333bp; Hit=1..333bp; Blast score=552; Percent Identity=82.0; E value=1e-157; Homolog= fruR COG1609
VKLDEIARLAGVSRTTASYVINGKAKQYRVSDKTVEKVMAVVKEHNYHPNAVAAGLRAGRTRSIGLVIPDLENTSYTRIANYLERQARQRGYQLLIACSEDQPDNEMRCVEHLLQRQVDAIIVSTALPPEHPFYQRWTNRSLPIIALDRALDSEHFISVVGDDFEDAKMLAQELRQFPSESVLYLGALPELSVSFLREQGFREAWESDQREVNYLYANSYERDAAAEVFASWLENHPVPQVLYTTSFALLQGVMDTLLKRSGRLPEQLVIATFGDHELLDFLECPVLSVAQRHRDVAECALELVLASLDEKKRPEPGITRMRRHLCRRGSLSRKA

SEQ ID NO: 11510 - protein, 49 aa, Xenorhabdus bovienii
  Coding DNA sequence: Name=SeqID_5402
MTIGNKKSLNIKSIKKSLRHRSKRCKSSDFTCRSFTLPFLVTSYRIFRS

SEQ ID NO: 11511 - protein, 35 aa, Xenorhabdus bovienii
  Coding DNA sequence: Name=SeqID_5403
MKTLSSQSPCALARFTERFQREEERFFRFGNINNR

SEQ ID NO: 11512 - protein, 164 aa, Xenorhabdus bovienii
  Coding DNA sequence: Name=SeqID_5404
  Gene classification: Function=Uncharacterized BCR; Function class=S Function unknown
  Homolog annotation: Query=13..164bp; Hit=1..152bp; Blast score=228; Percent Identity=79.0; E value=2e-60; Homolog= ZyabB COG2001
MWRFLPSRGNLSMFRGATLVNLDSKGRLTVPARYREMLNEESKGQMVCTIDLHQLCLLLYTLPEWEIIEEKLSRLSSMNLAERRVQRLLLGHASECQIDSAGRLLLANTLRQHAGLTKEVMLVGQFNKFELWDEQAWYQQVQNDIEAEQSTQEPLSARLQDLSL

SEQ ID NO: 11513 - protein, 314 aa, Xenorhabdus bovienii
  Coding DNA sequence: Name=SeqID_5405
  Gene classification: Function=Predicted S-adenosylmethionine -dependent methyltransferase involved in cell envelope biogenesis; Function class=M Cell envelope biogenesis, outer membrane
  Homolog annotation: Query=5..311bp; Hit=4..310bp; Blast score=471; Percent Identity=77.0; E value=1e-133; Homolog= yabC COG0275
MANSHYKHTSVLLDEAVNGLNIRENGIYIDGTFGRGGHSRLILSQLGADGRLIAIDRDPQAIEASKAITDPRFSITHGPFSELATYIEEAGLVGKIDGVLLDLGVSSPQLDDPERGFSFMRDGPLDMRMDPTRGQSAAEWLMKAEADDIAWVLKTFGEERFAKRIARAIVARNQEGSITRTRELAELIAQASPVKEKHKHPATRSFQAIRIYINSELEEIERALNGALQVLAPQGRLSVISFHSLEDRIVKRFIRQHSRGPQVPAGLPLTEVQLKAQGGRSLKSIGKLKPSEDEVAINPRARSSVLRFAEKAGE

SEQ ID NO: 11514 - protein, 105 aa, Xenorhabdus bovienii
  Coding DNA sequence: Name=SeqID_5406
  Gene classification: Gene name=FtsL; Function=Cell division protein; Function class=D Cell division and chromosome partitioning
  Homolog annotation: Query=4..103bp; Hit=20..119bp; Blast score=130; Percent Identity=67.0; E value=3e-31; Homolog= ftsL COG3116
MAGERHGLVGVIGRDLIRNAKIPLVLLVAVIISAVSVVTVAHKTRLLIAEKERSAIDFDSLDIEWRNLLLEENALGDHSRVENIATETLHMQHVDPAQENIVITQ

SEQ ID NO: 11515 - protein, 591 aa, Xenorhabdus bovienii
  Coding DNA sequence: Name=SeqID_5407
  Gene classification: Gene name=FtsI; Function=Cell division protein FtsI/penicillin-binding protein 2; Function class=M Cell envelope biogenesis, outer membrane
  Homolog annotation: Query=3..591bp; Hit=4..588bp; Blast score=907; Percent Identity=75.0; E value=0; Homolog= ftsI COG0768
MKAARSLKLKKQEDKASFVSWRFALLCGGISFALFGLLIRVAYLQIINPDRLLKEGDSRSLRVQSIPTTRGMITDRNGRPLAVSVPVDAVWADPKEVFEKGGITDDTRWQALADTLSIPLNQLTRKIQDYPQGRFVYLARQVNTSIGDYVEKLRLPGIYLRQESRRYYPAGQVTAHIIGVTNIDDKGIEGVEKSFDNWLTGKPGSRIVRKDRNGRVIEDVSFTDSQAAHNLALSIDERLQTLVYRELTKAVILNKAESGTAILIDVKTGEVLAMANNPSYNPNNLAGTPQDTMRNRAITDIFEPGSTVKPLVVMSALNLGIVKENSVLDTKPYRLSYGARSHQIKDVAPRAELTITGILQKSSNVGVSKLALAMPASELVNVYSRFGMGKPTNLGLVGESSGIYPKRERWSDLERATFSFGYGLMVTPLQLARVYATIGSFGIYRPLSITKVDPPIPGTRVFPEPIMRTVVHMMESVALPGGGGVRAAIKGYRIAIKTGTAKKVGPDGKYVNKYISYTAGIAPASNPRFALVVIINDPQAGKYYGGAVSAPIFGTIMSGVLRTMNVEPDALPADDKKEFVIDNKEDKSGRS

SEQ ID NO: 11516 - protein, 495 aa, Xenorhabdus bovienii
  Coding DNA sequence: Name=SeqID_5408
  Gene classification: Gene name=MurE; Function=UDP-N-acetylmuramyl tripeptide synthase; Function class=M Cell envelope biogenesis, outer membrane
  Homolog annotation: Query=1..495bp; Hit=1..495bp; Blast score=699; Percent Identity=74.0; E value=0; Homolog= murE COG0769
VADRNLRDLLAPWGVDTPELPLREMTLDSRKAAAGDLFVAVKGHQTDGRKYIPQAIAQGVAAVIAEAKGKTDNGTIQAMHGVPVIYLDDLNNKLSKLAGEFYQHPGNKLKLVGVTGTNGKTTTTQLLAQWSQGLGEISAVMGTVGNGLLGMIVPSENTTGSAVDIQLDLQQLVNQKATFAAMEVSSHGLVQGRVAALPFQAAVFTNLSRDHLDYHGDMENYEEAKWLLFSSHDVKQKIINADDDVGQKWLARLPEAVAVTMENRLPENWSGRWLSASDTHYHDKGASITFTSSWGQGTLHSPLMGAFNVSNLLLALATLLSLEYPLQKLLETASCLEPVCGRMEVFAARGRPTVVVDYAHTPDALEKALSAARLHCKGQLWCVFGCGGDRDKGKRSLMGGIAEQGADRVVVTDDNPRSEEPHSIVEDILTGFIDPGRAMAIHGRVEAVTSAIMQAAEEDVVLVAGKGHEDYQLVGNRRLDYSDRLTVARLLGVIA

SEQ ID NO: 11517 - protein, 460 aa, Xenorhabdus bovienii
  Coding DNA sequence: Name=SeqID_5409
  Gene classification: Gene name=MurF; Function=UDP-N-acetylmuramyl pentapeptide synthase; Function class=M Cell envelope biogenesis, outer membrane
  Homolog annotation: Query=1..460bp; Hit=1..452bp; Blast score=502; Percent Identity=61.0; E value=1e-142; Homolog= murF COG0770
MIPLTLKQLTQLTGGVLYHISEQQAATCQINTVETDSRKMVRGGLFIALKGEKFDAHDFVADVAKLGAGALLVNRRLEIDCPQVVVEDTRLAMGKLAAWVRQQSKARIVALTGSSGKTSVKEMTAAILRQRGHTLYTAGNFNNDIGVPLTLFRLTEEHQFAVIELGANHIGEIAYTAEMTRPESALVNNLFAAHLEGFGSLAGVAKAKGEIFAGLSSAGTAIINLDSNDWAHWQQGISEPQTVWRFAVSPVPEADFYATDIQEQPLATSFCLHTPIGNIEVTLPLPGKHNIANALAASALVISVGASLSDIRAGLLELKAVSGRLFPIQLAEGKIVLDDTYNANIGSMIAAADTLSQMPGYHVMVVGDMGELGDQTVECHRQVGEAVASTKIDKIMSVGEFSSHISETSGRGQHFANKAELVAALFPLLEQHEMISILIKGSRSAAMEEVVNILKGNFQC

SEQ ID NO: 11518 - protein, 360 aa, Xenorhabdus bovienii
  Coding DNA sequence: Name=SeqID_5410
  Gene classification: Gene name=Rfe; Function=UDP-N-acetylmuramyl pentapeptide phosphotransferase/UDP-N- acetylglucosamine-1-phosphate transferase; Function class=M Cell envelope biogenesis, outer membrane
  Homolog annotation: Query=1..360bp; Hit=1..360bp; Blast score=528; Percent Identity=85.0; E value=1e-150; Homolog= mraY COG0472
MLVWLADYLVKYHTVFHVFSYLTFRAIVGLLTALFIALWVGPTLIGYLQKLQIGQVVRDNGPESHFSKRGTPTMGGLLILFSITMSILLWTRLDNPYVWCVLAVLLGYGVVGFVDDYRKVVRKDTKGLIARWKYFWQSVIALGVAFAMYSMGKDTAATQLIVPFFKEVMPQLGLLYILLAYFVIVGTSNAVNLTDGLDGLAIMPTVFVAAGFAIVAWAMSNVKFALYLHIPHLVHASELVIVCTAIVGAGLGFLWFNTYPAQVFMGDVGSLALGGALGTIAVLLRQEFLLIIMGGVFVVETLSVILQVGSFKLRGQRIFRMAPIHHHYELKGWPEPRVIVRFWIISLVLVLIGLATLKVR

SEQ ID NO: 11519 - protein, 436 aa, Xenorhabdus bovienii
  Coding DNA sequence: Name=SeqID_5411
  Gene classification: Gene name=MurD; Function=UDP-N -acetylmuramoylalanine-D-glutamate ligase; Function class=M Cell envelope biogenesis, outer membrane
  Homolog annotation: Query=1..436bp; Hit=1..438bp; Blast score=615; Percent Identity=72.0; E value=1e-176; Homolog= murD COG0771
MAEYLGKKVVIVGLGLTGLSCVDFFIAHGVTPRVMDTRLVPPGSDKLPDDVECHTGSLNTQWLMDADLIVASPGIALATPELQAAADAGIEIVGDIELFCREATAPIVAITGSNGKSTVTTLVGEMAKEAGWQVGVGGNIGVPALELLKQPCQLYVLELSSFQLETTYSLKAAAATVLNVTEDHMVRYPDGLSQYRAAKLRIYDQAKVCVVNEQDALTLPEAGKDSRCISFGVDSGVYQLESGRQQLVVNHQSLLETRQIRLTGQHNYINGLAALALADAVGIPREASLQALQTYPGLAHRFQVVHMRHGVRWVNDSKATNVGSTQAALSGLTLEGTLYLLLGGDGKAADFTPLQPYVSGNNIRLYCFGCDGNQLAQLRPEISTLTETMEQAMREIAPKLMTGDMVLLSPACASFDQFNGFEHRGHEFARLAEELG

SEQ ID NO: 11520 - protein, 397 aa, Xenorhabdus bovienii
  Coding DNA sequence: Name=SeqID_5412
  Gene classification: Gene name=FtsW; Function=Bacterial cell division membrane protein; Function class=D Cell division and chromosome partitioning
  Homolog annotation: Query=10..397bp; Hit=27..414bp; Blast score=534; Percent Identity=74.0; E value=1e-152; Homolog= ftsW COG0772
MTIPGLGKFKNWLTGNVETDATDIVMYDRTLVWMILGLAVIGFVMVTSASMPVGQRLAQDPFIFAQRDAIYLVLAFILSLITLRIPMEFWQRYSNIILLGTIIMLVVVLLVGSSVNGASRWVAIGPLRIQPAELSKLSLFCYLSSYLVRKVEEVRNNFWGFCKPMGVMIALAILLLAQPDLGTVIVLFVTTLALLFLAGAKLWQFLAIIGCGIFAVCVLIVAEPYRMRRVTSFLNPWDDPFGSGYQLTQSLMAFGRGDFFGQGLGNSIQKMEYLPEAHTDFIFSILAEELGYLGVVLVLSMVFFVAFRAMMIGRRALQLNQRFAGFLACAIGIWFSFQAFINVGAASGMLPTKGLTLPLVSYGGSSLIVMSTAIVLLLRIDYEVRLAKAQAFVRSPK

SEQ ID NO: 11521 - protein, 361 aa, Xenorhabdus bovienii
  Coding DNA sequence: Name=SeqID_5413
  Gene classification: Gene name=MurG; Function=UDP-N -acetylglucosamine; Function class=M Cell envelope biogenesis, outer membrane
  Homolog annotation: Query=1..346bp; Hit=1..346bp; Blast score=512; Percent Identity=74.0; E value=1e-145; Homolog= murG COG0707
MSGRNRRLMVMAGGTGGHVFPGLAVAQHLKEQGWEIRWLGTADRMEADLVPKQGIDIEFIQISGLRGKGIKALFAAPVRIFKAIRQAKTIMRRYQPDVVLGMGGYVSGPGGIAAWLCGIPVVLHEQNGIAGLTNRWLAKIAKTVLQAFPGAFSDAPVVGNPVREDVLALPVPAQRLAGREGSIRVLVVGGSQGARILNQIMPEVADRMGDHITVWHQAGKGAQEETHKKYENSAKSEFKVTEFIDDMAQVYAWADIVVCRSGALTVSEVSAAGLPAIFVPFQHKDRQQYWNALPLENAGAAKILEQPQFTAEAVVDLLTQWQRPQLLEMAEKARSVAIVNATERVAAALIDAVKNHSGRSK

SEQ ID NO: 11522 - protein, 476 aa, Xenorhabdus bovienii
  Coding DNA sequence: Name=SeqID_5414
  Gene classification: Gene name=MurC; Function=UDP-N-acetylmuramate -alanine ligase; Function class=M Cell envelope biogenesis, outer membrane
  Homolog annotation: Query=1..475bp; Hit=16..490bp; Blast score=729; Percent Identity=81.0; E value=0; Homolog= ZmurC COG0773
MRKVRHIHFVGIGGAGMGGIAEVLANEGYQISGSDLAPNPVTQQLIALGATIYFNHRSENVRDASVVVASTAISADNPEIIAAREARIPVIRRAEMLAELMRYRHGIAIAGTHGKTTTTAMIAGIYAQAGLDPTFVNGGLVKAAGTHARLGTSRYLIAEADESDASFLHLQPMMAVVTNIEADHMDTYQGDFENLKQTFVNFLHNLPFYGRAVMCIDDPVVKELIPRIGRYITTYGFSEEADIRITHYEQKGAQGFFTISRDDLPELHVVLNAPGRHNALNATAAVAVATEEGINDAAILASLAEFQGTGRRFDFLGEFSLKHINGKEGSVMLVDDYGHHPTEVDATIKAARAGWPDKCIVMLFQPHRYTRTRDLYDDFANILSQVDVLLMLDVYSAGETPIPGADSRSLCRTIRSRGKLDPIFVSDPEQISAMLSQVMENNDLVLIQGAGNIGKIARNLAETKLQPSFNEGEHHG

SEQ ID NO: 11523 - protein, 306 aa, Xenorhabdus bovienii
  Coding DNA sequence: Name=SeqID_5415
  Gene classification: Gene name=DdlA; Function=D-alanine-D-alanine ligase and related ATP-grasp enzymes; Function class=M Cell envelope biogenesis, outer membrane
  Homolog annotation: Query=1..306bp; Hit=1..306bp; Blast score=409; Percent Identity=67.0; E value=1e-114; Homolog= ddlB COG1181
MVEKVAVLLGGTSAEREVSLQSGQSVVAGLKEAGINAYSVDTKDFDVTKLKGEGFSKAFIALHGRGGEDGTLQGVLEFLQIPYTGSGVMASALSMDKLRTKQLWQGAKLPVSPYAVINAQKFEQVNDFQLQEYVRELELPLMVKPNLEGSSVGMTKVNDYSELRGALELAFQYDTDVLVEKWLFGPEYTVAFLGDEILPSIRIQAPEVFYDYDAKYLSNETKYFCPSGLSAEKEQELAEIASRAYKALGCSGWGRVDIMDDGNGNFYLLEVNTSPGMTSHSLVPMAARQSGLSFSQLVVKILELAD

SEQ ID NO: 11524 - protein, 274 aa, Xenorhabdus bovienii
  Coding DNA sequence: Name=SeqID_5416
  Gene classification: Gene name=FtsQ; Function=Cell division septal protein; Function class=M Cell envelope biogenesis, outer membrane
  Homolog annotation: Query=1..256bp; Hit=1..259bp; Blast score=310; Percent Identity=62.0; E value=1e-84; Homolog= ftsQ COG1589
MSQAARNTRERESETQSSRPSNGYHLAGIVFFLMVIGTIVWGGWMTLDWMKDSNRLALSKLVLTGERHYTTNDDVRRAIMAFGAIGTFMTQDVNIIQGQIERLPWIRQVTVRKQWPDELKIHLVEYVPYVRWNDTHMLDVEGNVFSLPIERSVKRHYAMLSGPEGKEKEVLAEYNKVAPLFTEHKMKLKTVIMTERNAWQLILDNDIRLELGNKNDVKRIKRFIELYPVLQKNTEKRVAYVDLRYDSGAAVGWAPLLIDAPVSINGQKNNSDWQ

SEQ ID NO: 11525 - protein, 418 aa, Xenorhabdus bovienii
  Coding DNA sequence: Name=SeqID_5417
  Gene classification: Gene name=FtsA; Function=Predicted ATPases of the HSP70 class involved in cell division; Function class=D Cell division and chromosome partitioning
  Homolog annotation: Query=1..418bp; Hit=1..420bp; Blast score=761; Percent Identity=91.0; E value=0; Homolog= ftsA COG0849
MIKSTDRKLVVGLEIGTAKVSALVGEILPDGMVNIIGVGSCPSRGMDKGGVNDLESVVKCVQRAIDQAELMADCQISSVYLGLSGKHISCQNEIGMVPISEEEVTQDDVDSVVHTAKSVRVRDEHRILHVIPQEYAIDYQEGIKNPVGLSGVRMQAKVHLITCHNDMAKNIVKAVERCGLKVDQLIFAGLAASYAVLTEDERELGVCVVDIGGGTMDIAVYTGGALRHTKVIPYAGNVVTSDIAYAFGTPPSDAETIKVRHGCALGSIVSKDESVEVPSVGGRPPRSLQRQTLAEVIEPRYTELLNLVNDEILRLQEQLRQQGVKHHLAAGIVLTGGGAQIDGVAECAQRVFHTQVRIGRPLNITGLTDYVQEPCYSTAVGLLHYGKESHLGGDSDADKRTSVSGWFKKVSSWLRKEF

SEQ ID NO: 11526 - protein, 387 aa, Xenorhabdus bovienii
  Coding DNA sequence: Name=SeqID_5418
  Gene classification: Gene name=FtsZ; Function=Cell division GTPase; Function class=D Cell division and chromosome partitioning
  Homolog annotation: Query=1..386bp; Hit=1..382bp; Blast score=579; Percent Identity=90.0; E value=1e-165; Homolog= ftsZ COG0206
MFEPLELTNDAVIKVIGVGGGGGNAVEHMVRERIEGVDFFAINTDAQALRKTAVGQTIQIGNGITKGLGAGANPEVGRTAAEEDREALRTALEGADMVFIAAGMGGGTGTGAAPVVAEIAKELGILTVAVVTKPFNFEGKKRMAFAEQGITELSKHVDSLITIPNDKLLKVLGRGISLLDAFGAANDVLKGAVQGIAELITRPGLMNVDFADVRTVMSEMGYAMMGSGISQGEDRAEEAAEMAISSPLLEDIDLSGARGVLVNITAGFDLRLDEFETVGNTIRAFASDNATVVIGTSLDPDMNDELRVTVVATGIGMDKRPEITLVTNNKVSQSNTLDRRYPQMSGGIPSLSEEKKTAAKVVNDQNAQTSKEPDYLDIPAFLRKQAS

SEQ ID NO: 11527 - protein, 380 aa, Xenorhabdus bovienii
  Coding DNA sequence: Name=SeqID_5419
  Homolog annotation: Query=1..380bp; Hit=29..408bp; Blast score=522; Percent Identity=67.0; E value=1e-147; Homolog= ref|NP_927678.1|
MIDAILPKYAEHTVSHGEALLAMILNGLGFHSRTLHMCPDFFKHKPVERLIGVGIMAEHLNDDVLGRTLDALFDCGVSEIYQVIAERVIDKLALKSDSVHLDITSFHVDGEYKLPDDDETKRLVLVRGYSRDHRPDLNQVVLQLICENQAGIPVYMQAMSGNTNDTKAFAETTKHHIGCLKAAQNSRYLIADAALYTQETLASLHQQNQKFITRVPLTIKEAKQHLLTVNTDQLQPVTEGYAGHWIESCYGGVPQRWLLVNSEAAMQCEHQTFRKNTRISTEKELKQFEKLSKKSFPCDEDALQALCDFEAECQFIGIEAPKFKKSRCIRGEGAPAKGHIPIVVIISFLPSSTANWGKVAVCPLKVGMVILATNEMDDRR

SEQ ID NO: 11528 - protein, 499 aa, Xenorhabdus bovienii
  Coding DNA sequence: Name=SeqID_5420
  Gene classification: Gene name=ThrS; Function=Threonyl-tRNA synthetase; Function class=J Translation, ribosomal structure and biogenesis
  Homolog annotation: Query=1..496bp; Hit=1..496bp; Blast score=918; Percent Identity=85.0; E value=0; Homolog= thrS COG0441
MPVITLPDGSQRQFEHAVSVMDVARDIGAGLAKACIAGRVNGELVDACELIETDANLAIITSKDENGLEIIRHSCAHLLGHAVKQLWPDTKMAIGPVIDNGFYYDVDLDRSLTQEDIELLEKRMLELAKTDYDVIKKKVSWQEARDAFAARGEEYKIQILDENISRDDHPGLYYHEEYMDMCRGPHVPNMRFCHHFKLQKIAGAYWRGNSDNKMLQRIYGTAWADKKQLNAYLQRLEEASKRDHRKIGKQLDLYHMQEEAPGMAFWHNDGWTIFRELETFARVKLKEYHYQEVKGPFMMDRILWEKTGHWENYKEHMFTTSSENREYCVKPMNCPGHVQIFNQGLKSYRDLPLRMAEFGSCHRNEPSGALHGLMRVRGFTQDDAHIFCTEDQIHQEVSSCIKMIYDVYNTFGFEKIVVKLSTRPEKRIGTDKQWDEAEADLAEALKQSGIEFEYQPGEGAFYGPKIEFTLYDCLDRAWQCGTVQLDFSLPARLNASLAS

SEQ ID NO: 11529 - protein, 35 aa, Xenorhabdus bovienii
  Coding DNA sequence: Name=SeqID_5421
MLKLTLTTVRKSNYRHLKSLSTVVTHTKDHLYEIF

SEQ ID NO: 11530 - protein, 43 aa, Xenorhabdus bovienii
  Coding DNA sequence: Name=SeqID_5422
VIFSHLELPKISNNYYGRKLSKMLLKYTPSGFNLISNTQRFLL

SEQ ID NO: 11531 - protein, 47 aa, Xenorhabdus bovienii
  Coding DNA sequence: Name=SeqID_5423
LYVFTQSFAQGNSQDLVNEKDHDIERGMYGKKSLKNHPISMQISSDL

SEQ ID NO: 11532 - protein, 227 aa, Xenorhabdus bovienii
  Coding DNA sequence: Name=SeqID_5424
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=63..218bp; Hit=82..237bp; Blast score=186; Percent Identity=57.0; E value=2e-47; Homolog= mltE COG0741
VKLRLGYIVLAMLLTGCADQEIHQSGVGKQLTAKRLLGNNNVVSSPRKFMARSESTPFDRFIEQAARRYGVDETLIKAIIRVESGFRPEVVSKSNAVGLMQIKASTAGRDAYRIKGKSGQPTMRELKDPETNIDLGTAYISILKKQHLEGITNPETMYYAMIVAYVNGAGALLRTFDSNRTLAINKINRMTPNEFYQYVQNNHPAPQAPRYLWKVKNAYRDLDIIDN

SEQ ID NO: 11533 - protein, 48 aa, Xenorhabdus bovienii
  Coding DNA sequence: Name=SeqID_5425
VNKKLAYCLGLRNINGSIYFDKLYKSILGLLVKLYMIYKVNFGLGKTA

SEQ ID NO: 11534 - protein, 44 aa, Xenorhabdus bovienii
  Coding DNA sequence: Name=SeqID_5426
LNAFCSFWQTLLVIHVIIDNDYQYHLFKVKAILHKINDSLIDIP

SEQ ID NO: 11535 - protein, 304 aa, Xenorhabdus bovienii
  Coding DNA sequence: Name=SeqID_5427
  Gene classification: Gene name=ZnuA; Function=ABC-type Mn/Zn transport system, periplasmic Mn/Zn-binding (lipo)protein (surface adhesin A); Function class=P Inorganic ion transport and metabolism
  Homolog annotation: Query=14..304bp; Hit=5..293bp; Blast score=438; Percent Identity=72.0; E value=1e-123; Homolog= PM0400 COG0803
MNKRRSISAFPIFSMIIALFTLTLFSQQAYADKKFRVVTTFTIIQDMAQNIAGDAAIVESITKPGAEIHDYQPTPKDIIKAQRADLILWNGLNLERWFERFFENMKDIPTAVITEGIIPLPIREGPYNKNPNPHAWMSPKNALIYIENIRKSFVKYDPANAEVYNRNAKIYAEKMAKLDAPLRERLSRIPENQRWLVTSEGAFSYLTQDYGFKEVYLWPINAEEQGSPQQVRRVIDTIRTQKIPVVFSESTVSDKPAKQVSKETGAHYGGILYVDSLSTPKGPVPTYIDLLNTTVDTIAKGFNQ

SEQ ID NO: 11536 - protein, 303 aa, Xenorhabdus bovienii
  Coding DNA sequence: Name=SeqID_5428
  Gene classification: Gene name=ZnuC; Function=ABC-type Mn/Zn transport systems, ATPase component; Function class=P Inorganic ion transport and metabolism
  Homolog annotation: Query=19..302bp; Hit=11..294bp; Blast score=390; Percent Identity=65.0; E value=1e-109; Homolog= PM0399 COG1121
MSHSSLNHQSLFEHPHLIVDDATVTYNNGHTAIYDASFDITGGTICALVGMNGSGKSTLFKTIMGLVTPSHGKVTLNAQTIKTALKQNIIAYVPQTEDVDWNFPVLVSDVVMMGRYGKMGFLRRPSKRDHQIVDKALERVGLNELRNRQIGELSGGQKKRTFLARALAQEGKVLLLDEPFTGVDVKTENAIVDLLRDLRDEGHLVLVSTHNLGSVPEFCDHVILINRTVLASGPTETTFTQKNLETTFGGVLRHINLSGSELHDDDDPRSLTVITDDERAAVFYGYDRHVPPRQSQKQKENQP

SEQ ID NO: 11537 - protein, 291 aa, Xenorhabdus bovienii
  Coding DNA sequence: Name=SeqID_5429
  Gene classification: Gene name=ZnuB; Function=ABC-type Mn2+/Zn2+ transport systems, permease components; Function class=P Inorganic ion transport and metabolism
  Homolog annotation: Query=1..272bp; Hit=1..272bp; Blast score=325; Percent Identity=74.0; E value=3e-89; Homolog= PM0398 COG1108
MMELLIQPFNYNYMVKAMWVSAIVGAVCAFLSAYLMLKGWSLMGDALSHSVVPGVAGAYALGLPYAGGAFFTGMLAALSMTLVRHITRLREDAVIGFIFSTFFAVGLLIVSLNPTSVNVQTIILGNILGISDEDVLQVEIIIAVSFIILMLIWKDLLVVFFDETHARSIGLSPLRLKIIFFTLLSACTVAALQTVGAILVIAMVVTPGATAYLLTDRFKHLLIIAVTIGSLTSAIGAYLSYFLNGATGGVIVTLQTVIFLLAFFFAPKHGMLASRRRAKKESLALTQGGRS

SEQ ID NO: 11538 - protein, 291 aa, Xenorhabdus bovienii
  Coding DNA sequence: Name=SeqID_5430
  Gene classification: Gene name=ZnuB; Function=ABC-type Mn2+/Zn2+ transport systems, permease components; Function class=P Inorganic ion transport and metabolism
  Homolog annotation: Query=4..273bp; Hit=1..270bp; Blast score=302; Percent Identity=61.0; E value=2e-82; Homolog= HI0359 COG1108
MSTLIEFITEPFMHDFMQRAIFASVMVGAVCAVLSCYLVLKGWSLMGDAISHAVLPGIVLAFVAGIPLAIGAFLSGIFCAFATGYLKEHSRIKEDTVMGIVFSGMFALGLVLFTRIDTDQHLTHILFGSILGITQHELIQTLCIASVTLAIVLLKRKDFMLYCFDPNQARVVGLPVKLIHYGLLSLLALTIVASLQAVGIILVIAMLISPGIIAFMLCRSFDRMLIVAMIASVSSSVLGTIISFHIDGETGPCIVIIQAIFFITALIYDQIKLARKKMSKKRTKDIPSPSS

SEQ ID NO: 11539 - protein, 42 aa, Xenorhabdus bovienii
  Coding DNA sequence: Name=SeqID_5431
MSAPPKCSLNRRFTACHMIHLIKLTIAMLILQTDATIEQVKK

SEQ ID NO: 11540 - protein, 287 aa, Xenorhabdus bovienii
  Coding DNA sequence: Name=SeqID_5432
  Gene classification: Function=Uncharacterized BCR; Function class=S Function unknown
  Homolog annotation: Query=1..286bp; Hit=1..285bp; Blast score=366; Percent Identity=59.0; E value=1e-101; Homolog= yniA COG3001
MWQAVNRLLSEHFGGADIHNKTELAGGDIHRSWCVEYGEQHIFIKSNLKEMLPVFKTEAEQLELLAHSKTIHVPQVYGVGYDRDHSFLLLEYLPIKPFNAYSAYYFGQQLAKLHQWSEQPKFGFDFDNMLATTIQPNGWQKRWNQFYAEKRIGWQLQLAADRGMVFGNIELIVQIISDKLQSHQPQPSLLHGDLWPTNCASLNSNSAAAFDPACYWGDRECDLAMLPLYPELPLQIFDGYQSIWPLPQGFIERQPLYQLYYLLNRCNLFGGENFIIVQNMIDNILSE

SEQ ID NO: 11541 - protein, 30 aa, Xenorhabdus bovienii
  Coding DNA sequence: Name=SeqID_5433
MYLVCREFCFIVIVNLLNIKIINSDFWQWC

SEQ ID NO: 11542 - protein, 42 aa, Xenorhabdus bovienii
  Coding DNA sequence: Name=SeqID_5434
MPIKLLNILISCEEKINASAAVIFIFYITNPIVLRKNKQSHQ

SEQ ID NO: 11543 - protein, 179 aa, Xenorhabdus bovienii
  Coding DNA sequence: Name=SeqID_5435
  Homolog annotation: Query=1..179bp; Hit=1..180bp; Blast score=234; Percent Identity=68.0; E value=6e-61; Homolog= ref|NP_929912.1|
MTYQQAGYIAIAKRILGWVIFVPAFLSTFVSVINLAWQHGVKGSGIYAVLNDFLRMMTEMIKFNTSFLDFFWKHSPIPDRMVMITGTNVSFLVIYFLMFVGLAMSASGLRMYRQFKFIKEHIEDQMILENAKESGITKEQLEAKIKFPPHSLFSQIFILYISPIIIGAIAYFFSKLLGW

SEQ ID NO: 11544 - protein, 37 aa, Xenorhabdus bovienii
  Coding DNA sequence: Name=SeqID_5436
MIATTLHYRRNSSPAISVAYGKIPHVQKHQLQKTFQL

SEQ ID NO: 11545 - protein, 48 aa, Xenorhabdus bovienii
  Coding DNA sequence: Name=SeqID_5437
VKISHEQKVLRKSQYLQKQKVWWKSPYPRCDITPCGNRGDFHPSCLTH

SEQ ID NO: 11546 - protein, 55 aa, Xenorhabdus bovienii
  Coding DNA sequence: Name=SeqID_5438
LTTRDISSVNSSLFQLLGNPNGYFMCWTKGINALYFNVLIVRKGLGKQTPNLSSD

SEQ ID NO: 11547 - protein, 97 aa, Xenorhabdus bovienii
  Coding DNA sequence: Name=SeqID_5439
MVPARFRFKRRCEINYKDSLSLRNHQSQRLNYENFVVYIFANKESSSQSDKFLADRANWDLKAHLSGNAHLSDNSLIFNQTTDLASACPAPCAQLTH

SEQ ID NO: 11548 - protein, 280 aa, Xenorhabdus bovienii
  Coding DNA sequence: Name=SeqID_5440
  Homolog annotation: Query=123..278bp; Hit=9..164bp; Blast score=236; Percent Identity=74.0; E value=2e-61; Homolog= ref|NP_930547.1|
MSIQNNNPDTPCPCDCDLFVVPSRNYVKESIEEHAQSRNHPNATLQDKGFVTLSNDADSNNETSAATPKAVKTAHDLANLANQNANNANINANNRLAKDQNGADIPDKKAFIKNLGLVSNSTLPVGVPVPWPAETPPEGWLICNGDSFDKATYPKLALAYPSGNLPDLRGEFIRGWDNGRGADVGRSLLSNQVADIAPHSHRIGRMWSSSNGGVEGLGTGNRIFNSVHQDINYGIDPRGLGIAIGMGSGGVGYMDNAVAASTGTETRPRNVAFNYIVKAD

SEQ ID NO: 11549 - protein, 56 aa, Xenorhabdus bovienii
  Coding DNA sequence: Name=SeqID_5441
VGGCWGAWCEAGDGRRMKPVLTRGKLRVKDYSSDHSIAGIRIFSRYSAVFLTCGIN

SEQ ID NO: 11550 - protein, 144 aa, Xenorhabdus bovienii
  Coding DNA sequence: Name=SeqID_5442
  Homolog annotation: Query=4..144bp; Hit=10..148bp; Blast score=133; Percent Identity=53.0; E value=6e-31; Homolog= ref|NP_931542.1|
MNYYYYSPSQNAFYPYAMKRDYVNAGSWPDAGIDVEEAVFEKYTATPPMGKMRVAGADGLPAWGDIPPAPPPTPEERQQQAESQKWSLIQPIRGKIEPLQDAVYLDIATEEEKIALTEWHRYRLALYRVDCTTAPDVKWPEQPK

SEQ ID NO: 11551 - protein, 297 aa, Xenorhabdus bovienii
  Coding DNA sequence: Name=SeqID_5443
  Homolog annotation: Query=3..200bp; Hit=4..175bp; Blast score=116; Percent Identity=38.0; E value=5e-25; Homolog= gb|AAK16093.1|AF288083_4
MIYSDGTTNLVSGSAIVRGTGTQWKSNINGIAAGQIISIQSGNTVIQNVIQSVNSDTELVLAFAPSVSLNNAKYVISTTVPDTVSDGVRHMCAINAAIILFLQNMARWMSENGKVEVEMPNGQKVTLDSIRALQAAINGKQDRGDYATNSALNTVNDNANIRLEKNQNGADIPNKPEFVNNLGLSELVYRTIGNGPNQIPDMSFFSAGGGHMKFPNGKMIQYGYAQSDPSEPKIINFPTPFPKQCYGVTSSGTDPDAANISGCGVIDRFGFYLSAWHVGSKTTNRTATHISWIAVGI

SEQ ID NO: 11552 - protein, 356 aa, Xenorhabdus bovienii
  Coding DNA sequence: Name=SeqID_5444
  Homolog annotation: Query=8..235bp; Hit=969..1196bp; Blast score=149; Percent Identity=37.0; E value=1e-34; Homolog= ref|NP_037717.1|
MDFNSEAIMEIAAVEGAIVQRQLKVNGELKAEILHVQTTQVTDRQAFAEDMKKVQAEVGENAAAVQTKATAVFDIKGDGYALYDVGVGLKYKDQFHKAGMVMGSEVKNGQVTTSIGFSANNFGWFNPASGKMEPFMMAKNGQLFTREEFIEDGSITNAKIGNYIQSRNYITGRAGWKIDKGGGAEFNHVTVRGEIHATSGTFSGTINGADGRFSGAVYATKIVGDVVSVTLGNVSLGNRESIFFHKRLTESMPFDRVFIYGPIMTQRYVGSLGGSGEASVSIYVNNAHVAGQYFSMESFDRGPQCISGTLFTPPITIPANTTPTIKVVLTTHGAGITYPTSGIGMLFKVSSQWSDM

SEQ ID NO: 11553 - protein, 92 aa, Xenorhabdus bovienii
  Coding DNA sequence: Name=SeqID_5445
LPVRNLRGLNVQYLGLKLTIHFQLSLNNCSFHRGDLHDGFGVKVHLRLQTLAGFVGKKFLTGRINDPVRIRRRLPTNERRGLSPPPLLPRIN

SEQ ID NO: 11554 - protein, 191 aa, Xenorhabdus bovienii
  Coding DNA sequence: Name=SeqID_5446
  Homolog annotation: Query=4..190bp; Hit=9..199bp; Blast score=191; Percent Identity=56.0; E value=4e-48; Homolog= ref|ZP_00141097.1|
MNTLRTIRLSGVLIPQFGRQYKLAVSSPIEAIRALSVLIDGFEKFLLTAKERGLTFAVFIGKRNINRDELELSGEGDIRIVPVIIGSKKAGIFQTILGAVMVVAGAFLWATPYGVPLVMSGASMMLGGVVQMLSPMPGGLARREDPDNKPSYAFGGPVNSIAQGNPVPIGYGKRRIGGAIISAGIYAEDQQ

SEQ ID NO: 11555 - protein, 46 aa, Xenorhabdus bovienii
  Coding DNA sequence: Name=SeqID_5447
MTYFTYRHSSDLIDLVEQSVDHTTLCLSIFWGFLSPNGGFFYGVNS

SEQ ID NO: 11556 - protein, 112 aa, Xenorhabdus bovienii; identical to SEQ ID NO: 8648
  Coding DNA sequence: Name=SeqID_5448
  Homolog annotation: Query=1..112bp; Hit=11..122bp; Blast score=199; Percent Identity=83.0; E value=9e-51; Homolog= ref|NP_085189.1|

SEQ ID NO: 11557 - protein, 71 aa, Xenorhabdus bovienii; identical to SEQ ID NO: 8647
  Coding DNA sequence: Name=SeqID_5449
  Homolog annotation: Query=1..71bp; Hit=122..192bp; Blast score=108; Percent Identity=74.0; E value=3e-23; Homolog= emb|CAC83041.1|

SEQ ID NO: 11558 - protein, 66 aa, Xenorhabdus bovienii; identical to SEQ ID NO: 9011
  Coding DNA sequence: Name=SeqID_5450

SEQ ID NO: 11559 - protein, 150 aa, Xenorhabdus bovienii; identical to SEQ ID NO: 8646
  Coding DNA sequence: Name=SeqID_5451
  Homolog annotation: Query=3..150bp; Hit=250..397bp; Blast score=218; Percent Identity=72.0; E value=3e-56; Homolog= emb|CAC83041.1|

SEQ ID NO: 11560 - protein, 43 aa, Xenorhabdus bovienii
  Coding DNA sequence: Name=SeqID_5452
MNSSIKSGVRPDALKSGVRPDALKTGVRPDALKTGVRPDAIID

SEQ ID NO: 11561 - protein, 40 aa, Xenorhabdus bovienii
  Coding DNA sequence: Name=SeqID_5453
MKETISFPFIGLKNLNTRFHRIINYHTSFNTLTILNINFP

SEQ ID NO: 11562 - protein, 49 aa, Xenorhabdus bovienii
  Coding DNA sequence: Name=SeqID_5454
MNGNEIVSFIYHHCQWGQFLERLLRTTFNDMNKLYIDMKIITPVTSFLI

SEQ ID NO: 11563 - protein, 276 aa, Xenorhabdus bovienii
  Coding DNA sequence: Name=SeqID_5455
  Gene classification: Gene name=MhpC; Function=Predicted hydrolases or acyltransferases (alpha/beta hydrolase superfamily); Function class=R General function prediction only
  Homolog annotation: Query=27..274bp; Hit=59..302bp; Blast score=77; Percent Identity=28.0; E value=2e-14; Homolog= DR0791 COG0596
MVVTNDEIQHHDIQTRYANISVLDTGGNGLPVLLIHGNSSCKEIFRHQIEYLKGDYRVLALDLPGHGKSSNASDPREAYSMSGYARTIIEVLEKMGIDKVVVFGWSLGGHIGLEMLALNPKMIGLMICGTPPVAAGRENVARGFRQSELRLTGKAEFTDEDVKNFARETNGVNAPHEPFMIEAVARTDGLARQYMFEASVSPQATDQKLLAETSEVPLAIVNGAGDPFINHDYINGLNYKNLWKGQVFNLAGVDHAPFWEAPNIFNPILAEFLKGF

SEQ ID NO: 11564 - protein, 33 aa, Xenorhabdus bovienii; identical to SEQ ID NO: 8322
  Coding DNA sequence: Name=SeqID_5456

SEQ ID NO: 11565 - protein, 468 aa, Xenorhabdus bovienii
  Coding DNA sequence: Name=SeqID_5457
  Homolog annotation: Query=1..453bp; Hit=1..453bp; Blast score=682; Percent Identity=72.0; E value=0; Homolog= ref|NP_927678.1|
MSLSEPAIKRLDHLGLVAAFCHEIGLPRMIDAILPKYAEHTVSHGEALLAMILNGLGFHSRTLHMCPDFFKHKPVERLIGVGIMAEHLNDDVLGRTLDALFDCGVSEIYQVIAERVIDKLALKSDSVHLDITSFHVDGEYKLPDDDETKRLVLVRGYSRDHRPDLNQVVLQLICENQAGIPVYMQAMSGNTNDTKAFAETTKHHIGCLKAAQNSRYLIADAALYTQETLASLHQQNQKFITRVPLTIKEAKQHLLTVNTDQLQPVTEGYAGHWIESCYGGVPQRWLLVNSEAAMQCEHQTFRKNTRISTEKELKQFEKLSKKSFPCGEDALQALCDFEAECQFIGIEAPKVQKIEVHKGRGRPAKGQHPDSVHYQLSASVYSQLGKVAYVRLKVGMFILATNEMDDKALNMETLLANYKAQQKVERGFRFLKSPEFLTSAIYLKKPERIEGVINDNDMQFNGLCCTGA

SEQ ID NO: 11566 - protein, 85 aa, Xenorhabdus bovienii
  Coding DNA sequence: Name=SeqID_5458
  Homolog annotation: Query=1..85bp; Hit=454..538bp; Blast score=142; Percent Identity=76.0; E value=1e-33; Homolog= ref|NP_927678.1|
MIMTCSLMVYAALEHKIRTGLKQNAPFYPDMKGKPTQSPTARWVFLTFEGISTFEFQEHRMVTGIQVYQNELLKILGQPYESFYS

SEQ ID NO: 11567 - protein, 34 aa, Xenorhabdus bovienii
  Coding DNA sequence: Name=SeqID_5459
VDFLLITKRLHYAKSGCFKCIVFHRLVETPLIFN

SEQ ID NO: 11568 - protein, 428 aa, Xenorhabdus bovienii
  Coding DNA sequence: Name=SeqID_5460
  Homolog annotation: Query=16..428bp; Hit=93..455bp; Blast score=117; Percent Identity=29.0; E value=4e-25; Homolog= sp|P31489|YADA_YEREN
VIYYFEFLFRAQEKKSTGIGYNAVATGEFSTALGADSIASGWESTALGEKANATGRASTAVGNHAHATGDNSISMGFTAKAKANNSMAFGNESVADRENTVSFGNSNNQKQIVNVADGTQKNDAVNKGQMDVVDGKATEAKNTANQANNTANNANATANNAVTKADSAFQRAEQAEKNANNYTDSNITENNKVINQNINNAKNEAFQKWQETANAAEKNANAYTDSKAKETLNFANNYTDNKITGNNKVINHNIDNAKNEAITTSNKYTDLKITDRKTELNQNIDNSKKEAITTSNNYTDSRITDIIINENIDNAKNEAISTSNDYTDYWFNQLDGKTDSRFNQVDKRIDRLENKVNAGLAGVTAISSIPYVQEERFSFGMGLDNYKNGNAIAAGAKYKPTGNTNVRLNFSWDNESNSAVGVGFAIGW

SEQ ID NO: 11569 - protein, 318 aa, Xenorhabdus bovienii
  Coding DNA sequence: Name=SeqID_5461
  Gene classification: Function=Predicted transposase; Function class=L DNA replication, recombination and repair
  Homolog annotation: Query=15..299bp; Hit=1..281bp; Blast score=302; Percent Identity=54.0; E value=2e-82; Homolog= Z4330 COG3335
MPIIAPIPRNERQKMKKLIQKTQNKDYARRMMALLMLHKGDTVSHVAKTLCASRSSVNRWVNWFTLYGLDGLKSLPPGRPAIWNLEPLLAVVSFLLKHSPQHFGYLRSRWSLELITHKINVLLDISLSQSTLYRYFYRAGIVWRRAAPTLRLSDPEHDEKRAKITGALSNASEQHPVFYEDEVDIDLNPKIGADWCFKGQQKRVVTPGKNQKHYLAGCLNAKTKEITYVGGLRKNSDLFIKLLDVLNNQYVNAKTITLILDNYGIHKSQKVIAWLAKNPKFNLLFLPVYSPWLNKIERLWQSLHETVTRNHCCQFMGQ

SEQ ID NO: 11570 - protein, 58 aa, Xenorhabdus bovienii
  Coding DNA sequence: Name=SeqID_5462
MLTNKISIAQKNESNLKNKSEKYCNGFKLKLIVLVLSSTLGIGGAYASYNTIYGDQAK

SEQ ID NO: 11571 - protein, 233 aa, Xenorhabdus bovienii
  Coding DNA sequence: Name=SeqID_5463
  Homolog annotation: Query=1..179bp; Hit=367..543bp; Blast score=74; Percent Identity=26.0; E value=1e-12; Homolog= ref|NP_669908.1|
LDQTISGYAGEEKPLNISVSAKYGLERIDWKLAELTANGGKIENDGGYYRILLPDYQYSHTDPTSVAATGDHKVKNTYSVSAVAIDKKGNRSNPVHMQVIVSSAAINTVNSLFSPEKSELAAEGKSTQKLTLTIKDKMNQPVDVNVEEFRVKMNERAKRAEIKVLATELMKIDPDLTGLDEQLYQGHTKNIKWISLVLPLSTHLWLEERVKGSNRTKAEELKLLCFWMQQKES

SEQ ID NO: 11572 - protein, 129 aa, Xenorhabdus bovienii
  Coding DNA sequence: Name=SeqID_5464
  Gene classification: Function=Predicted transposase; Function class=L DNA replication, recombination and repair
  Homolog annotation: Query=2..125bp; Hit=139..248bp; Blast score=71; Percent Identity=38.0; E value=2e-13; Homolog= mll8100 COG3293
MLTAGQAHESQSAIPLFDGIGIQRKNGFMKRRGKAVLADKGYSGGKLRGYLRKLRIKSVIPYKINEKGSADGRTQFDEQAYRDRNVVERCFGFLKGNRRIATRYEKTARNYLSRVKLGCIRLFYRRLSN

SEQ ID NO: 11573 - protein, 151 aa, Xenorhabdus bovienii
  Coding DNA sequence: Name=SeqID_5465
  Gene classification: Function=Predicted transposase; Function class=L DNA replication, recombination and repair
  Homolog annotation: Query=2..127bp; Hit=1..117bp; Blast score=101; Percent Identity=45.0; E value=2e-22; Homolog= mll8100 COG3293
MMARYDIPDDAWIVIEPCLPPIHSERAGRPHVEHRRVMNGMFWVLCSGAPWRDLPERYGSWKTVYNRFNRGSKSGIINKIFNRLLSILDEKGLIDWAEICLDGSNIRASKDAAGAKKNIPISLTIMRWVAHAVVMAPKSTWQPTERVFPST

SEQ ID NO: 11574 - protein, 77 aa, Xenorhabdus bovienii; identical to SEQ ID NO: 9681
  Coding DNA sequence: Name=SeqID_5466

SEQ ID NO: 11575 - protein, 389 aa, Xenorhabdus bovienii
  Coding DNA sequence: Name=SeqID_5467
  Homolog annotation: Query=8..380bp; Hit=12..375bp; Blast score=314; Percent Identity=48.0; E value=2e-84; Homolog= ref|NP_821845.1|
MPSPAKIWEQALQALHTRLVPLFHSTGSRQRSLAYLRGLLSDVERKNSWQLAEWMGESTPDGIQYLLERADWDVDMSRDILRDYVTEHLGDEQGVLIIDETGFIKKGTHSAGVQRQYSGTAGRVENSQIGVFLCYAGNGGHAFVDRALYLPRQWTDARSRCEAAGIPAGVTFATKPQLARQRLERTWDAGVPCRWVTADEVYGRDRRLRVWLESRYQPFVLAIPCNTPLWWQGPEYIRADRIADTLTAADWKTRSAGTGTKGEREYDWAVVPLWRLQLSEEDRHYGHYLLVRRSRDSRQERAYYVVYALREQADLNTLVQVAGCRWEIESGFEETKGECGLDHYEVRRWQSWHRHITLSLLAHAVLAVLRVQEKKNTGRPGSAQCSGTP

SEQ ID NO: 11576 - protein, 77 aa, Xenorhabdus bovienii
  Coding DNA sequence: Name=SeqID_5468
MDYGCSTSSCLWLFHSLSNSGGILSRVVRYFSWLLTTNSVIPCSKASLTICTAVFIYHLLIVLVSFLVLSGNVFIFL

SEQ ID NO: 11577 - protein, 60 aa, Xenorhabdus bovienii
  Coding DNA sequence: Name=SeqID_5469
MAINIILKSLTFILTYYCYSSSYTFFYLCIKKQLNKNIFINTLRYNLLPFYFMKHHLMSW

SEQ ID NO: 11578 - protein, 38 aa, Xenorhabdus bovienii
  Coding DNA sequence: Name=SeqID_5470
MVIKKELHVSCNNTKLLVIKMMLFVIRLEGLGLRYLAE

SEQ ID NO: 11579 - protein, 283 aa, Xenorhabdus bovienii
  Coding DNA sequence: Name=SeqID_5471
  Gene classification: Gene name=FadB; Function=3-Hydroxyacyl-CoA dehydrogenase; Function class=I Lipid metabolism
  Homolog annotation: Query=4..283bp; Hit=1..278bp; Blast score=212; Percent Identity=42.0; E value=4e-55; Homolog= DR1068 COG1250
MSKLKIAVVGGGNIGSSLAFDCALQGHDVVVIEKDALSCEQSRERIMETAGYAPLFSPLAKGKTPEEMLLNIVWSQDLQAVSDCAFIVENITENIELKQALYARMSEFVAPHAVLAANTSCIPITKLGSFHKTSSQVIGVHFMNPVYLKHTVEVIVGLNTSEQTKERCLEILRVLGKNAVVVKDGPGFVSNRISHLFMNEAAFTIQDGIAQPADVDTIFKQCFGHKMGPLETADLIGIDTVVNSLDVLYQMFQDSKYRVCPLMRTMVDAGYLGRKSGRGFYTY

SEQ ID NO: 11580 - protein, 242 aa, Xenorhabdus bovienii
  Coding DNA sequence: Name=SeqID_5472
MPLFSQTITDFWQAPFLNGDVLYSDAVFTVTVNPDLNEDRRVMVLETSDGRVMAVLTPALADKAGLYQQQDLSEPVFRQKLNEAGVTLHGADYIFYFSEADKNALLQENLAGVLRQLTEQDKAVFSEFESSASEQDLDDAYVELDHWAVFGSFEQHRLVSAASMYPWENAQIADLGVLTLAPFRGKGHASKVVRSISKYACHQGYEPQYRCQLDNYASTSLAKAAGLTLFGKWEVISPDSTE

SEQ ID NO: 11581 - protein, 62 aa, Xenorhabdus bovienii
  Coding DNA sequence: Name=SeqID_5473
MEPAKNQLLFVKIKAYFLLALVGISERTMALSQITLGKTSGSLSYPLPCSLFNLWYHFITCK

SEQ ID NO: 11582 - protein, 394 aa, Xenorhabdus bovienii
  Coding DNA sequence: Name=SeqID_5474
VSLRRKRSLRRATRMWIQSLIFRGGRKMSLFSNTWNAFGDVAMWAFEEMSIYRCRQGTQREVGNNDNDALARLEAAEYRKVEKVSDISIAEFSERYLMKKEPVIIADGLRGWRAKQIWNFDYFCQEFGDMSVQLQDAGFKPKDHVELRTYLREIMSLPAVELGEMGNNLSYLRYTYDSFFKHLLFTWGFGHRVKTNSFSFLAFQRIQEHWRRPYFLPDGGYKIPWVQVGSLHPNKRMCQDWGLYFSAPGACTRLHVDGMRTNAVLCQVAGRKAGWIFSASLEDVVRDTAEGRAALSSVASPAANGKSEANSPHSKDRIWQFDLLPGEIMLIPKGLAHEVHTLSPSISLTYNFVTNSEYRDYFNFKRERGHGWIANAPIAAVPEFALIHQRNQRL

SEQ ID NO: 11583 - protein, 1669 aa, Xenorhabdus bovienii
  Coding DNA sequence: Name=SeqID_5475
  Gene classification: Function=Polyketide synthase modules and related proteins; Function class=Q Secondary metabolites biosynthesis, transport and catabolism
  Homolog annotation: Query=11..502bp; Hit=8..497bp; Blast score=374; Percent Identity=43.0; E value=1e-103; Homolog= Rv2935_1 COG3321
MRTEIREDLDIAVIGLSGRFPGAGNCSEFWRNLLMGVDGISCFTAEELLKAGHDAGKIRNKDFVPVNGVLEGAQYFDAEFFGYSQAEAALLDPQTRLMMECVWHALENAGVDPDKRSRNIGLFLGARSSVQWTMQAMLSEQVENVGGFLASQLSNKDAMSTLISWKLGLEGPSFTLQTACSTSLVSVHQAVQSLLSGECDFAVAGGISLLLPQQNGHTYQDGMLFSKDGKTRAFDAEATGSVFGSGLGAVVLRRAGDAIADNDPIWAILKGSAINNDGARKVGYTAPSVKGQTEVIRSALQMAEIDAADLDFIECHGTATSLGDSIEFMALREVFNERGSSASAEETLNQCALGAVKTNIGHLDSAAGIAGFIKMVLALRHGMIPPTLHFQRPNPQLEFEHSPFYVNTRAEPWPSKQGKLRTGGVSSFGIGGTNAHMVLQQYVLPPQAMKTSGVDKVPEVCFFPFSAKNSASLVLQLESVSQWLVSQTDPNLSALSRTLGKRHSFPYRAVFAADSKFALMRQIERYLAPDEQMESLALVRQVLETTSPDNLSEHFAAITDWVSGKTKELEKCLFRSCDGQLLMDVPGYAFIREEHGTEHITDKIWSQIASVIAAPDGKNLSKNAAGLLLPFWKPLRLPAQPMSEVKPDAVLLVDQTLASLASGLADKSQIEVVSLDMLCPVQVRSALAKLSIGSQLTGLQKNPSLVLSLAFPTEGFSFAPASLQILSELGRSLAETDFSAFTSVHIYLIAPACSMTGDSGSLAESVLTAAALKALALVMPQEIPGVNCAFLGIQNPSADWTPAALTRLLQTPLHGPLKLNDEGLFVEDFRCPDAEENDVLDASYFTGKTYVITGAGGRMAKAMAGVIARRFQGRLALISRQPADSPAMKRLQEELKDAGAETVEIFPYALESEADALALFESIRHRLGEISVVLHAAGVTDGNSFSPLVQLNADHYCAQLAPKAKVAAVLANVFESIPVEYCFVMSSMSAFFGGIAHAPYAAANLFLDGWGQMQNRRLTGTRWVAVNWETVHFDEDRRADALVWGANEVALSGAEFPALFERSLREYDHENQKIFSAGQFMDRLYAWGGRRAANGDHRPQAEGNVKLKSRPKTLTSVYQSPANEMQKEIAAIWSSILGIDGIGIDDRFMELGGDSLKTIVMAEKVYKKLGKRVSIQDFFAQPTLREIERQLLNDQNALHPILPAIDPSEPIVASADQELLYIHQTTFTDASYNMPMAFQCPAAISAIAIATAIEQVADRHPVLKCLFKRQGANLMMLPQLDAKVSLAIFEAEPAQEGNLARLEQFAKAPFDLHTELPMRAMMIKGTDAGQFHQVLIVVHHIVCDAVSLGILAHDFQNRLKERPLPAPEYSFAAYRRYRLEFESEDQIRKNKAYWLANLLPLPAPLALPVVDDYDGHIDADSHRGVTRVKSFSAQTSEEIRCFCSDLGLPVFTFFLGAFGVLMTKIARAESFLLGVPVTGRTQPEELALVGYLVNMLALKIEPDADFAMTDYLLELNAQWSESVPYQTYPMSALLDDLSTEHDFQSRQGKHPLFDVVFGYLPLSLNGADEAAWRPGFSRLELTSDTAKFDLVMEISETQETFDCTIQFRARMFNEATIMALFEYFFALIEEVLTDPDVEIQELLKNLSGEPTPETFAQTSDQNVDSEFNF

SEQ ID NO: 11584 - protein, 2178 aa, Xenorhabdus bovienii
  Coding DNA sequence: Name=SeqID_5476
  Gene classification: Gene name=EntF; Function=Non-ribosomal peptide synthetase modules and related proteins; Function class=Q Secondary metabolites biosynthesis, transport and catabolism
  Homolog annotation: Query=437..1084bp; Hit=600..1233bp; Blast score =250; Percent Identity=31.0; E value=1e-65; Homolog= BS_dhbF COG1020
MKIKQEVAEMHTNDPIVMNARKQAFKDYVRQQLDTDYQGCPFFVTRLATSGTDTEVVTTSFTFAEPLNSRIFTMAASPLHRLSLFSACIKYLAFLHCREPEGSLNWAIGAQDIAGNGTPAVLSDDRSAGVYLVPAKWHLTETELTQPVKRLFGEELAQWKQVAALTSGIPLQSASSVMSQSPQILAGYSETQPPFEGTETACYSLSLWLQASPEKTCLHMRFDSQRVDAELTSLLIDRLTLLLNSMVFEPNSPLASMPWMPDQERERVAALSAPVPAQPLRYKNVAQAMTASMRGRAETRFLEASDQTVNFKLLERYTDNLLTDPDLPQWESLGDCVLIVGAKGVETTLAAMACIRIGKPFCLQSYSAPERQLVDIIELHSTKVVLLQESCGEMAEFFRTQGCQVVMLPYYVPDAPAKSTHRTEMSALAALLRKGEAVNPDDPLCVVMTSGSEGKPKGCINTHQALLNLSAEKQTLYRTAGSRVASVANHTFDYFVLECVQCLTQDIVLVMPPEEVRTDAEKCVRFLRESRIDLLFTTTVLAEYIMELGDIPNLRQLYFGGESLRTFQKNNYELFNVYGPSETGVITTYLSLVRNNQKITIGKPLGGCQCVVVFPDSLEPCPIGVAGELLIGGTGVGVGYINRPDLTAKVFVDLDTEWLKGKYYRSGDLCYWNVQGEIEIEGRRDRQLKVNGFRVELDAIEKNILDLPTVAQAAVIGIEDQRGHAHLGVFIVTTDSGVTEQNIREALLSRMPAYMVPSQVILVVELSLTRNGKLDRQGLKQAFSKAMSGKIVRPDGATQEWLAACWARYLELEVDALSVDKSFFSLGGHSLRAARVLAEIQHEFGQVVSLLEFFQNDTIESLAKTIDARRTGGDSMAVEDFSSLLEAAPQLAVGGRGPLSAQEIRLYAQYRLHPESLAYILALEIPLSHDLSTDVVKQTLQVLIDRHDILRTRYRIDSEGIPYAEILPSLSVDRVLIDDRSQWLQRRTQAFELGEAPLLRGCLQEMNTEHAGLQLQIHHILVDKPSLEILQREFQQLLAHESLAPVALSYRHYALALADARQHPVWTQAETFWANHLEGLEFDPFGHGAVNAGGKVKTLSWHLSAADMAAVKRLCGAVNVTPAMLFLSVWGLTVAHEGSSDAFSISVANAFRPKNALETVGMFVSLSPCAFRFDQPAETFDRFIKKLADEQWRAVDQLFFPVEEAFALLSRDPRMFGRNPLLNVAYSYLDAGENEALDAEDLLLEAHGPLNLTVSHRTQGIQNTQSCRLTLEYQIAAFTDSQIEAIVTGYQEILRQILRHVPSTLQIDDLIVSADIVKKAFRPVQRRASYRQIDAMLINGFLTLTDRPAVMDEKGVVTWGEFAALTAAYTQVLNQGTIRRALILGRQGRQLQAFLAACFLTHTTYLALETGTPEERINEVIRHAEPDLVIKCGSEIGAQLQDDSLIEPVSINWRGFHSMKSADDNPIGWVLYSSGTTGKPKGICVAAHTAAQYVDSLVNKLGLKQQLQATQQGLRIVQQFSPSFDGYLEEVLLSWALQGTSVVVDRYSLLDERKARAFLLHYRPDVISAAPALFSAWNRMPALAPLPKICISGGDFLTAGDISQLLERTQIWNSYGPTETCIAVSMVNCAQLASGTALSIGEPFDHAAFAVINQDGGRLRVGQWGELVIYGDFERHGYLNDPALTARKFGRDAQGTFFRTGDLAMADKNGLFYLKGRMDDSCKVRGNFIGLGELENRAGQYPDVIAAGAAVAFAGTPEACLVLAIEGKENMQSDLQQYLARHYPRSHLPSAIFPLASLPRTETGKLDRQRIVALFLEWRENTHQTQEEQAATMSEGVQKLIACWRKCLGYKGALTQDSDFFLVSGSSLSAVRLANQLETLFGVTFSPVDVFRNATLGEQWSLINARQGADDTMPVKLLQERFLNVDEPGTAKLILLPPALGGLIELQTLADKLAGRVTVSVLTTEPRAVENLSVQEFKQALLNALTLHIKAQDIHPSRSLWLGGYSLGAEMLVALLAQQSESSPHFSQYIDKLVFLDPNLRTNVFEGDELYAEFVAFFRDVNRLAFDCAGIDADMDVETLRRQFPSLHQEWRYYQLQHQILENKTFHERILALPSENLPVTMFFSDDADEAGIDGLTQKMKGCCTVRRKSGDHVEFVKQLTSDDFIDLEQGKTLCVQK

SEQ ID NO: 11585 - protein, 2179 aa, Xenorhabdus bovienii
  Coding DNA sequence: Name=SeqID_5477
  Gene classification: Gene name=EntF; Function=Non-ribosomal peptide synthetase modules and related proteins; Function class=Q Secondary metabolites biosynthesis, transport and catabolism
  Homolog annotation: Query=661..1954bp; Hit=33..1282bp; Blast score =545; Percent Identity=33.0; E value=1e-154; Homolog= PA2402_1 COG1020
MLNQLLSENHSDHSNQSRAPEDTILNCCIHELFERQVEKTPDAVAVRFGEQSLSYAELNRRANRLARFLRDDLHVGPDTLVGVCVERSMEMVVALLAVLKAGGAYVPLDPHYPAERLDYMLHDSAPRALLSHGAVPAVVRALLDQYAMSTNVSVIDLEADVSQWSGQNSDDLHPADNGLTSSHLAYVIYTSGSTGRPKGVMNQHVGVVNRLVWMQKVYRLNANDVVLQKTPFSFDVSVWEFFWPLMYGARLVVAKPEGHKDPAYLSALIQAHRITTLHFVPSMLSAFLDQVPPEVGDCLQRVFCSGEALPARSVHRFRERFAKVELHNLYGPTEAAIDVTAWNCCLDETDGLIPENVIPIGKPIDNIQLYILDAYGQPCPVGVAGELHIAGVGVARGYLNQPELTAEKFIKNPFSPALNGVMYRTGDLARYLPGGDIEYLGRNDFQVKLRGFRIELGEIEARLMKHPAVRDAVVLAQGESAEDKRLVGFVIAAERALQRQSRESVKESIQRLINDAVPDYMRLAAIVIVSGFPLSASGKIDRKSFPVVTFDEFTAQDVEPPKNALEQTLVEVWSELLGVKNIGRNSHFFNLGGHSLLTLKMVLALRRRGLFVDGYTLYQYPVLSELATQLQVSDPQETRSDMAERSMVEASAWAQLSQKEIDALITAIPGGLANIQDIYPLGALQQGMIYHYLTNLAGDPYVLWQVVRFRNADLLHAYVDALRGTIARHDAFRVSVHHEGLSQPVQVVWRDAELTVEELKPTMDCDDPLVILKQHCDPAMLRFDITKAPLQRCLYCYDPKRDEWVLLHLIHHMTVDHTTVEKMQQEIEAQLHSEPSAPIAPISFRQVNAGLFCATGAEEQKAFFDAMLRDYEPTPAPFGAGEYLGGNAVVVEAWRPLQERLCSQIRQQAKAHGVSAAAVFHLAWAKVIACLTGCNDVVFGTVLLGRMFAGENAENIMGPFINTLPIRVRLDNLAVFECLWNAQDTLTQLVRHEQASLALAQKSVQTSGTAPLFTSLLNYRHSEMRNIPSADPFQAMNPSSVNGVSYSGSMERTHYPVSVNIDDFTNDFVINAQVEQGLDPELLCDYLQTALQEIVTALESAPERRMGRIHVLPVQEKDKLLWQWNQTESDFPRQACLHTLIEEQARRTPDAIAVVFEDQVLSYAQLNQKANQLARFLRDDLHVGPDTLVGVCVERSMEMVVALLAVLKAGGAYIPLDPHYPAERLDYMLHDAAPRALLSHGAVPAVVRALLDQYAMSTNVSVIDLEADVSQWSGQNSDDLHPADNGLTSSHLAYVIYTSGSTGRPKGVMNQHVGVVNRLVWMQKVYRLNANDTVLQKTPFSFDVSVWEFFWPLMYGARLVVAKPEGHKDPAYLSALIQAHRITTLHFVPSMLSAFLDQAPSEVGDCLQRVFCSGEALPARSVHRFRERFAKVELHNLYGPTEAAIDVTAWNCCLDETDGLIPENVIPIGKPIDNIQLYILDAYGQPCPVGVAGELHIAGVGVARGYLNQPELTAEKFIRDPFSPALNGVMYRTGDLARYLPGGDIEYLGRNDFQVKLRGFRIELGEVEAALLSHDSVKECVVLVREDVPGDARLVAYVTPASGYADQVQEERNQTLRAHLQTNLPPFMMPSNLLWLDAFPLTTNGKLDRKALPSPADAPMGQTITAQPPQEGTETRLAQLWAELLNLNTNAIGRQSHFFEAGGHSLLAVALMARIQQAFSVSLLLSAIVEHLDLASQAELIETEIEKGNAARENGDRAPLTEQNEPTPVEQIRALPTQKAIYKAVKLNPQDLSNNSFLALSFDDDAQPDLKQLRNLLQSVFSRHESLRAQFILTGDELSLRPAKRFLFRLEKRQTLGSLEEDLRDFIRPFSLEDGMNVRGRWVVDGRHPLLLLDFSHACIDGSGLMQILSELAAENDPAPSGTRLATYSELFYSREFAALRQEHADFWRTQLQEWSPLVHAQDTESVTHTCLITLDDGLKGQIETLTSRLKISVPEFFMAAFLLFKARLDYQPAQFNPHDQLTSMIFHGRDRLDQQTVIAPLMSVLPVRVRLRGETMEPEMLHEVSTAVRAACRHYLFDVEELTVRYPALAKQALSPTSFFGYFQKEGFDGRIAGRLCRQLETPNVAGGQSHWNLTCEIAEHTTGFDVHLEALSFRTRSDVGNWEALFKSILQSALSVE

SEQ ID NO: 11586 - protein, 1107 aa, Xenorhabdus bovienii
  Coding DNA sequence: Name=SeqID_5478
  Gene classification: Gene name=MdlB; Function=ABC-type multidrug/protein/lipid transport system, ATPase component; Function class=Q Secondary metabolites biosynthesis, transport and catabolism
  Homolog annotation: Query=588..1104bp; Hit=18..533bp; Blast score =201; Percent Identity=29.0; E value=5e-51; Homolog= yojI COG1132
LQKNRRCRNKGWEINGARCRLVANYAALCPVRICPVRGVKTMSNSGLIRIGIFLVAIYLALVGSVFADTIDQKQVISQKQDPDLEQIVGELSRRWDVAQVPTGGLSVIVGDKVRTWRLGKEEAGTFELASTSKAFTGLLIALLEQEGVLNRQDAITQWIPELAERPEMGYSAVLLKNLLFHTSGISGDTIDLLRPYDASDALVKLPVLLKEIPLVYPVGAKEEYATLNYSLLGLAAERATGKSFATLMREKIFLPLGMKNTTVEGDLPAEGSTAVSARIPGYKISFTHARPYDAPRYLQNTPAGYVLSTPQDMAIWLKFLLHQQPLASDKGNGDEKRSALYAALEQAKRPYGGNGDVGYAYGWDVKTDVTTSWSHPGQNPNATAYVAFDPKAGVGVSLLGNSNSPQVIQLGQAIFEHLRGASPAGLPENFPTDDQDWLSTVVAVIFWLGGALLLVAVMYKRGNKDKGDRDESVPDGASVLESRVETAIIQESFVRTAESTAGKPVWRSFLSRLLVQNVVLVSVLAITPLLLSGLSWANLLVWGPLSLPVAVVGLLFFVNAISLFFFLVTQRSDRYTSKTFSSLMIAKIVGLTVISGLLNSALVLFIIQAIDSPSTYLLYSAVLLFSCIYFYISTRKAAEQQIMRFGHSFVQGWRMEIIRKLLASDYKNIEQLSSGKIQSVVGENSQELAKSVLAFVPFFANLLTIIFLFTYLMVFKSPVATSVLLACALPMIVLYYCISERATRIMPQALSIRSEFMDTVEDLQKGYKGLRREAVKHSFYRHAQAVSDRFKALRIQYDLGFLNAFFIGESLLTILLVAVALMFPLLIPHFDGNVSKEYLIILLYLIGPLNAVMSAMPELIRLKSLMNSMVMFSQSIQTDSPAGTMPGIQDVKTLELSAVHFHYPATGGECFGVGPISLKAESGKSYFLTGGNGSGKSTLAMILAGLYVPAQGTIRINGEEASQYQLLEHTRAIFSDNWLFKRVYDPALLPLREAVNQNIALLGLTQKATLLSDGAFDNIKLSTGQRKRLSLAMLLADPSPLVVLDEWAADQDPRSKARFYKEWLPMLKAQNRIVFVVTHDDEYFSEADVLITMKNGQLIELKEESYA

SEQ ID NO: 11587 - protein, 2165 aa, Xenorhabdus bovienii
  Coding DNA sequence: Name=SeqID_5479
  Gene classification: Function=Polyketide synthase modules and related proteins; Function class=Q Secondary metabolites biosynthesis, transport and catabolism
  Homolog annotation: Query=5..815bp; Hit=6..811bp; Blast score=439; Percent Identity=35.0; E value=1e-122; Homolog= mlr9053_1 COG3321
MKREYTGSEVAIIGISCRFPQSSDWRNFWNNLLAGRELVSFFSREELLAVGVPSEIIDLPNYVPAKASLEDAECFDYEFFGYSQREARKMDPQLRVLHEVSFNAFLDAGLPVGEAILKAGVFIGSTLNLARLEQFAGASQDISEMFDVGNYNDPASFAAQIAYRMKLNGPAVHVQSACSTSLSAVHLACKALLAGECEMALAGGACITDPVAGGYLHQDGMILSPDGHCKTFSDDGKGTVNGNGVAVVLLKLLEDALADGDPIHAVIIESGMNNDGDRKVSFEAPSVQGQAEVISQVYRLADIPFSSLGMIEAHGTATVLGDPIEIQALNNVARELLSPDELQQFSCAVGSVKSNMGHLDAAAGIAGLIKAALSVRFGKIPPSLHFNKPNPHLDLDKTPFWVPTQATDWPAKQAIRRAGVSSFGIGGTNVHVLLEQPPETVGKDASHRKSAQILPLSAKSPSALARLAASYSIHLSLINQGLAEEETSNLEVIARQLQENRTEYPCRAAFIANHRDDWQQQLDNWTLMEGAYAPMAELVWLFPGQGSQSPEMGLRLAAEYPEFGDIYLGLLDKAAALLSVQKAALIDQQTLIDSIRRPEQLSTLYLQPILYAVQAALGVWLQKLGCKPTALLGFSLGEFAAAAIAGVFSIEEGMELVVARAGLMDSMPKGAVFAASRKSKNSKENFDGDFPAMLGCISELSPGTWTLATEEGLVADAENWLTQHGFAFKRVAVSHAFHTPMIEPAAKAFGDLLKSYDLQPAQCAIYSTALGRKIEADEMCDPQYWINQMLSPVQLGAALKQVAQEHPESLFAQIGVGMDLLQHTRKWLHLNGERWVPTLGTGGADHEINSTLQFIAKVWIQGGGIDWSRIHPQTSIERTITKTHLPGHAFERRVCLPQASTKAAQTISSLFFGSHYYGLEWEKINSSTPENAAQSGDTPTTWIICPQVQERERRLAEALELNNRQLTFIESANWRGSDANLYAELEGWLLQQGLAVSAAMDIIVTGLLDDLDARQAEFWAFWLPTVLARWSTTQHFSPKIRLFFPSTEMAAWKGSETLNAEKNQLLGPLLILPEEYPNITALCVDLENSEVENVARGLQPWINQDWHGGQFYCFRQNDFWQRRVTSQVQKQALTHPLPDISRDSWVLVTGANGGMGAAIAEHLAQVYHCNLLLLVRKSLPKKRGWPMEIESNGSHAKFLRWVLNLEAKGSRVELLQADLGDDESLAQAFAPVFQLAARGEGIDYVFHTAGRGEGAMLQMRSEAESIATLAPKVAGTRFLSDNLSRLGNPALLLFSSLGNLLPKEKIGQIAYVAANACLEAYADQIRHKGGKALAIAWDDWAESGMATRSAQQLDRALKNPAQDTAPDAPIWLRRLCAKDDWWLDEHRIDAATAVMPAMGMVVLVHRALIEWQAVAAEAFSLQEIAIERPLVVANDAELDVAVIFADDLNAFELFSGNGKFSPETWLKHASGKIKYRDGHTALSGETVSLKTLPSQPPLLNLFSAKDNIGVSPKGALTFGPRWQNVIAVDQTGINEVLNLLQLPITYRGEAEASGLHVALLDTATLIASPEHEDGQFAPISIGAFTQFAPMCDRVKSHVQIQDLGANKLLQVNIYSEEDNLLVAISDLLLVDASAALQHTVMRLNARDAGSVDFSFSSQSETRKEPGPLDVEIQVKAAGLNFKDVLIALGVLPAPADPTMTFGQEAAGIVTRVGRQVNGIRVGDRVMCAGHSCLAEHVIMPQRVVAPIPRTLGFQQAAGVPVAFTTAWIALKHAANLKKGERILIHSAAGGVGMAAMQIALYLGAEVWVTVGSEEKRRLLREMGAQGAANSRTREFGDIFRRELGDRPFDVILNALAGELLEESLSLLAPQGRFLELGLRDILQNWQLGLSIFAEGGSFHAVQAGAEHPAYQEAWAEVAALLEDEVLKPLPTKVYPAKEITEAFQFMAQGRHIGKIVIAMEERGKALSFVEKLKAEGLSNLEGTQIAVAMAALVGQTKLPYVAVSKLPIGSVLEKQRHTQQMLFSSGSTRNAPAVVDGDADGSLKGANADDLLQAMRTILEGFLGVDGLDVGASFFSLGATSLDLIQFAKRLEQRLERDIPVALLFKAASLRELSKELAPEQSVAEEPQMPQQGLGDKRRTLQARRKLRGVVSGEDMPGQGSEDNE

SEQ ID NO: 11588 - protein, 1109 aa, Xenorhabdus bovienii
  Coding DNA sequence: Name=SeqID_5480
  Gene classification: Gene name=EntF; Function=Non-ribosomal peptide synthetase modules and related proteins; Function class=Q Secondary metabolites biosynthesis, transport and catabolism
  Homolog annotation: Query=13..1067bp; Hit=6..1045bp; Blast score=288; Percent Identity=25.0; E value=2e-77; Homolog= BS_srfAB_1 COG1020
MMQPYYSDKPNYIEELLQVTPQANGLLFHALKDGNSAYHIGVAFSLKADVSEEVILDIWYQIQQSQPALRAVFTWEGIRVPHQAIYALPRIPLEYIHVDSTTPQPSLDWLAQSKATPFELDTEVFRIICFHDINAGILRVAFSFHHILMDGWSSSLLISLWLQGLRQQKIVPLAARLYSQQLWKGLSQEELRLSREYWQRVFQYLPDGETSATTKLLAEPLFRSAEHTAIKHKAGEKITDEKITANCIWDKERKAAIELICRRAGVTPASFVYLCWALVLAKLTFQKTVTFGCTFSGRGAALTQNVDRQPLGLFTNTVPLILTLDGKWRLEVALRTVFQALQQTHQHEKTPPLLIREETKIRDELYDSIVVFDNYPIDAELQDAGCGAFLTDLHSEETTHFGLTLTVSGVDQWKVELSAGETFEGDPDAVNRVFYAFESLVADLVKGSADVRVEDLVLKLNPDGAEEAALVMGEHNAQTPDINALLLRIYQRLNQSPQAISLIEDRHQISNRELLRGVSVLQERLRGSGFVPGDRVAVHLEKGLLSTQAILAILFSGGSYFYVNPKDPPQRKKNLLALANCGIVLCDASLNGELDTDIGRYLLLNIETETTWLESTGEPTLWRNRQPEDEFYFIFTSGTTGAPKGISIRNESVANLLDWFVRETHLTPADRVLGLTDLNFDPSVEDLFGSLVAGATLIYPSPNVLLERQAFIDLLRDESITLINFIPGAIAQLIQGAPFFPAMRLWIFGGEELPQWLRDDLLQQGYAVSNHYGPSETTVDCLTARQSLAAEVSIGWPIQNVIACCADVFGKPLPADIRGELWIGGQAVAHGYATNPVESDKYFVKYSEQAFYRTGDAVTFSHGSGFKYLGRIDDQVKVNGVRIEPRELERAVEALEEVKACCLLSATGREGKRQWCLFVDGREQPAILEPRVREHIRQHFPASWLPALIVVVDGFKRTITGKIDRQRLLECETQRRQTQTATDHVPLTDSVEAKIQAIWSAVLENPVADANVNFFDAGGDSIKIIALQSQMQQAFNQKIGVAVLFEHPTITAFANWIKQSNVSPENTEAEVMLSDSGKQLSQENTLSSARSGKNRLADRRRKVKGSSVS

SEQ ID NO: 11589 - protein, 412 aa, Xenorhabdus bovienii
  Coding DNA sequence: Name=SeqID_5481
  Gene classification: Gene name=FabD; Function=(acyl-carrier-protein) S-malonyltransferase; Function class=I Lipid metabolism
  Homolog annotation: Query=8..311bp; Hit=2..303bp; Blast score=111; Percent Identity=29.0; E value=2e-24; Homolog= BS_fabD COG0331
MRTAIDSAKTVFLFPGVGAQQPDMFAEFRAYPEYRACLEEVSDLSQVDLYGAIHGERRDTLKQVRIAQLALTATTVAIAGILRKYCGLVPEFMMGHSLGQYPALCSAGYLDLATLTKVVNLRSEVVETCSRHYEQGDMCWVLHLPADVVVQEVDKARKDDGIELYVSAIDAFDQVTVSGVMADIRRFAPRMEALGGLLYPLKIGGPFHSPLMMEAKEKLAEWLDFLPGTDKQGTLISRLVCNVSGAELPAEDLKPSILQHLTSPVQWLRSLQYAAQNGVTRYLEISPKTVLSYLNQRAGLPMLPLCEPAEIFTFTEALSTAESRLERFFSYCHFHLYSSRLPDINDATAIVQLRQIRDAVTQKIKGSHLTREECGFLHQHTQQWLKIIEEKGDTSLLVEKMKLQSLFNAVGR

SEQ ID NO: 11590 - protein, 1550 aa, Xenorhabdus bovienii
  Coding DNA sequence: Name=SeqID_5482
  Gene classification: Gene name=EntF; Function=Non-ribosomal peptide synthetase modules and related proteins; Function class=Q Secondary metabolites biosynthesis, transport and catabolism
  Homolog annotation: Query=1..1055bp; Hit=1..1009bp; Blast score=197; Percent Identity=24.0; E value=8e-50; Homolog= BS_ppsA_1 COG1020
MSKPTFELSRSQQAVFKMEAFHLSGYSFYLGGVARLSGNVSLDQLVWAAETVRNKQDVCHIGFVNDPLETVHPEVVDWEILWRGIRHNTPQADVERVDFSRHPDPRQAFESWVERQLLVEEDLSLTPIRIFAVRFRQEQSGWFVKAHHAAVDGAALAILLERLADALAQESGKVNSPLYSIHAERERDYENSRRMVRDAAYWRTVFGEQNAYGDTASARATKISCRYPIGDYRGLKPHAMRVRIALSEAQNDMLHKFSNRGGSVFRLFFAAVAYTQMVIEDGNGALLQAPMLNRWSEAEKQSIAMSVAPVLIPVFREVGETVADCYRTLKKSLQKAIVHSRYAPGARWGDFASQEWRQIVPAFGVSYQTGVFQKTVSGAEVEIDHIQVVEALFATVHIHDRFEGGDFKIEADFRKIWSFDQCHAFLQTVIDYALEAAAEVMGQQETTRQTKEINVRTDCLAEPIGIHLCDAFQRYADNWLFKQEAGDLTYRQGWQWIRKFGTQLRDRRDRRFEHRPVVILGRRSPEMTLAYLTCLIENVTVVPVCPTTPLARLSTIVRNSGASLCIYTGVDQNLAAALNLPLLRASLDKDLCDAGLHPEIQSEFIHPEQARSQQTDSNPAYILYTSGSTGEPKGVVISPVALANYALAAKGEYASEASFNAPLFTSFGFDLTQTAILIPVLSGGFIQAHEQDIRDNPELLQTLLSDEALTGVKCTPSHLSLLIEHSAQRRNPLTFIVGGENLSVALVNRALGFFPSGSRVINEYGPTEATVGCCIYLMNESLMSESDENDKTSAVIAPIGKALGQAEMSIRDAWGQNMPRGFKGEIGIGGSVLADGYINNRAQTEAKFVCGADGRHRWYRTGDLGLQDEQGIFYCLGRIDDEFKVRGHRIHPAEIEKAVAEVLADLGRDGDDRRELKALKLAIDGYETVALCSSQSVPYDNSAFQKNLKNKIPDGWLPSLYCTVQPWPMNANGKVDMAALTAAAKATLAAADPAQFRATDRQGQTEPEAYSLPAWLDAEFLRPIWPETVDLSASFLAQGGDSIKAIRLVALLARQGIRIGVSELLTSTALGTVLERVCAEKPEVAVTDPAVSEEPEANWVNYLPSVRWFREHHFKYGERLQQGVVLELPPSICAGRINSAVAAVKARHKIFMLRSNRSLSEFYFSSLEPEQHNGDMLLQDHVLAPDESLEDRLHRLQGEVCLENQPSVHEVVLAPVANKKYLIWVCHHLICDVHSWIFLLDELDQVLNESAAQLNVDKANVDKASAAVEQGAFLWGKWLRDHVSHAESAPHDDAFYQPAAVPVTLALSVSSEGFRLMEQRYKAERTQLIAAALLEIVQDNGMLPEQLAVLFENHGRLFSEAETPAVWHAAMADSVGWFTGFNQQNLHVPLDHQSGFLPGFFLRTLKSRQYANSSDWKEQLGLNGVRTRPVICINDIGFGLSERGTWRHFNLVDSLSGGFRYPDEKSVADFDVLIHDDRESSSVFVELRLGIPGAGADDAKRYLMQLNERLSVWNDALHRAQVEPMLIPADFPLCQLSQSELDLIINGASA

SEQ ID NO: 11591 - protein, 556 aa, Xenorhabdus bovienii
  Coding DNA sequence: Name=SeqID_5483
  Gene classification: Gene name=EntF; Function=Non-ribosomal peptide synthetase modules and related proteins; Function class=Q Secondary metabolites biosynthesis, transport and catabolism
  Homolog annotation: Query=26..535bp; Hit=466..945bp; Blast score=272; Percent Identity=36.0; E value=7e-73; Homolog= PA2402_3 COG1020
MRFEQIQHSEDVGIMATGRFITDYFESTARNNQNPAIRWGKGNVLSWAELYERAQRLAHYLVNERGVCQGDCVAIGLERSPEFLVAAYAVLLAGGVYFPVEAKTPAARLTSMFATAQCRIAFCNVAQESLFTQAKPGLELIGREFLTEIFTSHCLDDHRLSFHHSESAGKKARQRRATDPAYLIFTSGTTGTPKGVLVNHGAFINRLQWHQAHSEMTDADIILQRTALTFDVSLWELFLPALNGASNYLLQPGLEAFPRGIVAALISENITVVHFVPSLLKPVLQELQELQDDSAETPSLSALRRVYVSGESLPASLVTQFQKIFASRCLLTNLYGPTEAAIDVSFYDCVETVSDAIPIGQPLTGCQLYILEPDSLTLKADSKEGEIAIGGICLAEGYYNRKDLTDKVFIFHPELQQRLYLTGDLGWHEKRRGFFCQGRKDTQVKLRGLRIELGEIEHHLLNYPSITEAVACVVEDEDQEQWLVAAIVAGKRGLNEQDIRQFLAVQVPAYMLPTRYWQARNLPRSGSGKLDRKTIAQNMRDLFFTDHHGVGNLIHE

SEQ ID NO: 11592 - protein, 387 aa, Xenorhabdus bovienii
  Coding DNA sequence: Name=SeqID_5484
  Gene classification: Gene name=CaiA; Function=Acyl-CoA dehydrogenases; Function class=I Lipid metabolism
  Homolog annotation: Query=6..374bp; Hit=3..372bp; Blast score=195; Percent Identity=34.0; E value=7e-50; Homolog= VNG1482G COG1960
MLNRFLSPLQNEWLQTFEQFSATEIAPYADEWDLAEAIPATVVQKLAHNGWLGGLAKPESGGLGFDVTTFGLLNMAIGAGSGSLTGLLNVHSMVLKTIEDWGSQDQKQRFLAPLVKGEIIGAFAQTEVSAGGDSKNLSTQFEEDGDYLSVNGQKAWITFAQIADLFLVFGKYQGLDTAVLVPKDTPGLKVTAKKNMLGFKSAYLAVLDFTDCRVPKTNIVGKPGFGQNLISNNALDYGRISVAWAALGIQQAALAASARRANSRATFDTLLADQGIIRGYLAEMSSSLLASQLICLSATKAKETRDEDALEQILQAKLFSSHEAGTAAAKAVQIHGGHGCDESNGISRLYRDAKILQVVEGSNELQKMLIGKAVCNRYSHNVAQTIP

SEQ ID NO: 11593 - protein, 83 aa, Xenorhabdus bovienii
  Coding DNA sequence: Name=SeqID_5485
MDVSARKKLVSEYLCKLAGKQDLDDSVNIFETGLVNSLAAIQLISFLEKNFKIKVEIDDLDNANFSSIQAVCHFLDRKVAVNA

SEQ ID NO: 11594 - protein, 35 aa, Xenorhabdus bovienii
  Coding DNA sequence: Name=SeqID_5486
MRLSLFRIIYCLNFLIYRRNLCYSLIQFYLYPHKK

SEQ ID NO: 11595 - protein, 53 aa, Xenorhabdus bovienii
  Coding DNA sequence: Name=SeqID_5487
MLIYCQAMVLLWHWHIYGIEMYFKVHKGLLLNFLCIMAELNVSLLRLILAHSK

SEQ ID NO: 11596 - protein, 412 aa, Xenorhabdus bovienii
  Coding DNA sequence: Name=SeqID_5488
  Gene classification: Function=Uncharacterized membrane protein; Function class=S Function unknown
  Homolog annotation: Query=121..411bp; Hit=2..299bp; Blast score=94; Percent Identity=26.0; E value=1e-19; Homolog= VC1151 COG2431
VRIICSDNSKLGFSSPDCFHQDGEPFTFAHLVKRSPNALGGDNYIANVASRNKKLEEVNSSDIISKFKLQNFLESFAVCDEKVSHYVSHLTLEEKTGESYRCMILIDFSFKKTEHRMKDSLSVIVIIVSLLIIGFFLGKGIKTNTRDYLVSLISKIVIILLLCMGIELGEVFNNTNAGVSIVKKSIILASLISLSTFFLFIKYREKNKSGYNKPNFKKPIISCAVAMLSFILGVLFYSYTKISLHSISLSSNYVLYLLIVLVGMDLVNFKLSGIKFDAIKIPFITILGTVIAAAIFSKIYNYSLIESMLVSSGFGWFSLSGPMINTLATPELGALAFMTDFFREIISITFLYFMGRSQPQGGIGISGAAALDSALPFIKENCKPDNIKYAIVSGFILTLLAPLLISLLASLL

SEQ ID NO: 11597 - protein, 75 aa, Xenorhabdus bovienii
  Coding DNA sequence: Name=SeqID_5489
MIYHNIPIKFLYSERRNRYHFELYLRNRMLQEEIVTPKSQKTQTTQTTQTTQTLRRELKSRHLTMICFSTISNGL

SEQ ID NO: 11598 - protein, 59 aa, Xenorhabdus bovienii
  Coding DNA sequence: Name=SeqID_5490
  Gene classification: Gene name=XerC; Function=Integrase; Function class=L DNA replication, recombination and repair
  Homolog annotation: Query=2..52bp; Hit=371..422bp; Blast score=79; Percent Identity=67.0; E value=6e-16; Homolog= ZintV COG0582
MLSAGANPSFIATQMGHVSSQMVHNVYGAWMNENSDDQIKLLNKKLTIAPCMSQVINEN

SEQ ID NO: 11599 - protein, 103 aa, Xenorhabdus bovienii
  Coding DNA sequence: Name=SeqID_5491
  Gene classification: Gene name=FliE; Function=Flagellar hook-basal body protein; Function class=N Cell motility and secretion
  Homolog annotation: Query=2..103bp; Hit=3..104bp; Blast score=82; Percent Identity=52.0; E value=9e-17; Homolog= fliE COG1677
MSIQAIEGVLQQMKAQALQATNIAKPMPVQGGFASHLTAAVEKINQTRLSATKLSQDFTLGVPGVELNDVMVNMQKSSISLQMGIQVRNKLVSAYHEIMSMQV

SEQ ID NO: 11600 - protein, 36 aa, Xenorhabdus bovienii
  Coding DNA sequence: Name=SeqID_5492
MMGLIVGRIFSLAYGESVLLRHAFSIHVDQQGKDRL

SEQ ID NO: 11601 - protein, 569 aa, Xenorhabdus bovienii
  Coding DNA sequence: Name=SeqID_5493
  Gene classification: Gene name=FliF; Function=Flagellar biosynthesis/type III secretory pathway lipoprotein; Function class =N Cell motility and secretion
  Homolog annotation: Query=19..568bp; Hit=14..550bp; Blast score=575; Percent Identity=59.0; E value=1e-164; Homolog= fliF COG1766
MSAATTDVENQNKGFSAIISKIKTDPKVPLLVAGSAAIAIVVALFLWMRSPDYRVLYSNLSDKDGGEIVTQLTQMNIPYRFAENSSALMIPTDKVHEARLKLAQQGLPKGGAVGYELLDKEKFGISQFSEQVNYNRAKEGELSRTIESLDPVESARVILSIPKPSLFVREQKSPTASVTVRLLQGRTLDEGQVNAIAHLVSSGVAGLPPSNVKIVDQSGRLLTQADANGLDLNTTQLKYIQEVEKRFQNRIETILTPVVGRGNVHAQVTAQLDFSRREQTAEEYKPNQPPNEAAILSKQSSSSEQSGGSLVGGVPGALSNQPSAAPSAPIEKPNPDTKGKGDEKSDQNRNSTYNNYERLVNNSRNNRHDELINYQVGKTISHTQLQVGAVERLSVAVVINYATAQGENGPETKALTPEQLSQIEALTREAMGFSTKRGDSLNVVNTPFNDTAEVIELLPFWQHPVLLEKTLELGRWLLLALVAWLLWRKMIVPQIAKKRAAEKAALNAQKNQQKQQAPESNAELDEKVRRKLARQRVNAEIQSQRIRELAEKDPRVVALVIRQWMSNEQ

SEQ ID NO: 11602 - protein, 330 aa, Xenorhabdus bovienii
  Coding DNA sequence: Name=SeqID_5494
  Gene classification: Gene name=FliG; Function=Flagellar motor switch protein; Function class=N Cell motility and secretion
  Homolog annotation: Query=2..330bp; Hit=3..331bp; Blast score=457; Percent Identity=79.0; E value=1e-129; Homolog= fliG COG1536
MSLTGTERSAVMLMTLGEDQAAEVFKHLNSREVQQLSIAMAGMRQVSNQQLAEVLAEFEEDAGQYAALSINANDYLRSVLVKALGEERASSLLEDILESRDTTTGIETLNFMEPQMAADMIRDEHPQIIATILVHLNRGQAADILALFDDRLRNDVMLRIATFGGVQPSALAELTEVLNNLLDGQNLKRSKMGGVRTAAEIINLMKNQQEESVIEAVRTYDGELAQRIIDEMFLFENLIGVDARSIQRLLQEITTDSLLVALKGCDQALRDHFLNNMSQRAAEIMRDDLATRGPVRMSQVEAEQKSILLVVRRLAENGEMILNGGDDTYV

SEQ ID NO: 11603 - protein, 240 aa, Xenorhabdus bovienii
  Coding DNA sequence: Name=SeqID_5495
  Gene classification: Gene name=FliH; Function=Flagellar biosynthesis/type III secretory pathway protein; Function class=N Cell motility and secretion
  Homolog annotation: Query=5..238bp; Hit=6..233bp; Blast score=180; Percent Identity=49.0; E value=2e-45; Homolog= ZfliH COG1317
MVVMIPMSDKSNKAIWQPWQPNELTQWETLRAKLEPMDNEPEPSEQDRLLVQARMLDALKEQARQTGHEQGFTAGQAQGYEQGIQEGRQAGLEQGLQEARQQQQIVVEQWKALLEDFSHSLDGLDTVIASRLMQLSLTAAHHILGQPAVCDGTALLNQIREFIQQEPMFSGKPQLRVHPQNIPLVEQQLGEVLALHGWRLIADNKLHPGGCKASADEGDLDASLATRWHEMCRLAASGEL

SEQ ID NO: 11604 - protein, 454 aa, Xenorhabdus bovienii
  Coding DNA sequence: Name=SeqID_5496
  Gene classification: Gene name=FliI; Function=Flagellar biosynthesis/type III secretory pathway ATPase; Function class=N Cell motility and secretion
  Homolog annotation: Query=1..453bp; Hit=40..493bp; Blast score=656; Percent Identity=78.0; E value=0; Homolog= ZfliI COG1157
MTARLGRWLATLDSLEKRLEKTPKVRRYGRLTRATGLVLEATGIQMPLGATCLIERQNGSTIEEVESEVVGFNGEKLLLMPLEELEGIVPGARVYARSYGEDSAGGRRLPLGPELLGRVLDGSGRPLDGFPTPDTGYRALLTTPPINPLQRTPISDVLDVGVRAINSLLTVGRGQRMGLFAGSGVGKSVLLGMMARYTQADVIVVGLIGERGREVKDFIENILGVEGLARSVVVAAPADVSPLLRMQGASYATRIAEDFRDRGKHVLLIMDSLTRYSMAQREIALAIGEPPATKGYPPSVFAKLPALVERAGNGVSDGGSITAFYTVLTEGDDQQDPIADSARAILDGHIVLSRSLAESGHYPAIDIEASISRAMTALIDNDHYRWVQQFKQLLSSYQRNRDLINVGAYAAGSDPLLDRAIQLYPHMAQFLQQGMNERSEYDAACIQLQQLLPI

SEQ ID NO: 11605 - protein, 148 aa, Xenorhabdus bovienii
  Coding DNA sequence: Name=SeqID_5497
  Gene classification: Gene name=FliJ; Function=Flagellar biosynthesis chaperone; Function class=N Cell motility and secretion
  Homolog annotation: Query=1..145bp; Hit=1..145bp; Blast score=95; Percent Identity=49.0; E value=1e-20; Homolog= fliJ COG2882
MQQHSPLVTLRELAQDAAEKAASQLAQIRQSHQQMEQQLTALTDYQDEYRTRLNDTLSCGMSSSTWQNYQQFMKTLEMAIEQHRLQLTQWKNRLEQAMSQWQEKQQRLNAFDTLQQRAEHNLKLHQNRMEQKQMDEYAQRGAQRRMKQ

SEQ ID NO: 11606 - protein, 454 aa, Xenorhabdus bovienii
  Coding DNA sequence: Name=SeqID_5498
  Gene classification: Gene name=FliK; Function=Flagellar hook-length control protein; Function class=N Cell motility and secretion
  Homolog annotation: Query=259..395bp; Hit=192..324bp; Blast score =123; Percent Identity=54.0; E value=4e-28; Homolog= fliK COG3144
MNLTLLPTDIKLTEKSQPTLNDPLARNNSSEFGQHLDAEIASVRKTAARADKNGLNNEKHPSDNPIEGELAPLLAVADNTVINVGGKTLAGGKPLTEISTPESDIDFAVLKDEDLLSAEALVAAMPIQLAGLINAQSIPAEGVENTDELLRGENTGAETLLGQNVKPGKSAKVDAALITTDRTDHTKDGEQDKSIRSFATQETTLSNNAEQSTKTRPTLAPVAGQVKLAINNKAEQNSASQNNGKELNQFQTAIQGIPARVAAAAETSQPESPAIPAASPLLSAGQQTTGQFQLNGTPAPLLSAHLGSEEWQQQLNQHVLFFNRNGLQQAELRLHPQELGALHIRMNVEDNQAQLHFVSAHQHVRTALEAALPGLRHALAENGIQLAQSSVGGDTQGNWQQEQAGDSPSHSHHSAKAHGRDPAAVTQMPTTHESAIKITPQQLASIRGGVDIFA

SEQ ID NO: 11607 - protein, 50 aa, Xenorhabdus bovienii
  Coding DNA sequence: Name=SeqID_5499
LDLCVYARSYNQTWTDKFLFSVADKFPRIPWRVFLSIKIDINYPASLFRQ

SEQ ID NO: 11608 - protein, 158 aa, Xenorhabdus bovienii
  Coding DNA sequence: Name=SeqID_5500
  Gene classification: Gene name=FliL; Function=Flagellar basal body -associated protein; Function class=N Cell motility and secretion
  Homolog annotation: Query=1..158bp; Hit=1..154bp; Blast score=149; Percent Identity=48.0; E value=9e-37; Homolog= fliL COG1580
MSDYSYERKRTNPIWIILLILIAVLSAAIGGYSWWTMKQPTKNSTEKAKVISTPVFMTLENFTVNLIDNEDHIDRVLHVGVTLRLPDEKTRQRFHDYLPEVRSRMLLLLSRQKAIDLANDDGKMRLVADIKQTLRPTMIPGEPDQVVTDVLFTTFILR

SEQ ID NO: 11609 - protein, 335 aa, Xenorhabdus bovienii
  Coding DNA sequence: Name=SeqID_5501
  Gene classification: Gene name=FliM; Function=Flagellar motor switch protein; Function class=N Cell motility and secretion
  Homolog annotation: Query=1..333bp; Hit=1..333bp; Blast score=542; Percent Identity=81.0; E value=1e-154; Homolog= fliM COG1868
MSDNILSQAEIDALLNGDSATADDVEPTASGESEIRPYDPNTQRRVVRERLQSLEIINERFARQFRMGLFNMLRRSPDITVGAIKIQPYHEFARNLAVPTNLNLVHLKPLRGTALFAFEPSLVYIAVDNLFGGDGRFPTKVEGREFTYTEQRVINRMLKLALDAYRDAWDSIFKIEVEYVRSEMQVKFTNITTSPNDIVVTTPFQVEIGALCGEFNICIPFAMIEPLRERLTNPPVENARQEDGQWRESLVKQVQHSELELVANFVDIPLRLSKILQLKRGDVLPIERPERLIAHVDGVPVLTSQYGTLNGQYALRVEHLINPVLNALDEEKPNE

SEQ ID NO: 11610 - protein, 143 aa, Xenorhabdus bovienii
  Coding DNA sequence: Name=SeqID_5502
  Gene classification: Gene name=FliN; Function=Flagellar motor switch/type III secretory pathway protein; Function class=N Cell motility and secretion
  Homolog annotation: Query=9..143bp; Hit=1..137bp; Blast score=172; Percent Identity=67.0; E value=1e-43; Homolog= fliN COG1886
MLWMRKSPMSDAKQPAEARLTEDMWAEALEQQAAQQTSDSGASIFENLEPQDALAQLSDIDLIMDIPVKLSVELGRTKMTIKQLLRLSQGSVVPLDGLAGEPLDILINGYLIAQGEVVVVSDKYGIRITDIITPSERMRRLSR

SEQ ID NO: 11611 - protein, 165 aa, Xenorhabdus bovienii
  Coding DNA sequence: Name=SeqID_5503
  Homolog annotation: Query=50..160bp; Hit=1..113bp; Blast score=138; Percent Identity=60.0; E value=3e-32; Homolog= ref|NP_929206.1|
MMANQPSLYASFQHGAASDAAPVNAKANTLSANTVKPAASPEPLPASQTLMQVSSALGGILVLIFVMTWLIRRLGLAPAKNKNHRLLNVKASCSLGPKERVVVLEIEDSWLVLGVTPQQINVLHQMPVPPDNAEKETALKTLPFSQMLKNTLQRKSKNDKDDDEK

SEQ ID NO: 11612 - protein, 269 aa, Xenorhabdus bovienii
  Coding DNA sequence: Name=SeqID_5504
  Gene classification: Gene name=FliP; Function=Flagellar biosynthesis/type III secretory pathway protein; Function class=N Cell motility and secretion
  Homolog annotation: Query=23..268bp; Hit=3..244bp; Blast score=294; Percent Identity=75.0; E value=6e-80; Homolog= fliP COG1338
MKNSVFFMTGTPMTGKKFVSLLRPVHLATLLMALLLPLFPMNAAAALPGIISQPMANGGQSWSLPVQTLVFITALGFIPAALLMMTSFTRIIIVLGLLRNALGTPSAPPNQIMIGLALFMTFFIMSPVFDKVYQDAYLPFSEDKISLEAALDKGAQPLRQFMLRQTRQTDLALFARLADQDAFETADSVPIRVLVPAFITSELKTAFQIGFTLFIPFLIIDLVVASVLMALGMMMVPPATISLPFKLMLFVLVDGWQLLLGSLAQSFYV

SEQ ID NO: 11613 - protein, 43 aa, Xenorhabdus bovienii
  Coding DNA sequence: Name=SeqID_5505
MAGNCCLVHWHKAFMSSEQFLCLARNLREILLEQDRKSGLKKL

SEQ ID NO: 11614 - protein, 89 aa, Xenorhabdus bovienii
  Coding DNA sequence: Name=SeqID_5506
  Gene classification: Gene name=FliQ; Function=Flagellar biosynthesis/type III secretory pathway protein; Function class=N Cell motility and secretion
  Homolog annotation: Query=1..89bp; Hit=1..89bp; Blast score=75; Percent Identity=79.0; E value=1e-14; Homolog= fliQ COG1987
MTPESVMALGIEAMKVALALAAPLLLSALICGLVISLLQAATQINEMTLSFIPKILAVFVTIVIAGPWMLNLLLDYMRVLFSSIPTIIG

SEQ ID NO: 11615 - protein, 260 aa, Xenorhabdus bovienii
  Coding DNA sequence: Name=SeqID_5507
  Gene classification: Gene name=FliR; Function=Flagellar biosynthesis/type III secretory pathway protein; Function class=N Cell motility and secretion
  Homolog annotation: Query=1..260bp; Hit=1..260bp; Blast score=203; Percent Identity=57.0; E value=1e-52; Homolog= ZfliR COG1684
MIPFDSEMLSRLVSDFFWPLVRLLALFSTAPIFSEKQTPIKVRISLALAITFLLVPNIPSPQIPIFSVAGVWVMIQQVLIGVALGLTMQIAFAAIRHAGEILGLQMGLSFATFFDPTGGPNMPILARILNLLMMLMFLALDGHLWLLSIIAGTFDSIPIQPMQLNPKGFLLLAQSASLIFINGMMLAMPLITLLLVLNFALGMLNRMTPQLSVFVIGFPLTLTVGIFTLSLLFPMLAPFTERLMAEIFDRLAVIIGELVL

SEQ ID NO: 11616 - protein, 252 aa, Xenorhabdus bovienii
  Coding DNA sequence: Name=SeqID_5508
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..249bp; Hit=1..249bp; Blast score=277; Percent Identity=52.0; E value=6e-75; Homolog= VC1591 COG1028
MMRFENKVVVITGAGSGIGEATAKRFSQEGAIVVLVGRNVDKLNRVYSELSSSHARVIQADVSDQDSVKMMIDETIEHFGRIDILVNNAGLYIPSTILDTSLDDGKKVLATNLDGVIYCSHFALPHLLKSKGCIVNNASVSGIRADWGNAYYCTAKGAVVNLTRAMALDHGSQGIRVNAVCPSLIITPMTEYMSDEVLQKFDSRIPMKRAGTPAEVASAIAFLASEDASFINGVNLPVDGGVTASNGQPNFS

SEQ ID NO: 11617 - protein, 141 aa, Xenorhabdus bovienii
  Coding DNA sequence: Name=SeqID_5509
  Gene classification: Function=Uncharacterized ACR; Function class=S Function unknown
  Homolog annotation: Query=1..141bp; Hit=51..205bp; Blast score=60; Percent Identity=31.0; E value=4e-10; Homolog= VCA0345 COG3506
LLASFSGNVVISTEIIFSPQQDYDQAGLMIRLSDKNWIKFSLELEPDKTIKLGTTVTSQGVSDWSGEIIDDISMPITLIAEISSGACLLSMRYGDGLPNTVRITPFIAVKSGDMWAGIYAACPRQSGFVANFENTSMRVIK

SEQ ID NO: 11618 - protein, 60 aa, Xenorhabdus bovienii
  Coding DNA sequence: Name=SeqID_5510
MLNDVFIELPVNSTVKWLNPAPYWETDIGLCRIKPASETDFWRETYFGHTAQWTCFVGFF

SEQ ID NO: 11619 - protein, 103 aa, Xenorhabdus bovienii
  Coding DNA sequence: Name=SeqID_5511
MIEHLVSYKFKNNLLDDDIKSVLDKLVSMPQSIPEIRHASWHLNSSLEGRDQGYCYLLRLEFDDQFQLEHYLASPAHTALCDDILFPALEDGLNSLIVFDITQ

SEQ ID NO: 11620 - protein, 322 aa, Xenorhabdus bovienii
  Coding DNA sequence: Name=SeqID_5512
  Gene classification: Gene name=Tdh; Function=Threonine dehydrogenase and related Zn-dependent dehydrogenases; Function class=E Amino acid transport and metabolism
  Homolog annotation: Query=16..263bp; Hit=17..266bp; Blast score=100; Percent Identity=26.0; E value=2e-21; Homolog= TM0298 COG1063
MAALVLIERNQFRYIEDMPDSNTEWPAWEVYRVGICRTDVNLTHNPARTNTVLGHEVVCRDGHGQYYALNNEINCGECDYCLEGKTSHCRHMRELGVNEHGGFASKIHAPANNLVPFTCIDHRIGVLIEPLACAIHGIKRLDTVLNTQSEIKVLVQGSGISGKLITYLLHTLYPALELTLYDVQADAMAWAESYPAIQRITEILQEHFHVAIECSGSQQGLADCFHAVRRGGILMIYGVPLAEATFSFSPNELMTREINLVTSLAGCDRETFCQSRDTVVAHQPFFSTLLGKTIGLKALEKELLHFSLILGTKTLVDPLSTI

SEQ ID NO: 11621 - protein, 123 aa, Xenorhabdus bovienii
  Coding DNA sequence: Name=SeqID_5513
MEQDYENTLPEKAKRYLAGLKKLKDKYACIHHVDGLGMLFNISFADAMGKPIENAGKYAVTLAQDEDYFYAGQRLRMVLNSGGYWNEGLKLAPYLDITYQEIDRTLSVLDQVIANLHKKLENK

SEQ ID NO: 11622 - protein, 34 aa, Xenorhabdus bovienii
  Coding DNA sequence: Name=SeqID_5514
MGGYPLRSLHPVMPTAILPIIPWEPARLSQHGIT

SEQ ID NO: 11623 - protein, 39 aa, Xenorhabdus bovienii
  Coding DNA sequence: Name=SeqID_5515
MVATRLRPVFCLTIFSASSTTSVPLALKEIRPGVTHENI

SEQ ID NO: 11624 - protein, 373 aa, Xenorhabdus bovienii; identical to SEQ ID NO: 10284
  Coding DNA sequence: Name=SeqID_5516
  Homolog annotation: Query=1..369bp; Hit=3..372bp; Blast score=249; Percent Identity=36.0; E value=8e-65; Homolog= ref|NP_415977.1|

SEQ ID NO: 11625 - protein, 117 aa, Xenorhabdus bovienii
  Coding DNA sequence: Name=SeqID_5517
  Homolog annotation: Query=14..112bp; Hit=38..136bp; Blast score=87; Percent Identity=36.0; E value=6e-17; Homolog= ref|ZP_00102184.1|
MLNNASVERLREIDQKYLSWGDTVHYQERPIIADHCHGELIHDLEGNTYIDTQMWHSSCNFGYSNPTIEQACRKQFEKLPQISGDFLHEEKLLLAEKVCQAIYERTGIKGRISRGYA

SEQ ID NO: 11626 - protein, 37 aa, Xenorhabdus bovienii
  Coding DNA sequence: Name=SeqID_5518
VHQFEGFFLGICQSNCHGRDLDLIRIKNQASSMTMGI

SEQ ID NO: 11627 - protein, 345 aa, Xenorhabdus bovienii; identical to SEQ ID NO: 7895
  Coding DNA sequence: Name=SeqID_5519
  Gene classification: Function=Predicted transposase; Function class=L DNA replication, recombination and repair
  Homolog annotation: Query=165..332bp; Hit=20..184bp; Blast score=77; Percent Identity=29.0; E value=3e-14; Homolog= BH2520 COG3335

SEQ ID NO: 11628 - protein, 146 aa, Xenorhabdus bovienii; identical to SEQ ID NO: 8316
  Coding DNA sequence: Name=SeqID_5520

SEQ ID NO: 11629 - protein, 178 aa, Xenorhabdus bovienii; identical to SEQ ID NO: 8288
  Coding DNA sequence: Name=SeqID_5521
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 11630 - protein, 59 aa, Xenorhabdus bovienii
  Coding DNA sequence: Name=SeqID_5522
MYITIPLIYKEPIKRLTIKLFAYCYHSIIGTCTNIQFFVAFLPRQSPQKSIITIPGIMD

SEQ ID NO: 11631 - protein, 140 aa, Xenorhabdus bovienii
  Coding DNA sequence: Name=SeqID_5523
  Gene classification: Gene name=ArsR; Function=Predicted transcriptional regulators; Function class=K Transcription
  Homolog annotation: Query=20..139bp; Hit=105..227bp; Blast score=89; Percent Identity=39.0; E value=1e-18; Homolog= BH0391 COG0640
MMHFANRNHTDIAIISTPKSLRFLRTCYDHMAGEIAVKIHNSLLTNHWITRDYKLTQRGNDFLLSIGVCCDTESSSRRKFACSCLDWSERHFHLGGFLGASLFKTFLQKKWAIRQLDSRELILTEQGRRVLMQKFGVDIN

SEQ ID NO: 11632 - protein, 87 aa, Xenorhabdus bovienii
  Coding DNA sequence: Name=SeqID_5524
  Gene classification: Gene name=ArsR; Function=Predicted transcriptional regulators; Function class=K Transcription
  Homolog annotation: Query=13..82bp; Hit=9..78bp; Blast score=68; Percent Identity=44.0; E value=9e-13; Homolog= BH0391 COG0640
MNELNLEESVVTIAAVLADRTRTRMLFLMMDGRAYTATELSAASDVAPSTASVHLNRLAEGKLVICVKQGRHRYFKIHSEEVDCWKA

SEQ ID NO: 11633 - protein, 109 aa, Xenorhabdus bovienii
  Coding DNA sequence: Name=SeqID_5525
  Gene classification: Function=Uncharacterized enzyme involved in biosynthesis of extracellular polysaccharides; Function class=R General function prediction only
  Homolog annotation: Query=1..108bp; Hit=1..108bp; Blast score=130; Percent Identity=55.0; E value=2e-31; Homolog= mll4602 COG2329
MLAIIFGVEIAENQSDRYFDTSATLKPILEAIPGFISVERFQSLNNNHKYLSLSYWRDEEAVKQWRNTYPHREAQKLGRNGVFTDYRLKVVTVIRDYGLNAREEVPKED

SEQ ID NO: 11634 - protein, 116 aa, Xenorhabdus bovienii
  Coding DNA sequence: Name=SeqID_5526
MKIINILICVVFILFSAILVGCFSTIDYEWAIGEEGINTVCDVVNAFVIDDDRVLTAPLCFVFLLPFMVTFVVKSIKGFPENKLKAISYLVTVGFSAGYWYWMFFGRFIDCPLVTH

SEQ ID NO: 11635 - protein, 61 aa, Xenorhabdus bovienii
  Coding DNA sequence: Name=SeqID_5527
MALNKIKTTHINIFIIFMLIYSSCLYKDKISSLLKIAEMYQQEFISKKLMHYSTFLSKIRS

SEQ ID NO: 11636 - protein, 31 aa, Xenorhabdus bovienii
  Coding DNA sequence: Name=SeqID_5528
MRLITEYDRHNREKQTGSYPFLPIAEKQIRA

SEQ ID NO: 11637 - protein, 308 aa, Xenorhabdus bovienii
  Coding DNA sequence: Name=SeqID_5529
  Gene classification: Gene name=FlgL; Function=Flagellin and related hook-associated proteins; Function class=N Cell motility and secretion
  Homolog annotation: Query=1..306bp; Hit=13..315bp; Blast score=291; Percent Identity=52.0; E value=6e-79; Homolog= flgL COG1344
MDGILGAQSKWMRYGEQLSTGKRVINPSDDPLAASQSIMVSQSESKNQQFMTARIFARNSMSAQLSITSNIVSVATNVFETLVAAADKQSDQDRASYAQQLEGFKQQLLNLGNKTDGNGRYIFGGYKTDVPPFKADESGKVHYKGGHEEITQKVDDNRSMIIAHTGQQVFLSTTTNPIKEPDGGTGEPDVFTTLDLAIKALRTPYSTASESEKNDAMELINKANRGIRNSLDNFSSVEAVLGLQLQELEQLDSLGSERSISNKVRTGELVDVDWASSISSYYQQQAALQASYKAFTDLKGLSLFEMYR

SEQ ID NO: 11638 - protein, 546 aa, Xenorhabdus bovienii
  Coding DNA sequence: Name=SeqID_5530
  Gene classification: Gene name=FlgK; Function=Flagellar hook -associated protein; Function class=N Cell motility and secretion
  Homolog annotation: Query=3..546bp; Hit=2..547bp; Blast score=422; Percent Identity=44.0; E value=1e-118; Homolog= flgK COG1256
MSNSLMNTAMSGINAAQVAMGVVGNNIANSRSEGYNRQTAVLTQNNGTLSPVGFIGNGVAVSSINREYSEFINQQHSSAQTKHAALGAYNQQITKINDLLADKDTSLSNSLEDFFKSLGAAESNAEDSAARTTVLGKAEGLVSRFKEADEFLRQIDNSINSQIEQNAREINKYAEEIATLNNEITRMRGTGTGEPLALLDKRDDAVNKLNQLVEVSVTQQDGSVYNVSFGGGMSLVSGSKAYRLEAIPSSTDSSRITLGYNNGTVGTKEIDERFISQGRLGGALQVRREVVDSSRNQLNQLALVMADQFNQVQNGGFDLKGKPGVNFFNFTQPDVISNSNNKGTADIKVEYTDTTKVKGSDYTLKHEGGDWKVQRVSDRAAIPVTKNGNALEFDGLKVEIDAAHSQDHDTYTLKTVSNVVATLEMNLQDSSQLATASAKDAGPSDNRNAKKFLDLQDQRLVDGKSSFAGGYASLVSQVGSKANEAKVSVETQGHIVDKLHATRESISGVNMDEEYGSLQRLHQYYLANARVIQTATTLFDAILGIR

SEQ ID NO: 11639 - protein, 60 aa, Xenorhabdus bovienii
  Coding DNA sequence: Name=SeqID_5531
MLLPTTPIATCAALIPLMAVFIRLLDMCRSFYVFVMPPSWEVIHCYSYRQDSLILEQKRR

SEQ ID NO: 11640 - protein, 321 aa, Xenorhabdus bovienii
  Coding DNA sequence: Name=SeqID_5532
  Gene classification: Gene name=FlgJ; Function=Flagellum-specific muramidase; Function class=N Cell motility and secretion
  Homolog annotation: Query=1..321bp; Hit=2..313bp; Blast score=304; Percent Identity=52.0; E value=7e-83; Homolog= ZflgJ COG1705
MSDFLTTPTAAYDVNSLHSLKARLSQEPQQGLRQVAQELEGVFVQMMLKSMRSSLPQDGILSSDQTRFYTSMYDQQIAQDLSQKGLGFADMIVKQFSNANSVAGEQAGTVPMPLDKEFLQTLPKQALEQFMHRTMTAPFAAAASKGSVQSKSLPVSSTDFVSMLSLPAQIASQQSGIPHLLIIAQAALESGWGQREILTAEGKPSHNLFGIKAGKNWKGAVTNIMTTEYIEGEPKKMHDSFRVYGSYREAITDYVKLLTENPRYAKVAQSTTAEQGAYSLQSAGYATDPGYAKKLVSLIQQLKSTGNQMVKAYTDDFDNLF

SEQ ID NO: 11641 - protein, 372 aa, Xenorhabdus bovienii
  Coding DNA sequence: Name=SeqID_5533
  Gene classification: Gene name=FlgI; Function=Flagellar basal-body P -ring protein; Function class=N Cell motility and secretion
  Homolog annotation: Query=8..372bp; Hit=1..365bp; Blast score=420; Percent Identity=71.0; E value=1e-117; Homolog= ZflgI COG1706
MEKLVASLFTLLLALSSIVVSGTASAERIRDLVTIEGVRDNALIGYGLVVGLDGTGDQTMQTPFTTQSLSNMLSQLGITVPPGTNMQLKNVAAVMVTAKLPPFAHSGQNIDVVVSSLGNAKSLRGGTLLMTPLKGIDNQVYALAQGNILVGGAGVSAGGNSIRINQLAGGRISNGAVIERELPTQFGQKGTLNLQLNNDDFSLAEQISDAVNRLQGKGTATPLDSRTVQLRLPRENSEQVRFLSQVQNLNIRVDAGDAKVIFNSRTGSVVMNRNVTLDSCAIAHGSLSVTVERQTAVNQPNTPLAGGNTVVTRNTGVGIQEQGGALQQVNASANLTQVVRALNVLGATPTDLMSILQAMETAGCLRAKLEII

SEQ ID NO: 11642 - protein, 250 aa, Xenorhabdus bovienii
  Coding DNA sequence: Name=SeqID_5534
  Gene classification: Gene name=FlgH; Function=Flagellar basal body L -ring protein; Function class=N Cell motility and secretion
  Homolog annotation: Query=18..249bp; Hit=1..231bp; Blast score=303; Percent Identity=71.0; E value=1e-82; Homolog= flgH COG2063
MDTMPVAENNVAYDSPSLRKNRGYKWRISMALAVLSLAGCAYIPHKPLVKGATTANPAEAPAPTPNGSIFQVSQPVYYGYQPLFEDRRPRNIGDTLTIILQENVSASKNSSANASRSGKTGFTAALTPRFLKGLMGGDKTDLSMEGDSDFGGKGGANANNTFRGTITVTVDRLLANGNLHAVGEKQIAINQGTEFIRFSGVVNPRTITGTNTVSSNQVADARIEYVGDGYINEAQTMGWLQRFFMNISPF

SEQ ID NO: 11643 - protein, 260 aa, Xenorhabdus bovienii
  Coding DNA sequence: Name=SeqID_5535
  Gene classification: Gene name=FlgE; Function=Flagellar basal body and hook proteins; Function class=N Cell motility and secretion
  Homolog annotation: Query=1..260bp; Hit=1..260bp; Blast score=390; Percent Identity=85.0; E value=1e-109; Homolog= flgG COG1749
MIRSLWIAKTGLDAQQTNMDVIANNLANVSTNGFKRQRAVFEDLLYQTERQPGAMSSEQTNLPSGLQIGTGARPVATERLHSQGNLAQTNNSKDVAIKGQGLFQIQMPDGTTGYTRDGSFQVDQNGQLVTASGFQVVPAIIIPDNATKISIARDGIVSINVQGQNAPQQVGQLTLTTFINESGLESIGENLYLETNSSGVPVENAPGINGAGLLYQGYVETSNVNVAEELVNMIQVQRAYEINSKAVSTSDQMLQKLTQL

SEQ ID NO: 11644 - protein, 251 aa, Xenorhabdus bovienii
  Coding DNA sequence: Name=SeqID_5536
  Gene classification: Gene name=FlgE; Function=Flagellar basal body and hook proteins; Function class=N Cell motility and secretion
  Homolog annotation: Query=1..251bp; Hit=1..251bp; Blast score=280; Percent Identity=62.0; E value=7e-76; Homolog= ZflgF COG1749
MDHVIYTAMGAARQTLEHQAVTANNLANATTPGFKAQLAALRSVPIEGETLPTRTLTVASTPGMDSRQGPMNYTSRPLDVAVGQGGFLAVQLDDGTEAYTRNGGIQMSPEGQLTVQGRMLMGENGPIDVPPQAELTIAADGAISALIASDPPTLLGQIGKLKIVKLEAGQVVRGDDGLFHLTPQAREQQGNELAASTEVKIMPGVLEGSNVNPVESMVNMIANARRFEMQMKVIHSSDENAQRANQILAMS

SEQ ID NO: 11645 - protein, 406 aa, Xenorhabdus bovienii
  Coding DNA sequence: Name=SeqID_5537
  Gene classification: Gene name=FlgE; Function=Flagellar basal body and hook proteins; Function class=N Cell motility and secretion
  Homolog annotation: Query=1..406bp; Hit=1..402bp; Blast score=392; Percent Identity=57.0; E value=1e-109; Homolog= flgE COG1749
MAFSQAVSGLNAAASNLDVIGNNIANSATFGFKSSSAAFADVFSGSDVGLGVKVSGMVKNFKDGSTTTTSRQLDMAITQGGFFRMLDSNGSTFYSRNGQFNMDSDRNLINMQGMKLTGYPAVQGANGPEIQKGAAPGPISIPRDMLDAKATTNVTMTANLNSMNKKVDIAATPFDSSKKDSFNYSSGLSVYDSLGNEHNINVFFVKTKDNEWQIHAQDTSVAGSAAQKLGDVKFDGNGRIQGTNNAFAFNVPALNGSIAAPINIDFNNSKQQSISQDSISNQQQNGYAAGSFTNYRVDSDGKIHGLYSNQQTQVLGQVVLANFSNPEGLAAQGDNVWVETGASGSPIVGTAGSGNFGKLISGALEASNVDMSQELVNMIVAQRNYQSNAQTIKTQDQILQTLVSMR

SEQ ID NO: 11646 - protein, 231 aa, Xenorhabdus bovienii
  Coding DNA sequence: Name=SeqID_5538
  Gene classification: Gene name=FlgD; Function=Flagellar hook capping protein; Function class=N Cell motility and secretion
  Homolog annotation: Query=30..231bp; Hit=28..231bp; Blast score=196; Percent Identity=53.0; E value=2e-50; Homolog= ZflgD COG1843
MAVSSSINDSLDNSTVGELATLNKQQPQKSGDIKDNFLNLLVAQLKNQDPTNPMQNNELTTQLAQISTVQGVEKLNKTLGAVVGQMEGNQAMQTTMLIGRTVMIPGDKILVGPDEENGISTSPFGFELTRPADNIKITIRDKEGVVVREVEAEKVNVGVHKVQWDGKDADGKEVINGAYNFTVSASYQDQALVTLPLTSAEVSGVTRGEDGTRLDLGLAGTVTMDQVRQIL

SEQ ID NO: 11647 - protein, 136 aa, Xenorhabdus bovienii
  Coding DNA sequence: Name=SeqID_5539
MEFLLLTQSQRFQHDGLGRVKHFNVCLITAGSRDGIDHFPDDIHIWHTYITFFIGQWITRPVFEAKRGGIIHNFTDTHATDLLSCQSRNAEYNLFGTVRLAIRPYNAIGIRHIAGADIQSLGLSGKCGASNIKNTE

SEQ ID NO: 11648 - protein, 138 aa, Xenorhabdus bovienii
  Coding DNA sequence: Name=SeqID_5540
  Gene classification: Gene name=FlgB; Function=Flagellar basal body protein; Function class=N Cell motility and secretion
  Homolog annotation: Query=1..136bp; Hit=1..136bp; Blast score=145; Percent Identity=61.0; E value=1e-35; Homolog= ZflgB COG1815
MLDKLDAAFHFRQEALALRNQRQEILSANIANADTPGYQARDIDFAAQLKQVMAEGRVTGNGMKLRLASDRHIPAQSQNRLEMDLLYRVPYQTAMDGNTVDMDVERSHFADNSLKYQAELTMTNSQLKSMMSVLQSQG

SEQ ID NO: 11649 - protein, 223 aa, Xenorhabdus bovienii
  Coding DNA sequence: Name=SeqID_5541
  Gene classification: Gene name=FlgA; Function=Flagellar basal body P -ring biosynthesis protein; Function class=N Cell motility and secretion
  Homolog annotation: Query=16..223bp; Hit=12..219bp; Blast score=113; Percent Identity=33.0; E value=2e-25; Homolog= flgA COG1261
MPALKFIGFITFFLSSFLHSALALASNLPQSINNYFTQIHHNADHKVTVKIKTPEQQWPVCEFPEIQPSLSNRNWGSLSIPVTCGQQRRFIQVYVGVTGSYLMSNRTIQRNTVLTEKDFQVKTGALDKLPNDIIRNRKAIQNGIAIRNIPAGQFITRNMIRRPWTIRAGQNVVVTVDGHHFQVRYEGKAINNAASFDNIRVRLTSGQVITGETQENGSVKMML

SEQ ID NO: 11650 - protein, 99 aa, Xenorhabdus bovienii
  Coding DNA sequence: Name=SeqID_5542
MALYDFDGLFIIFHVFKGFSEQSISNFTAVHGQSSFRNGFFQLLYFLDINILATWLNKLFLRLAQLNLRISAFFCDSYSSASALSTFIGIALLHSSNGQ

SEQ ID NO: 11651 - protein, 146 aa, Xenorhabdus bovienii
  Coding DNA sequence: Name=SeqID_5543
  Gene classification: Function=Flagellar biosynthesis/type III secretory pathway chaperone; Function class=N Cell motility and secretion
  Homolog annotation: Query=1..146bp; Hit=1..138bp; Blast score=80; Percent Identity=38.0; E value=5e-16; Homolog= flgN COG3418
MEELQLLLEQQNVHLNSLSNTMAEEQRILSEGFIEANHLHRVTEQKTFFLSALDHVERRRQQLNETLKVNAPYSSHEILAVLWDQISQTVERIRNLNVHNGFLLDQHIELNSQAIAFLKSHHSPSLYGADGQAHHNTALSGHKISV

SEQ ID NO: 11652 - protein, 42 aa, Xenorhabdus bovienii
  Coding DNA sequence: Name=SeqID_5544
MGKPITTQHCLATRSVFNFEWCDFTSSYVQTSLFISEIRGLF

SEQ ID NO: 11653 - protein, 338 aa, Xenorhabdus bovienii
  Coding DNA sequence: Name=SeqID_5545
MKVFVYPWLLLASVFFSPGKVYADCSGGSGIISTVAVSIPQHISRDEIYRSLYSQSRADMAITCTNMPVGATHITVGIKAYGDDSGITSISRKIFKLGDSGIGYVVIGVDDTHDEKPITTTADRFWGGNARELYTTEIGPDGTINLNAALRLEFYKIGPIKPGRYSQSVAAAIVAPRGSRIPSVTQEFRFTTGMITINAPTCSVDNSTIPVTLGRITTMQLPYVGSTAAETLFHIPLTCEPKASVFMTLEAGRQGAYDLMQGIIELKRGLNERARDGVGVQILDGKTNMPIHLGEKKYYTTTGTGGPVNIPLKARYYRYGDVRAGVANATATFTMSYE

SEQ ID NO: 11654 - protein, 829 aa, Xenorhabdus bovienii
  Coding DNA sequence: Name=SeqID_5546
  Gene classification: Gene name=FimD; Function=PapC-like porin protein involved in fimbrial biogenesis; Function class=N Cell motility and secretion
  Homolog annotation: Query=47..828bp; Hit=49..857bp; Blast score=627; Percent Identity=43.0; E value=1e-179; Homolog= Z4968m COG3188
MSLITPFIRAQLILLLLAGFLPVAGYASDYFDLDALEIHDPSAPPPDLSYFAEKGGSAPGTYHVDIRVNGQNKGAQDIQFVLDAGRKLQPDLSVQQLADWGVNVAAFPVLNSKMQVTDLADIIPYASTSLQLGQQTLIISIPQAAMTAEARGAIDSSLWQQGESALWMNYDFNGAETRSKSGSKTNSIYMNLRSGLNWDAWRLRNYSTYHRSRGGESRWENLNTYLQRDVHLLKSQLVMGETNTRGELFSGFAFRGITLMSDDNMLPDSQRGFAPIVRGIAESNAQITIRQNGFMIYQAYVPPGAFVIDDLYPASSGGNLDVTIQEADGRERHFVQPFSSVPIMLREGGFKYSLTAGEYRTSHDQTRQPLFMQSEVYYGLPHATTVYGGTLLSPNYQAYVVGVGYSLGRWGSLSFDITRSQADIINEGQQQGWVYRSQYTKDFEQTGTRLSLASYHYSSPHFYDFQDVNNWAAHDELSYQRKHKFQLNLSQNLSDYGSVYVSGYLQDDWGNRGTTRNLNVGYSVNYADINYTLNYTQNMSSGNSTADNQLAFNIQVPLDRWLPNSWATYSFNHNRQGDMNQSVGLSGTALDDNVLGYSLQQRYGNNGQNSSGNINLNYKARYGELSGGYNYNNSSQQINYGLRGGLVAHRHGITLSQSLGETIVLVKTPGAAGVKVNGYNGVETDGRGHAVLPYVSPYHHNRIALSPDSFGDGVEIESNIQTVIPTQGAMVVADFRTRIGHRVLFTLTHLGKPIPFGAIATLNEENTISFLTENQSIVGNGGEVYFGGVPEQGQLSVQWGNGQFEQCKARFILPKSEAAVISMKADCQL

SEQ ID NO: 11655 - protein, 234 aa, Xenorhabdus bovienii
  Coding DNA sequence: Name=SeqID_5547
  Gene classification: Gene name=FimC; Function=PapD-like chaperone involved in fimbrial biogenesis; Function class=N Cell motility and secretion
  Homolog annotation: Query=24..231bp; Hit=25..230bp; Blast score=174; Percent Identity=42.0; E value=9e-44; Homolog= ZyraI COG3121
MLKRFLFGLLLSLPVVFSAPTHAGIALSSTRVIYEASQREATISVINDSKENVYLIQSWVNTFTTTTELSDRKAPFLVTPPLFRLDGEQENRLRIILTDDSLPQDRESVFWLNVKAIPAVEKNDANRLLISVKNRIKLFYRPAGLTEKLADNAYQQLTFSRQNGQLVVQNPTPFHISFHNITVGNNPVPEAGMVAPFSRRQWPLPAGSGNTVTWRAINDFGGTTEPQHQTLSSL

SEQ ID NO: 11656 - protein, 174 aa, Xenorhabdus bovienii
  Coding DNA sequence: Name=SeqID_5548
  Gene classification: Gene name=FimA; Function=Pilin; Function class=N Cell motility and secretion
  Homolog annotation: Query=10..174bp; Hit=16..178bp; Blast score=79; Percent Identity=36.0; E value=2e-15; Homolog= Z4971 COG3539
MKLLKLFIAAIISGSMAASALAADGRIDFNGRITKATCTVDASTADPVNLPEVGATALAEKGKTGGDTLFSINLKDCGIVGGSANVQVKFDGVKDRIDGNLLKINSESGGATGVGIGIYEKNGSTLINMGELSKSTPVTKDVTKLEFKAKYVATGATVTPGTVKASTDFTLDYE

SEQ ID NO: 11657 - protein, 43 aa, Xenorhabdus bovienii
  Coding DNA sequence: Name=SeqID_5549
MLIYLILFAVIWLISDDLKKLYLYAINFMAPHFMATTNEVICR

SEQ ID NO: 11658 - protein, 33 aa, Xenorhabdus bovienii
  Coding DNA sequence: Name=SeqID_5550
VLRKMQVNKWNGVTPQYLGGNAFIPFLPVDKSK

SEQ ID NO: 11659 - protein, 95 aa, Xenorhabdus bovienii
  Coding DNA sequence: Name=SeqID_5551
  Gene classification: Function=TPR repeat proteins; Function class=R General function prediction only
  Homolog annotation: Query=3..83bp; Hit=196..276bp; Blast score=79; Percent Identity=51.0; E value=6e-16; Homolog= ybeQ COG0790
MEWYLKASKQGLSTAQNNIGILYRKGRGVPQNYQKAMEWYLKAAKVGNAVGMFNVGYLYQSGLGVEKDEQKALEWYQKAAEADKNFTEAAFAVKN

SEQ ID NO: 11660 - protein, 35 aa, Xenorhabdus bovienii
  Coding DNA sequence: Name=SeqID_5552
LKGPALMLLDTTPSLFDNLVAQFHLIHKSVMIPIY

SEQ ID NO: 11661 - protein, 167 aa, Xenorhabdus bovienii
  Coding DNA sequence: Name=SeqID_5553
  Gene classification: Gene name=InsB; Function=Insertion element IS1 protein InsB, putative transposase; Function class=L DNA replication, recombination and repair
  Homolog annotation: Query=1..167bp; Hit=1..167bp; Blast score=225; Percent Identity=66.0; E value=1e-59; Homolog= insB_g3 COG1662
MPGDSPCDGDWSEYCPSPFKKLRPKSVTQAIAPGTEVIVCCEMDEQWSYVKSKNQPRWLFYAYDRIRRKVIAHVFDPRTKKTLMRLMTLLAPFNIVISMTDGGRSYEKTRAGKRHVVSKRYTQRIEKHNLNLRQHLARLTRKTLSFSKSIEIHDRAIGYYLNIHHYQ

SEQ ID NO: 11662 - protein, 96 aa, Xenorhabdus bovienii
  Coding DNA sequence: Name=SeqID_5554
MAKDSIQTNPHHTGCRPASHSIHGPIDDLLMCTGTTSGISEFPLPRMTAGLAKITLMTRARAPITVDPFNCTTRWAGHINLCHLNVFQIDRLYRVQ

SEQ ID NO: 11663 - protein, 206 aa, Xenorhabdus bovienii
  Coding DNA sequence: Name=SeqID_5555
  Homolog annotation: Query=22..201bp; Hit=6..183bp; Blast score=181; Percent Identity=51.0; E value=6e-45; Homolog= ref|ZP_00119216.1|
MEFYKLMIIRKDNMFSHKNNPIRAFYTEEYIRVYQAFSDTIADSAIKNGTFVSPPFSMTRMTWIKPSFLWMMYRSGWAMKDSGQTRILAIDITHEGFREIVRQGIISHYDPEFFDSMDAWKEKVQNSDVVVQWDPERDILLNKLEQRTIQIGLRNKAVDNYVNQWIVNISDMTHMAHEIYELVRNNKLDLAQALLPKEEIYFKSSC

SEQ ID NO: 11664 - protein, 695 aa, Xenorhabdus bovienii
  Coding DNA sequence: Name=SeqID_5556
  Gene classification: Gene name=FlhA; Function=Flagellar biosynthesis/type III secretory pathway protein; Function class=N Cell motility and secretion
  Homolog annotation: Query=1..693bp; Hit=1..691bp; Blast score=1019; Percent Identity=79.0; E value=0; Homolog= flhA COG1298
MANLASLLRLPGNMKGSQWQMLAGPVLILMILSMMVLPLPPFLLDLLFTFNIALSIMVLLVAMFTRRTLDFAAFPTILLFSTLLRLSLNVASTRIILMEGHTGSAAAGQVVEAFGHFLVGGNFAIGIVVFVILILINFMVITKGAGRIAEVGARFVLDGMPGKQMAIDADLNAGLIGEDEAKKRRAEVTQEADFYGSMDGASKFVRGDAIAGLMILVINIIGGLIVGVAQHNMNLGDAAEAYTLLTIGDGLVAQLPALIISTAAGVIVTRVATDEDVGQQMVTQLFNNPRVLLLSAGVLGLLGLVPGMPNFVFLLFTAALAGFGYYLLRKDKNPLAAQHEEMKAAEEQQQTAEASWSDVQLEDPLGMEVGYRLIPMVDFRQNGELLGRISGIRKKFAQEVGYLPPVVHICDNLELAPASYRILMKGVEIGRGEAHPGRWLAINPGGAVGELQGDLTQDPAFGLSAVWIDDSLREQAQVQGYTVVAASTVVATHLNHLLSQHSSELFGRQEAQQLFERVSQEMPKLTEDFIPDVVSLTTLHKVLQNLLAEQVPIRDMRTIIETLAEHAPTQADPYELTATIRIALGRAIAQQWFPRADEIKVIGLDAGLERLLLQALQSGGGLEPGLAESLERQAAEALERQEMLGAPPVLLVNHALRPLLSRFLRRVLPRLVVLSNLEITDNRQIRMTATIGGAR

SEQ ID NO: 11665 - protein, 411 aa, Xenorhabdus bovienii
  Coding DNA sequence: Name=SeqID_5557
  Gene classification: Gene name=FlhB; Function=Flagellar biosynthesis/type III secretory pathway protein; Function class=N Cell motility and secretion
  Homolog annotation: Query=29..410bp; Hit=1..381bp; Blast score=417; Percent Identity=58.0; E value=1e-116; Homolog= flhB COG1377
LSCLTQFYLLFPKSNFSACNNERSPRKVVAEDSDLEKTEEPTPHKREKARKDGQIARSKELTSILMLAGGVSLLWMSGNSITNELSLMVFEGFNFDHNMVSNDKQMIQQVGRLLKQAVWALLPVFVGLVLVALSAPTLMGGLIFSSKSIKFDLAKLSPISGLKKIFSMNALAELFKAILKASLVGGGAALFIWLNWPAMLNLTAQPPLMALSDAMMMLIFAGYIVLFMLIPMVAFDVLYQIRSHLKKLRMTRQEIKDEFKEQEGDPHVKARIRQQQRAAARKRMMSDVPKADVIVTNPTHYAVALQYDSKKMGAPKVLAKGAGLIALRIKEIGAENRIPLLEAPPLARALFRHAEVGGFIPATLYAAVAEVLAWVYQLKRWKREGGLKPKTPENLPVPSALDFAGENNRHG

SEQ ID NO: 11666 - protein, 39 aa, Xenorhabdus bovienii
  Coding DNA sequence: Name=SeqID_5558
MAGILQSLQRYLGNHTIPELGRLRNREMSVTYNGSVTLR

SEQ ID NO: 11667 - protein, 44 aa, Xenorhabdus bovienii
  Coding DNA sequence: Name=SeqID_5559
  Homolog annotation: Query=9..44bp; Hit=3..38bp; Blast score=69; Percent Identity=91.0; E value=1e-11; Homolog= emb|CAA60622.1|
MFCLLLCELSMSLIRKSFKRLHYPVDIMAQCVRWYLAYSLSLRN

SEQ ID NO: 11668 - protein, 43 aa, Xenorhabdus bovienii
  Coding DNA sequence: Name=SeqID_5560
LLGRIFTKPILKLIQPLFGVGLYGKNAIRRQHPSFRPHFFSIS

SEQ ID NO: 11669 - protein, 308 aa, Xenorhabdus bovienii
  Coding DNA sequence: Name=SeqID_5561
MRDYRVTYRIQDLSVLQPAEEVQITTPTYDIRGKGESGAQVTVAASGKPLCSAIVDGQQNWVCPRFVSSPGWYEIEARQTLEGYSWGKPVTRHYEVIYGMPDIVINSTAPAFCPPPNTGQPTSAFVTGKALPGSYITLNASAGHTCGTTQASAKGSWSCRLDNVWLGKFHLTAFPSLTPDGRPVGPTVEQEVTIRENTFRVLEPGNRVVYETRSPWGRVAHITMYGVGTPGAEVELEVVRASGWKTTSRVRVGNDGGWKYDGFQLDIGWYTLHASQQGCDKGSSADIHFSVTSKPITIPCPPHVICDN

SEQ ID NO: 11670 - protein, 588 aa, Xenorhabdus bovienii
  Coding DNA sequence: Name=SeqID_5562
MKAGKIVAKNTTYMTVKKKNNKDKDKFKSDYPKNNTTVDPDGTIQLFGSFGTVGGVVAGAGVAVVGLLGSIFGAVSGAVSLVAGLPATLWGVAINPNKLGGGDIYTLTLQETHYGQLVGDPIIWTFTVPMRITEPGLNAQYRVDNPISIKGEGTPGQLILIAGSQYLLSSRLTVGQVPENNLICQTTVNGGGTWACPNNPAMTAKLAGTFFLYGAQYKKTAPGNVDAMYERTSAVVRRYDITQTRINITAPRQGAKITVLPLTITGTGEPRAQVHLGSFGGTPKCNTDVEASGIWSCGPYQPEKGEYTLSAEQLINNQLHSTAQVSFDVQTDRIRPLVITQPHHGGVYRYQESVVPAGQSEPGTTICLAEQALEQVCQNGVTVDKEGRWTERDRLNTARKGEQTLVATAFLGQARQSTAKVTFQVEGADGERLLTVNVPGEAAVIKTPSYTFSGTLPANGRSVTVHAFGGNEGCTAELNLTSGSWTCGPYSAVPGDYRAVIEDDTGSRIARSFKVRYGDNLQMRVLEPAEGAQIDRPLYAINGTGQTGARITVTLAGEPVCETTVDEHQTWACQERQLSRQGDYQLLA

SEQ ID NO: 11671 - protein, 841 aa, Xenorhabdus bovienii
  Coding DNA sequence: Name=SeqID_5563
MNIFRTFFILLLLLFFCDYAFSNSALKYQPIKAIAGGEKSCDSGSGNKCKPWVVNIYVQSNSDTQYALCSGSVIARKYVLTAAHCQKKNIKKYIIKNYKNEEISTALPHSFIASYNGSDLAILKLESPVILVSYGHVRRFFNYDEAYEKFRNSYYDASIYGYCSFGINKITGAQVRNSGDQYRADVKMFTTAPDSRNNQGLMVEENLNENLKPGIAQEGDSGGPLIWDDTIIGVVSWGYSYFEKKYQDSDSRSHFFVMSDVTGKYIDIGLSKKRSMSSWFSRTMNKIWIESPDWNSRLSRRGKSVVVKGFGRPNSDLKLDYSVGNKKNKVIKCKDLDNMKKEHSVDNFGKWKCDIPYDSYFTEFVTENKEYKVAIKARESKEDSRGWKEDIIQAKIPPEKEEFSIVYPTDKSIVLTKNFIIRGYADPNSNVKLILKSNSSDKSYTQDKICNGLEDKELIKTGEDGVWSCMIDYQLIIKSGDINKQYDIKITAMQNIGKVIIPDGINMILKPEDYTELKIEQSNESKNNIYRKNLIFDVNYSKYAKVVCVFNRKSFSCKNNTDGKGDFYLGNISAGRDNLNSHEKARFNISAIQKIEGADPFDPKLWSDINYESVGGYFPPDFNEVHDISHPKSILSAEIENNVITGFGGDNKRYTDMNNDIILPSEYSICMKKGGDSPLPPGSSLCSEKGDNNIYLKIPFKDSREFSELPIKYGNFSGRKNFPIWSITLPPTLKDGLYYLEVTDKYHPLGLPNFKETYYSILNKTYFQILTPNVEIKTPSVGDVNTVGTPSFVSGDANVPGDEVDVKKRKITFSLESQGKNNLNSAQETVICTGAIVNDNG

SEQ ID NO: 11672 - protein, 272 aa, Xenorhabdus bovienii
  Coding DNA sequence: Name=SeqID_5564
MVKEYKPNIDIETGKWSVEGLDAECFTYYKASIYFQSDQEDNPDMSGKRSVNYDVSHCPVKITKPTMYQMISSISEDYNKIGVEGKVTQNTPLDISASDSSGGKNLIHLNSRTGNDWLAEISDAPNGFIKIKANNTGTDQVKIKNSEDEVIILKSKEFSVNYEFPDKVFIDFYGTSMPMISEKENDKSNGFKESLHPTIRILLDGEKADEIIPDERGDWKSNNKYYAKRGVYTFTIQEISDNKRYKAREDKVLECKGGTSNMTCFEKNNYTK

SEQ ID NO: 11673 - protein, 407 aa, Xenorhabdus bovienii
  Coding DNA sequence: Name=SeqID_5565
MKIIKINLYIALFFSILFTFNKARADNLISADNIISEKNYKFKKNIINLERHYALIFKNESKNDDLEIKVLDSNCMKNSGDQYIHLSPGEIKYDYTKDSNAWPDCLREAKIIKWKIITYKKGVEYKSCDFEIKNSVPSFPSEGYLVWRTIINAANCDLVTSALCGTSNCLNNSVYTDSYDINISIKDDNNWEPPKIISPDRKHYAEKNYITVVGQGLMEDESLPLIITSFDNNIYQVDNTGEAEDKWSAKIWANCGISGTVSIKDIANSDVTIIGTPCGATITSMKENQLLSSGKYNLSGLINGYKLDDIKNELSVKIANFSDPEHKKGVGMVKEYKPNIDIETGKWSVEGLDAECFTYYKASIYFQSDQEDNPDMSGKRSVNYDVSHCPVKITKPTMYQMISSRMN

SEQ ID NO: 11674 - protein, 46 aa, Xenorhabdus bovienii
  Coding DNA sequence: Name=SeqID_5566
MGYDLFSFYIKRIQKPMTLFFVTDKRSLFKNTRISNYRFGIMTNNL

SEQ ID NO: 11675 - protein, 75 aa, Xenorhabdus bovienii
  Coding DNA sequence: Name=SeqID_5567
MTQWFWRYNKERQTIAYQNYDSTIFHITPSVIGCYETNTKGVSKSNNLRQVASVREPNTWAMTYFLFISNVYKSQ

SEQ ID NO: 11676 - protein, 50 aa, Xenorhabdus bovienii
  Coding DNA sequence: Name=SeqID_5568
MRFLARWITQHFQDQSQLFPRQSATSTFTVEPSVDYSLIWVGKLPNSSAR

SEQ ID NO: 11677 - protein, 73 aa, Xenorhabdus bovienii
  Coding DNA sequence: Name=SeqID_5569
  Gene classification: Gene name=WecD; Function=Histone acetyltransferase HPA2 and related acetyltransferases; Function class=K Transcription
  Homolog annotation: Query=4..73bp; Hit=58..127bp; Blast score=60; Percent Identity=41.0; E value=4e-10; Homolog= mlr1969 COG0454
MWVPDADQRITIWRFMVDKNHQNKGIGRKALSLALDEIRRTVQLETIAISYDPNNLVAKNLYASFGFVEVGMD

SEQ ID NO: 11678 - protein, 57 aa, Xenorhabdus bovienii
  Coding DNA sequence: Name=SeqID_5570
MKLSATYQSLMTNLTILRKICDLLLNPNFTLYTKRVQFVWMGSLLVFSCGYRMLTKE

SEQ ID NO: 11679 - protein, 46 aa, Xenorhabdus bovienii
  Coding DNA sequence: Name=SeqID_5571
LTVLAYNPILEWCMLITLTDVNKNNYEAVCDLSVTDDQLDYIAENM

SEQ ID NO: 11680 - protein, 103 aa, Xenorhabdus bovienii
  Coding DNA sequence: Name=SeqID_5572
MKNKKLKRLQKELDTLGFIEKDPDVVGYALFNTRNRRFATLDENEFGMVIYADDIEEAYLATSRFSALMDIGFLPEPDQFDIAVIPVIENPVFGLILKKTVLN

SEQ ID NO: 11681 - protein, 33 aa, Xenorhabdus bovienii
  Coding DNA sequence: Name=SeqID_5573
MVNHRSSLMSGFFNAKRPTIYRTLTRNRMANDN

SEQ ID NO: 11682 - protein, 458 aa, Xenorhabdus bovienii
  Coding DNA sequence: Name=SeqID_5574
  Gene classification: Gene name=AlsT (BS); Function=Na+/alanine symporter; Function class=E Amino acid transport and metabolism
  Homolog annotation: Query=1..440bp; Hit=1..443bp; Blast score=453; Percent Identity=60.0; E value=1e-127; Homolog= PA2533 COG1115
MELITQWLNAINGIVWGIPMLVGILGIGIFMQIRLSFLPIRKLGTGFKLLFQKNEQRGEGQISPFNALMTALSATIGTGNIAGVATAVVMGGPGALFWMWMTALLGMATKYSEAVLAVRFRETDKNGNYVGGPMYYIKNGLGKKWIWLGTLFAFFGSIAGFGIGNTVQANSVADVLHSNFGIEKTVTAGILVILVGAVLIGGIKRISDVAGKLVPVMTVGYFGAGIIVLALNITAIPEAFVLIIKSAFTPVAAQGGFAGAAVWAAIRFGVARGVFSNEAGLGSAPIAHATAKTQNPIRQGLIAMLGTFIDTIIVCSVTGLTIVITGGWLTGETGATLTASSFSAVIPGGNYIVAVALAIFAFTTILGWSFYGEKCIQYLLGPKAIVPFRIAWIIALPIGATQSLNFVWLLADTLNAMMAIPNLIALALLSPIVYRLTKDHIRDVNADSIEMKTATKTD

SEQ ID NO: 11683 - protein, 62 aa, Xenorhabdus bovienii
  Coding DNA sequence: Name=SeqID_5575
VDNCCLEDQYIVTRVSDSTHRINFFLPMITNCPRLFSQNALYLIETILLLICYVRLRECIWN

SEQ ID NO: 11684 - protein, 202 aa, Xenorhabdus bovienii
  Coding DNA sequence: Name=SeqID_5576
  Gene classification: Gene name=PinR; Function=Site-specific recombinases, DNA invertase Pin homologs; Function class=L DNA replication, recombination and repair
  Homolog annotation: Query=3..193bp; Hit=4..194bp; Blast score=239; Percent Identity=64.0; E value=2e-63; Homolog= ZpinH COG1961
MVFLGIEGLSVARVGYVRVSTNDQNSDLQKNALVSIDCERIFEDKISGKTANRPGLKRALKYLQSGDTLVVWKLDRLGRSVKNLVTLISELHDRGIHFQSLTDSIDTSTAMGRFFFHVMSALAEMERELIVERTNAGLAAAREQGRIGGRPVLFTEEDRQQAARLLDRGHSRKQLSLIYHVSLSTIYKYLPVGQVINLPLLD

SEQ ID NO: 11685 - protein, 59 aa, Xenorhabdus bovienii
  Coding DNA sequence: Name=SeqID_5577
MGYSLSKAGRSTKYQRILPPSRWSLLNRNENNIEVRVSENSFIKGTGTMSTRFPHHQPQ

SEQ ID NO: 11686 - protein, 59 aa, Xenorhabdus bovienii
  Coding DNA sequence: Name=SeqID_5578
MDYLDYGFYQENGQTMNNITAFAFMHYNQEEKNGVFIIKGRQEHQISENSSPLALESIE

SEQ ID NO: 11687 - protein, 41 aa, Xenorhabdus bovienii
  Coding DNA sequence: Name=SeqID_5579
LPVLPHVRQRLIHDISLSHDHLRHEIPVISEYKHRHWQAGE

SEQ ID NO: 11688 - protein, 275 aa, Xenorhabdus bovienii
  Coding DNA sequence: Name=SeqID_5580
  Homolog annotation: Query=1..198bp; Hit=1..199bp; Blast score=230; Percent Identity=57.0; E value=2e-59; Homolog= ref|NP_928301.1|
MNVFNPTLYACTPTVTVMDNRGLSVRDIAYHRTTAGEQADTRITRHQYSPHNFLIESIDPRLFDLQSQSTIKPNFTYCPALKGDVLRTESVDAGQTVILSDIEGRPLLNISAMGVVKHWQYEDNALPGRLLAVSERKSEASTPQIIERFIWAENSQSEKDHNLAGKCLRHYDTAGLNQLNAVSLTGVDLSQSRQLLQDLVYHYDPVGNLLNIRNNAEVTRFWCNQIVEPENHYAYDTLYQLVSASGREIASIGQQGSRLPVLIIPLPANDDVYTR

SEQ ID NO: 11689 - protein, 48 aa, Xenorhabdus bovienii
  Coding DNA sequence: Name=SeqID_5581
MTVTVGVQAYKVGLKTFIVFFPNQPESDVKKMTLKCGLNLPRLHNREG

SEQ ID NO: 11690 - protein, 535 aa, Xenorhabdus bovienii
  Coding DNA sequence: Name=SeqID_5582
  Homolog annotation: Query=4..532bp; Hit=963..1483bp; Blast score=594; Percent Identity=57.0; E value=1e-168; Homolog= gb|AAC38625.1|
MGGYPRRNKPAQNPYPDSLPDTLFADSYDDQQKQLYLTKQQQSYYHLIQQDDWVLGLTDSRYSEVYHYAQTDAQSDIPKAGLTLEDLLADDGLIGKDKTFIYLGQQRVAYVGGDAEKPTRQVRVAYTETAAFDDNALHAFDGVIAPDELTQQLLAGGYLLVPQISDVAGSSEKVWVARQGYTEYGDASQFYRPLIQRKSLLTGKYTLSWDTRYCVVVKTEDGAGMTTQAKYDYRFLLPVQLTDINDNQHIVTFNALGQVTSSRFWGTENGKISGYSTPESKPFTVPDTVEKALALQPTIPVSQCNIYVPDSWMQPLSQQSLTGQLKEGETLWNALHRAGVVTEDGLICELACRRWLNRQTPSSMEAVTLQQILAQTPRQPPHAMTITTDRYDSDSQQQLRQSIVLSDGFGRVLQSAQRHEAGEAWQRAEDGSLVVDNTGKPVVANTTTRWAVSGRTEYDGKGQAIRAYLPYYLNDWRYVSDDSARDDLYADTHFYDPLGREYQVKTAKGFWRENRFMPWFVVNEDENDTAARLTS

SEQ ID NO: 11691 - protein, 227 aa, Xenorhabdus bovienii
  Coding DNA sequence: Name=SeqID_5583
  Homolog annotation: Query=1..198bp; Hit=1963..2160bp; Blast score =280; Percent Identity=71.0; E value=2e-74; Homolog= gb|AAF05542.1|AF188483_1
LKQRLYNLRHNLTIDGLPLSLPIYAKPADPKALLSAAVNASQGGTDLPNPEMPLHRFPIMLDNAKSIVSQLIQFGSTLQGIIERQDAEALNELLQNQARELTLISIQMQNKTLEELDAEKEVLKQSRQGAQSRFDSYSKLYDENINAGEITAMGLRATASAISTALEAAKLAEAGADMFPNIFGLAGGGSRWGAIPGAINRHRTPIRIRYRILCSPIVMTTSKNSYI

SEQ ID NO: 11692 - protein, 360 aa, Xenorhabdus bovienii
  Coding DNA sequence: Name=SeqID_5584
  Homolog annotation: Query=1..360bp; Hit=1616..1975bp; Blast score =351; Percent Identity=49.0; E value=1e-95; Homolog= emb|CAC38401.1|
MVERAETGIDTLLAMDTQQLPEPKMGDGGYISVTLPKYDPDKHGSTRNAAVTLYQEKDGVDSTTHYGFWDGSLTDAEQTIKLFIPLTSTKEPFYNTIDFPSSISDGLQVFLKSAKEGLLAGTLKTAFTPSEDKKANIVFTEYTPVSGTPPMKVELLSKYYDQPMDFNGANSLYFWELFYYSPMLVAQRLLQEQNFDEANHWLKYVYNPEGYIVKGEIAPYHWNCRPLEEDTSWNSNPLDSTDPDAVAQDDPMHYKVSTFMRMLDMLIARGDKAYRQLERDTLNEAKLWYIQALSLLGDEQFVALDSNWSEPTLETAADKTVEQDYQHALMLIRLVQPAEYTANSLTNLFLPQQNDKLNGY

SEQ ID NO: 11693 - protein, 1636 aa, Xenorhabdus bovienii
  Coding DNA sequence: Name=SeqID_5585
  Homolog annotation: Query=22..1563bp; Hit=21..1598bp; Blast score =1167; Percent Identity=42.0; E value=0; Homolog= gb|AAF05542.1|AF188483_1
MYNTENIFFRLNRENHRKPITLAHIMPISFSAFRKEVKDTLNWGESPHLYLAAKKAEKENRIFEARLLSRANPQLRGAVHLGIQQLSQWQSYDMLFGGRSDKYVLSGSVASMFSPAAYLTELYRESRHLHLESPIYHPDKRRLDLQSIMLSQENQDQTLSTLELSNDILYPQLSQVSQSPKVIGLLSPVSLLGISSQISPELYKILTEEITAENAQDMYKKNFGDLPISALSNPNYLMKYYDIDADTLRAVMGIYGSGQNDDEPAFISDQAIVTYLDDKNSFVTYLITRTKGETYGWQVNFIEAIPTKDGKLKYWYNFKAPASSAVSTKISLNGQTILDRPDWLPELNKTYSDIVDFPSDADRKKFTLKFERAASGSGGSFNTDATFSIETVLPQLFFLKLNKVIRLYKKTGITLEQIETAVDSDNAQQQITETILKKIFYTTYYINRYYLSFNDALVLCNTAISQHSYNDQPSHFDLIFNNPPLNGNYYQLGGDKIQVDPDQADYEQYNQRREMLKHALKVNDSELFTLSKILDQENTSGIDNNLATDLSALYRVRMLAYIHQLSINELAILLKLSPYAEESFNKISTEKLIEVIEYLYSITQWLQTQKISIYTLYMMTTTTYSTVLSPDINNLIETLRAGMQNKTVPDDPLQLIKTLAPFIAAALKLSSAFVAESILIWINKIKPNGMDVTAFWKSIEPVKDPIKPDSMVFCQVLGQLALIYLATQLTENALNLAVTTKVIIGHSSNTDHLGKDTETVRQLSRFAGWCNSLASNTDTVLTALQSNNLDSTILASAMRMDERLLSTASEQANINHQVAEKNKYADWSEIDSVLQWLAVANVMKTSPNKINALLQLDYLKDQNTTEVSYETWSQSADILAAGLNSNQSDILKQVLEEEASAALSQYYIREVVDSAAEVIDRNDLYGYLLIDNQISAQVETTRLAEAIASIQQYINRALNGRESTPATDVMTGQFYQDWDRYNKRYSTWAGVSTLVYYPENYIDPTMRIGQTHMMDELLQSVSQSQLSVDTVEDAFKTYLTRFEQIANLTVVSGYHDNVNISQGNSYLVGKGETDANQYYWRKLDHSKSRQGKIAANAWSEWAKIDSPVNPYQGLIKPVIYKSRLYIIWLEKRVITVSESDKEGVITSKDIIKYEIKIAHIRHDGTWNTPITLDVSDIFSAYNDTDLANLAMYCSEYTGESTLLLLLYVKQANTEGNKDLTKTKTKGMYIYSDMTTKVMEKDEIGNYQNSVYREFDTLTQRWLNNRYAANYDYPSSVAVSSGYEWGDYSLSMVYDSKIASIATVGTTSSEIKLKIDADLRVIYNGVEGRQRHQCALMQKFGQLGDKFIVYEDLKIDRENQSAGNNNLFYPVYQYSGNVSKLSTGRLLVYRESSSSYVKADIGPGHDPLINENAQKPYGYVEDSKNNPAALKNNMTLTDNAGISTKVASPRDIDTAVTPANITIKASAGSSKPVEFNAGTSVINLPNNNLEEMIYNFHDMEFTIPLTEFKDNQVDVEIVLTGKTDDGRVLGSETFNFTVTQKILNEQSGLLTLNTAASKAQYLQWGLTVPALIPYLPEIWWNGQKRALIPCWQWIPNSCLNLKWEMGDILVSPYPNMIQISMVVPETPRSHFIRKKMV

SEQ ID NO: 11694 - protein, 32 aa, Xenorhabdus bovienii
  Coding DNA sequence: Name=SeqID_5586
MNYNILMESVTYIFKESFTAFIYSVRLSIYAV

SEQ ID NO: 11695 - protein, 36 aa, Xenorhabdus bovienii
  Coding DNA sequence: Name=SeqID_5587
VCYFDELHTLDNYSQYRYILFTPCFPPETGNASTNY

SEQ ID NO: 11696 - protein, 45 aa, Xenorhabdus bovienii
  Coding DNA sequence: Name=SeqID_5588
LGILLLATLPLLFTDGYLLTSFTVEQGKSAMSVVAVKVLFYLVVC

SEQ ID NO: 11697 - protein, 73 aa, Xenorhabdus bovienii
  Coding DNA sequence: Name=SeqID_5589
LDVGAAFRITRPQVGNRGIVQVHIASLNESNVRPRGFKTSNLTFQRPGLCHCGDFPLAGCIVAPVALKNSELP

SEQ ID NO: 11698 - protein, 344 aa, Xenorhabdus bovienii
  Coding DNA sequence: Name=SeqID_5590
  Gene classification: Gene name=DesA; Function=Fatty acid desaturase; Function class=I Lipid metabolism
  Homolog annotation: Query=86..328bp; Hit=55..292bp; Blast score=64; Percent Identity=22.0; E value=1e-10; Homolog= mlr7780 COG3239
MNLNDTSVSDLRAGDSESSADVQLAPSKDKDLRSRLPREYFVKRPALFISKIVFAFALIALGWYGVGYALNTPVTIGSILVAIGGMLLSGLIYPHLVELQHECLHDHAFKSAKLNRLFGVLVGLFMFNSHSHYRYDHLRHHAYLGTEQNVEHFDYRFNDLASPKGFAIAFFDLNRYRRVFNILGAAYTGKSISGVNKEQAQRDIKQEYVFYMLMFILSVVASVYFQTWLFALAWWLPTLVIAEGAHFMIEMPEHYGLDTQSSPDVLKNTRTISTNWLIAWYVNGNHTHTAHHFHQGVPMCHVKKLNELIKPQLQVVETSYFAFYRNVISGRIRSYVDVSCKVTD

SEQ ID NO: 11699 - protein, 50 aa, Xenorhabdus bovienii
  Coding DNA sequence: Name=SeqID_5591
LLGRSVRRKLALSSRHKGRLPSAENYRLLSAGRATGKRRLRAAHKQVVLH

SEQ ID NO: 11700 - protein, 36 aa, Xenorhabdus bovienii
  Coding DNA sequence: Name=SeqID_5592
MMNTKRQQPLIKWGRNYLLLSSHLNILIMFFPYQRL

SEQ ID NO: 11701 - protein, 133 aa, Xenorhabdus bovienii
  Coding DNA sequence: Name=SeqID_5593
  Gene classification: Function=Predicted transposase; Function class=L DNA replication, recombination and repair
  Homolog annotation: Query=22..128bp; Hit=142..247bp; Blast score=87; Percent Identity=44.0; E value=4e-18; Homolog= mll8100 COG3293
LNQNPFGCRQLRFTCSFRTVWGQVNDIVHAESLVSQSPLSDFVIADKGYDSQRLRSVIEEQKSVPVIPYRKNSRKLDQKIDKCLYRYRHLVENAFARIKHFRAIATRYDKLERNYASMLALAFIIVWLPMWAE

SEQ ID NO: 11702 - protein, 120 aa, Xenorhabdus bovienii
  Coding DNA sequence: Name=SeqID_5594
  Gene classification: Function=Predicted transposase; Function class=L DNA replication, recombination and repair
  Homolog annotation: Query=1..105bp; Hit=1..107bp; Blast score=89; Percent Identity=45.0; E value=4e-19; Homolog= CC0928 COG3293
MPRTMLTDTQWDKLSAFMQHTGLIYHKTKHRQTFEGILYRMRTGIPWRDLPSEFGKGNSVFQRFNAWSKKGILHLIFNWLSGLSDTEWLFIDGSIVRAHQHSAGAASEEDEAMGQSRGGR

SEQ ID NO: 11703 - protein, 77 aa, Xenorhabdus bovienii
  Coding DNA sequence: Name=SeqID_5595
MNADSLSHCVSVNIVRGMRVKSSYFLAKTIIPNHHAVQIPLTKRQQPLGIALFFNVFDSLLKTIIAVYSSSLIGFDM

SEQ ID NO: 11704 - protein, 241 aa, Xenorhabdus bovienii
  Coding DNA sequence: Name=SeqID_5596
  Gene classification: Gene name=XerC; Function=Integrase; Function class=L DNA replication, recombination and repair
  Homolog annotation: Query=1..237bp; Hit=172..414bp; Blast score=286; Percent Identity=56.0; E value=1e-77; Homolog= Z4313 COG0582
MRYAVQNDILESSPANDISGALTTVKSKHHPALPHERLPEFLTRLARYRGRLITRIALELTLLTFVRSSELRFARWEEVDLERAIWKIPATRKPIEGVKFSERGMKMKTEHIVPLCRQAVSLIETLRGLSGDCEVMFPNDHDPKKVMSESTVNNALRVMGYDTKTEVCGHGFRTMARGAMGESALWNDDAIERQLSHIERKNVRAKHLDERRLMVQWWADYLDANREKPITPYDFAKKRRK

SEQ ID NO: 11705 - protein, 41 aa, Xenorhabdus bovienii
  Coding DNA sequence: Name=SeqID_5597
MMAVTRCCNRRAISCLVSASTALIGANRWLVLKMEISSLPI

SEQ ID NO: 11706 - protein, 119 aa, Xenorhabdus bovienii
  Coding DNA sequence: Name=SeqID_5598
  Gene classification: Gene name=XerC; Function=Integrase; Function class=L DNA replication, recombination and repair
  Homolog annotation: Query=11..66bp; Hit=8..61bp; Blast score=68; Percent Identity=55.0; E value=7e-13; Homolog= intB COG0582
MMVGYIWRSLHAAKYWRMKYRRPTDKKEDRLAFGVYPAVSLADARTKRDEAKKLLAQGIDPKIEKKGGYLSRQEHIPLNGLPVNGMPVINGGVKTTATGFCAVLSNTFSLILAGLIFPF

SEQ ID NO: 11707 - protein, 53 aa, Xenorhabdus bovienii
  Coding DNA sequence: Name=SeqID_5599
VCCISANSLSQTRSVNIVRSMMMRLNEFLAKLIIPNHHAVQITFTKRQHALGA

SEQ ID NO: 11708 - protein, 253 aa, Xenorhabdus bovienii
  Coding DNA sequence: Name=SeqID_5600
  Gene classification: Function=Predicted transposase; Function class=L DNA replication, recombination and repair
  Homolog annotation: Query=1..248bp; Hit=1..247bp; Blast score=184; Percent Identity=39.0; E value=1e-46; Homolog= mll8100 COG3293
MLRTMLTDLVWDKLFALMQHTGLVYHKAGHRLILEGILYRMRTGIPWRDLPLEFGRWNTVFVRFNAWSKKGVLNLIFKGLSGLADREWLFIDGSIVRAHQHSAGAATNEEEAIGKSRGGRSTKLHLAVDSQGLPVHFELSGGQTHDIKHAESLVNNSPASDFVIADKGYDSDAFRNIVEQTGATPVIPYRKNSRKSEKPIDKGLYRYRHLVENAFARIKHFRAIATRYDKLERNYASMLALAFTLVWLPMWAD

SEQ ID NO: 11709 - protein, 218 aa, Xenorhabdus bovienii
  Coding DNA sequence: Name=SeqID_5601
  Gene classification: Gene name=CheZ; Function=Chemotaxis protein; Function class=N Cell motility and secretion
  Homolog annotation: Query=1..218bp; Hit=1..214bp; Blast score=255; Percent Identity=70.0; E value=3e-68; Homolog= ZcheZ COG3143
MSENPVMPRDEAVTTSEIISRIGQLTRMLRDSLRELGLDQTIAQAAEAIPDARERLNYVVQMTAQAAERVLNCVEEAQPHQNELESSAKSLTQRWDEWFANPNNLELTEARSLVTDTRDYLNLVPEHVSFTNTQLLEIMMAQDFQDLTGQVIKRMMEVIQELEKQLVMVLMENMPSDQMAKAKKENDSLLNGPQVNQNGAGVIANQAQVDDLLDSLGF

SEQ ID NO: 11710 - protein, 136 aa, Xenorhabdus bovienii
  Coding DNA sequence: Name=SeqID_5602
  Gene classification: Gene name=CheY; Function=CheY-like receiver domain; Function class=T Signal transduction mechanisms
  Homolog annotation: Query=8..136bp; Hit=1..129bp; Blast score=192; Percent Identity=81.0; E value=7e-50; Homolog= cheY COG0784
MKFQGVFMASKDLRFLVVDDFATMRRIVRNLLKELGFNNVDEAQDGAEALAKLRAAEFDFVISDWNMPNIDGLELLKIIRSEEKLAALPVLMVTAEAKKENIIAAAQAGASGYVVKPFTAAILEEKLNKIFEKLGL

SEQ ID NO: 11711 - protein, 350 aa, Xenorhabdus bovienii
  Coding DNA sequence: Name=SeqID_5603
  Gene classification: Gene name=CheB; Function=Chemotaxis response regulator containing a CheY-like receiver domain and a methylesterase domain; Function class=N Cell motility and secretion
  Homolog annotation: Query=1..350bp; Hit=1..349bp; Blast score=512; Percent Identity=77.0; E value=1e-145; Homolog= cheB COG2201
MNKITVLCVDDSALMRQIMREIINSHPDMEVVDCAPDPFVARDLIKKHNPQVLTLDVEMPRMDGIDFLEKLMRLRPMPVVMVSSLTAKGSEITLKALELGAVDFVTKPQLGLREGMLAYSELIAEKIRAAAQAKISTMPSSPVIATPLNFKPLLSSEKLIAVGASTGGTEAIKNLLQPLPVTSPALLITQHMPPGFTRSFAERLNKLSQITVKEAENGERVLPGHAYIAPGDHHMELCRSGANYQIMTTRAPPVNRHRPSVDVLFRSVAKHAGRNAVGVILTGMGSDGAAGLLEMKQAGAYTLAQSEASCVVFGMPRAAIQLGAIDDVMDIQKISKTMLAKISAGQSIRI

SEQ ID NO: 11712 - protein, 296 aa, Xenorhabdus bovienii
  Coding DNA sequence: Name=SeqID_5604
  Gene classification: Gene name=CheR; Function=Methylase of chemotaxis methyl-accepting proteins; Function class=N Cell motility and secretion
  Homolog annotation: Query=1..289bp; Hit=1..285bp; Blast score=352; Percent Identity=64.0; E value=3e-97; Homolog= cheR COG1352
MKSNLAASDTDAISPLNFMFQRHILSDAQFERICQFIYQRAGIVLAKNKREMVYNRLVRRLRVLGINDFGQYLSILEQNIHSKEWELFINALTTNLTAFFREAHHFPILAAHASRKNGGTYRVWSAAASTGEEPYSIAMTLCDALGHRTNRIKIIGSDIDTHVLEKARQGVYRLEELQHMSDSQKKKYFFKGIGLFEGYARVRPALAELVSFQHLNLLDSDWTLEGKFDAIFCRNVMIYFDKKTQERILRRFVNFLKPDGLLFAGHSENVTQISREFYLQGQTVYGVGRRAGRGHE

SEQ ID NO: 11713 - protein, 543 aa, Xenorhabdus bovienii
  Coding DNA sequence: Name=SeqID_5605
  Gene classification: Gene name=Tar; Function=Methyl-accepting chemotaxis protein; Function class=N Cell motility and secretion
  Homolog annotation: Query=1..515bp; Hit=1..517bp; Blast score=392; Percent Identity=50.0; E value=1e-109; Homolog= Ztsr COG0840
MLGRLRISTSLYLLLMMFCVMQIISSGLSLGIIHTDQSYIERIDLGTKRRDTLGLSWAAMLQTRNTLNKIAIGQKVGQSQDQIDAMEALLKSSLNEAERNFAQFSALPQIEKNDQSVALLAAVERSYQEYINALKELKTYLYEGNFQAFLDQPTENYQRQLEVAYNNYMQYLGHNISTAVSDGAFYYKVSIAMFFGSILMVFVVSASAHWWMRRNLLRPFDNMRACFQDVAEGRLNKEIAVTTSDEIGDIFRKLRDMQKSLIKSIASVRDNTNQMYAGIQEITQGNTDLSSRTEEQAASLEETAASMEELTVTVKQNAENARQASELAVSASQTASKGGELTVSVVATMDEIANSSKKISAIISVIDGIAFQTNILALNAAVEAARAGEQGRGFSVVAGEVRDLAQRSAEAAKEIKTLIDESVHRVNQGSELVNNAGNTMDELVKSVNQVTELMAEIAAASDEQSRGIHQVAQAVSQMDQVTQQNAALVEQSAAAAAALEDKADTLVKTVALFELPEGLDNEYDHQTPSASKMTDEYIASQIR

SEQ ID NO: 11714 - protein, 563 aa, Xenorhabdus bovienii
  Coding DNA sequence: Name=SeqID_5606
  Gene classification: Gene name=Tar; Function=Methyl-accepting chemotaxis protein; Function class=N Cell motility and secretion
  Homolog annotation: Query=1..563bp; Hit=5..551bp; Blast score=508; Percent Identity=55.0; E value=1e-144; Homolog= tsr COG0840
MKIVTGLISVIILFGALQFISGGLFFNGLKNDTEAFDLLDKMRQQQKLLDESWINLLQARNNLNRVGIIYMMKERDLDGTYQIDDVLAESKVNLARGERRFEQFEQLKKLPIHDPDHLQRLKQTHHEYLNALKELDGFLAKKQYKEFFAQKTTDYQNAFNVEYDYYLNQDQKLYDEVAREADIAYRNIIISLISVFVLLILVMAVSWISLRKALINPLNKLLENIKAFSKGDLTQTINVSGTNEMGMLAVGLRHMQDELIHTVRSVHQSTETIYTGTSEIAAGNNDLSSRTEQQVASLEETAASMEQLTATVKQNADNARQASNLADNASDIARQGGKVVANVVQTMHDIADSSRKISDITGVIDAIAFQTNILALNAAVEAARAGEHGRGFAVVAGEVRNLAQRSAEAAKEIKSLIEDSVDRTDTGSVLVESAGETMNKIVDSVTRVTDIMGEIASASDEQSRGITQVGVAISEMDRVTQQNASLVEQSAAAAAALEEQAMILTKAVALFQLPEQAERKQSEKRKHEVLSTIKSPTPPANKTNPPMLKKGSNVEDPSNWETF

SEQ ID NO: 11715 - protein, 48 aa, Xenorhabdus bovienii
  Coding DNA sequence: Name=SeqID_5607
MPVLSAPLKGTLCVIQKIEFLHYFFDLKQLRLPFCSTDYNEWQQSRQP

SEQ ID NO: 11716 - protein, 165 aa, Xenorhabdus bovienii
  Coding DNA sequence: Name=SeqID_5608
  Gene classification: Gene name=CheW; Function=Chemotaxis signal transduction protein; Function class=N Cell motility and secretion
  Homolog annotation: Query=1..163bp; Hit=1..163bp; Blast score=234; Percent Identity=79.0; E value=3e-62; Homolog= cheW COG0835
MSAIEEFSKLSGETTGKEYLVFTLGDEEYGIEILKVQEIRGYDQVTRIANTPSFIKGITNLRGVIVPIIDLRIKFSQENITYNDNTVVIVLNLLNRVVGIVVDGVSDVLSLKDDQICPAPEFAVTLSTEYLTGLGSIDERMLILVDIEKLLNSEEMALVDSVAKS

SEQ ID NO: 11717 - protein, 721 aa, Xenorhabdus bovienii
  Coding DNA sequence: Name=SeqID_5609
  Gene classification: Gene name=CheA; Function=Chemotaxis protein histidine kinase and related kinases; Function class=N Cell motility and secretion
  Homolog annotation: Query=1..706bp; Hit=3..647bp; Blast score=808; Percent Identity=63.0; E value=0; Homolog= ZcheA COG0643
MDITAFYQTFFDEADELLDDMEQHLLLLDADEPDHEQLNAIFRSAHSIKGGAATFGFAKLQQTTHVLENLLDSARRDEIRLTTDIINLFLEAKDIMQQQLDAYKSSQEPDEDTFNYICETLRQLALELQEDKQDESADTAAPAIQPEPALKETVLEAEEEQAVVINQPEEKNLPAGKTDQGRIRVHLSGLKEREVSLMKDELGHLGDVYDVEQTADSLEASLITSATEDDITAVMCFVIETEQITFLPVADSHPAETEADTQSEKKPAAEGVAIESRVAVSTISTDKPQSADVPQKSEVHEVGRPAPRPVAGSPRQRVESSSIRVAVEKVDQLINLVGELVITQSMLAQHCDGLEQTKHSELLSCMAQLQRNSRDLQESVMSIRMMPMEYVFSRYPRLVRDLAGKLNKKVELTLIGSSTELDKSLIERIIDPLTHLVRNSLDHGIENPEKRIAAGKSETGNLTLSAEHQGGNICIEVIDDGAGLNREKILAKARSQGLNISENMSNEEVAMLIFAPGFSTAEVVTDVSGRGVGMDVVKRNIQDMGGQIQISFQEGKGTIIRILLPLTLAILDGMSVKVNSEVFILPLSAVVSSLQPQEEDIYPLAGDEKLLQVRGEYLPLLELYRIFDISNGETSPTKGIAVIVQSAGRRYALLVDKLVGQHQVVVKNIESNYRKVPGISAATIMGDGSVALIIDIPALQKLNHEQLATRKAELVNKKITQ

SEQ ID NO: 11718 - protein, 333 aa, Xenorhabdus bovienii
  Coding DNA sequence: Name=SeqID_5610
  Gene classification: Gene name=MotB; Function=Flagellar motor protein; Function class=N Cell motility and secretion
  Homolog annotation: Query=2..307bp; Hit=4..307bp; Blast score=333; Percent Identity=57.0; E value=1e-91; Homolog= motB COG1360
MRANNVTVIRVKKRKKHGEKHCGGSWKIAYADFMTAMMAFFLVMWLLSIASPQELTSIADYFRTPLQVAINQGPQSSDSTNPIPGGGDEVFQQDGEVFRESKLVESNEEKRRLNRLHQQLDQLIITDPRLKELRPHLLIDMMDEGLRIQIIDRENRPMFMVGSAKVESYMRDILQAIAPILNGIPNKVSLSGHTDNLQYANGQRGYSNWELSTDRANASRRELLNGGLDEVKILRVVGMASTVSMQKGIDPNAPVNRRISIIVLNKDAEKRIEQENSGGDAMTANSSMDMQEVIRTDSNKGAPSQQPTEQSSEITISVQTQTEPSSDTNKVTE

SEQ ID NO: 11719 - protein, 293 aa, Xenorhabdus bovienii
  Coding DNA sequence: Name=SeqID_5611
  Gene classification: Gene name=MotA; Function=Flagellar motor component; Function class=N Cell motility and secretion
  Homolog annotation: Query=1..293bp; Hit=1..293bp; Blast score=434; Percent Identity=75.0; E value=1e-122; Homolog= motA COG1291
VLVLLGYVVVFGAVIGGYLLVGGHMGALYQPAEFLIIAGAGIGAFIVGNNGKAIKATLRVLPKVLRRSKYNKAMYMDLMALLFRLLSKSRQNGLLALERDIENPHQSDIFTQYPRLLKDPYLMDFITDYMRLIISGNMNPHEIEALMDEEIETYEQESEVPATSLAMVGDSLPAFGIVAAVMGVVHALGSADRPAGELGALIAHAMVGTFLGILLAYGFVSPLATLLRQRSSEQVKMMQCIKITLLSSLNGYAPQIAVEFGRKTLFLTDRPSFTELEEHVRRVKSPVQQEVEE

SEQ ID NO: 11720 - protein, 193 aa, Xenorhabdus bovienii
  Coding DNA sequence: Name=SeqID_5612
  Homolog annotation: Query=1..193bp; Hit=1..194bp; Blast score=370; Percent Identity=93.0; E value=1e-101; Homolog= sp|Q9X9F3|FLHC_XENNE
MVEKSIVQEAKDIHLAMELITLGARLQMLESETQLSRGRLIRLYKELRGSPPPKGMLPFSTDWFMTWEQNIHSSMFYNAYRFLMKSGHCDGVEAVVKAYRLYLEQCPPSSEGGPVLALTRAWTLVRFVDSGMLQPTECRCCGGTFITHAHQPVNSFVCSLCQPPSRAVKKRKLSALPADTNSQLLDGFAQQAM

SEQ ID NO: 11721 - protein, 116 aa, Xenorhabdus bovienii
  Coding DNA sequence: Name=SeqID_5613
  Homolog annotation: Query=1..116bp; Hit=1..116bp; Blast score=176; Percent Identity=96.0; E value=5e-44; Homolog= sp|Q9X9F2|FLHD_XENNE
MSTVELLKHIYDINLSYLLLAQRLINHEKASAMFRLGISESMADTLAELTLPQLVKLAETNQLICHFRLEDHETVLQLTKESRVDDLQQIHTGILLSTHLFQQLSALDDISIKKRA

SEQ ID NO: 11722 - protein, 39 aa, Xenorhabdus bovienii
  Coding DNA sequence: Name=SeqID_5614
MLINFTPESSTYTTENICHFKYYVTYITKLTLFIMILAH

SEQ ID NO: 11723 - protein, 50 aa, Xenorhabdus bovienii
  Coding DNA sequence: Name=SeqID_5615
VEERSLPPLSRGKFSKHFENLTKVYIFYRHFKFRSLIDRINQKTVLNIFI

SEQ ID NO: 11724 - protein, 54 aa, Xenorhabdus bovienii
  Coding DNA sequence: Name=SeqID_5616
VTSVVLNSSGFCCVLEALSALFTLRQGCRCFLFQHHTVFYLIFVICVIFMRKVA

SEQ ID NO: 11725 - protein, 43 aa, Xenorhabdus bovienii
  Coding DNA sequence: Name=SeqID_5617
LLFLLIDYLIPTINKINLSLKACSFFIMLRIINVYAIYTERSD

SEQ ID NO: 11726 - protein, 68 aa, Xenorhabdus bovienii
  Coding DNA sequence: Name=SeqID_5618
LHSLFRIQSVFSSFNWILCYKNLLLNLYLGVILFLFFMLFKEINFLLMGDFSFAYTVSHSVLYKWHKH

SEQ ID NO: 11727 - protein, 53 aa, Xenorhabdus bovienii
  Coding DNA sequence: Name=SeqID_5619
LNRYFYMIYCYLYFKLSKIISFFIFIYSVCIPCFVFKVFFLLLIGFYVIRIYC

SEQ ID NO: 11728 - protein, 59 aa, Xenorhabdus bovienii
  Coding DNA sequence: Name=SeqID_5620
  Gene classification: Gene name=MgtA; Function=Cation transport ATPases; Function class=P Inorganic ion transport and metabolism
  Homolog annotation: Query=1..58bp; Hit=812..869bp; Blast score=72; Percent Identity=60.0; E value=1e-13; Homolog= PA4825 COG0474
MEGQLSQALAVHMLRTQKVLFVQSIAVLPVLLTTSIIMTLGIYIPFLPFDVLIGLQSLL

SEQ ID NO: 11729 - protein, 62 aa, Xenorhabdus bovienii
  Coding DNA sequence: Name=SeqID_5621
VISKIENVVPNPIIKYPIFFTSICEGFSITLYPFCLTTKTVVKYRTLGFVQANRWLTSVKME

SEQ ID NO: 11730 - protein, 31 aa, Xenorhabdus bovienii
  Coding DNA sequence: Name=SeqID_5622
MANISKNGINTLEISIENTFTKSNWLSYLNT

SEQ ID NO: 11731 - protein, 103 aa, Xenorhabdus bovienii
  Coding DNA sequence: Name=SeqID_5623
MIFPNVSLLFITRSPNTIKFLSNKMISSDSFAVLVLVSTEIPISAYRNVDISFIPLPKKLTVYLLFCNDFKMRDFSVGLTYKMLFLIPLLLKGLHHSQIQYQN

SEQ ID NO: 11732 - protein, 154 aa, Xenorhabdus bovienii
  Coding DNA sequence: Name=SeqID_5624
  Gene classification: Gene name=MgtA; Function=Cation transport ATPases; Function class=P Inorganic ion transport and metabolism
  Homolog annotation: Query=15..148bp; Hit=490..623bp; Blast score=114; Percent Identity=45.0; E value=5e-26; Homolog= PA4825 COG0474
MSSVCSHMRLKEKIISLTEENRNNVMGLVNLYKEQGFRGLILVTGELSLDEVKHPFSVADEKERVLQGLLTFLDLPKVSVAMAMAALRENDVSAKVLNGDSPVITAEIYRDVGLDPRNIFINFDIEFASDEDLSKEVELRTAFCKLTPRKSHAF

SEQ ID NO: 11733 - protein, 51 aa, Xenorhabdus bovienii
  Coding DNA sequence: Name=SeqID_5625
MDLMDQAIVRYGSEKLVLVFSPATEKLMSYLLILLDVACQFLFKNSSKSAN

SEQ ID NO: 11734 - protein, 62 aa, Xenorhabdus bovienii
  Coding DNA sequence: Name=SeqID_5626
MLLAMIIFFTDYFLSSRHENEINITNIIIILIIISFSGLFLFWQVRDFSIPLGIAKQAALWI

SEQ ID NO: 11735 - protein, 203 aa, Xenorhabdus bovienii
  Coding DNA sequence: Name=SeqID_5627
  Gene classification: Gene name=SapB (BS); Function=Uncharacterized membrane protein; Function class=S Function unknown
  Homolog annotation: Query=13..197bp; Hit=13..228bp; Blast score=177; Percent Identity=48.0; E value=8e-45; Homolog= PA4635 COG1285
MLLTPIAIHLLSAMFFGALIGAERQWRQRIAAQIVFGIGFLGAGVIMRQGMNIRGLNTAATLWCSAGIGVLCGLGQYWSASIATGIILCANILLREAAQRINTQPYQQALDLEQRYKIHIVCDIHDEILVRTLILQAINGLGVRLQSLSSADANATQPDRLEVCAEILATPTEQKEIESIVCRVSLEKSVSSVNWKIATELPA

SEQ ID NO: 11736 - protein, 57 aa, Xenorhabdus bovienii
  Coding DNA sequence: Name=SeqID_5628
MSYDDTIYSPELNLIEIIWKQAKYHWRRFITWTQDTVEYELNTLLEGYGAKFAINFS

SEQ ID NO: 11737 - protein, 117 aa, Xenorhabdus bovienii; identical to SEQ ID NO: 7849
  Coding DNA sequence: Name=SeqID_5629
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 11738 - protein, 163 aa, Xenorhabdus bovienii; identical to SEQ ID NO: 7546
  Coding DNA sequence: Name=SeqID_5630
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 11739 - protein, 128 aa, Xenorhabdus bovienii
  Coding DNA sequence: Name=SeqID_5631
LLDKIKAGARAGRYRLVYFDEAGFAASPPVQYGWSPRGKPHETEPQHHDRRSVLGALNYTDNTLFYQAPSGSITRADVIDFLEQVAKQGDNRLTFLVLDNARIHHGIEKKIRNRWLREHNLLLFYLPA

SEQ ID NO: 11740 - protein, 146 aa, Xenorhabdus bovienii; identical to SEQ ID NO: 8316
  Coding DNA sequence: Name=SeqID_5632

SEQ ID NO: 11741 - protein, 52 aa, Xenorhabdus bovienii
  Coding DNA sequence: Name=SeqID_5633
VAKIFIYNVWELFFNYGLKIILSYLVNRTSINKTKLINEIICTFVIVGNTIH

SEQ ID NO: 11742 - protein, 50 aa, Xenorhabdus bovienii
  Coding DNA sequence: Name=SeqID_5634
MSCTHPTKDYLILRIYCIEFLIKYQQKLYRGIHNVVIYSLLISSGNIQII

SEQ ID NO: 11743 - protein, 70 aa, Xenorhabdus bovienii
  Coding DNA sequence: Name=SeqID_5635
  Gene classification: Gene name=CspC; Function=Cold shock proteins; Function class=K Transcription
  Homolog annotation: Query=4..70bp; Hit=3..69bp; Blast score=110; Percent Identity=91.0; E value=4e-25; Homolog= cspC COG1278
MSDKMKGQVKWFNESKGFGFITPADGSKDVFVHFSAIQGNGFKTLAEGQNVEFTIENGAKGPAAANVTAI

SEQ ID NO: 11744 - protein, 80 aa, Xenorhabdus bovienii
  Coding DNA sequence: Name=SeqID_5636
LNGREVNEYVFATISWSDETKAFRLVEPLHLTFHFVRHLTFLYIKKNSPPRACVGQYQLLLMEALRRKRSTKATRDSTYT

SEQ ID NO: 11745 - protein, 35 aa, Xenorhabdus bovienii
  Coding DNA sequence: Name=SeqID_5637
MPFLRLACPEHTPVYQLPYFIYKIVIVWKQYRYFC

SEQ ID NO: 11746 - protein, 196 aa, Xenorhabdus bovienii
  Coding DNA sequence: Name=SeqID_5638
  Homolog annotation: Query=28..183bp; Hit=1..156bp; Blast score=202; Percent Identity=66.0; E value=2e-51; Homolog= ref|NP_929116.1|
VCSGHASLKNGITFNSITRFYNNRVSIMNIIKQILIQDLKRINLEEHRDGKVHFNSIFIRHHPYLCLGMVTAYAFLVMLMGYSPYFGTWSLILFTVLFVAMAAVLLFDIKPVYHFEDIDVLDLRVCYNGEWFVNEKVSHKAINKILTHPKVPSEMKDEIKRIMRKKDGICFYDVFIVAFSEQSPYFHPSEMVNKSA

SEQ ID NO: 11747 - protein, 61 aa, Xenorhabdus bovienii
  Coding DNA sequence: Name=SeqID_5639
MCNMMIFCYFLQQNISITAIFHTLLNLLSLLCSVLGTTLIKIQQIDVKNKEQIYQREKGAL

SEQ ID NO: 11748 - protein, 250 aa, Xenorhabdus bovienii
  Coding DNA sequence: Name=SeqID_5640
  Homolog annotation: Query=4..162bp; Hit=2..159bp; Blast score=147; Percent Identity=46.0; E value=1e-34; Homolog= ref|NP_774990.1|
MDRIRLINQILQPETIIFLRQRMGLFQEELGRIMGMTLRPWQRKEACSKELKQQYDSSTLTLGESNFLLLIADKHPNYRLTTQFKESRVISEQPTAENVRQLRGALGLTPQEMATQMGYTVSAWRSKEQASKRGIKLKQGEYNLLLVLAGMHSKMEVTTKLKEDPPELLQQQKGVIQAELGQIMSFTPSELAQIKDTSGEEFTQYNFNALMPGEYSFLLLVLDKHPNYRLTTPFNATQVINERPTVENIE

SEQ ID NO: 11749 - protein, 83 aa, Xenorhabdus bovienii
  Coding DNA sequence: Name=SeqID_5641
  Homolog annotation: Query=1..80bp; Hit=88..167bp; Blast score=112; Percent Identity=65.0; E value=2e-24; Homolog= ref|NP_774989.1|
MKKVYYDEGFSGNNKYTFEVYELDDGSYKAVARRWNRKLNLVNVETHFVATTRADLREQNYPRTRQVKIFLNSDFWSNQNGQD

SEQ ID NO: 11750 - protein, 67 aa, Xenorhabdus bovienii
  Coding DNA sequence: Name=SeqID_5642
MNEFDTNTLINVSSQLTGRTLALSPTSADVSTDDKGTGTQPKEETVQTDPNEAETRANSAKMFSDDD

SEQ ID NO: 11751 - protein, 85 aa, Xenorhabdus bovienii
  Coding DNA sequence: Name=SeqID_5643
MTGYELRLWRKAQGWTQERTAEELGIHIRTYKGYEKVNRRVSKIIQLASQVLSLRSDLSIMQAMSREQLLIYLYNTLNKELADEP

SEQ ID NO: 11752 - protein, 335 aa, Xenorhabdus bovienii
  Coding DNA sequence: Name=SeqID_5644
  Homolog annotation: Query=1..334bp; Hit=17..349bp; Blast score=322; Percent Identity=48.0; E value=4e-87; Homolog= ref|NP_455494.1|
MQGKNRFIQLSVPFRMLKRVLASDDSGHVLDRSQREINRNRVNGIYNYLMNSRENNSDICLPPLVGNCDQNIDFQFFCNSVVGMARIPMDSVITLFDGQHRAAAIMKFADKCLGHYSIPIMMYKKLELKTRQQFFSDINNNASKPSATISMAYNGRDKLTNMVRDILKENPVLSDATDFEHNVVKSKSDYFVSFKALCDATRKFAVNGEQIASAEEIDAVWSSWVNFSALNDIKGVVEQVQYRKEYIQFHAVMVNAFGYAVRQLAQETELKKIPAMIDSFAVEIDASKREEFFFIKNWNGICTRVENDRSTIIASVSAQKATAEKLADAIRRRSV

SEQ ID NO: 11753 - protein, 169 aa, Xenorhabdus bovienii
  Coding DNA sequence: Name=SeqID_5645
MNLKPIPRTLNVTLHRVTERDHVTVHVDFSTEADLDTDQLELSLCRLQGCNSLLSLEYDVLTGNGCFSLMNKPPELSVYTVCYPLLPIVRLHASLTFGVVTEEETLTHIAGDRIGVFQTLCGTETVSQQVNSLCPVDEVRVTCERCQAIWQRCQLFTAQDFATKQEENA

SEQ ID NO: 11754 - protein, 298 aa, Xenorhabdus bovienii
  Coding DNA sequence: Name=SeqID_5646
  Gene classification: Gene name=LysR; Function=Transcriptional regulator; Function class=K Transcription
  Homolog annotation: Query=7..289bp; Hit=4..286bp; Blast score=358; Percent Identity=68.0; E value=5e-99; Homolog= cynR COG0583
MIVMNFRYIRYFLAVAEHHGFTRAATALHVSQPALSQQVRLLEESLGVQLFDRSGRNTRLTDAGEVYLQYVYRAFQELDEGKRAIHDVEDLSRGSLRVAVTPTFTTYFIGPLVAEFYTRYPHITLQIQEMSQERIEERLINDDLDIGIAFDGGESPGIASRILLTETLSLIVAYHHPRAQQRKIALNELNDEKLILLSAGFATREQINRYFCEAGLRPQVQMEFTSISAVLDVIRRTSLSTLLPAAIAMQNNDLVAIPLADWQLERTGVLMQRKGAWQTTAARVFIEVAQALGHVLNS

SEQ ID NO: 11755 - protein, 468 aa, Xenorhabdus bovienii
  Coding DNA sequence: Name=SeqID_5647
  Homolog annotation: Query=141..351bp; Hit=1..213bp; Blast score=279; Percent Identity=60.0; E value=7e-74; Homolog= gb|AAK09054.1|
MQFTIQIAVADESGHSHTETLFRVEKQSDTPNDIGLSLSESKLLLNAIQQSVIQKQAAEYLSEHRACPHCQRNRRIKGKQTILYRTLFGIIPVEGFRVYRCACEKHSTHTVSLLNNWCDTHTHPELRYIETRWASLMSYGLTANLLKDILPVGERCNAATVRNHLCQTAKRQEAELDGLPDFLPGDPREWEKLPKPGKPMAVGIDGGYVRNRDDRKHHFEIIAGKSFSATVPAKRFGFVQCLENHPRRKLLAQLSSQGMQANQQITFLSDGADNLRDLQFNLYPESQHVLDWFHITMRLTVLKQYAKGVSKNAPELGAELLDVLTSTKWSIWHGNVDKALEYLDHCALICDDDTLHYENHKSLLKHLDEMYTYIENNSMMIPNYGEMYRYGEPISSSFVESAINEVIAKRMVKKQQMQWSQQGAHYLLQTRTAVLNNDLKARFEHWYPGIKLGEETERYLTEAEAIAA

SEQ ID NO: 11756 - protein, 193 aa, Xenorhabdus bovienii
  Coding DNA sequence: Name=SeqID_5648
  Gene classification: Gene name=PinR; Function=Site-specific recombinases, DNA invertase Pin homologs; Function class=L DNA replication, recombination and repair
  Homolog annotation: Query=5..182bp; Hit=9..181bp; Blast score=103; Percent Identity=37.0; E value=1e-22; Homolog= DRC0005 COG1961
MHYAYIRVSSVDQHVERQKEALFASGIEIDKMYVEQASAKNINRPQLQDMLQQVRTGDTIVVHSIDRLCRNMMDMCSLTLRLRQQGITLIFLKEQLSFNANECTPMQELQLHMMSAFSQFERALIRERQTEGIAAKKQRGERTGRPPADISKLPPIDALRAKGIKLKLACDNVGLGVSTYYKLRHQLKNGGIQ

SEQ ID NO: 11757 - protein, 193 aa, Xenorhabdus bovienii
  Coding DNA sequence: Name=SeqID_5649
  Homolog annotation: Query=1..192bp; Hit=7..198bp; Blast score=211; Percent Identity=51.0; E value=6e-54; Homolog= gb|AAK09056.1|
MPVYTVKAAIRDVSPMIWRRFRIQSDMSLGAFHFLLQFAFGWDNDYLHTFHIYGKDYGISYEGGLSFYNDPWAVSLASFHFENRDKFTYEYNFYRHGLLDIRIEAIEPDSNKSTPFCLSGQGMPDVTQYDEIEATLKLLEAIVESDDSTTFGDIQEFIDEFNRVKFNRHRLNRLLKDYDFYTPNYSQGLDWIL

SEQ ID NO: 11758 - protein, 231 aa, Xenorhabdus bovienii
  Coding DNA sequence: Name=SeqID_5650
  Gene classification: Function=Putative transposase; Function class=L DNA replication, recombination and repair
  Homolog annotation: Query=7..165bp; Hit=27..185bp; Blast score=211; Percent Identity=67.0; E value=3e-55; Homolog= XF2303 COG3316
MPLSRNAFKRLHYPVDIIAQCVRGYLAYALSLRNLEEMMAERGIAVDHSTLSRWVHRRVPLLVKRYRRCRPDVGHRWRMDETDIKIKGQWKYLYRAVDSGGKTVDFLLTARRDKAAALRFFKKAMRQHGQPDVVTMDKSGANKAAVDELNQGKPKEEAIVIRQNKYLNNLIEQDHRNIKRRIHPMLGFKHFRRAQTLLSGIELVSMLRKGQYPQEPECFLSPADFFYQLAA

SEQ ID NO: 11759 - protein, 47 aa, Xenorhabdus bovienii
  Coding DNA sequence: Name=SeqID_5651
MLGFKSFRRAQTILAGIERVSMLRKGQYSQSEDKTLSPAEMFYRLTE

SEQ ID NO: 11760 - protein, 48 aa, Xenorhabdus bovienii; identical to SEQ ID NO: 6457
  Coding DNA sequence: Name=SeqID_5652

SEQ ID NO: 11761 - protein, 172 aa, Xenorhabdus bovienii
  Coding DNA sequence: Name=SeqID_5653
LDAFNTKRDPVGKGRRLAMQQPHAQLDEIYILERTHCQLQGDGDAHYFMKSIEPITLHVPDGHYLYVIYTDMPLTVICGLYDPNRIPTIGHTSLIKGRIRLYGKNKNISQLDDKDIDYAKYPVLLAGELFFDDGRLTMWNNRSGHYFPKGDKVVLNATNCILPQKLFRQVWG

SEQ ID NO: 11762 - protein, 231 aa, Xenorhabdus bovienii
  Coding DNA sequence: Name=SeqID_5654
  Gene classification: Function=Putative transposase; Function class=L DNA replication, recombination and repair
  Homolog annotation: Query=3..166bp; Hit=23..186bp; Blast score=198; Percent Identity=61.0; E value=4e-51; Homolog= XF2303 COG3316
MPLIRKAFKRLHYPVDIIAQCVRWYQAYALSLRNLEEMLVERGITVDHSTLSRWVHRLIPLRVKRYRRSKPAVGRRWRRDETDIKIKGQWRYLYRAVDSDGNTVDFLLTAHRDKEAALRFFKKAIRQHGQPDGVTMDKSGANKAAVDELNKEKTKDNDIIIRQNKSLNNLIEQDHRHVKRRTHPMLGFKNFRRAQTVLAGIELVCMLRKGQYRQKEGGPISPAAFFYQLAE

SEQ ID NO: 11763 - protein, 241 aa, Xenorhabdus bovienii
  Coding DNA sequence: Name=SeqID_5655
MAEMLAQLAGTRGYYATIMPFMPLHQALEVARYYPHARVLMHSAEATLSVPAGGLDSQLQQLCSHHRVRTNAELAAFSRLGNRVEWCRLDDYLLEAAAELITNNRGKYGSHQGIDWMQRIFDGQKKSSVINTAVAAVAKRGEQILGVTIFYRFGETLHARYYGSNYQIDDNDFRYFVLTYYDSLDYVAKNGSCECRLSISALRAKTGSVALSDHQVSSPVFERVQSDAPDPKSVQTSALPC

SEQ ID NO: 11764 - protein, 180 aa, Xenorhabdus bovienii
  Coding DNA sequence: Name=SeqID_5656
  Gene classification: Function=Putative transposase; Function class=L DNA replication, recombination and repair
  Homolog annotation: Query=3..164bp; Hit=23..185bp; Blast score=224; Percent Identity=68.0; E value=5e-59; Homolog= XF2303 COG3316
MSLIRKAFKRLHYPVDIIAQCVRWYLAYALSLRNLEERMTERGVRVHSTLSRWVIRLTPLLGKAFRRHKRPVARRWCMDETYIKIKGQWKYLYRAVDTSGQTIDFLLTANRDTAAALRFFRKALRHHGEPDIITLDKSGANTAAIALLNTDKSKEKTIKIRQNKYLNKIIETLNVGYGRY

SEQ ID NO: 11765 - protein, 119 aa, Xenorhabdus bovienii
  Coding DNA sequence: Name=SeqID_5657
  Gene classification: Gene name=Tpx; Function=Peroxiredoxin; Function class=O Posttranslational modification, protein turnover, chaperones
  Homolog annotation: Query=1..119bp; Hit=49..167bp; Blast score=187; Percent Identity=78.0; E value=1e-48; Homolog= tpx COG2077
VLNIFPSIDTGVCATSVRKFNQLASELDNTVVLCVSADLPFAQSRFCGSEGLSNVVTLSTLRGWKFQEDYGVAISEGPLAGLTARAVVVLDENNQVIYSQLVDEITNEPDYDSALAALK

SEQ ID NO: 11766 - protein, 638 aa, Xenorhabdus bovienii
  Coding DNA sequence: Name=SeqID_5658
  Gene classification: Gene name=VgrG; Function=Uncharacterized BCR; Function class=S Function unknown
  Homolog annotation: Query=3..630bp; Hit=8..655bp; Blast score=380; Percent Identity=34.0; E value=1e-105; Homolog= PA0095 COG3501
MERIIIAHSSLGDESLLFKSLKGKEKLSTIYSFEVELFSEKKDLDIKELRNKPLSIEIKNSTNISEKSRFLSGIIREATICDYYDHYYYLYKVIIQPELFILTLNKDFRIWQKKTVPEIISDVLNKYKIKFKNELNAKYQPLEYCTQYKETDFDFLSRLMEREGIYYYFQHDKNDHTLILADSPQSHSALPEQASIEYYPSHFSPRNKDKNYLYDWIVSYSINPKFYTMSDYNFLKPNAQLKETQQNPDPTVPKTELFEWPGNYTENAQGQFYVRILQQSYTAQDLYIKAKSIESGIAPGYTFTLSKALRDGDNGDYLIVSANYEFHENPYILGDNTADADNINKIITEFTAIPAKVNWRAPRTTSWPIAGTERATVVGASGKTIWTDEHGRVKLKFHWDRSDIKDDKSSCWVRVSNNWAGSKFGVMQVPRVGEEVIVNFINNNPDEPLVVGRSFNQNNMPPWELPAEATKMGIMSRSLEGGKDNASYLLIDDAQGKESFEIHAEKDMTVSVEHDQTVSIDGASITKIKNKQQTTVTNGKEVEVTSGGIQYKITDGYKADITGDKSEKISGSYQLEVGRNFANNISGNYNLNITGNKKESVTGNAEIKASKLSLASSTTIDINGAAKISITAGLILLG

SEQ ID NO: 11767 - protein, 836 aa, Xenorhabdus bovienii
  Coding DNA sequence: Name=SeqID_5659
  Gene classification: Function=Uncharacterized low-complexity proteins; Function class=S Function unknown
  Homolog annotation: Query=517..819bp; Hit=24..331bp; Blast score=84; Percent Identity=25.0; E value=6e-16; Homolog= slr1819 COG1357
MALTDMGASPRLRPEPELWQLAEAELKTTNGVVDLAIPKSSAEFLATGYAYTHHQPDKTTCSARIQIEQLDKTLIVSGDRHWIGDKPSTPQAFEQMRLDWSRAFGGKNYEENPYGIGFTPELQENGLETHRLPNVEAQNRQLLSLQDTPNPASFCPLEFGWPRRFTRIGKKYDKEWLENEFPGFSRDIDWRLFNAAPRDQWWEHYQTLPENAAWRIWNMHPEKPMQEGKLPPWQARCFIKRLRADEEIFEEIAMRNTTVWFFPHREQMILIWHGYTRVNEDDATDVLHMLSAIELNSEAHSENDYLQVLNQRTEKEKGALYALREKDLIPESIIGPWIDTEQSEHGSPLRENLQNREKRLREQHKERMAKYGKDISTLITPYIEQPANPKADELPEFVDKIEQEAAQKYIAAEQQREKIRTIAQEQGVKVEQVAMQNAPRGPQNFHQIRDILYQQQESQKQVEPKSIELNDKKLTQIEQSLHKMYLASAQTQPPALRLTGDLSQIIRKQVQRIMREGGDFRAMDFTGADLSGMDLQGANFSGSLLESACFNNSQLDGADFSEAMLARAEICHASLYGAKLDNASLAQAKCEQSDFSAASFKETQLQETLLNHCRFNHAIFTDLFLQRTFIKHCRFQHSQWQGCIFIEMMLPALKFSYASLNKVSFINCLLENAIFDHAVLESCSWIETEAVAIRFRSAKLLNCVFTMKSVLNQADFGYATLTECNLRQTPLVQASFHSATLNNSDFSEANCQLADMQYLNTTQSIFIRTNFKNALLNNANLIGAFMQKCTFCSTDLHEANLFRADMSQSIIDDSTLIHHAYTQRIKTLPKRDQDVI

SEQ ID NO: 11768 - protein, 355 aa, Xenorhabdus bovienii
  Coding DNA sequence: Name=SeqID_5660
  Gene classification: Function=Uncharacterized low-complexity proteins; Function class=S Function unknown
  Homolog annotation: Query=6..331bp; Hit=57..382bp; Blast score=68; Percent Identity=21.0; E value=1e-11; Homolog= RP563 COG1357
MLTANEIMAKIKQGDVIEQVNLQGISLVGQNLSGGRFWAVDFSDANFSHAILEESVFTECLFEETVFNSVRCEKTLFEQCNMIRAMFNKATLSASVFDQCVLKKTQFKVTKQNSTQFSSCQLQYADFIENEFDRATFINSVLHYATLRNSHFFLVTFFRQDLRKTDFYASQFMKTLFFECDHRDQDYRKLQFQACQFTDNQLDAVNFNQSNLTHCNFKGSSLQDAQLSNVNATQALFINADLTRACCHNSLFNGAIFIGACLERTDFRQSQLQQAIMQKVRAVNAQFVNCDMTYADLSYANMNNSDFRAAHFMRTLFHRTQQVGALFSDRQGILENDPELFAAEEWSTQQRQRKI

SEQ ID NO: 11769 - protein, 171 aa, Xenorhabdus bovienii
  Coding DNA sequence: Name=SeqID_5661
  Homolog annotation: Query=1..171bp; Hit=30..210bp; Blast score=98; Percent Identity=32.0; E value=3e-20; Homolog= ref|ZP_00092775.1|
MVKNQNHGWHCRQAASCLLAPAMGDRVLLVEADEQLWILAILERAEQQDPAVIKVSGDLSIMAQGNLNLSSNGLNITAENGNCHINEMQYSGGSLSAWVSVSKIIGNQFESVWQTVTQLSHRLFRHTTQTEQVHAGQLDMQAENYMRLHAQNTVITAKAITKIDAEQIHIG

SEQ ID NO: 11770 - protein, 133 aa, Xenorhabdus bovienii
  Coding DNA sequence: Name=SeqID_5662
  Homolog annotation: Query=1..128bp; Hit=1..124bp; Blast score=112; Percent Identity=50.0; E value=1e-24; Homolog= ref|NP_883049.1|
MFANTQGGGTDLATPDICLTPCPLGAPVPMVYLNIAQGTNGICASTVNILFMGSPAHNMATMIAMTNGDNPGVNLGVASGTVMGPSRHTLGANSVLIKGSPATRLSSPTLQNSTNAVGSRTVPSQTKVDISGA

SEQ ID NO: 11771 - protein, 68 aa, Xenorhabdus bovienii
  Coding DNA sequence: Name=SeqID_5663
  Homolog annotation: Query=6..64bp; Hit=55..113bp; Blast score=62; Percent Identity=40.0; E value=2e-09; Homolog= ref|ZP_00092794.1|
LEKNIPEANSIGILAEYKQLDGKKWRIALPVPIPEPPAFYKFWTSPPDTLDICIQVTANGLNFIDKCN

SEQ ID NO: 11772 - protein, 447 aa, Xenorhabdus bovienii
  Coding DNA sequence: Name=SeqID_5664
  Gene classification: Function=Uncharacterized BCR; Function class=S Function unknown
  Homolog annotation: Query=1..442bp; Hit=1..443bp; Blast score=347; Percent Identity=41.0; E value=2e-95; Homolog= PA0079 COG3522
MSRSEKVIWTEGMFLRPHHFQQAENYLETYVRDWGMAQRPYYWGFLTLKLDQSLLEQGKVMVASASGIFPDGTPFNFTETHAPVPLQLAENQTGENVVLALPIFRGGREEIIFQERKDSMARFVSVDAEVNDFNAMSVGSTTVQFGRMRLRLMLESDLTPEWTSLSIVHVISRTRDNKLLLDSRFIPPLLNCHVHPQLVGFINDLQGLLEQRRQQTSQCLLQLGQQNSSEIMYFLFLSLVNRYRGQVSHTRNIPLLHPERLFSEWLQFATELASFSQSRIPEEKLPIYDHDNLQVCFNHLMFLLRQGLSIILEEHALQLPLTEYSHGLNVATLTDANMLNTFSFVLAVYADMPKETLISRFPAQMKIAPVGRIRELVQLQLPGIPISAMPSVPRQIPWHSGYLYFELEKEGELWSQMAKSGGFALHLAGEFPGLHMEFWAVRNQSKS

SEQ ID NO: 11773 - protein, 403 aa, Xenorhabdus bovienii
  Coding DNA sequence: Name=SeqID_5665
  Gene classification: Function=Uncharacterized BCR; Function class=S Function unknown
  Homolog annotation: Query=19..230bp; Hit=61..276bp; Blast score=165; Percent Identity=39.0; E value=7e-41; Homolog= PA1668 COG3455
MTPNTPNRHTELSGDTWDNPLVTAANPLLNSIPQIRHDTESPDPTVLRQKLIDEIRHFELKCQYAKLPYEVIIGARYCLCTTLDEAAALTPWGVRSVWSGSGLLVTFHNETWGGEKFFQLLATLSQSPQKNLLLLELINFCLQLGFEGRYRVMDNGRTQLETLKQRLFQLIHSVRGNYPPELSPALQKIVAPNHPWQSSFPIWSYIAVTCLIACILYIGLNWQLDNITSPILTKIYQVNLPNMSVDDRVSSFLPPVLNLQDMLRRESAAGLLNVADLADKSIVTLRGDGLFKTGSTQIKNNYLPVIKHIAETMNNIEGEILVIGYTDDVPINSSSFSSNYALSLARAKSVKREFEKYLDHPERVRTEGRGESDPLFPNDTPSHRAKNRRVEIILLISPTHQTT

SEQ ID NO: 11774 - protein, 1169 aa, Xenorhabdus bovienii
  Coding DNA sequence: Name=SeqID_5666
  Gene classification: Gene name=IcmF; Function=Uncharacterized BCR; Function class=S Function unknown
  Homolog annotation: Query=95..1157bp; Hit=20..1088bp; Blast score =509; Percent Identity=31.0; E value=1e-143; Homolog= PA0077 COG3523
MLSAIVAIFTSRLMWSFLGITAISSIIWFIGPMTSIGNTIPLESSTVRIIIIATLYFVWLFIQLASHLYQVWLNKKLSAPLNRGNGEGEQLRNSQYSPLSEHFSDALRLLKNAYFYGSEIQYKPKWKPFFDRRYRYQLPWYVLIGAPNSGKTTLLENSGLHFPLSDHFETLSSNEIKETDNCHWWFTNQAVLLDTPGRYTTQDTRHEQDAREWKCFVNLLKKYRTRQPLNGVILTISVADLLNPSKKVRDQHAYLLRRRLSELQAQFKIQFPIYVIITKIDLLKGFGAYFAHFDKTQRDQIWGFNFPWNKTGWDLKDIFAQQYGLLQTRLNAGLSHILLHLNDLQQCAESYLFPQEFAALQSLIAQHLEIAFAKSGFDIPYSPRGLYFTSGVQEEPIHQGYFLKTLLETLFQEAGLAGQNRWWVYRNRLLKGLGYIILAAIMGLIITLFFSSYNNNKNYLIEVQNKIFPILSQSAKLKKISNDIDIYALLPILNKVADLGKSKYFSPDAPPWLYQMGLYHGEQINGASLTLYTKTLQTLLLPQVARLITSQLHQTNSDNIDDTYNTLKAYQMLCQPQHYDGKFLHRWVMQYLQAHLPPTISPAQLHQIEGHLRQLLEYQVVTFPYVCDNPLIKQKQILLSKIPPARLVYIHLKQELSDNPNLSPVGLTTLAGPEAGLVFSRINGTPITLNIAGMFTPAGYQMGIGNNLTTLIDKLYSQNAWILGQYAEISTPKELALLVRKFYLHDYLEQWDKFLFDIRLNNIDSLEQRSNMAQLLASNASPMRNLLINISKNVNLNEGLSDSKFDKKIGELVSRKAGSLTKVVPNPFMSGDNPPTPEQELREHFTQIIALANNPDGKNKQIPFDNILSQLAKLHEYLDSVQKATNIGIPAPSDEIITQLQATAERLPIPFKGIISSLAMGANSDTQASNVKNLNKQLNTEVQGFCHQAIANRYPLTPWALDDIRPDDMARMFAPQTGIMDSFFQKNLVGKVDTSHENWRLILGTDSKALPENHKLLLPFQQAQIIRDTLFSNGSRIPSFRVIVRTVNMDKEILSMILDVDGQQLQYSHGPQVSQSLNWPGPNGSNQARIQLNLDDGTTASLITSGPWALNRLIDHEQHATGKPATNNHTSQRVTFNIRGHHVSLEFIPNSILSPFQLPLFVCPKLINS

SEQ ID NO: 11775 - protein, 351 aa, Xenorhabdus bovienii
  Coding DNA sequence: Name=SeqID_5667
  Gene classification: Function=Uncharacterized BCR; Function class=S Function unknown
  Homolog annotation: Query=1..137bp; Hit=2..138bp; Blast score=97; Percent Identity=43.0; E value=1e-20; Homolog= PA0082 COG3515
MNIETLLEPVSIESPCGENLEYDPEFMALEQYLLGKTEQQFGDITIPAEPPDWIQAEKQAISLLRRTKDLRIIMALTQSWLQMRGLCGYADGLNLLQQTLERYWDEVWPKLAFEGEYDPLFRLNILAAIEDDSPLSLQAQYSTLLRNASKELSLLEVCSLLDGTINEISGYTGGRPRLQEELKQQASSPEVLAVIRIRDHLIAILDIIRQAFSESYVPELSWLLKQLNKVIEFCPSLSKTRHRDKEPDPKNIFDSTTCSEQRTPASTYSTHAVSASWHTIEASNRDEARMLLEKAKNYFVVNEPSHPAPHMIARIQRLIDRDFVDIVYDLAPDGLNQLEIILGRPDNFDSN

SEQ ID NO: 11776 - protein, 183 aa, Xenorhabdus bovienii
  Coding DNA sequence: Name=SeqID_5668
  Gene classification: Function=Uncharacterized BCR; Function class=S Function unknown
  Homolog annotation: Query=3..165bp; Hit=5..167bp; Blast score=207; Percent Identity=65.0; E value=4e-54; Homolog= PA0083 COG3516
MKSSGQKFIARNRPPRVQIEYDVELYGSEQKIQLPFVMGVMSDLAGKPLEALPEVSHRKFMEIDIDNFDECMKSTQPRVAFQVDNTLTNDGKLNVELIFEKMEDFQPDAIAKKVEPLAKLLEARTQLANLLSYMDGKSGAEQLIADILQNPALLKSLADAPKPTESVADTDSTTNTEQAENKE

SEQ ID NO: 11777 - protein, 500 aa, Xenorhabdus bovienii
  Coding DNA sequence: Name=SeqID_5669
  Gene classification: Function=Uncharacterized BCR; Function class=S Function unknown
  Homolog annotation: Query=12..500bp; Hit=11..498bp; Blast score=728; Percent Identity=72.0; E value=0; Homolog= PA0084 COG3517
MSTTEQETEFQQEQLSKEYTPDELSVLLNKEFRPQSDQARSAVESAVTTLAQQALENTVTISGDTYRTIQALITEIDKKLSQQINHILHHDEFQTLEGAWRGLHYLANNTETDEMLKIRVMCISKKELGSTLKRFKGVSWDQSPIFKKIYEAEYGQFGGEPYGCLIGDYYFDHTAPDVELLREMAQISAAAHCPFLSGASPSVMQMECWQELSNPRDLTKVFQNTEYAPWHSLRESEDVRYLGLTLPRFLSRLPYGNKTNPVDNFNFEEDTEGPTHSNYTWANAAYAMAVNINRSFKLYGWCTSIRGVESGGTVENLPCYTFPTDDGGVDMKCPTEIAISDRREAELAKNGFIPLLHRKNTDMAAFIGAQSLQKPSEYYDQDATANANLSARLPYLFACCRFAHYLKCIVRDKIGTFQERSDMENWLNNWIINYVDGDPTNSSAGTKARKPLAAAEVQVEEIPSNPGYYHAKFFLRPHYQLEGLTVSLRLVSRLPSLKSA

SEQ ID NO: 11778 - protein, 167 aa, Xenorhabdus bovienii
  Coding DNA sequence: Name=SeqID_5670
MSDFNSMYNTHSFVQFEGIEGESQTKGYEKWIGVQFISRAIINPANVSTDTGSWGSGKGVLNHFMLHINYDKAISALEKYAVTGKHIKTTKIHILRFIGEAEPAIWAKYELTNTYISEISSGQPSDNVITVGLKMKKLQLNYTPADYEGKKQAETTWTWDMEKNVIE

SEQ ID NO: 11779 - protein, 517 aa, Xenorhabdus bovienii
  Coding DNA sequence: Name=SeqID_5671
  Gene classification: Function=FHA-domain-containing protein; Function class=T Signal transduction mechanisms
  Homolog annotation: Query=314..507bp; Hit=303..497bp; Blast score=80; Percent Identity=28.0; E value=5e-15; Homolog= PA0081 COG3456
MRFTIVKNIGTNQPQQLSYDFMPPGGTIGRSPDNNWVLPDEGQAIARLQATVSVSIDGECRISNRGAASDILLNTIPIAPDRKIEIRDGDTLNIGDYQIQVININQGSNNTNSVNTPPLATIRKDIHSEIWDGLENTFTSDESMPQTPQQIAKTLNDNNPLIKSQRHQERNPINPLEQMETIIDLDSLQFRATDPITMFNANTDSQQENILNDSTPSTLLQQGNQRDKQEIDPLILFSDKRRRGILHDEPLNWVMENAEPLVAQANTGTSDPQYGASDPPFHRHNNERLDIDPVTYPPNPHQPDQVEEGVKLEGKLLAALLDGMGLNHLQNLQFDGHTLYKLGKLLSQLSQGIIALNASRTQLKYETDTGVAQILVDGNNPFALLPSGQAVLIQMLGDHMPGFMSAEQATRDILIELQAHQLGMIAGLRTITTEMLQRFDPSVIKQKAQETGNLPRLALSSTYKAALWDYFIKHYQKTMEKIEQDHSVFGEHFQQAYESEIIRYKHSQDKLKNRDKK

SEQ ID NO: 11780 - protein, 184 aa, Xenorhabdus bovienii
  Coding DNA sequence: Name=SeqID_5672
  Gene classification: Function=Uncharacterized BCR; Function class=S Function unknown
  Homolog annotation: Query=19..177bp; Hit=2..158bp; Blast score=102; Percent Identity=36.0; E value=2e-22; Homolog= PA0087 COG3518
MKDNITLLHGGYHFRKPPARITARDRMQSSLLDRLTDNEPDKKKENTKNYLLSHRTFRQNILRDLQWLLNSINKESNPELSCFPEIQNSTYNFGIAPLSGKNMSDIEWSDIQNKIIKAIHIFEPRIISSELQVNCISNIHSLSLYNILSIEIKGFLWCIPWPIEFLFRSDIDLEHGYFTMKEAG

SEQ ID NO: 11781 - protein, 624 aa, Xenorhabdus bovienii
  Coding DNA sequence: Name=SeqID_5673
  Gene classification: Function=Uncharacterized BCR; Function class=S Function unknown
  Homolog annotation: Query=1..621bp; Hit=1..616bp; Blast score=486; Percent Identity=42.0; E value=1e-137; Homolog= PA0088 COG3519
MDSKLLEYYNRELVYLREMGKEFAERYPKIANRLGMHGIEIADPYVERLIEGFAFLTSRIQLKMDAEFQHFSQHLLEMLYPNYLAPTPSMAITELQPDMSKGDISHGFLVPHGTIMRCQSLENDGITLQYATAQDVILQPLKLQKVELGKIPANIPLVGLNLHQYGAISALRIRLACKGKFFLHDLDLNKLTFFLSGPDIQSQKLLELIMEHSVGMVCQTLGASPQYLTLPDIAPHHEGFDDEQALLPNDPRNFSGYRQVQEYFAFPARFRFFSVCGMQSLLKETKKDVEFELILLLNKTDSSLESLIDTSYLALNCTPVINLFPKMTERVTVDESTNEYHLVVDNIRPLDYEIFSVQRLLGVDAQHKQERIFRPFWSTNSDDQGNYGAYFSLRREPRILSEHAHHYGTRTSYIGTETFISIVDEHYSPWPDTLRYLSADVMCTNRDLPAMLRQKDINSFAMLDSIPISKIEFIKRPTIPRPALAEGAVSWKLISQLQINYMNFMDQNQEEGTQALRQLLSLYADLAEPAVVRQINGIRHCSLKEVYRRVPDTGPIVFARGVSIKLEVDEQEFAGASPWLLGSVLEKLFSRLVTINAFTEMTLYSQQRGQVGFWPARMGSKKLI

SEQ ID NO: 11782 - protein, 358 aa, Xenorhabdus bovienii
  Coding DNA sequence: Name=SeqID_5674
  Gene classification: Function=Uncharacterized BCR; Function class=S Function unknown
  Homolog annotation: Query=22..337bp; Hit=18..319bp; Blast score=226; Percent Identity=40.0; E value=3e-59; Homolog= PA0089 COG3520
MKTDITAIHRVCRLPEYFWQQLTQAPWQFDLFQTLRRIDAQAGGYYRLGTAPLPRYELLRLGQKASMAFAPSTISTVHQLKNSKLYEVLIYSFGLFGPNGPLPLHLTEYTYSREYNYQDPTLGAFTNLFHHRLILLFYRAWANAQPTSSLDRPDNQKFCHYLACLIGMGLSAQQNSNPVNHDNIIRNSINNHARYALSGHLSRQRHNAEGLKKIMLFYFKVPVKIIQNIPQWLQIETQDQARLAAGRHVPCLGKSAILGIAIHDIQHKFRIELGPLTQAEYDMFLPEQTKSQQVREWVYQYLGIEYGWDIRLILDKSDITEMRLSKTGKLGLNSWLGKVNKSSHYDDLIYNPKSCKTH

SEQ ID NO: 11783 - protein, 877 aa, Xenorhabdus bovienii
  Coding DNA sequence: Name=SeqID_5675
  Gene classification: Gene name=ClpA; Function=ATPases with chaperone activity, ATP-binding subunit; Function class=O Posttranslational modification, protein turnover, chaperones
  Homolog annotation: Query=1..877bp; Hit=1..900bp; Blast score=1003; Percent Identity=57.0; E value=0; Homolog= PA0090 COG0542
MPEISRSVLFGKLNRVLFTSLENATTFCKLRSNPYVELVHWLHQLMQQQDCDLQSVIRYFALDEAKLAKDIITALDRLPRGASAISDLSEHIDSAVERAWVYGSLKFGVDKIRTAHWLIGMLKTFNLYNTLKAISRQFEQVNADTLIDNFNAICGNSSEEPENESPSHHSQPTKPQSSDSALRQYGQNLTDLARHGDIDPVSGRDEEIRQIVDILMRRRQNNPLLTGEAGVGKTAIIEGLALRIAANEVPPPLQNVQLWLLDIGMLQAGAGIKGEFESRLRRVIDEVQSSPLPIILFIDEIHTLIGAGGQQGTGDAANLLKPVLARGQLRTLGATTWSEYKKYIEKDPALTRRFQVVQIHEPDEAKALLMLRSLVRTLEKHHRVLLLDEAVEAAIRLSHRYIPARQLPDKAAALLDTACARVAISQHAEPPQLENCRHKIDALKIELEIVEREAKMGIGDQQRSNTILNALSLLEEQRIQLENHWQQELSLINRIIHLQTQLYEPPFHQQQHNDPNALHAELIALQQQLKMLQGEIPLIFASVDSNVVSAVVSDWTGVPLSRMVKDEINAVLHLADTLNQRVIGQYHALELIAKRVRTSRAKLDDPNKPVGVFMLCGPSGVGKTETALALAETLYGGEQNLITINMSEFQEAHTVSTLKGAPPGYVGYGEGGVLTEAVRRRPYSVVLLDEIEKAHSDVHEIFFQVFDKGWMEDGEGRHIDFRNTIIILTSNIGADLVSSLCLQQASLPDPEKLSTALRKPLLHVFPAALLGRLIVIPYYPLSDNVMTSIVHLQLARIKKRLLENHDIVATFDEPMIKYIVGRCTEIESGGRMVDAILTNSLLPQISQLLLSANANGQQYHQLQVSLGQGEFQFQFME

SEQ ID NO: 11784 - protein, 294 aa, Xenorhabdus bovienii
  Coding DNA sequence: Name=SeqID_5676
  Homolog annotation: Query=1..283bp; Hit=1..283bp; Blast score=350; Percent Identity=60.0; E value=1e-95; Homolog= ref|NP_927686.1|
MSNLEELYCCVDDFCQKFIPLWHQQLIENGLRKRHREASLSLSEVMMILILFHMSHYRDFKTFYIEHVKQYFTADFPGLVSYTRILTLKKRALIPLCAFLSSRKAHTQGIAFIDSTKIAVCHNLRFPRHRVFEGMAQRGKTSTGWFYGFKLHLVINDCGELLAVKLTTGNQDDRQPVRALTKGLTGCLYGDKGYLSQALCDELEAEGITLITNVRSNMKTKALSLWDRLMLRRRFLIETVVDQLKNISQIAHSRHRSQLGFLLEVAAGLIAYTFQPKKPSLNLRDNEIAIFKRS

SEQ ID NO: 11785 - protein, 100 aa, Xenorhabdus bovienii
  Coding DNA sequence: Name=SeqID_5677
  Gene classification: Function=Putative transposase; Function class=L DNA replication, recombination and repair
  Homolog annotation: Query=3..81bp; Hit=23..101bp; Blast score=121; Percent Identity=74.0; E value=1e-28; Homolog= XF2303 COG3316
MSLIRKAFKRLHYPVDIIAQCVRWYLAYALSLRNLEEMMTERGIRVDHSTLYRWIIRLTPLLGKAFRRHKRPVARRWRMDENQRAMALSLPGCGFRRQYG

SEQ ID NO: 11786 - protein, 182 aa, Xenorhabdus bovienii
  Coding DNA sequence: Name=SeqID_5678
  Gene classification: Function=Putative transposase; Function class=L DNA replication, recombination and repair
  Homolog annotation: Query=28..182bp; Hit=71..232bp; Blast score=137; Percent Identity=46.0; E value=4e-33; Homolog= mll9070 COG3316
LTILPYTVGLSGSHHYWVKPFVDINVPWLVAGVWMKIKGQWRYLYRAVDSDGNTVDFLLTAHRDKEAALRFFKKAIRQHGQPDGVTMDKSGANKAAVDELTKEKTKDNDIIIRQNKYLNNLIEQDHRNIKRRIRPMLGFKSFRRAQTILAGIELVSMRRKGQYLQPEDKTLSPAEIFYRLTA

SEQ ID NO: 11787 - protein, 243 aa, Xenorhabdus bovienii
  Coding DNA sequence: Name=SeqID_5679
MVLAAKSFTCDVNIYHEETPGTFFDALGGLTPSQYCRWLWRRNSNENGRHLYVPVGQTKRKRKVTSSLSSFYLQINTDEDLYFTPNTFFDWRKKALLSGLCANYVEIDTSIERMLTANESQQVLDEVLQQVAASGTPAPNAIVESGSGGLHLYWFYEMIDAFPAQKLAWESISKTLTDRFTGGDLWHVDTGASHDMTRFLRFLVRSILQRGSALSFGCQTNSILPKCWPTSWMLFIRHQYWNH

SEQ ID NO: 11788 - protein, 67 aa, Xenorhabdus bovienii
  Coding DNA sequence: Name=SeqID_5680
MLANKLDVVYSPPILESLRVSVVFILLPHQDLLSLKVIPRLGIVSPIGGAVSIGIYPALSGVPSELS

SEQ ID NO: 11789 - protein, 289 aa, Xenorhabdus bovienii
  Coding DNA sequence: Name=SeqID_5681
  Gene classification: Gene name=Soj (BS); Function=ATPases involved in chromosome partitioning; Function class=D Cell division and chromosome partitioning
  Homolog annotation: Query=31..289bp; Hit=3..254bp; Blast score=81; Percent Identity=28.0; E value=1e-15; Homolog= XFa0060 COG1192
MAKSVKSKKTGSSVSLLHKKIVEAIRAAHPIFGNSNDKGGVGKTTVTAHEAWYLASLGLKVLVIDFDKHITKMFFENAIPDLSEFAYASDLFSDEGITKPIYEMPNHQNIWFLPAEHEMKGIDSRPMSSGIVVYPRFHLQSLRDDFDVIVIDTPPGEGNRQQAGLLACTHAVLVTEMGALSIGGVSDAISITNELIDNINANNPDQDMTKPSYIVIPNKFNSRRSRHKDYLAQLKQLDVNLTPCINDRETFGISTDTAIPVWKFDDGNARLAAKEVKNVLNYIFLEVAK

SEQ ID NO: 11790 - protein, 240 aa, Xenorhabdus bovienii
  Coding DNA sequence: Name=SeqID_5682
  Homolog annotation: Query=1..206bp; Hit=1..195bp; Blast score=72; Percent Identity=30.0; E value=5e-12; Homolog= gb|AAO92393.1|
MTKKPFTLNIPALESISRSASANQKNIAGQVFYVDPDECYVVVNPRTKYNEALIESYVQDFLDERQGQREPCTVYPKDDKGYRIHHGATRTLAGKKAKEIKSDWKLKIIIDPSLQTRSDFENYWEQGTNNVARDNMNLLDVANWIIKSKTLAKAEGKTLTQESIAKSIGQTGAWVSKVQALAELPDYLIEVYQNGETVDPWTLNSLLKIHKANESLCRAFIESGEVGPQQRTESVESNVS

SEQ ID NO: 11791 - protein, 251 aa, Xenorhabdus bovienii
  Coding DNA sequence: Name=SeqID_5683
MKACAVLLSKVEKWGRSSAQKVLKAMSLDVLKAPTDSSKDAGLQPVTSQSSTNEITSKESVMTRNQDDEVIFDLVHAQKIEVMSGVTGDAFIYVQPIDNLWISTAETTFEHEFNATPSISSNLKFASKEAAEFAALVSLKSVAENILVQRRSLLEEESRDAEMLLSSIDIKLNSNGTENNALTGSSKDKKNKGAKKIELQVAGRWNGIDCVIMMKKAEQPNHVVIKLLSDSSIKEIAAEEFTLTGYFEYSH

SEQ ID NO: 11792 - protein, 247 aa, Xenorhabdus bovienii
  Coding DNA sequence: Name=SeqID_5684
MTLSAKQEDRGRGNPISLPELHAATYYATLTNKDRGIPISLFVQTCAMNQDLSKKEAGIRLGKLAFELGYRQLDKPVYSNTLFSWMRNKTTPLWAAKTAWNYLESQKVQPMNALDWCSWARTFTDSGRDMNQVPQFYDVNEASKWLIAANKYQQFRDKVREVNQESSKEIFGKYSNPELALRTYCFLAVYDDQNGFSSVNIAISISAKSAVSLITDVSAVLDELFKDDLLICSEGEYKIKKSTNYFQ

SEQ ID NO: 11793 - protein, 94 aa, Xenorhabdus bovienii
  Coding DNA sequence: Name=SeqID_5685
MRTKSQVEKKTQIEKLKYIPMPIMCHIDDRIFVAEKLSLLHERYRERIAGLYTKIFLINLHDPKISDLKRLGHARQKANEWILEFINGIIENNS

SEQ ID NO: 11794 - protein, 113 aa, Xenorhabdus bovienii
  Coding DNA sequence: Name=SeqID_5686
MMEYVQTKIGAMKIEQCLTNLGDENHLNLSELTHLSDAAKDICKSHSICLDIYVTRHRYCDFSETEIETVNRSKLSLKEKSGNYVSTYKYRHFNLIITTDLTKNTTEIDVCVS

SEQ ID NO: 11795 - protein, 98 aa, Xenorhabdus bovienii
  Coding DNA sequence: Name=SeqID_5687
VQVFLTWAKEHSPSSDFVINNNYISIVDTELSVEYFGFSVENFCTLLIIFKNKKSSLDSNHKLLFETLLKKSNYTIYNGEINLDVDETHAYRPINQLK

SEQ ID NO: 11796 - protein, 39 aa, Xenorhabdus bovienii
  Coding DNA sequence: Name=SeqID_5688
MTHKKFLDGWGIEILCELKALLSLAANADVVFHMSRASQ

SEQ ID NO: 11797 - protein, 59 aa, Xenorhabdus bovienii
  Coding DNA sequence: Name=SeqID_5689
MNTEFTDPYYESAEGESISKKQALLELKKHGIEDPSEFFTELKEKENYDAQEVLRWLGY

SEQ ID NO: 11798 - protein, 80 aa, Xenorhabdus bovienii
  Coding DNA sequence: Name=SeqID_5690
  Gene classification: Gene name=Smf; Function=Predicted Rossmann fold nucleotide-binding protein involved in DNA uptake; Function class=L DNA replication, recombination and repair
  Homolog annotation: Query=3..75bp; Hit=101..173bp; Blast score=65; Percent Identity=47.0; E value=1e-11; Homolog= VC0048 COG0758
MWLFVEGNYSTLHQPAVAIVGSRKATEDGLWLTKYIVSAIANQGLVSVSGLANGIDQKAHVESIRFNVPTIAVLGVRARV

SEQ ID NO: 11799 - protein, 96 aa, Xenorhabdus bovienii
  Coding DNA sequence: Name=SeqID_5691
  Gene classification: Gene name=CynS; Function=Cyanate lyase; Function class=P Inorganic ion transport and metabolism
  Homolog annotation: Query=15..96bp; Hit=75..156bp; Blast score=157; Percent Identity=90.0; E value=1e-39; Homolog= ZcynS COG1513
LAKSWIFAGMPACYLKLFPVRGSIEDRIPTDPTMYRFYEMLQIYGTTLKVLVHEKFGDGIISAINFKLDVKKVADPEGGERAVITLDGKYLPTKPF

SEQ ID NO: 11800 - protein, 84 aa, Xenorhabdus bovienii
  Coding DNA sequence: Name=SeqID_5692
  Gene classification: Gene name=CynS; Function=Cyanate lyase; Function class=P Inorganic ion transport and metabolism
  Homolog annotation: Query=1..79bp; Hit=1..79bp; Blast score=99; Percent Identity=65.0; E value=6e-22; Homolog= cynS COG1513
MIQSQVNREVRLALADKIWSVKTKKDLSFAQIADGTGLSEAFVTAALLRQHALSAKGVKIVGKKLDLRRDAGMLLETIPCSWQH

SEQ ID NO: 11801 - protein, 62 aa, Xenorhabdus bovienii
  Coding DNA sequence: Name=SeqID_5693
  Gene classification: Gene name=CynT; Function=Carbonic anhydrase; Function class=P Inorganic ion transport and metabolism
  Homolog annotation: Query=1..62bp; Hit=1..68bp; Blast score=78; Percent Identity=61.0; E value=1e-15; Homolog= cynT COG0288
MKKVIDGFLKFQSDTFPERVELFRSLATQQSPRTLFISGSEPGDQREPSDLFVICNADDYRP

SEQ ID NO: 11802 - protein, 295 aa, Xenorhabdus bovienii
  Coding DNA sequence: Name=SeqID_5694
  Gene classification: Gene name=LysR; Function=Transcriptional regulator; Function class=K Transcription
  Homolog annotation: Query=4..286bp; Hit=4..286bp; Blast score=358; Percent Identity=68.0; E value=4e-99; Homolog= cynR COG0583
MNFRYIRYFLAVAEHHGFTRAATALHVSQPALSQQVRLLEESLGVQLFDRSGRNTRLTDAGEVYLQYVYRAFQELDEGKRAIHDVEDLSRGSLRVAVTPTFTTYFIGPLVAEFYTRYPHITLQIQEMSQERIEERLINDDLDIGIAFDGGESPGIASRILLTETLSLIVAYHHPRAQQRKIALNELNDEKLILLSAGFATREQINRYFCEAGLRPQVQMEFTSISAVLDVIRRTSLSTLLPAAIAMQNNDLVAIPLADWQLERTGVLMQRKGAWQTTAARVFIEVAQALGHVLNS

SEQ ID NO: 11803 - protein, 468 aa, Xenorhabdus bovienii; identical to SEQ ID NO: 11755
  Coding DNA sequence: Name=SeqID_5695
  Homolog annotation: Query=141..351bp; Hit=1..213bp; Blast score=279; Percent Identity=60.0; E value=7e-74; Homolog= gb|AAK09054.1|

SEQ ID NO: 11804 - protein, 193 aa, Xenorhabdus bovienii; identical to SEQ ID NO: 11756
  Coding DNA sequence: Name=SeqID_5696
  Gene classification: Gene name=PinR; Function=Site-specific recombinases, DNA invertase Pin homologs; Function class=L DNA replication, recombination and repair
  Homolog annotation: Query=5..182bp; Hit=9..181bp; Blast score=103; Percent Identity=37.0; E value=1e-22; Homolog= DRC0005 COG1961

SEQ ID NO: 11805 - protein, 193 aa, Xenorhabdus bovienii; identical to SEQ ID NO: 11757
  Coding DNA sequence: Name=SeqID_5697
  Homolog annotation: Query=1..192bp; Hit=7..198bp; Blast score=211; Percent Identity=51.0; E value=6e-54; Homolog= gb|AAK09056.1|

SEQ ID NO: 11806 - protein, 133 aa, Xenorhabdus bovienii
  Coding DNA sequence: Name=SeqID_5698
  Homolog annotation: Query=12..129bp; Hit=239..354bp; Blast score=85; Percent Identity=39.0; E value=2e-16; Homolog= ref|NP_386255.1|
LPLTSETKHLGSWPDIQALLVTETIRQEQYSDTVTSDFRYYLISCQDVPAFQLGAIRKHWAIENSLHWVLDVTFREDDSRMRERIATRIFAQLRKMALNIVKRDINSKLSLSARRKSAGWDKCYMEALLFNQF

SEQ ID NO: 11807 - protein, 228 aa, Xenorhabdus bovienii
  Coding DNA sequence: Name=SeqID_5699
MPFFQPFKTSLEPEDLVFGLNTERNKYAIEYRAFGHLRDKNHFSIIDRYSITPEEITTRKFLRAQIPPNQESFTQSIENHRKYKVLQSAAKDNGKTNFDVDWDKHCLSYTKKVTKRKCKAGLSWYSLSLNRSCIHFILDGIDMESVIYKHYEQKIKKGTSYTGSELRWIYRNRKDPKVKSCIQFWRNGQPVLPPWEEGKDAHLWQYYQPKFENSEIEVGEFAETVLNL

SEQ ID NO: 11808 - protein, 97 aa, Xenorhabdus bovienii
  Coding DNA sequence: Name=SeqID_5700
MRNNSTPFTSAICWISFWLGTVLVGASWLYAKLQGKEFLVGLSEGLMNITSPDSTVAIMLSIGAMMIAIGMLYVPLFYTTVFVQAFMKVLTRKPIRI

SEQ ID NO: 11809 - protein, 117 aa, Xenorhabdus bovienii
  Coding DNA sequence: Name=SeqID_5701
  Homolog annotation: Query=14..71bp; Hit=63..120bp; Blast score=65; Percent Identity=55.0; E value=2e-10; Homolog= ref|ZP_00007274.1|
MHKSGHFYLALTCKSGNYSLPESLKLQVLALLYENYSDFGPTLAAEKLRERHDIIVSVEMLRKWMTADGHWGYLFWSNQSYYPLIIWYIGKMCINMKKSKLSQKEMQFSTNVSFHHL

SEQ ID NO: 11810 - protein, 115 aa, Xenorhabdus bovienii
  Coding DNA sequence: Name=SeqID_5702
MKAISIVAPAGENIATGKKTLEIRKWAPNFDCNEDLLIVENQHYLLKEGDEEMGKAVAIVKVKNVRPFFESDIEAACASYYEAGWLAWELTDVRAIEEPIKMIAKRKIYEVELRA

SEQ ID NO: 11811 - protein, 34 aa, Xenorhabdus bovienii
  Coding DNA sequence: Name=SeqID_5703
MDLFIEKVTPNTVGFWELMKEYSFLIQYVTQAET

SEQ ID NO: 11812 - protein, 368 aa, Xenorhabdus bovienii
  Coding DNA sequence: Name=SeqID_5704
  Homolog annotation: Query=1..364bp; Hit=3..372bp; Blast score=247; Percent Identity=36.0; E value=3e-64; Homolog= ref|NP_417941.1|
MKELVEVFSDFPDPRCQGKVKHRFIDILVIAVCAVIAGANAWTDIEQYGQLKKDWLGSFLLLKGGIPSHDTFRRCFSLLNPGLFERHFYQWISRDVSSEKRAIIAIEGKSLRHSFDKKIEQSPLHVVSAFSVEKGLSLCQCAVDGKSNEIKAIPALLSMLSLKGHLVTIDAMGCQRTIAQQLRESEADYILSLKGNQGKTFSEAVNYFQQQQITQKPYLKPDYDEFDDSHGRGWVLPLTSETKYLSSWPNIQALLVTETIRQEHYSDTVTSDFRYYLSSCHDSPTFQLGAIRKHWAIENSLHWVLDVTFREDDSRMRERIATRVFAQLRKMALNIVKRDTNSKLSLSARRKSAGWDNGYMEALLFNQF

SEQ ID NO: 11813 - protein, 317 aa, Xenorhabdus bovienii
  Coding DNA sequence: Name=SeqID_5705
  Gene classification: Gene name=PinR; Function=Site-specific recombinases, DNA invertase Pin homologs; Function class=L DNA replication, recombination and repair
  Homolog annotation: Query=31..168bp; Hit=15..152bp; Blast score=192; Percent Identity=72.0; E value=5e-49; Homolog= pinR COG1961
MTSEIILSEVICTLGFKPYQLVQSPSENDKQNTESQRREIEAAGFAIRPQRLIEEYVSGSVAAGERPGFTRLLDRMENGDVLIVTKLDRLGRNAMDIRKTVELLVDSEIRVHCLALGGVDLTSPAGKMTMQVISAVAEFERDLLLERTHAGIARAKASGASLQRPELLRLLDDAAPGDIILIEQVDRLSRLDEAGWQKLKQLIQEKHLVIVSLDLPTSHMALAENAGDEFTLAMLKAINGMMLDMLAAIARKDYQDRRRRQEEGILKAKAAGKFRGRQADNQLHEKIIELRVKNRQSIRDTARLCGVQGLRMKIFSG

SEQ ID NO: 11814 - protein, 262 aa, Xenorhabdus bovienii
  Coding DNA sequence: Name=SeqID_5706
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..262bp; Hit=1..259bp; Blast score=216; Percent Identity=44.0; E value=3e-56; Homolog= mlr0808 COG1028
MDLGIADRWAVICAASEGLGFSCAAALVAEGVNVVINARRPEPLKAAARRLQNINPAVSIKWVPGDITESQTQDTVLSASPMVDILVTNAAGPPTGNYSDWNRDIWYQAINTNMLTPISLIQIVIDEMVNRRFGRVINITSGTVKAPQSELGLSNGARGGLTGFICGLAKTDSLASNNVTINNLLPGAFDTNRLKQTFAQKASRCGDLPERIAMQRRQKIPAGRFGTPEEFGAYCAFLCSVYAGYITGQNILIDGGAYPGVF

SEQ ID NO: 11815 - protein, 390 aa, Xenorhabdus bovienii
  Coding DNA sequence: Name=SeqID_5707
  Gene classification: Gene name=ProP; Function=77 Permeases of the major facilitator superfamily; Function class=G Carbohydrate transport and metabolism
  Homolog annotation: Query=12..388bp; Hit=19..392bp; Blast score=125; Percent Identity=28.0; E value=1e-28; Homolog= VCA0083 COG0477
MKSKLIIINSCVILVLGLFSIDLYNPALPIIKSALAITNNQAQSLVVYYLSGFAVSQLFYGPLSDKYGRIPIIVFSLLFSAAGNYLTSTAESFHTLSLFRLLTGIGAGGCPVISRAILSDTFRDKTELSKSLTIFSMASQVSPAFAPVIGGYITEYLPWRFNFIALAIMMLVGVSFVKMTLPETSPMKPTDSGRITGFRILLSDVSFVVYSVVSAVLFAITIGYFTASPFVFQTQFDLSSSQNGYLFMIYSAGIVIGSLLTKKWLSHSSPEKILRVSLPLLLFFTAIALISVHFIQILSIAFIVIYSFSVGMGCGFSSPLLLGISLHGHPELSGTGSALQGALKMAGAAIVLYFFSRGHTATAAGLMWGLFILTLICVVLIAFTQYKAPK

SEQ ID NO: 11816 - protein, 463 aa, Xenorhabdus bovienii
  Coding DNA sequence: Name=SeqID_5708
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=20..449bp; Hit=117..550bp; Blast score=153; Percent Identity=26.0; E value=4e-37; Homolog= MJ0277 COG0028
MEMHNVLQDSTQSGINQREIFAPVTRAAFDVKAGQPLSRFLRESLRAMKGTEKGPVYLGISQEVLNEHDENRPDISASIADSWKNRPIDIKKINSPEFATFIAKARNCIILAGLRGKMPETADTLLAFAEKYHFPVATTLSGKGLFPESHPLSLGIYGYSSNPRAIEAFKNPKLEGIILLGMDTTQWSTMLWSLELQLPGGTIQVDTNPEYLGKYLEITCGITANSSAFLETLNEYYHNPLIEGRPEREKWVQHLSTVPKYFPIDFSATGNETRHPASYIKIFQEHFPENGIVSVDSGAHRSFFGHYWIAHRPETYISATTLGPMGWSIPAGIGASFAAPDRKCMVITGDGCMLMQGMELATASKYQRNILFVVFNNTSYAASYFNNKDNRTDLTQIPDYDWCQLAKGLGLNSLCVNSPEQLQKHIAEIMQQNSPFLIEIKCDKQHATPNKEYNKRIKTLPLL

SEQ ID NO: 11817 - protein, 93 aa, Xenorhabdus bovienii
  Coding DNA sequence: Name=SeqID_5709
MAHSDNGYKENGASYILKQLRHLNASHIFMVPGKLINSFMKCYPKDDDSVLDIFPIPIITACETGAAYMAEGSVSLTLLVYVSLLEGRVLQIP

SEQ ID NO: 11818 - protein, 259 aa, Xenorhabdus bovienii
  Coding DNA sequence: Name=SeqID_5710
MNIIKQMSEQGYVVISEVINKKEIDIIREYYKKILERNNLSTLLPTDVLKSPDVFNTILKDKVVTAIRELFSRDFSLFPNFTIRESVYIPWHNDAYFLPDEVINPEVPLQFMQCAIYLQDNDPELGGGITLIPFSHRLDQPTVKSMLNTPQAYEKVIMSKAGDLILWDNRITHRSTYPDKAPDNTKLALQWTVSASERHNESYLQYLQDRAQCSMHVSDYLLKSPKPYFADMPNVRYPDSFHQDSLNIMKQYNIQFIGL

SEQ ID NO: 11819 - protein, 392 aa, Xenorhabdus bovienii
  Coding DNA sequence: Name=SeqID_5711
  Gene classification: Gene name=AroA; Function=5-enolpyruvylshikimate -3-phosphate synthase; Function class=E Amino acid transport and metabolism
  Homolog annotation: Query=5..384bp; Hit=57..427bp; Blast score=186; Percent Identity=33.0; E value=4e-47; Homolog= MJ0502 COG0128
MKEACRSIGARIIEEPERLIIYGIGGKINPKKKVIDALGSGLVFRVMTALTCHSTAPAVISGDVVLRTRAMEPLLNALIQLGGNISSVHMNGKAPFINWGGYSGGICEIEGNISSQFITAILFAAPLARKSTTIKIIEKTLSLSYIRQTLETLTIAGIKFQQNENLSQITVFPGQYNSAEYTITGDYTSCSYLVAAATLFPCDLTLKNINSKSLQGEQAILTFVDEMGMDIIRNYKRNEIRLINKKKQLTGNYEFNVSDCPNIVPTLAALGIYVAGCFRVTGGSITRFHKSPRIEAMVNELLKLGVNIRPLFINGVYDGLEIYGASSYAGNCILSSWGDHRIFMSLFVASLRCQQANYIDGYEDVHCSFPDFFKEFEQLGITFQEVIPQHGK

SEQ ID NO: 11820 - protein, 182 aa, Xenorhabdus bovienii
  Coding DNA sequence: Name=SeqID_5712
  Homolog annotation: Query=1..182bp; Hit=1..181bp; Blast score=229; Percent Identity=60.0; E value=1e-59; Homolog= ref|NP_929067.1|
MKITLTDAQKEALELMHDTTRDGRVRDRIKAVLLASEGWTAQMIAQALRIHESTVSRHLKDDFSEEKLAPENGGSESRLSAEQTTELVEYLTANLMHTTAQIVAYVWAHWQVTYTVAGMTKWLHRQGFSYKKPRGIPHKSDADKQQHFIETYNALKAECGQNAPILFIDAMHPTQSTKLSYG

SEQ ID NO: 11821 - protein, 151 aa, Xenorhabdus bovienii
  Coding DNA sequence: Name=SeqID_5713
  Gene classification: Function=Predicted transposase; Function class=L DNA replication, recombination and repair
  Homolog annotation: Query=1..122bp; Hit=46..169bp; Blast score=62; Percent Identity=30.0; E value=2e-10; Homolog= BH2520 COG3335
VVETTGSRTRLNIMGALNLIEETIIREYPTINAKNVVLFFGAIRETYPLSQKIHLILDGAGYHRSEIVQFFAEVLNIELHYLPPYSPNLNPIERLWKYANEQVRNNIYFPDAKTFRETLHHFFHVTLPEKVKELTTRLTDNFQTLSPASSS

SEQ ID NO: 11822 - protein, 187 aa, Xenorhabdus bovienii
  Coding DNA sequence: Name=SeqID_5714
MFRSKSFNINNRSVGFGPLTRSKSCTDMYTTLVNMKTFITIKEVSPEEAFYATEKMLTETMAEDWFYFDFLKLDKEQERWKMRYNQAVSILNCLSTNAKIQSMRDKTDGSKKFFAVAYFRGIPVGALQLLVQDNHENELPEVSFLATHCGIRGCGVLLIEYAVNKSQQLGMEGKLKLSPMMRRGKHI

SEQ ID NO: 11823 - protein, 158 aa, Xenorhabdus bovienii
  Coding DNA sequence: Name=SeqID_5715
MNNEWLCPNSSGQLDEEQIKWNSRYNQALGIFKFFYIDIGIRLKLEEIDKRVLFFVAYFRGVPVGVLQLLITDGLPKVVFLATHCGIRGCGALLIEYAVNKSQQLGMGGKLQLSPYEGARATYMAMGFTGAGEHLELYPADRNDKWKWNEATGRYRFC

SEQ ID NO: 11824 - protein, 343 aa, Xenorhabdus bovienii
  Coding DNA sequence: Name=SeqID_5716
  Gene classification: Function=Predicted transposase; Function class=L DNA replication, recombination and repair
  Homolog annotation: Query=165..314bp; Hit=20..169bp; Blast score=71; Percent Identity=29.0; E value=2e-12; Homolog= BH2520 COG3335
MKITLTDAQKEALELMHDTTRDGRVRDRIKAVLLASEGWTAQMIAQALRIHESTVSRHLKDDFSEEKLAPENGGSESRLSAEQTTELVEYLTANLMHTTAQIVAYVWAHWQVTYTVAGMTKWLHRQGFSYKKPRGIPHKSDADKQQHFIETYNALKAECGQNAPILFIDAMHPTQSTKLSYGWMRRGREHVNVVETTGSRTRLNIMGALNLIEETIIREYPTINAKNVVLFFGAIRETYPLSQKIHLILDGAGYHRSEIVQFFAEVLNIELHYLPPYSPNLNPIERLWKYANEQVRNNIYFPDAKTFRETLHHFFHVTLPEKVKELTTRLTDNFQTLSPASSS

SEQ ID NO: 11825 - protein, 76 aa, Xenorhabdus bovienii
  Coding DNA sequence: Name=SeqID_5717
MKIISGKNNHGYSYIINEIWDDCIREKIPLPQYNSISASSMYEARIKLPDNAIKTIYAINLKMQDLKSGNYLSTGW

SEQ ID NO: 11826 - protein, 152 aa, Xenorhabdus bovienii
  Coding DNA sequence: Name=SeqID_5718
  Gene classification: Function=Predicted transposase; Function class=L DNA replication, recombination and repair
  Homolog annotation: Query=1..126bp; Hit=1..117bp; Blast score=105; Percent Identity=46.0; E value=1e-23; Homolog= mll8100 COG3293
MARYDIPDDAWIVIEPCLPPVHSERAGRPHVEHRRVMNGMFWVLCSGAPWRDLPERYGPWKTVYNRFNRGSKSGIINKIFNRLLSILDEKGLIDWAEICLDGSNIRASKDAAGAKKNIPISLTIMRWVAHAVVMAPKSTWQPTDGVFPSTCF

SEQ ID NO: 11827 - protein, 189 aa, Xenorhabdus bovienii
  Coding DNA sequence: Name=SeqID_5719
MPSDVLLQKTVEVSFHQEKRFHYFLDTPKHKPGGRLNIIGHASPVGSPILFAGACAYNFGMNLNVFCQTINALLTDIKNRGQNIQCVRIIACHSGANGLAQALANHINMPVKGSLGGTRVYPTMQFRSMPNINRHFIDKTDRGGHYYSEEEERQLRHDPAYGLYKWYYPQSSNPDSEFDEFASQRVLSH

SEQ ID NO: 11828 - protein, 231 aa, Xenorhabdus bovienii
  Coding DNA sequence: Name=SeqID_5720
  Gene classification: Function=Putative transposase; Function class=L DNA replication, recombination and repair
  Homolog annotation: Query=3..165bp; Hit=23..185bp; Blast score=217; Percent Identity=68.0; E value=7e-57; Homolog= XF2303 COG3316
MSLIRKAFKRLHYPVDIIPQCVRGYLAYALSLRHLEEMMAERGIGVDPATIHRWVFRLVPLLGKAFRPRKKPVGSRWRMDETDIKVKGQWKYLYRAVNTDGQTIDFLLTARRDATAARRFFRKAIRQHGRPTVVTIDESGANTAALTLLNAEGEPQQGIEIRQNKYLNNRIEQDHRHVKRRIRPMLGFKSFRRAQTILAGIERVSMRRKGQYLQSEDKTLSPAEIFYRLTA

SEQ ID NO: 11829 - protein, 103 aa, Xenorhabdus bovienii
  Coding DNA sequence: Name=SeqID_5721
  Gene classification: Gene name=FabA; Function=3-hydroxymyristoyl/3 -hydroxydecanoyl-(acyl carrier protein) dehydratases; Function class =I Lipid metabolism
  Homolog annotation: Query=1..103bp; Hit=1..103bp; Blast score=174; Percent Identity=76.0; E value=1e-44; Homolog= fabA COG0764
MFNKQESYTKEELQTSGQGKLFGENGPPLPSGNMLMMDRIIKMTETGGAYDKGYVEAELDINSELWFFHCHFVNDPVMPGCLGLDAMWQLVGFFLGWIGGEGK

SEQ ID NO: 11830 - protein, 93 aa, Xenorhabdus bovienii
  Coding DNA sequence: Name=SeqID_5722
  Gene classification: Gene name=LonB (BS); Function=Predicted ATP -dependent protease; Function class=O Posttranslational modification, protein turnover, chaperones
  Homolog annotation: Query=1..92bp; Hit=488..580bp; Blast score=92; Percent Identity=49.0; E value=5e-20; Homolog= ycbZ COG1067
LCNYRELTGKQGVIIPTSNVQHLCLNQDIIDAVKNGQFHIWTVEHVSEAASLLTGIPYYDPQKEHLLAIIYERITQANSQERPKLPWFLRWLG

SEQ ID NO: 11831 - protein, 425 aa, Xenorhabdus bovienii
  Coding DNA sequence: Name=SeqID_5723
  Gene classification: Gene name=LonB (BS); Function=Predicted ATP -dependent protease; Function class=O Posttranslational modification, protein turnover, chaperones
  Homolog annotation: Query=5..420bp; Hit=39..456bp; Blast score=410; Percent Identity=49.0; E value=1e-114; Homolog= Z1305 COG1067
MDAIQSRLHNGLTLFCQADLRQPFMLLKADESDIYLSHLSDTISALLPESRPKIGGYYQIEHQTITWRSSGEGSFAPTERVAYREWIEPEQLFGNIYTHQGALQLQPGLIHQVNGGVLILPLRTLLSQPLMWVRLKQMIIQRRFDWLSHNENRSLPLPVPSMPLNLRLVLVGDRLSLEELHALEPELANNALYGEFELDMPFHEEDDLALWCRYVNRIIQQQTLPPLSTDAWPELLKQAVRYTEDQLSLPLDIQWLQQKLETAAAYQQENQITSHSMQQAEDNRLWRHGYLAERSIDEILKGQILIRTQGSVIGQINGLSVLEYPGHPDPMGEPSRISCVAHLGDGEFIDVERKVELGGNIHAKGMMIMQAYLISELKLDQPQPFSASIVFEQSYGEVDGDSASLAELCALISALSQQPMISKLP

SEQ ID NO: 11832 - protein, 80 aa, Xenorhabdus bovienii
  Coding DNA sequence: Name=SeqID_5724
  Gene classification: Function=Uncharacterized BCR; Function class=S Function unknown
  Homolog annotation: Query=1..80bp; Hit=70..149bp; Blast score=110; Percent Identity=80.0; E value=4e-25; Homolog= ycbG COG3120
MKQTIRARRKRHFNAEHQHSRKKSIDLDFQVWQRLSALSRRRGNTLSETIVQLLEDAEYREKYTHQMSSLKQDLEAILGK

SEQ ID NO: 11833 - protein, 383 aa, Xenorhabdus bovienii
  Coding DNA sequence: Name=SeqID_5725
  Gene classification: Gene name=OmpA; Function=Outer membrane protein and related peptidoglycan-associated (lipo)proteins; Function class =M Cell envelope biogenesis, outer membrane
  Homolog annotation: Query=7..381bp; Hit=1..346bp; Blast score=462; Percent Identity=65.0; E value=1e-130; Homolog= ompA COG2885
MITRRKMKKTAIAVAVAVAAFATVAQAAPKDNTWYTGAKLGWSQYHDVNFYGNGYDNQIGNGPTRKNQLGAGAYVGYQANPYLGFELGYDWLGRMAYKGSVNNGAFRAQGVQLAAKLSYPVMDNLDVYTRLGGMVWRADSSATYNVNALGGAGDKDQRRLKNHDTGVSPLAAIGVEYALTKDLATRLDYQWVNNIGDATSVGARPDNGMLSVGVSYRFGQDDIAPVVVPAAPVIPAPTPAPSPTVENKSFTLRSDVLFNFNKSTLKTEGKQELDNLYTQLAKIDPDQGRVLVIGHTDRIGSQQYNLPLSQKRAQSVVDYLVAKGIPVASIQAEGRGKEGSVTGSTCDNIKGRAKLIDCLAPDRRVVINIQGTKEIVTQPKAAQ

SEQ ID NO: 11834 - protein, 197 aa, Xenorhabdus bovienii
  Coding DNA sequence: Name=SeqID_5726
  Homolog annotation: Query=61..197bp; Hit=28..177bp; Blast score=166; Percent Identity=58.0; E value=1e-40; Homolog= ref|NP_929055.1|
MGIRSSWGYLIEKKTAANGTEEEQKTDSCPVLKIDKTASITTASRLSFVESSQYDSQMVKGMVSELIYCEHQPAINHLLLPLLRQSGHENRWLLWVTPNKRLSRQWLMSSGLPLDKVVQLNQIRPVASIDAMEKALASGNYSVVLGWLPELSEYDVQKLQLAAQKGTALGFIMRPQNSAHHFKPPVNRLQISSVYYH

SEQ ID NO: 11835 - protein, 66 aa, Xenorhabdus bovienii
  Coding DNA sequence: Name=SeqID_5727
LRTGQLSVFCSSSVPLAAVFFSIRYPQDDRMPIMFLAHNELYIYTVYRYLLKSKPIFFQSASQKFT

SEQ ID NO: 11836 - protein, 207 aa, Xenorhabdus bovienii
  Coding DNA sequence: Name=SeqID_5728
  Gene classification: Gene name=TfoX; Function=Regulator of competence- specific genes; Function class=N Cell motility and secretion
  Homolog annotation: Query=18..192bp; Hit=16..192bp; Blast score=126; Percent Identity=38.0; E value=2e-29; Homolog= VC1722 COG3070
MFLSGARFAQLKHGVSSLGKLKKKSQFGGFGLLLDGVLFAISSDGELYLRGNSHAEVLFKARGMEKFIFSKRGIPVTLRYYRVNESLWQDQKQLFEYVSLAYQYTMAEIIDKQKMPLRLKDLPNLGMTLERQLWKVGISKVEELHVLGAKATYLKLQQHRKQTNVSILLALAGAIEGCHVAVLPEKIRDDLLLWHKELDHCSLGYHS

SEQ ID NO: 11837 - protein, 40 aa, Xenorhabdus bovienii
  Coding DNA sequence: Name=SeqID_5729
MAYIIIRKMIVIIYIVFYLLKPYKKYFLHMKINKLNTQKK

SEQ ID NO: 11838 - protein, 33 aa, Xenorhabdus bovienii
  Coding DNA sequence: Name=SeqID_5730
MSEFGFRVIIFAQENRKTGEERCAGMSGYIISN

SEQ ID NO: 11839 - protein, 386 aa, Xenorhabdus bovienii
  Coding DNA sequence: Name=SeqID_5731
MFGQFGWPEYEPNMTSNGHLISSDLRKILLEQCSISKKLPSEQWWKEKRKKDLPLHFLVRDYLNHPAIQFNSRTLFSSCVETLENIKFSINERREIDILLPVFCVISNWQKRHDITSLTMAEEVSLLHLAKISTYLEEHTGVRIRFKILSDATFYAGIFGDPMAAAEQYIKDLEEFTQVSKINEIVNILDISKIVSLLQDNYDRAFPEHLRTFTLNPSLGISHEEAIRFNASVGSTVNISDLSLTYNQRKAIFCDSIFPDSEIKHEIMNRVHTAFVHYRAMKETMASIRWENTLFPNAIRATIHHKTIPLMGVRIYPGYKSHSPNLPYHGIAVIENRKNVWQMSIEQEIHQHGKRLRIINNRGVSDFYVDADILENMAVLLHKLNS

SEQ ID NO: 11840 - protein, 31 aa, Xenorhabdus bovienii
  Coding DNA sequence: Name=SeqID_5732
MDGPLISDMSTYSTLLSCYSHIKGCSSMLIC

SEQ ID NO: 11841 - protein, 397 aa, Xenorhabdus bovienii
  Coding DNA sequence: Name=SeqID_5733
  Gene classification: Gene name=ProP; Function=77 Permeases of the major facilitator superfamily; Function class=G Carbohydrate transport and metabolism
  Homolog annotation: Query=2..377bp; Hit=14..387bp; Blast score=129; Percent Identity=31.0; E value=4e-30; Homolog= mlr8412 COG0477
MRNLIFIILGNITLESAVPLLFTVGGLAGLHLAPLAWLATLPIAIQMAAGSVCAIPFSNLMARYSRRTGFILASMAMIFGGLASATAIYSGSFGLLLGGHFLIGISMIGINFLRFAAAESVPKNRAATATSLLLASGIIGVIIGSELYGRGDSLGFELPFIGIYMIVSVIGGCAVLAFAALDGGLRCSINRQTEADISKASGFSLIATNRRLFFGIVTMVLGHAIMLIVMSTASIASIDYGIGNSETGILIGVHLVAMFAPGVITGMLISRMGANRIILLGAILYLVGFLIGLINEAVMVIIAAPLIFAGLGWNFMFLGGTHIINSMPDGINKVRVQGASETLLASVSTVFALASGGIYGAFGWKGLIFVVTTMTLLTISLLCIRALLISNVVDQSD

SEQ ID NO: 11842 - protein, 34 aa, Xenorhabdus bovienii
  Coding DNA sequence: Name=SeqID_5734
MLLINRTDFSPVIHSIRNSFSYHHSIFALAHLFQ

SEQ ID NO: 11843 - protein, 31 aa, Xenorhabdus bovienii
  Coding DNA sequence: Name=SeqID_5735
VKCRAEIYSFVSQSTSNLRTECIRIIYYENI

SEQ ID NO: 11844 - protein, 4686 aa, Xenorhabdus bovienii
  Coding DNA sequence: Name=SeqID_5736
  Gene classification: Gene name=EntF; Function=Non-ribosomal peptide synthetase modules and related proteins; Function class=Q Secondary metabolites biosynthesis, transport and catabolism
  Homolog annotation: Query=3183..4661bp; Hit=52..1541bp; Blast score =866; Percent Identity=37.0; E value=0; Homolog= PA2402_1 COG1020
MRTSESSLNSNLYNLHPAQEDVFYEQALYENNPLHNLGWYTLIEEDVDIVTFQQVWNLLHQHIDMLRLRISVNADNEAIQYIQDQGVPESIIFHDVTMQPEPEKKAQLWMQQQIDNPINFLKETPYQISLIRMTDEKYYFFTIFHHIMIDGVGLFRLHEYVNKLYECIKNGTSIAWLSEIPQYLDTIIKAREYLNSSHYETDKNYWCDFLKENEIYPLTPCYQNTGSGVGSLTLPSAMTSDLRIFCRENNTNLLAVFSSLVIIMMAELTGQKELTFSTITHGRKRKLDKHVVGMHANIYPVHCQVSHSLSVIEQIKFMELSQKNSYRYCKFPHSHLIRIANNFGIPLPNLFIFYERFSESASEVTQNKHNHIEGTSNIYPIVFRFKDYSGTDQELKININYLQAYFSDQDVGKILERLKNLFAALIKKPSLLVSELPILLEQERHTLLYTWNQPDALYPQNQTLQQQFEARAAAMPDNVALVFEGATLTYRQLNERANQLAFVIREHYQQRHNQAMPADTLVALYLDRGLEMVISILAVLKAGGAYVPMSPEHPPERIQFILEDTQSPCVVTQQRHLTTLSECTQVLIDQPALIAADDQVVTAGWPVDNPVPVNGAADLAYVIYTSGTTGQPKGVLQTHHNAMRLFATTQGDYQFDQNDTWVLYHAYTFDFSVWELWGALIYGGRLIIPTVDCTKDFVSFTRLCSHQKVTVLNQTPGAFYAFIDASLSIGAKFPCLRYVIFGGDKLNPVQLKPWWDSYGDQSPTLVNMYGITETTVHVTYQKLIKDDAITASCIGRPLNDMHAYVLNDSGHLVPIGAPGELYIGGAGLARGYLNRPVLTAERFVVNPFATAEDQAHGYTRLYKTGDLVRWQPDGNLEYLGRNDFQVKIRGYRIELGEIESALASHPQVKQAVVIDHEHEGHKALAAYLVTDGELPDDTLMTYLSARLPDYMVPASLTRIETVPLTLNGKLDRRALPAPVWGNRDGYVAPRNALETQLCAVWQDVLGLERVGIEDNFFRIGGDSLIAIKLTAAIRRVLAVDVSLAQVFSLKTVAGMAAQMGQQACTVIPHVELARYPLSFAQERMRFIEQFEQGTHAYHVPYLVQLDDGACLSQLETAIHRVVERHPVMKTVYRTDEAGQAYQQVLEGNLVLRSQSCEAFDALLQTVRAELATPFDLTAEPGLRLCHYRVAEHHYLLMMWHHIAIDGWSIDIFMDELAEIYSALREGRDSQLSPLEITYGDYARWQRDYLQGEVRERQLAYWQQALAGYEPLSLPTDRSRPTQVDYQGRDFNFALGSELSHQLRALAKTQETTLYTVLLSAFYVTLAKLSGQNDIVLGTPTDNRHHAQTQPLIGMFVNSLVLRAQLEPAGSVETLIKQTHAVIAQAKANQDMPFEQLVDALEIERDTARHPIFQVMFGVQNLGEGGQSRANLPFSPVKLAGVLYSPAKFDLSLFMAEEQANIAGGINYAVSLFDESSIARMADSYQRVLTAFVADQKQSLAGLDVLSAQERHTLLHRWNQTDVPYPQSRTLQQQFEAQVVATPDNVALVFAGETLTYRQVNERANQLAVVIRERYQQQRHAPMPADTPVALYLDRSLEMIISILAVLKAGGAYVPMSPEYPPERVRFILADTGSSCVVTQQRHLTALGEYTHRLSLIAADDPSVTAGRPVDNPVPVNGATDLAYIIYTSGTTGQPKGVMLTHQSVMNRLCWMQSRYALNAADNVLQKTPYTFDVSVWELLAANWVGARIVIAPPDSHRQPETLHKLMQETGVTVVHFIPPMLSAFCQSLQALRQRLAETVRYVFCSGEALTGSQVNAFKTINPGASALINLYGPTEAAIEVTYFDTADEFNGNVPIGRAIDNTRLYVCEGGGNLSPLGAPGELYIGGAGVARGYWNRPDLTAEYFVVNPFATAEDQTRGYTRLYKTGDLVRWRPDGNLEYLGRNDFQVKIRGYRIELGEVESALASHPQVKQAVVIDREHEGHKALAAYLITEGMLSDETLIGHVSARLPDYMVPSSFTRIESVPLTLNGKLDRRALPAPVWVNRDDYVAPRNALETQLCAVWQDVLGLERVGIEDNFFRIGGNSLMAIKLTAAIRYALVVEVPLVQVFELKTVAGLAAQMGQQACTVIPHLELVRYPLSSVQERILFIEQFEQGSSVYHVPYLVQLDDGDCLPLLETAINRVVERHPVMKAVYRTDDAGQAYQQVLEGSLVLRSQSCEDINALLQTVNTELATPFDLTSEPSLRLCHYRVAEHHYLLMMWHHIAIDGWSIDIFMDELAEIYRALLASRDSQLPPLDITYGDYAKWQRDYLQGEVRERQLAYWQQTLAGYEPLSLPTDRSRPAQVDYQGRNFNFALGNTLSHQLRALAKTQETTLYAVLLSAFYVTLAKLTGQDDIVLGTPTDSRHHAQTQPLIGMFVNSLVLRAQLEPTDSVEMLIKQTHAVIAQAKAHQDMPFEQLVDALEIERDTARHPIFQIMFGLQNLGESLPDRAGLPFNPVKLDRVLHSPAKFDLSLFMSEEQSSIAGGINYAVSLFDESTIARMADLYQRVLAAFVADQKQSLAGIDVLSAQERHTLLHRWNQTDVPYPQDKTLQQQFEARAAATPDNVALVFAGATLTYRQLNERANQLAVVIRERYQQQCHALMPADTPVALYLDRSLEMVISILAVLKAGGAYVPVSPAYPPERIRFILADTAALCVVTQQRYLTDLGEYSHALSLIAADDLSVTAGQSADNPAPVNMSTDLAYIIYTSGTTGQPKGVMVEHASVINLSRFIARTHLLGETVKALFFSNYVFDASVFELFPALMAGATIFIAPEAVTADSDQLLSFINTNEITKAFIPTALMNHFADELARSTLQVIHTGGEALNALSLPPDVILFNQYGPTEGTVCVTQNLLRDGDRAIGKGIDNTRLYVLDGEGNLSPIGALGELYIGGAGLARGYWNRPALTAERFVVNPFATAEDQEQGYTRLYKTGDWVRWRPDGNLEYRGRNDFQVKIRGYRIELGEIESALASHPQVKQAVVIDREHEGHKVLAAYLVTDGTLSDEILMEHVSARLPDYMVPSNFTRIESVPLTLNGKLDRRALPALVWVSRDGYVAPRNALETQLCAIWQDVLGLERVGIKDNFFRIGGNSLIAIKLTAAIRRILAVEIPLVQVFELKTIAGLAAQMGQQACTVIPHVELARYPLSLAQERMRFIEQFEQGSSVYHVPYLVQLDDGDCLPLLETAINRVVERHPVMKTVYRNDDEGNTYQQVLEGSLIFRSQSCEEFDALLQTVRAELATPFDLTTEPSLRLCHYRVAENHYLLMMWHHIAIDGWSINIFMDELAEIYPALLASRDSQLPALDITYGDYARWQRDYLQGEVRERQLSYWQQTLAGYEPLSLPTDRSRPAQVDYQGQDFNFALESKLSHQLRALAKTQETTLYTVLLSAFYVTLAKLTGQDDIVLGTPTDNRHHAQTQPLIGMFVNSLVLRAQLEPTDSVETLIKQTHAVIAQAKAHQDMPFEQLVDALEIERDTARHPIFQIMFGLQSFGQDEPNRAGLPFSPVTLDGALHSPAKFDLSLFMAEGAGSIVGGINYAVSLFDESTIARMADIYQRVLTAFVADQKQPLAGFDVLSAQERHTLLHRWNQTDVPYPQSHTLQQQFETRAAATPDNVALVFAGVTLTYRQVNERANQLAVVIRERYQQQSHAPVPADTPIALYLDRSLEMVISMLAVLKAGGAYVPISPAYPPERTRFILADTAAPCVVTQQRHLTALGEYSHALSLIAADDPSVIAGQSADNPAPVNTSADLAYIIYTSGTTGQPKGVMVEHASVINLSQFIARTHLLGETVKALFFSNYVFDASVFELFPALIAGSTIFIAPAAVTRDSDQLLSFINTHEITKAFIPTALMNHFATELARSTLQVIHTGGEALNALSLPPDVMLFNQYGPTEGTVCATQNWLQDGDRAIGKGIDNTRLYVLDGEGNLSPIGAPGELYIGGAGLARGYWNRPALTAERFVVNPFATAEDQARGYTRLYKTGDWVRWRPDGNLEYRGRNDFQVKIRGYRIELGEIESVLASHPQVKQAVVIDREHEGHKVLAAYLVTDGELSDEILIGHVSARLPDYMVPASLTRIETVPLTLNGKLDRQALPAPVWVSRGGYVAPRDALETQLCAVWQDVLGLEQVGIEDNFFRIGGDSIVSIRLVSKLRQAGFSLQVKSIFDAPTVARLAKLLAQASTAVRVIAEPGLLSGEFGLLPIQQAFFGRSLPCPHHWNQAFMMQLPGEIRHADIEQALIRLAGRHDMLRTRFVSTEDGYRQCYQAEMPFGLPALHRADVSVLEKAALHQQLTQWQGGFDYAAGSLWQASHLTGYADGSARLFFAFHHLIIDAVSWRIIAEDMRLLLQGATLPPKTSSYRQWVAAVHHYAARHQQEVPYWQRVMVGKETEPAAGEASQHRLVLSAKLTDTLLREANSGYHTEINDLLLSALTLALSASFSRPVNHIILEGHGREPIDTTLDVSETVGWFTTVYPVRLEMQAGVTETMIHTKEMLRAVPNKGIGYGALHQAGDLAGELPAISFNYLGQLGGDAGQGRHQDWSLTDDDCGAMIASDNPNPLLLDINGAVQAGSLQFSVNSRLSPAQTQVFITALEQALTTVITAGQKQARLGGVKTPSDYGIKGVSIEQLNQLTHRLDHVNNENSSLHVEKKTILDV

SEQ ID NO: 11845 - protein, 3944 aa, Xenorhabdus bovienii
  Coding DNA sequence: Name=SeqID_5737
  Gene classification: Gene name=EntF; Function=Non-ribosomal peptide synthetase modules and related proteins; Function class=Q Secondary metabolites biosynthesis, transport and catabolism
  Homolog annotation: Query=2401..3685bp; Hit=1..1285bp; Blast score =804; Percent Identity=38.0; E value=0; Homolog= PA2400 COG1020
MCNNMLILLKELIKNRVSVWVCENKLKLAFAGETPPVQLIDKVKEKRQSVIDFLNEKCIFSEEDFQSFIFNKNQSNFDITFADPSQYSGNKIEAIFPATSLQQGFVYHYLAQPQDDAYRVQLLLDYHDRLDFAAYQQAWTLASLRFPALRTAFDWEGEVLQIVTEGASIGPANFTIKDISSLPAEEWDRAIEELQRNDRAQPFDLSQPGLIRFTLIRQQAQQVTALITQHHCIADGWSTPILLQTVHEYYNALVQGRVLPKGVDTAYLATQQYHLDHKDASDAYWAERKTQFQGANDLSALLSHGIDLAQIKTVEKPAEQVLTVEGNAYGQLKTMCREQGVTLNVVLQFAWHKLLHSYCGDEQTLVGTVVSGRDVPVDGIESSVGLYINTLPLTVQWEPAGSVLAVLHAIQNDIAALNSHSAVSLASLQPDGARLFHSLLVFENYPAPVISEHGAGIENKLAFRQAIEKVDYPVLLMAYEQGDSLTVKLSYGEDWLAGEQARRLLHQLEGILHTVARDPHQPHPSVEFLSDDERHTLLYRWNQTDVPYPQSHTLQQQFEARAAAIPDNVALVFAGATLTYRQVNERANQLAVVIRERYQQRCYAPMPADTPIALYLDRSLEMVISMLAVLKAGGAYVPVSPAYPPERTRFILTDTAAPCVVTQQRHLTALGEYSHALSLIAADDPSVTAGQSADNPAPVNTSADLAYIIYTSGTTGQPKGVMVEHASVINLSQFIARTHLLGETVKALFFSNYVFDASVFELFPALMAGAAIFIAPAAVTGDSDQLLSFINTHEITKAFIPTALMNHFATELARSTLQVIHTGGEALNALNLPPDVTLFNQYGPTEGTVCATQNWLQDGDRAIGKGIDNTRLYVLDGEGNLSPIGAPGELYIGGAGLARGYWNQPALTAERFVANPFATAEDQARGYTRLYKTGDWVRWRPDGNLEYRGRNDFQVKIRGYRIELGEIESALASHPQVKQAVVIDREHEGHKVLAAYLVTDGELSDEILIGHVSARLPDYMVPASLTRIETVPLTLNGKLDRQALPAPVWVSRGGYVAPRDALETQLCAVWQDVLGLEQVGIEDNFFRIGGDSIVSIRLVSKLRQAGFSLQVKSIFDAPTVARLAKLLAQASTAVRVIAEPGLLSGEFGLLPIQQAFFGRNLPCPHHWNQAFMMQLPGEIRHADIEQALIRLAGRHDMLRTHFVSTEDGYRQCYQAEMPFGLPVLHRADVSVLEKAALHQQLTQWQSRFDYAAGSLWQAGHLTGYADGSARLFFAFHHLIIDAVSWRIIAEDMRLLLQGATLPPKTSSYRQWVAAVHHYAARHQQEVPYWQRVMAGKETEPAAGEASQHRLVLSAKLTDTLLREANSGYHTEINDLLLSALTLALSASFSRPMNHIILEGHGREPIDNTLDVSETVGWFTTVYPVRLEMKAGVTETIIHTKEMLRAVPNKGIGYGALHQVGNLAGELPAISFNYLGQLGGDAGQGRHQDWSLTDDDCGAVVASDNPSPLLLDINGAVQAGSLQFSVRSRLSPALTQVFITAFEQALTTVITAGQKQARLGGVKTPSDYGIEGVSIERLSRFQQRYQIEALYPATSLQQGFVYHYLAHPQDDAYRVQLLLDYHDRLDFAAYQQAWALASLRFPALRTAFDWEGEVLQIVTEGTSIGPANFTIEDISSLPPEEWDRAIEELQQNDRAQPFDLSQPGLIRFTLIRQQTQRATVLITQHHCIADGWSTPILLQTVHEYYNTLVQGLRPPKGVDTAYLATQQYHLDHKEASEAYWAERKTQFQGANDLSALLSHGIDLAPIKTVENPAVQGLTVEGNAYGQLKTMCREHGITLNVVLQFAWHKLLHSYCGDEQTLVGTVVSGRDVPVDGIESSVGLYINTLPLTVQWKPADSVLAVLHAIQNDIAALNSHSAVSLASLQPDGARLFHSLLVFENYPAPVMSEHGAGIENKLAFRQAIEKVDYPVLLIAYEQGDSLTVKLSYGEDWLAGEQARRLLHQLEYILHTVARDPHQPHPSVRFLSDDELHTLLYRWNETDMPYPQDKTLQQQFEARAAATPDNVALVFEGATLTYRQVNERANQLAVVIRERYQQQRHAPMPADTPIALYLDRSLDMVISMLAVLKAGGAYVPVSPAYPPERIRFILTDTAAPCVVTQQRHLTALGEYSHALSLIAADDPSVTAGQSVDNPVPVNTSTDLAYIIYTSGTTGQPKGVMVEHTGVVNLSQFIARTHLLGETVKALFFSNYVFDASVFELFPALIAGSTIFIAPAAVTGDSDQLLSFINTHEITKAFIPTALMNHFAAELAHSTLQVIHTGGEALNALNLPPDVMLFNQYGPTEGTVCATQNLLQDGDRAIGKGIDNVRLYVLDGEGNLSPMGATGELYIGGAGLARGYWNRPELTAERFVANPFATVEDQARGYTRLYKTGDWVRWRPDGNLEYRGRNDFQVKIRGYRIELGEIESALASHPQVKQAVVIDREHEGHKALAAYLVTDGGLSDETLMAYLSARLPDYMVPSSFTRIETVPLTLNGKLDCRALPAPVWVNRDDYVVPRNALETQLCAVWQDVLGLERVGIEDNFFRIGGNSLIAIKLTAAIRRVLAVEVPLAQVFELKTIAGLAAQMGQQACTVIPHVELARYPLSFAQERMRFIEQFEQGTHAYHIPYLVQLNDGACLSLLETAIHRVVERHPVMKTVYRNDDEGQAYQQVLEGNLVLRSQSCEAFDSLLQAVRAELATPFNLTAEPGLRLCHYRVAEHHYLLMMWHHIAIDGWSVDIFMDELAEIYSALREGRDSLLPPLEITYGDYARWQRDYLQGEVRERQLAYWQQALAGYEPLSLPTDRSRPTQVDYQGRDFNFVLGSGLSDQLRALAKTQETTLYTVLLSAFYVTLAKLSGQNDIVLGTPTDNRHHAQTQPLIGMFVNSLVLRAQLEPAGSVETLIKQTHAVIAQAKANQDMPFEQLVDALEIERDTARHPIFQVMFGVQNLGEGGQSRANLPFSPVKLAGVLYSPAKFDLSLFMAEEQANIAGGINYAVSLFDESSIARMADSYQRVLTAFVADQKQSLAGLDVLSAQERHTLLYRWNQTDVPYPQSRTLQQQFEAQVVATPDNVALVFAGETLTYRQVNERANQLAVVIRERYQQQRHAPMPADAPVALYLDRSLEMIISILAVLKAGGAYVPMSPEYPPERIRFILADTGSSCVVTQQRHLTALGEYTHTLSLIAADDPSVTAGRPMDNPVPVNGATDLAYIIYTSGTTGQPKGVMLTHQSVMNRLCWMQSRYALNAADNVLQKTPYTFDVSVWELLAANWVGARIVIAPPDSHRQPETLHKLMQETGVTVVHFIPPMLSAFCQSLQALRQRLAETVRYVFCSGEALTGSQVSAFKTINPGASALINLYGPTEAAIEVTYFDTAGEFNGNVPIGRAIDNTRLYVCEGGGNLSPLGAPGELYIGGAGVARGYWNRPELTAEYFVVNPFATAEDQARGYTRLYKTGDLVRWWPDGNLEYLGRNDFQVKIRGYRIELGEVESALASHPQVKQAVVIDREHEGNKALVAYLITEGVLSDETLIGHVSARLPDYMVPSSFTRIESVPLTLNGKLDRRALPAPVWVNRDDYVAPRNALETRLCAVWQDVLGLERVGIEDNFFRIGGNSLMAIKLTVAIRREIDIDIPLSILFSHKCISLLTEWLESGCLKYNLLNLLTPESTATNKLFMIHAAGCGSEVYDPLAKALSDVYNCIGIDNYNLFTDNHIESLQKIAQIYLELILTETSIDKPIKILGWSLGGQLAMEIAFQLEQNGAKDIQLFLLDTVINTVQLTEIKNQLDMSYVLSEAAIKLQAMGVGDAYINKVLDAMPFEHKIVNCNLSGKLMHTNITLFKAGQMNSDYKGDIGLTVNQLIAKMPDNNISAWVTNPLVIKLVNDRSHADILESISIVSAEIIDKLSIEGNISI

SEQ ID NO: 11846 - protein, 720 aa, Xenorhabdus bovienii
  Coding DNA sequence: Name=SeqID_5738
  Gene classification: Function=Uncharacterized membrane protein; Function class=S Function unknown
  Homolog annotation: Query=9..717bp; Hit=10..711bp; Blast score=861; Percent Identity=62.0; E value=0; Homolog= yccS COG1289
VLTVLSSSRHFLYNSHVLYYIRIFIALTGTTLVPWLLGEEPKITIPLTLGVVAAALTDLDDRLVGRLRNLVITLVSFFAASTSITLLFPYPWLFMVGLAVSTCSFILLGALGQRYATIAFGALLIAIYTMLGTSIFPLWYQQPLLLLTGAIWYNLLTLTGHLLFPIRPLQENLARCYQQLSAYLYAKTSLFDPDSEAEEYKQSMFDVAMANSALVTTLNQAKISLLSRLKGDRGQRGTRHTLHYYFVAQDIHERASSSHVQYQKLRETFRHSDILFRCQRLLSMQARACEQVSQSIILRKPYQHNSRFENAFNYLESSLERLKNQQGADTQIMAFYNLLRNLRAIDAQLSGLNSEQSPLLQNASQSGKQEDTQLSNEALTGWRDVWFRISSNLTPKSALFRHAIRMSALLCTGYAIIQLFDLQRGYWILLTSLFVCQPNYSATRRRLALRVTGTLAGILIGLPILYFVPSIEGQLVLIIISGVLFFAFRNIQYAHATLFITLLVLLSFNLLGEGFEVALPRITDTLIGCGIALLAVSFIWPDWKFRQLPRVINRTMIANCRYLDAIVGQYYQGKNNSLNYRIARRDAHNCDAELASVISNMASEPKNYRVSQEEAFRLLCLNHTMLSYISALGAHRDRLNDQVILDILNDAIFQVESALQQGWVDDERLQRISERLAESINLVSSGSSGKVQLVLQQIGLLVELLPEFVSLIKQLTQSDI

SEQ ID NO: 11847 - protein, 687 aa, Xenorhabdus bovienii
  Coding DNA sequence: Name=SeqID_5739
  Gene classification: Gene name=UvrD; Function=Superfamily I DNA and RNA helicases; Function class=L DNA replication, recombination and repair
  Homolog annotation: Query=1..687bp; Hit=1..684bp; Blast score=876; Percent Identity=63.0; E value=0; Homolog= helD COG0210
MELKSTQMGQRLAQHPYNRVRLLNAGIEVSGDKHQYLIPFNQLMSIQCKRGIIWGELEFELYEGKVVRLHGTEWQQTQHFYHYLLKEWQQWSLDMSDVSADVLAAQVNEINKITQQDRWFKTADLLSLQQQIQEAFQALPLPLARIEQFENCRDDYRMCLDWLDEGGKTIKILNQQWVDRILQQYAEFFQTIETTPLNRFQCQAVVNGEKSILVLAGAGSGKTSVLVARAGWLLLRQQALPEQILLLAFGRQAADEMNKRIQKRLGTKEIQAKTFHALALHIIQQGSNKAPKMSELETDAQKRRDFLIQEWQKQCSEKKVQAKGWREWLNQELDWQLPEGEYWHDKQLSIRLSDRLERWLELMRMHGGSQKEMIEQASPAYADTFQKHIRLMAPLLKAWKLALKSEGAVDFSGLIHQAVNILEKGRFISPWKHILVDEFQDISPLRAKLLAVLRVQNKQSHLFAVGDDWQAIYRFSGAELTLTTAFSTYFGEGAESAECTLDTTYRFNDRIGEIANRFIRQNPNQLNKPLNSLIKGNKKSVVILPQEQLEALLNKMSGYVTKQETILLLGRYHHLKPEFLKKASTRWPNLNIEFMTIHASKGQQSDYVIILGLQQGQDGFPAPARESVLEQVLLPQPEDFPDAEERRLLYIALTRAKKQVWLMQEPKNPSVFIHQLTQLGVPTQRKP

SEQ ID NO: 11848 - protein, 137 aa, Xenorhabdus bovienii
  Coding DNA sequence: Name=SeqID_5740
  Gene classification: Function=Predicted CoA-binding protein; Function class=R General function prediction only
  Homolog annotation: Query=1..137bp; Hit=28..164bp; Blast score=187; Percent Identity=67.0; E value=3e-48; Homolog= yccU COG1832
MSDQYIADILKNTKAIALVGASEKTDRPSYKVMEYLLNQGYHVIPVSPRLAGKTVLGQPVVSQLADIEQSVDMVDVFRNAEAASGMAEEAVAIGAKVFWLQKGVINEEAKSLAENAGLNVVMDRCPKIEIPRLAMEK

SEQ ID NO: 11849 - protein, 106 aa, Xenorhabdus bovienii
  Coding DNA sequence: Name=SeqID_5741
  Gene classification: Function=Uncharacterized ACR; Function class=S Function unknown
  Homolog annotation: Query=2..106bp; Hit=18..122bp; Blast score=156; Percent Identity=73.0; E value=3e-39; Homolog= yccV COG3785
MMIASKFGIGQQVRHKLLGYLGVIVDIDAEYSLEQPQENDIASNATLRSAPWYHVVMEGDDGQPVHTYLAEAQLAYETSDDHPEQSSLDELAESIRSQLQAPRLRN

SEQ ID NO: 11850 - protein, 45 aa, Xenorhabdus bovienii
  Coding DNA sequence: Name=SeqID_5742
MSYLLTDTEFAGDHHIVTSKETLQRFLYKGSKVNFKCTLGKRNFL

SEQ ID NO: 11851 - protein, 92 aa, Xenorhabdus bovienii
  Coding DNA sequence: Name=SeqID_5743
  Gene classification: Gene name=AcyP; Function=Acylphosphatases; Function class=C Energy production and conversion
  Homolog annotation: Query=9..91bp; Hit=9..92bp; Blast score=87; Percent Identity=53.0; E value=2e-18; Homolog= yccX COG1254
MATKGMTIYVYGRVQGVGFRYQTYCWAKKNKLVGYVRNMDDGSVKIVACSSDEQLKKLTHWLEQGGPPGAKVEHFKSQLCEVEEMTDFSIRH

SEQ ID NO: 11852 - protein, 109 aa, Xenorhabdus bovienii
  Coding DNA sequence: Name=SeqID_5744
  Gene classification: Gene name=DsrC; Function=Sulfite reductase, gamma subunit; Function class=P Inorganic ion transport and metabolism
  Homolog annotation: Query=1..109bp; Hit=20..128bp; Blast score=174; Percent Identity=73.0; E value=2e-44; Homolog= ZyccK COG2920
MLVFKDRAIETDAQGYLKNSSDWQEDMASLLAEQEDITLTEQHWEVIRFVREFYEEFNTSPAIRMLVKAISQKYGEEKGSSRYLYRLFPKGPAKQATKIAGLPKPVKCI

SEQ ID NO: 11853 - protein, 42 aa, Xenorhabdus bovienii
  Coding DNA sequence: Name=SeqID_5745
MSCTINITVLNVKYLSVQLPLNYSHCYSLAYFFSRFGDLSWE

SEQ ID NO: 11854 - protein, 114 aa, Xenorhabdus bovienii
  Coding DNA sequence: Name=SeqID_5746
  Gene classification: Gene name=XerC; Function=Integrase; Function class=L DNA replication, recombination and repair
  Homolog annotation: Query=1..109bp; Hit=18..126bp; Blast score=146; Percent Identity=61.0; E value=3e-36; Homolog= Z0324 COG0582
MKLTDMAIKRAKPKEKSYTLADGNGLSLLVETNGSKGWRYRYQFTGKTKMISLGIYPVVTLTEARAKRDEARKQVANGINPSEARKAEKVASISQSENTFKNIALEWYEGRKDR

SEQ ID NO: 11855 - protein, 122 aa, Xenorhabdus bovienii
  Coding DNA sequence: Name=SeqID_5747
  Gene classification: Gene name=XerC; Function=Integrase; Function class=L DNA replication, recombination and repair
  Homolog annotation: Query=1..117bp; Hit=123..239bp; Blast score=155; Percent Identity=62.0; E value=6e-39; Homolog= ZintL COG0582
MMDAFEKDVFPYIGDRPIADIKPMELLEVLSVMEKRGTTEKLKKVRQRCGEVWKYAIITGRAEYNPAPDLASAFVPHKREHYAHLSVSELPEFLSSIDKYMGSQIVRVALRILILTGFDQAS

SEQ ID NO: 11856 - protein, 80 aa, Xenorhabdus bovienii
  Coding DNA sequence: Name=SeqID_5748
  Gene classification: Gene name=XerC; Function=Integrase; Function class=L DNA replication, recombination and repair
  Homolog annotation: Query=1..80bp; Hit=269..348bp; Blast score=106; Percent Identity=62.0; E value=6e-24; Homolog= ZintL COG0582
MRRPHIVPLSEQVIELLKQIHPISGSYQYIFLSRTDYRKHISDMALNTMIRRMGYSGRATGHGFRHTMSTILHEQGYNTA

SEQ ID NO: 11857 - protein, 83 aa, Xenorhabdus bovienii
  Coding DNA sequence: Name=SeqID_5749
MHHIFALFECFHVVGIPLQHFPATIQILGVVVSSSNTVLINMGKLSFNLGSVIALFVQYSAHGVPKAVTCGSTAITHTPNHRI

SEQ ID NO: 11858 - protein, 245 aa, Xenorhabdus bovienii
  Coding DNA sequence: Name=SeqID_5750
MARVKPKEITSWFDISRYEQLLDLTVLEVIDDLKNRVFSLYDYEDEDEDEDEDDADDGSPTLNIDEIRKSILRGLEKGLVNYNSLIIHDIISDLHDGSDEKNIPVIKDESFDKSQECEFIVNGHPIRCVDFFNKEYDEHSIEGKSCNLFNIGDLASYYRGLLRQGDIMEEVNKPVKVIGGNIFSSINKVGYLGDGFNDELVVKFNIGDYSDDELLTEFKGLLKIWRLGTEIDEPKKTIIELDCLH

SEQ ID NO: 11859 - protein, 78 aa, Xenorhabdus bovienii
  Coding DNA sequence: Name=SeqID_5751
MLWEKINQKKISNELYARLLFPLSEGNIMGGVQIKDTVRPFVEKIIFDDFLRYLSFYVKKNEYLKDMRFSDVMKLAEI

SEQ ID NO: 11860 - protein, 30 aa, Xenorhabdus bovienii
  Coding DNA sequence: Name=SeqID_5752
LSFHYLVLDRHNHKNDLSTKIIGLKSRRVS

SEQ ID NO: 11861 - protein, 57 aa, Xenorhabdus bovienii
  Coding DNA sequence: Name=SeqID_5753
  Gene classification: Gene name=AlpA; Function=Predicted transcriptional regulator; Function class=K Transcription
  Homolog annotation: Query=11..57bp; Hit=8..54bp; Blast score=76; Percent Identity=72.0; E value=5e-15; Homolog= Z3946 COG3311
MSTITASKENLIRLPEVQRRTGYGKAWIYKLIADNKFPKQVKMGTRSVAFVESEIDD

SEQ ID NO: 11862 - protein, 42 aa, Xenorhabdus bovienii
  Coding DNA sequence: Name=SeqID_5754
LSTVGRNIKLFITSPRHEIQQYAVISSHQFLTQRKRLSEYPF

SEQ ID NO: 11863 - protein, 81 aa, Xenorhabdus bovienii
  Coding DNA sequence: Name=SeqID_5755
MEKITALIGNGQTHPKFSQSDISIIRKAVISGNWTAINKGICTLTDLGLRHNGQGLVWLNSGVSVHDADSDIGLAGRSCSQ

SEQ ID NO: 11864 - protein, 91 aa, Xenorhabdus bovienii; identical to SEQ ID NO: 6528
  Coding DNA sequence: Name=SeqID_5756
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 11865 - protein, 83 aa, Xenorhabdus bovienii
  Coding DNA sequence: Name=SeqID_5757
MSRGHLSATRRINAGSGMRGNQTRSKSPHMYLAIAVKKRWKNCWRFWHRLKSSIIVLIIMLFMIAFLRELTSEERNLPNASKE

SEQ ID NO: 11866 - protein, 84 aa, Xenorhabdus bovienii; identical to SEQ ID NO: 6530
  Coding DNA sequence: Name=SeqID_5758
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 11867 - protein, 158 aa, Xenorhabdus bovienii
  Coding DNA sequence: Name=SeqID_5759
VCPVNALNNGSYYGFVQLKDIDSYALNIITSISSEYNTRKNGASLATFALLIDQKQRKQAVDNWILYRNPNQPDKYTILNKHHELAKCYQAKGWMREPLVYIARVIRDNAEFSRLMKRLGYIKVRTRKITGSLQDFWVYRHKEKSTSLRTKKTLKTIS

SEQ ID NO: 11868 - protein, 30 aa, Xenorhabdus bovienii
  Coding DNA sequence: Name=SeqID_5760
VIGIDIEPLTIYSNAIEGSRWSFCILDKWD

SEQ ID NO: 11869 - protein, 369 aa, Xenorhabdus bovienii
  Coding DNA sequence: Name=SeqID_5761
VALCLCRSHSFSDQKAPPCRGCSGSGLHSERNRSARGHVMGIINYRDAGRLRSLTVEVLTLGATIALGQFLNALIYNQTAYLQSGHNMVVSFSDAVNLRSSLSGAQKEKDSTANATLWRDSDLSHELNQSVTRNPNLVYEELQQLKRLPSLRGGVNQVKDIYLVSYCSDNHVNNVHSVNQVNLIALDSHCTYCAFINHRTYCRLVQPFGSMPRDCSSLRRVRFIHVARDGSPSIFACSSSCFLNSSVILIWYWGDLFSFGVDMVITLGYCELHGNDHCSISYQIRQRPTVLATHVGRLTKPLVEVTIMAIQQHNQTRLKFTFLIASGNQRLVDIHPVRLITVLADCEGEARLLAGKSNLVFVSRQGVAA

SEQ ID NO: 11870 - protein, 82 aa, Xenorhabdus bovienii
  Coding DNA sequence: Name=SeqID_5762
MSKPITIHQAAEKAQQLEFINQLIESYPHQIQGSEISVMSSLMAKLSGDIAVFLIEVIAGEEAIDNTSHCSDMSTVQGVNHA

SEQ ID NO: 11871 - protein, 56 aa, Xenorhabdus bovienii; identical to SEQ ID NO: 6253
  Coding DNA sequence: Name=SeqID_5763

SEQ ID NO: 11872 - protein, 101 aa, Xenorhabdus bovienii
  Coding DNA sequence: Name=SeqID_5764
MSDIYNHLVRNNFNAMSTEEIKDLRKHSDGAHSAVMAAMSAMGELAFWSADNENYANCQAREDLRRVGEALMYLPRIAEALNDTAQHADFEIHHREGFPKW

SEQ ID NO: 11873 - protein, 319 aa, Xenorhabdus bovienii
  Coding DNA sequence: Name=SeqID_5765
  Homolog annotation: Query=7..310bp; Hit=5..292bp; Blast score=250; Percent Identity=47.0; E value=2e-65; Homolog= ref|NP_404500.1|
MVNHIDIRSVKMAAKDHWQGLLPACGVDVPAKGKHGACPLCGGTDRFHFMDDHGHGDWHCRQCDEPNHGDGLDLLVRAKGITIIEAAKVVADALALPLPEPKPARKEAPKSEAPPIAERIKKLVAQTTVGQSDYLTNKGLQCPHQKLLKDGSLLLVMQALDGTVTGAQTIKPNGEKRLVSGSQKKGSFISLSEITGMPDTFIITEGYATALTVSQLHDGVILAAIDEGNLPTVAEQVRERWPTAKIILAADNDMKSGHKNVGKISAEKAAKSVRGWVTLPPTEEKADWDDYRQRHDIEAAKQAFSNGLYQVGKKNQCQW

SEQ ID NO: 11874 - protein, 582 aa, Xenorhabdus bovienii
  Coding DNA sequence: Name=SeqID_5766
  Homolog annotation: Query=193..580bp; Hit=1..386bp; Blast score=467; Percent Identity=59.0; E value=1e-130; Homolog= ref|NP_287328.1|
MSVVINLAEHREKERDPLIPFIDVRNTGVFYATPKLDKETGEIIKPEQWLCSPIDVIGTGIDENDEQYLIVRWKTKGNKDPVIKGVASADIGEREGWRILKAGGVQVTTKSNLRAILADWLIRSHTKEIWSMTAKSGWHKGAYIMPDGSVIGVPQQPVLFNGGSAAAHAYTVSGTTASWREQVARLANNNPFMMLGIATALAAPMIGIVGADGFGVHLYAQSTAGKTTTADIATSLYGKPDEQRLTWYGTALGIANEALAHNDGLLSLDEVGQGANPKHVHTSAYTLFNGKGKIQGAKEGGNRPLASWRTVAISTGEKDIPTFLMEAGIKINAGQLVRLLNIPMERAKTLHGSENGKAHADALKRGCREHYGAAGREWIGYLSSHHEEARQAYIEAQSRWGKLIPESYGEQVQRVSDRFAVLEAALMLGRVITGWKAQDCRDVLQYIFNVWVAEFGTGNKEFEQIVEQAVSFLNAHGMSRYAPLPYDERDLPIRDLAGYREKKGLHDNDPMIFYTLPATFKQEIARGFNVDMFADTLVKSDILKKPASGRSYQGKTPRLKHLGGIQQRAYIMVLVPESDEEA

SEQ ID NO: 11875 - protein, 30 aa, Xenorhabdus bovienii
  Coding DNA sequence: Name=SeqID_5767
VRVKTCCLSCLGCLIFIFPYERFKTTVFRR

SEQ ID NO: 11876 - protein, 48 aa, Xenorhabdus bovienii; identical to SEQ ID NO: 6457
  Coding DNA sequence: Name=SeqID_5768

SEQ ID NO: 11877 - protein, 41 aa, Xenorhabdus bovienii
  Coding DNA sequence: Name=SeqID_5769
MPPMACQKENFYPFDVVSKPLFVVSCCLNLKTKIITIHTVT

SEQ ID NO: 11878 - protein, 50 aa, Xenorhabdus bovienii
  Coding DNA sequence: Name=SeqID_5770
MRKLRKLYRQKINGFTGMRLELHTLSEERFHDHELTDRIILNLVGECADA

SEQ ID NO: 11879 - protein, 128 aa, Xenorhabdus bovienii
  Coding DNA sequence: Name=SeqID_5771
  Homolog annotation: Query=48..116bp; Hit=52..120bp; Blast score=60; Percent Identity=40.0; E value=4e-09; Homolog= ref|NP_543073.1|
VCGCVIFRWYLTNGVHGPVKGIVTLTGHLLQRGLKGWFPVPERLALNVVMMTVLRLKKYNPYYFQLIVMHYIKASALRAMGTKLGISHNEVSKRLQAAEGFIEGVLAVSGVTLELDKCVQKEIINRVA

SEQ ID NO: 11880 - protein, 150 aa, Xenorhabdus bovienii; identical to SEQ ID NO: 8646
  Coding DNA sequence: Name=SeqID_5772
  Homolog annotation: Query=3..150bp; Hit=250..397bp; Blast score=218; Percent Identity=72.0; E value=3e-56; Homolog= emb|CAC83041.1|

SEQ ID NO: 11881 - protein, 66 aa, Xenorhabdus bovienii; identical to SEQ ID NO: 9011
  Coding DNA sequence: Name=SeqID_5773

SEQ ID NO: 11882 - protein, 49 aa, Xenorhabdus bovienii
  Coding DNA sequence: Name=SeqID_5774
  Homolog annotation: Query=2..49bp; Hit=145..192bp; Blast score=80; Percent Identity=81.0; E value=5e-15; Homolog= emb|CAC83041.1|
MLASAVNPKARVIIVTDAGFQNAGFKQIKTLGWDFVGRIRGNTQLRLEK

SEQ ID NO: 11883 - protein, 47 aa, Xenorhabdus bovienii; identical to SEQ ID NO: 10288
  Coding DNA sequence: Name=SeqID_5775

SEQ ID NO: 11884 - protein, 112 aa, Xenorhabdus bovienii; identical to SEQ ID NO: 8648
  Coding DNA sequence: Name=SeqID_5776
  Homolog annotation: Query=1..112bp; Hit=11..122bp; Blast score=199; Percent Identity=83.0; E value=9e-51; Homolog= ref|NP_085189.1|

SEQ ID NO: 11885 - protein, 62 aa, Xenorhabdus bovienii
  Coding DNA sequence: Name=SeqID_5777
MTYFTYRHSSDLIDLVEQSVDHTTLCLSIFWGFLSAQCGAFYYPVFNKGYLESAVNFKFTTH

SEQ ID NO: 11886 - protein, 154 aa, Xenorhabdus bovienii
  Coding DNA sequence: Name=SeqID_5778
MSEVNKPELKGYVMSFDIGLGVRRLYLGKDLYAERELGYSNDPHTYGALDIITNTTLIRNILFFNFRGDDDLNLPLSIGVISYPNDDSGPISALGRQDLDITVDGVIYHLGSSQEIYVQDGKVLLSYQNADVKKLFAMAMQAIGETKRFCLNWQ

SEQ ID NO: 11887 - protein, 49 aa, Xenorhabdus bovienii
  Coding DNA sequence: Name=SeqID_5779
MRQIEEIAEEIVSELFAVSKTPMEQFGINWKQAERLDSLNEAQLSGNSG

SEQ ID NO: 11888 - protein, 70 aa, Xenorhabdus bovienii
  Coding DNA sequence: Name=SeqID_5780
MSQFEKLPLGDKTPLAFIFGGIFLLAVSILKWMTSDIAVDWLYNSVESLLAIYLITLGFRLRKKYRSNNK

SEQ ID NO: 11889 - protein, 42 aa, Xenorhabdus bovienii
  Coding DNA sequence: Name=SeqID_5781
MIYSHFLFSSLKLGEEIGSTGNNKIFLKIFQTFYDFVFIENI

SEQ ID NO: 11890 - protein, 104 aa, Xenorhabdus bovienii
  Coding DNA sequence: Name=SeqID_5782
  Homolog annotation: Query=6..101bp; Hit=4..99bp; Blast score=110; Percent Identity=63.0; E value=6e-24; Homolog= ref|NP_720319.1|
MGWNMRMPNKDPIELYQWLILLLLSAWGGIVRYIIDIKTSNARWSWIGAFAQIVVSGFTGLIGGFISLEAGLSLYLMFVSAGVSGAMGSIALTYFWNRLTGEQR

SEQ ID NO: 11891 - protein, 133 aa, Xenorhabdus bovienii
  Coding DNA sequence: Name=SeqID_5783
  Homolog annotation: Query=1..133bp; Hit=1..136bp; Blast score=159; Percent Identity=61.0; E value=1e-38; Homolog= ref|NP_930141.1|
MSRGIRNNNPGNIDHNSANKWQGQLPHDPSIEKRFCRFESPEYGIRALMKLLCNYHKKGYQTVAKIIDRWAPTNENNTSAYIKGMAKALGVDPHQVISVDKVTLIVLAKSIIQHENGKQPYSEATFEKAFELL

SEQ ID NO: 11892 - protein, 157 aa, Xenorhabdus bovienii
  Coding DNA sequence: Name=SeqID_5784
  Homolog annotation: Query=11..152bp; Hit=10..148bp; Blast score=119; Percent Identity=48.0; E value=1e-26; Homolog= gb|AAO18062.1|
MKWEVKAVAVIVGIVLIGSAAYSIYSVYAENGRLTGANKSLTTRLSEQVAINTKQQARIQHLAELETKHIRELDNAKSEIDTLRSDVAAGRRKLRIKAVCPVRETTASGSVGDAGTPQLTEAARQDYYDLLRMMAENERQTKYLQDYANTECYKVKK

SEQ ID NO: 11893 - protein, 54 aa, Xenorhabdus bovienii
  Coding DNA sequence: Name=SeqID_5785
MAPATPVSFALRWQFVICSFFGNMGIHQGEGFFFRVVNAIPRPIILYRFLDDSL

SEQ ID NO: 11894 - protein, 81 aa, Xenorhabdus bovienii
  Coding DNA sequence: Name=SeqID_5786
LLSIIRLLLGEDGFIRFTSFCDNNVVKDVENDYEKISSSLPGSRYDSFSFDADLCHYLLTFCSITHSIYRLYSCLSCDESG

SEQ ID NO: 11895 - protein, 116 aa, Xenorhabdus bovienii
  Coding DNA sequence: Name=SeqID_5787
  Homolog annotation: Query=1..115bp; Hit=1..115bp; Blast score=182; Percent Identity=87.0; E value=1e-45; Homolog= emb|CAB58450.1|
MPPRIPRACRKQGCPKTTTDRSGYCPDHLHTGWENHQQGKSRHERGYGRPWDKLRATIKARDKHLCQQCLRNGRAVTGVTVDHIKPKAHGGTDALTNLILLCWSCHRAKTATERLR

SEQ ID NO: 11896 - protein, 55 aa, Xenorhabdus bovienii
  Coding DNA sequence: Name=SeqID_5788
MSEKQVKLSRLYKGGHFKGYALSVDGMLLSNQQQVVIETHSRDIHPTLNGNLHSQ

SEQ ID NO: 11897 - protein, 164 aa, Xenorhabdus bovienii
  Coding DNA sequence: Name=SeqID_5789
  Gene classification: Function=Uncharacterized phage protein; Function class=S Function unknown
  Homolog annotation: Query=55..144bp; Hit=14..103bp; Blast score=65; Percent Identity=37.0; E value=3e-11; Homolog= Z1853 COG3747
MAGTAGRSGRRPKPTARKELAGNPGKRKLNRDEPAFTPLSGVSPPDWFRENELPLAAVMWELTSQELCAQGLLCVTDLAVLERWCVAYQFWRKAVINIAQQGNTVTGATGGPIKNPELTAKKEQQSEMDTTGSLLGLDPSSRQRLIGAAGQAKTDNPFMRMISS

SEQ ID NO: 11898 - protein, 576 aa, Xenorhabdus bovienii
  Coding DNA sequence: Name=SeqID_5790
  Homolog annotation: Query=1..567bp; Hit=1..567bp; Blast score=1009; Percent Identity=82.0; E value=0; Homolog= ref|NP_700375.1|
MSRKSYLNVNAANQYARDVVRGKIEVGRYVREACQRHLDNLNQEKATSFKYRFDKDRAEQAAKFIQLLPHTKGEWAFKRMPITLEPWQLFIVCSVFGWVHKGSRLRRFREVYTEIPRKNGKSAISAGVALYCFTCDDEFGAEVYSGATTEKQAWEVFRPARLMCKRTPMLVEAFGIEVNASNLNRPADGARLEPLIGNPGDGQSPSCAIVDEYHEHDTDDLYTTMLTGMGARRQPLMWAITTAGYNIEGPCYDKRREVLEMLSGNVPNEELFGVIYTVDDGDDWTSPDVLRKANPNMGVSVYADFLLSQQQRALNNPRLASVFKTKHLNIWVSAREAYFNMVSWKQCEDTTLTLEQFEGQPCFLAFDLARKLDMNSMARLFVREIDGKRHYYSIAPRFWVPYDSVYSVEQTENRRTAERFKKWVAMDLLTVTEGAEVDYRYILEEAKLACHLNPVNEAPIDPFGATGLSHSLADEGINPVIITQNFTHMSDPMKELEAAIQSGRFHHDGNPILSWCISNVVGKTMGGNDDIVRPIKEQKDSKIDGAVALIMAMGRAILHEEPDFLSNLDPDDLLML

SEQ ID NO: 11899 - protein, 53 aa, Xenorhabdus bovienii
  Coding DNA sequence: Name=SeqID_5791
MKNLLIDGAALAGTGAVLAGCYLKYGLANTLIIGGVLLIAYALTVARRRKYAA

SEQ ID NO: 11900 - protein, 409 aa, Xenorhabdus bovienii
  Coding DNA sequence: Name=SeqID_5792
  Homolog annotation: Query=1..409bp; Hit=17..424bp; Blast score=677; Percent Identity=78.0; E value=0; Homolog= ref|NP_599035.1|
MLLDALFRSEPLENPRTPITAEAADHDGLFSADVYVSPETSMKLAAAYACIYVLSSSVAQMPLHVMRKNGKTVEMARDHPVFYLVHDEPNDWQTSYKWRELKQRHVLGWGNGYSWVRRNRRGEVTTLEACMPWETTLLNTGGRYTYGVYNEDGSFAISPDDMIHIRALGNNRKMGLSPILQHAETIGMGMSGQKYTSAFFGGNARPAGIVSVKGEVNDKGWERLKQVWKKAAAALRSEENKTLLLPAELDYHALTVSPVDAQLIDMLKLNRSMIAGLFNVPAHMINDLEKATLSNISEQAIQFVRHTVMPWVVNWVQELNRRLFTRQERAAGFYVRFNLAGLLRGTPKERGEFYHFAITDGWMSRNEARAFEDMNPVDGLDEMLVSVNAANLLNNPDQPHPNQEDKPDE

SEQ ID NO: 11901 - protein, 221 aa, Xenorhabdus bovienii
  Coding DNA sequence: Name=SeqID_5793
  Gene classification: Function=Phage head maturation protease; Function class=R General function prediction only
  Homolog annotation: Query=23..197bp; Hit=1..177bp; Blast score=93; Percent Identity=36.0; E value=2e-19; Homolog= L67524 COG3740
VSTPPICLTTRINPIPTRRTNPMSDREMRCYSGEVRTETPENQPTRIVGYGSVFNSRSEPFWGFREIIKPGAFDEVLHDDVRGLFNHDPNFILGRSAAGTLTVSVDERGLQYTIQAPDTQTIRDLVLAPMQRGDITQSSFAFRVARDGEHWYEDEEGIVIREISQFSRLFDVSPVTYPAYQAADSAVRSLQAWQEVRHSGALRQAINQKMARERILTLLNI

SEQ ID NO: 11902 - protein, 409 aa, Xenorhabdus bovienii
  Coding DNA sequence: Name=SeqID_5794
  Homolog annotation: Query=3..406bp; Hit=1..407bp; Blast score=546; Percent Identity=68.0; E value=1e-154; Homolog= ref|NP_599037.1|
MSMKLHELKQRRNTIAAEMRTLHDTIGDAAWTDEQRTEWNKAKTELDSIDAQIQREDELRHLDQQLVNQTESEQRGHPAPPETALAEKRAASFDKYLRHGLGEMTPEERQALRELWAQGTTPDEKGGYTVPVQMLNKVVEAMKAYGGIASVAQILSTSTGQTIEWATADGTTEEGELLGENTAASEEDTLFGTESLGAKKLSSKIIRVSNELLLDSGIDMEAYLAKRIAERIGRGEARYLVKGTGTGSPQQPKGLETSVTGTVDAATKFSWKDMNALKHALDPAYRNTGTFRWAFNDSTLKIITEMEDAQNRPLWLPEIAGVVPSTVLGVPYVIDQAIADMGAGNKFIYCGDFNRFIVRRVTYMTLRRLVERYADYDQTAFLAFHRFDCILEDTAAIKALVGKGTVSAA

SEQ ID NO: 11903 - protein, 43 aa, Xenorhabdus bovienii
  Coding DNA sequence: Name=SeqID_5795
MTLTPRKAVFLCLRSVRVAGVRRQDAFSHRGQTQTAMPYRQQP

SEQ ID NO: 11904 - protein, 93 aa, Xenorhabdus bovienii
  Coding DNA sequence: Name=SeqID_5796
  Homolog annotation: Query=5..83bp; Hit=4..84bp; Blast score=73; Percent Identity=40.0; E value=6e-13; Homolog= ref|NP_700381.1|
MPFPTVDKLRQQCRIDSNHDAEDSLLNTYARAAIRRAENYLNRRLYEEVVPDTDPDGLFVSDDVELAIMLTVGYWYENREAQTLSTPLWATLV

SEQ ID NO: 11905 - protein, 37 aa, Xenorhabdus bovienii
  Coding DNA sequence: Name=SeqID_5797
MKTARRRPYPRPCGRHWFNIDAAIFHFDLSTPLWATP

SEQ ID NO: 11906 - protein, 56 aa, Xenorhabdus bovienii
  Coding DNA sequence: Name=SeqID_5798
MMLNISEKTTKIFSQIPPFNHSTLAMPEGVNSARSVPIEIYQTAIAAILIATFISR

SEQ ID NO: 11907 - protein, 46 aa, Xenorhabdus bovienii
  Coding DNA sequence: Name=SeqID_5799
LRSLIGANCAGLGRQLSVIIDIVSRVAHMGANRSMAAMIVGKLCWC

SEQ ID NO: 11908 - protein, 290 aa, Xenorhabdus bovienii
  Coding DNA sequence: Name=SeqID_5800
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=1..290bp; Hit=1..290bp; Blast score=425; Percent Identity=79.0; E value=1e-119; Homolog= ZyjbC COG1187
MLTNPSIRLNKYISESGICSRRDSDRYIEQGNVFINGKRAAVGDQVFAGDIVKVNGQLIEPRDEEDLVLIALNKPVGIITTMEDSERDNISDFVNHSKRVFPIGRLDKDSQGLIFLTNHGDLVNKILRAGNNHEKEYVVTVDKPVTDEFIQGMSAGVPMLGTVTKKCKVQKEAPFVFRITLVQGLNRQIRRMCKYFGYEVTRLERTRIMNVNLKGLPQGEWRDLTDDELIGLFKLIENSSSEEKPAKKAQTKLVAAKKPGFNVPKNAEKSDGNSASRKRFTQPGRKKKGR

SEQ ID NO: 11909 - protein, 32 aa, Xenorhabdus bovienii
  Coding DNA sequence: Name=SeqID_5801
LYCLANSWRFMFKSLLSARNESRLKDLARSGS

SEQ ID NO: 11910 - protein, 73 aa, Xenorhabdus bovienii
  Coding DNA sequence: Name=SeqID_5802
  Gene classification: Gene name=SuhB; Function=Archaeal fructose-1,6 -bisphosphatase and related enzymes of inositol monophosphatase family; Function class=G Carbohydrate transport and metabolism
  Homolog annotation: Query=6..73bp; Hit=63..129bp; Blast score=64; Percent Identity=50.0; E value=2e-11; Homolog= Rv3137 COG0483
MARMAGTLGEEFGLAGSETFESGWIIDSIDGTRAFIYGVPLFNTLIAYIENGEPVVGVIGFPAISTIVYVAQG

SEQ ID NO: 11911 - protein, 31 aa, Xenorhabdus bovienii
  Coding DNA sequence: Name=SeqID_5803
LRQLTSLKNSDNTHRDHCTTSSLPTLERHIQ

SEQ ID NO: 11912 - protein, 50 aa, Xenorhabdus bovienii
  Coding DNA sequence: Name=SeqID_5804
MKRYHYKGRKDLNIWPAKGANMALNKKVLPVFKYHPDPPLEQGHFLPINR

SEQ ID NO: 11913 - protein, 36 aa, Xenorhabdus bovienii
  Coding DNA sequence: Name=SeqID_5805
LSFTLNISKRMWQLPVNLVMLLFPHLEMSLFSCITV

SEQ ID NO: 11914 - protein, 285 aa, Xenorhabdus bovienii
  Coding DNA sequence: Name=SeqID_5806
  Gene classification: Function=Uncharacterized BCR, integral membrane protein; Function class=S Function unknown
  Homolog annotation: Query=7..285bp; Hit=1..280bp; Blast score=324; Percent Identity=61.0; E value=7e-89; Homolog= PM1172 COG3739
MCQRLNVLRKVDNLLMAHKPNNSTGVKRFILEFLFFGLINARSCLFAGFFFLALFLVPAKGIMGIPRYDVLLVFAVTFQALLIRLKLETWDELKAICVFHLVGFMMELFKTSASISSWQYPDAAFTKLWGVPLFTGFMYAAVGSYIIQSWRFFKVRIEHYPPYWMATLVALAIYINFFSHHYIDDYRWYLTAFIFGLYARGTIFYTPLDQECRMPLLLAFILIGFFIWLAENFGTFFGIWQYPNQLGAWSVVHAGKWGAWSLLVVVTFTIVVHLKHIKANVAIAR

SEQ ID NO: 11915 - protein, 72 aa, Xenorhabdus bovienii
  Coding DNA sequence: Name=SeqID_5807
  Homolog annotation: Query=2..61bp; Hit=129..188bp; Blast score=80; Percent Identity=65.0; E value=7e-15; Homolog= ref|NP_287397.1|
MAEHQKRQLMGIAREKIAPLQDAVDLNIATNTEKSALTEWRKCRVLLNRVDCTTAPNIQWPEQQSVIRRIGS

SEQ ID NO: 11916 - protein, 42 aa, Xenorhabdus bovienii
  Coding DNA sequence: Name=SeqID_5808
MAGTTISDPSDWFLIISGLWGVIRKSARWENSSAISFARSRI

SEQ ID NO: 11917 - protein, 53 aa, Xenorhabdus bovienii
  Coding DNA sequence: Name=SeqID_5809
MFAYRFGLVTIPASNFYRHRHFEIPLKRHKNTRLTLWSHDQIKFTILLILLFN

SEQ ID NO: 11918 - protein, 92 aa, Xenorhabdus bovienii
  Coding DNA sequence: Name=SeqID_5810
  Gene classification: Function=Transposase; Function class=L DNA replication, recombination and repair
  Homolog annotation: Query=4..92bp; Hit=3..91bp; Blast score=83; Percent Identity=42.0; E value=3e-17; Homolog= insA_g5 COG3677
MTVTIEVACRYCNQTEPVRKHGAGKAGFPRYYCKGCQKTFQLNYHYNGHKPGMKEKIVDMAMNGSGVRDTGRVLSIGINTVMRTLKNCRQNR

SEQ ID NO: 11919 - protein, 44 aa, Xenorhabdus bovienii
  Coding DNA sequence: Name=SeqID_5811
MGYDLLPFCIKSIPKPMTLFFVAHKRPLFIQFTNEGDIIINNLP

SEQ ID NO: 11920 - protein, 38 aa, Xenorhabdus bovienii
  Coding DNA sequence: Name=SeqID_5812
MPFDTLSQNFSHQMLFWLDFSGVTSPTIGRDETNMKRG

SEQ ID NO: 11921 - protein, 51 aa, Xenorhabdus bovienii
  Coding DNA sequence: Name=SeqID_5813
  Gene classification: Gene name=InsB; Function=Insertion element IS1 protein InsB, putative transposase; Function class=L DNA replication, recombination and repair
  Homolog annotation: Query=2..46bp; Hit=122..166bp; Blast score=58; Percent Identity=60.0; E value=1e-09; Homolog= insB_g4 COG1662
LTQRIERHNLNLRIHIKRLARRTLCYSRSIEIHEKLIGTYIEKYHYNAWES

SEQ ID NO: 11922 - protein, 219 aa, Xenorhabdus bovienii
  Coding DNA sequence: Name=SeqID_5814
  Gene classification: Gene name=FimC; Function=PapD-like chaperone involved in fimbrial biogenesis; Function class=N Cell motility and secretion
  Homolog annotation: Query=12..215bp; Hit=21..226bp; Blast score=170; Percent Identity=39.0; E value=1e-42; Homolog= yraI COG3121
MVFLYFFSSHFAMAGGVVIGGTRVVYLSDKKEVSVSVNNLEKESVYLIQSWIQDENEKTKTPFIVTPPLFKLPENNENILRIIKVGDGLPMDRESIFWLNVTSIPETVKSSADVNQLQIVVNSRLKLFYRPTQLEENSGEAYKHIKFRKENGVLIAENSTPYFISLSHLKVDGKEIEGAGMINPFSQSSWPFPVKNAKNVSWKAINDYGGVTQEELADL

SEQ ID NO: 11923 - protein, 141 aa, Xenorhabdus bovienii
  Coding DNA sequence: Name=SeqID_5815
  Homolog annotation: Query=1..127bp; Hit=1..129bp; Blast score=127; Percent Identity=51.0; E value=3e-29; Homolog= ref|NP_929417.1|
MSKNIKHNLAKELCEGKYYRLWLPIFIMIGSFSYHFKSYAENDFNIHALRIGDDFPDDIDLSIFNTSKQPPGEYWVDTYLNKESIDTGNVEFILNDGELRPKLTVQKLRDLGVKIDVFPVLMNLPSEEVITQGLRMKIFSG

SEQ ID NO: 11924 - protein, 373 aa, Xenorhabdus bovienii; identical to SEQ ID NO: 9866
  Coding DNA sequence: Name=SeqID_5816
  Homolog annotation: Query=1..369bp; Hit=3..372bp; Blast score=248; Percent Identity=36.0; E value=1e-64; Homolog= ref|NP_415977.1|

SEQ ID NO: 11925 - protein, 726 aa, Xenorhabdus bovienii
  Coding DNA sequence: Name=SeqID_5817
  Gene classification: Gene name=FimD; Function=PapC-like porin protein involved in fimbrial biogenesis; Function class=N Cell motility and secretion
  Homolog annotation: Query=12..726bp; Hit=133..857bp; Blast score=599; Percent Identity=44.0; E value=1e-171; Homolog= Z4968m COG3188
MRNPWVITNISEYIPSASTQFDFNRQRLDISIPQVALNHQVRGYISPESWDQGMTALLVNYHYSGSTNWQDNRRTNQSNYLNLQTGVNWQAWRLRNYSTYTSQRKNWRSIKSYLQRDIHALKGQLIVGDSFTPSYLFDGIEFRGIQLASDENMLPDSMKGFAPVVSRIAQSHAQVTIKQNGYVIYQTYVAQGPFVLTDLYPTTTSGNLEIIIKEADGRERRFIQPFSAAPIMLRKDSLKYSLTMGHYRSPYSHSRKPYFFQGTLIYGLHNNLTAYGGVMLSRDYQSMVLGSGIDLGNFGSLSFDATHANTQLLSDKKSQGQAYRLQSLKALSLTGTHLTVAGYRYSTKGFYDFDDANHADNLNGNNRLFGRINKKSKLQVQVNQIMGDFGGLYVTAFQQDYWGQSGHERGLGAGYNMSLGGINYGLNYTYSRTPDPGNHDQLFSFSVHVPLDRWLKNSWASYSLTSGKNSPTSQQVSLNGTVLEDNNLHYSLQQSYTNQGDGVSGNIHTGYKGAYGRLNAGYNYQHHGRQLNYGVSGGIVAHPYGLTFSQELGETAVLVRAEGAKGVKVANNTGVTTDWNGYAVVPYASSYRKNRVALDPHSFADDVDIDINTQFVVPTKGALTLANFQTRVGSRVLMFLSYQGQPVPFGAIATLEKPHDLDKSNSTIVSSEGQAYFTGMPTRGKLQVKWGFQNAKTCLANYTLPEKQTLSGHPLSGIYTMKVNCE

SEQ ID NO: 11926 - protein, 166 aa, Xenorhabdus bovienii
  Coding DNA sequence: Name=SeqID_5818
MLIFHQNSRFLLAMIILLVSLVTEAYGSEGSCRIKEGRKQHDLSAVFQPKVTISRSDMPGAVIYRHPVISNPQDILGIHCDKPEKISWKFIGYTPTSSRNDGTYDSGVPGIGIRMYGSNIELIKTNPKTGTGPIKNGVIQAYVGSTIVHTYHIHDALITTEKLYLG

SEQ ID NO: 11927 - protein, 121 aa, Xenorhabdus bovienii
  Coding DNA sequence: Name=SeqID_5819
  Homolog annotation: Query=1..120bp; Hit=208..329bp; Blast score=94; Percent Identity=42.0; E value=3e-19; Homolog= ref|NP_929416.1|
MGSIGMWELSGNPRTAGEQDFSIDLDCDDNIPITLKFEGNTVSNDNRILALDQRGSHFTAGGIGLQILYQDQPVMINSVLKVGTSLMGIYSVPFKAHYIQTGSVITAGKANATAKISIIYN

SEQ ID NO: 11928 - protein, 46 aa, Xenorhabdus bovienii
  Coding DNA sequence: Name=SeqID_5820
MLPAIISFYGWLDPFLFIPSLFSGRKRPILLAIDLMLPVCRGNIAN

SEQ ID NO: 11929 - protein, 561 aa, Xenorhabdus bovienii
  Coding DNA sequence: Name=SeqID_5821
  Gene classification: Gene name=MenD; Function=2-succinyl-6-hydroxy -2,4-cyclohexadiene-1-carboxy late synthase; Function class=H Coenzyme metabolism
  Homolog annotation: Query=1..561bp; Hit=1..556bp; Blast score=759; Percent Identity=67.0; E value=0; Homolog= menD COG1165
MSNSVLNRRWAELLLEALTRHGLRHVCIAPGSRSTPLTLSAAGNVKLICHTHFDERGLGHLALGLAKASKEPVAVIVTSGTAVANLYPSLIEAGLTGERLVFLTADRPPELIDCGANQAIRQIGIFASHPTQTLSLPRPTTEISASWLVSVVDNGMSNLKQGGLHINCPFAEPLYGNDVIAYQDWQQTLGEWWQGNQPWLRQPETHVTSKVQDWGLWQNKRGVVLAGRMNAEEGLLVAQWSRKMGWPLISDVLSQTGQPLPCADLWLNHPRAQEILARAQLVIQFGSSLTGKRLLQWQAQCQPEEFWIVDPIVGRLDPANHQGRKFTCYVADWLREHPADSTQEPTSSWADELTSWSEQALECVNARLDGKFGEAAVAYQLHQLLPEQGQLFVGNSLIIRLIDALGQLPAGYPVYSNRGASGIDGLIATAAGVQRATNKPTLAIIGDLSALYDLNSLALLRDLSAPMILIVVNNNGGQIFSLLPTPEEARQRFYCMPQHVNFDHAAAMFGLNYVTPQSWPELKQRVKQAWGQKTTTLLELKVTDSEGARCLQELRKQVAAL

SEQ ID NO: 11930 - protein, 268 aa, Xenorhabdus bovienii
  Coding DNA sequence: Name=SeqID_5822
  Gene classification: Gene name=MhpC; Function=Predicted hydrolases or acyltransferases (alpha/beta hydrolase superfamily); Function class=R General function prediction only
  Homolog annotation: Query=15..264bp; Hit=3..250bp; Blast score=218; Percent Identity=47.0; E value=7e-57; Homolog= yfbB COG0596
MPARVTETGGCIVKLASQVFHSDKSGTWLVWLHGLLGCGDEWLPLVNACNQYASLVIDLPGHGHSADITVAGGFAEMSALLNETLFKHQIHDYWLIGYSLGGRIAMYHATYGKHEGLRGVLVEGGNPGLFSQQERDARLQHDQCWVQRFREESMETVLADWYQQPVFADLSSEQREQLIHCRSQNRGSRIADMLENTSLGHQPWLVPALQQITTHFAYLCGENDEKFQNIAKQYTLPLKTIPQVGHNAHNGNPAAFAAEVNHFLSLFG

SEQ ID NO: 11931 - protein, 285 aa, Xenorhabdus bovienii
  Coding DNA sequence: Name=SeqID_5823
  Gene classification: Gene name=MenB; Function=Dihydroxynaphthoic acid synthase; Function class=H Coenzyme metabolism
  Homolog annotation: Query=1..285bp; Hit=1..285bp; Blast score=555; Percent Identity=89.0; E value=1e-158; Homolog= ZmenB COG0447
MLYPNEEKLYAPIEWQDCSQGFEDILYHKSVDGIAKITINRPQVRNAFRPLTVKEMIQALADARYDDEVGTIILTGMGEKAFCAGGDQKIRGDYGGYQDDNGMHHLNVLDFQRQIRTCPKPVVAMVAGYSIGGGHVLHLMCDLTIAADNAIFGQTGPKVGSFDGGWGASYMARIVGQKKAREIWFLCRQYDAQQALDMGLVNTVVPYADLEKETVRWCREMLENSPMALRCLKAALNADCDGQSGLQELAGNATMLFYMTEEGQEGRNAFNEKRLPDFSRFKRNP

SEQ ID NO: 11932 - protein, 331 aa, Xenorhabdus bovienii
  Coding DNA sequence: Name=SeqID_5824
  Gene classification: Gene name=DgoA; Function=O-succinylbenzoate synthase and related enzymes; Function class=H Coenzyme metabolism
  Homolog annotation: Query=1..323bp; Hit=1..317bp; Blast score=407; Percent Identity=63.0; E value=1e-114; Homolog= ZmenC COG1441
MRKATLYPFSLPMEAGIILRYQRLKTRDGFLVHLQENERHGWGEISPLPEFSHETLEQAKNAAVTWLQQWCQNEQGLTVEPEESELPSVAFGISCALAELQGELPGDADYRKAPLCTGDPDDVIWRLGNMTGQKMAKVKVGLYEAVRDGMVVDVLLEAVPDLQLRLDANRSWTRIKADDFAKYVNPDYRQRIAFLEEPCKTREESLAFARDTGIAIAWDESVRETGFTVEAQEGVAAIVIKPMLVGSIVRCRQLVSDAHQAGLEAVISSSIETSFGLTQLARLAHWLTPDTLPGLDTLDLIQSQLISCWPESPIPCVALDDLDTVWSNECH

SEQ ID NO: 11933 - protein, 466 aa, Xenorhabdus bovienii
  Coding DNA sequence: Name=SeqID_5825
  Gene classification: Gene name=CaiC; Function=Acyl-CoA synthetases (AMP-forming)/AMP-acid ligases II; Function class=I Lipid metabolism
  Homolog annotation: Query=7..458bp; Hit=4..447bp; Blast score=447; Percent Identity=54.0; E value=1e-125; Homolog= menE COG0318
MSLAECAQWPWHHWAMLYPEKRAVRLHEETLSWRQLAEKINAIAAHFHQQGLWESSSVILRGKNSADLLLCYLSALQCGARVLPLNPQLPEPLLEELLPRLNMTFVIDFTDSPSSAIQAIKLDWQPELSVIPEQWVPWDSHRPASMILTSGTSGLPKAAVHSIGAHLASAQGILSCMNFQPNDSWLLSLPLFHISGQGILWRWLLKGAELVLRDLHLLDRALSGCTHASLVPTQLWRLLEQSLEHELTLKAVLLGGAMIPTALTQQAEQLGIHCWCGYGLTEMASTVCVKRADGLSGVGNPLPGKDIRLVDEDIQIRADSIAMGYWLDGKLKPLADTDGWFSTRDRGIFEQGELRILGRLDNQFFSGGEGVQPEDIERIINQHPQILQNFVVPIPDSEFGHRPVVVIETQYPALTETLADWLADKLAAFQRPVACYLLPVQLKNGGIKTSRQQVKQWVLEKWVMSN

SEQ ID NO: 11934 - protein, 42 aa, Xenorhabdus bovienii
  Coding DNA sequence: Name=SeqID_5826
VHVSKYLNLSKYIYPCIFIHHQVYKLIRHNPFFQHPLLDLLA

SEQ ID NO: 11935 - protein, 180 aa, Xenorhabdus bovienii
  Coding DNA sequence: Name=SeqID_5827
  Homolog annotation: Query=1..180bp; Hit=1..180bp; Blast score=240; Percent Identity=69.0; E value=9e-63; Homolog= ref|NP_930299.1|
MKSFIAVSVVSLFFVSGAANAISMNVQAGKHYTSTSVGLGDKSAGLSLNGNWTRSDHNGQIGSLGTAFALPVGPITASVGGKVLYLSPKEGKDGVALAAGAGLSWAVLPSLSLYGEAYGAPSGLTSGVDSYTEATGGVRYTLIRPLIVDAGYRVIDLKGKNGNRSNKVSEGFYIGAGFSF

SEQ ID NO: 11936 - protein, 33 aa, Xenorhabdus bovienii
  Coding DNA sequence: Name=SeqID_5828
MNDADDLDYTFHLSRCCFVGCKLKSIKYRFIRS

SEQ ID NO: 11937 - protein, 382 aa, Xenorhabdus bovienii
  Coding DNA sequence: Name=SeqID_5829
  Gene classification: Gene name=SdaC; Function=Amino acid permeases; Function class=E Amino acid transport and metabolism
  Homolog annotation: Query=1..382bp; Hit=21..403bp; Blast score=441; Percent Identity=69.0; E value=1e-124; Homolog= tyrP COG0814
MLAMPLASAGVGFGTTLVMLVALWALMSYTALLLVEVYQYNEPDTGLGTIAKHYLGLKGQLLTGFSMLFLMYALTSAYISGAGELLTSSINAWAGSSLSLSTGVILFTIVAGGVVCIGTSSVDFINRILFSAKLIFLVLMLGLMMPHIRHVNLLSLPLEQGIVLSAIPVIFTSFGFHGSVPSIVRYMKGDIRKLRWIFIIGSAIPLAAYIFWQLGTLGSIAPTSFMGILAEKSGLDGLLGAIRHVVASPQTELSVRMFANLALVTSFLGVALGLFDFLADLFKRQDNIAGRFQTGLLTFVPPLVFALFYPKGFIMALGYAAAALSILALLLPSILVFKARQQHKRQYRVFGGTPALVVVFLCGIILIAIQIGIVAGILPEVG

SEQ ID NO: 11938 - protein, 58 aa, Xenorhabdus bovienii
  Coding DNA sequence: Name=SeqID_5830
MTSVVPKPTPAEASGIASIPAPIVVPATIKILPIVRFFTRSSLLNMLKNSYKIGRLKD

SEQ ID NO: 11939 - protein, 36 aa, Xenorhabdus bovienii
  Coding DNA sequence: Name=SeqID_5831
VDSLLFRIYFHLDGRERLEFGRHIASRSYGMKVQVT

SEQ ID NO: 11940 - protein, 30 aa, Xenorhabdus bovienii
  Coding DNA sequence: Name=SeqID_5832
MGNHPRVRISILPPNFAGLAQLVEQLTCNQ

SEQ ID NO: 11941 - protein, 34 aa, Xenorhabdus bovienii
  Coding DNA sequence: Name=SeqID_5833
MVSHRRFSRPLPSTARPSFHGARLCLYRSDVSSP

SEQ ID NO: 11942 - protein, 38 aa, Xenorhabdus bovienii
  Coding DNA sequence: Name=SeqID_5834
MARDYAYTVLMCLVPEGKKIVFFLLFAQSSICNGLFIL

SEQ ID NO: 11943 - protein, 900 aa, Xenorhabdus bovienii
  Coding DNA sequence: Name=SeqID_5835
  Gene classification: Gene name=BaeS; Function=Signal transduction histidine kinase; Function class=T Signal transduction mechanisms
  Homolog annotation: Query=6..690bp; Hit=13..700bp; Blast score=421; Percent Identity=34.0; E value=1e-117; Homolog= ZyojN_1 COG0642
MYKQASIKPSTIPRFYALFVILLFTSLFLFGYNYFDSWLTEKKYAISSVTVKMRLQIENYRYHANHIFEQSNIPSSSSSSQEATSLFKLRPDVHWLESRYKTVDAIIFGQYNHSSIQLAQRLSNYLEILWGSRNEYESMYYLNGKDNNLLLVTTHPILKPEIRFKESYLTLTSEAKRTEMLAQSIALDEKESISAINVLRGENIYFYTYKAAFNLPGQLTTVIAFELPINNLLPIDMSPANFRLNLTNSHDAEGSNKVEVSLNGFWLEFSQHLNAMPYKLVYQVPLKALIIDLLIRNIWLLLSILLFSMFSLSGLFYIRRRYITPNASMDHELKIKDSLGNDIISNIPIGLLIYDFASNRLITSNKIAEQLIPYLDLNKVKAMAQQHHGVIQTSIDDAIYEVKMYNSNLLPETYLFLLQDRDQEVMINRRLQFANREYDKTVQARRSMLSNINNEIKIPIQSLNEIAVQLQQRSQDESMQNLLDKLLVKSEYITKWVENISLLNELESGDWQSATEIFSLSSRLEHILKASLSTLNAKGLKTYYHFNLHHESLFIGDGVAITKIISLLFNYAIAATSYGKISLSINSSGKYDNYIQIDLIDTGSGLSEKDLTSLNYPFLNKSAEDKYYTNSGLTFYLCNQLCKKMGGNFEIKSKLGLGTHYVINLPLLQHSDNNGETPQLLEDVTALIDISNPEISKIIHNYLNNYGASYFDKIKENVTEEYDIILTDMQYKVEKPTILLVDGLADLKKMKPNLVQCNYNFVDAVINAISLLVEENFSLDESCYALETPKSECNIVNSVDNILKGYQTQLADSDYRKLFIETVPMDITKLYTDMERHDLTSLSQTVHRLKGAFAMLDLKLLKSSCEALEQHIADNNEIEIKNSISRIDSFVTKLLQQGNQ

SEQ ID NO: 11944 - protein, 216 aa, Xenorhabdus bovienii
  Coding DNA sequence: Name=SeqID_5836
  Gene classification: Gene name=CitB; Function=Response regulator containing a CheY-like receiver domain and an HTH DNA-binding domain; Function class=T Signal transduction mechanisms
  Homolog annotation: Query=1..210bp; Hit=1..210bp; Blast score=351; Percent Identity=87.0; E value=3e-97; Homolog= rcsB COG2197
MNNLNVIIADDHPIVLFGIRKSLEQIEWINVVAEFENSTTLINNLPHIEADVLITDLSMPGDKYGDGITLIKYIKRHYPTLAIIVLTMNNNPAILSAVLELDIEGIVLKQGAPTDLPRALSALQKGKKFTPESVSKLLEKVNANGYGDKPLSPKESEVLRLFADGLLVTDIAKKLNRSIKTISSQKKSAMLKLGVDNDIALLNYLSSVTIEKDIGR

SEQ ID NO: 11945 - protein, 919 aa, Xenorhabdus bovienii
  Coding DNA sequence: Name=SeqID_5837
  Gene classification: Gene name=BaeS; Function=Signal transduction histidine kinase; Function class=T Signal transduction mechanisms
  Homolog annotation: Query=1..692bp; Hit=8..699bp; Blast score=680; Percent Identity=48.0; E value=0; Homolog= rcsC_1 COG0642
MLWALGALLTSFYLVNIFNEVKSDIRQEYNTNYDTMFSYIRHTTNTLRDIQHMTEKHLSQKNEKDLTITLPYNNPAFSYTPLNMNSDCDLLRKSTHNYLDSLNNLILFWKDNIAAPRGLNQIFLVGTQSMCMVSFSVRSTITEPETLKKMVYENFRKLIILKEQGKERNVFWVMPNTRADSGTFYILAPIYTNGQMTAVIGIEQAIRLDSFLQTRNRPISITMLNHYNQPELYYPVKNDNKLRYADYNIQTPYFGYDEGYTNLLLKRRLAPSSFNVIFSLPLKNIYDEFKVTIINSIVLNIISAILIIFFVWLFERKIFAPAEDNAIRLEEHEQFNHKIVASAPVGISILRINDGANILSNELAHNYTRMLTYEDQKRIVDIICDKTSTYIDVVTSNNNHLQISFVHSRYRNEEVAICVLVDISTRVKMEQSLQEMASAAEQANQAKSMFLATVSHELRTPLYGIIGNLELLQSHTLPLESARLLSAMDNASSLLLKIISDILDFSKIESKQLKIDSKKFSCKEIVLHVISNYLPLIVKKELGLYCYIEPNIPDIINNDPVRLQQIISNLLNNAIKFTETGCVVITISIKHSYLYISIKDTGFGIEDKLQTQLFEPFFQINANKQNFSQGTGLGLVICEKLINLMDGDIEFVSQQHIGSIFSIRLPLYGAKYHTKEYSKNRTQQKIVLAVRNDYLEKYLQNFLTKNYFQIALYDKNKIDGTELVIIDQPDVLDITVRYYIEISEKHIGPPKQIREHYWLHNTYQLSELDSVIDKLLSKNNHVSPATISTSTSIQADSRLSTIKILVVDDHPLNRHLLIEQLNTIGFKTAAANDGIDAIEHLKNNSTDIILTDVNMPNMDGYEFTKYLRDKGYTSPIIGITANALAEEKQRCTDAGMDHCLSKPVSLAILRDTLIEYSDI

SEQ ID NO: 11946 - protein, 48 aa, Xenorhabdus bovienii
  Coding DNA sequence: Name=SeqID_5838
MFFIRRPFEISIFFSNVTKDIPLPFSGAWLYAVGIRRLINQLLSGKYF

SEQ ID NO: 11947 - protein, 34 aa, Xenorhabdus bovienii
  Coding DNA sequence: Name=SeqID_5839
MPAFFVQFFYKELTRTKCCFVFPATLVYAVNSYY

SEQ ID NO: 11948 - protein, 886 aa, Xenorhabdus bovienii
  Coding DNA sequence: Name=SeqID_5840
  Gene classification: Gene name=GyrA; Function=DNA gyrase (topoisomerase II) A subunit; Function class=L DNA replication, recombination and repair
  Homolog annotation: Query=7..886bp; Hit=1..866bp; Blast score=1379; Percent Identity=81.0; E value=0; Homolog= gyrA COG0188
MRDSGSMSDIAREITPVNIEEELKSSYLDYAMSVIVGRALPDVRDGLKPVHRRVLFAMNVLGNDWNKSYKKSARVVGDVIGKYHPHGDSAVYDTIVRLAQPFSMRYMLVDGQGNFGSVDGDSAAAMRYTEIRMAKIAHELLADLEKETVDFVPNYDGTEQIPVVMPTRIPNLLVNGSSGIAVGMATNIPPHNLSEVIDGCLAYIDDENISIEGLMEYIPGPDFPTAAIINGRSGILEAYRTGRGKIYIRARAKIETDEKNGRETIIVNEIPYQINKARLIEKIAELVKDKRIEGISALRDESDKDGMRIVIEVKRDAVAEVVLNNLYSLTQLQVSFGINMVALHQGQPKLLNLKDILSAFINHRREVVTRRTIFELRKARDRAHILEALAIALVNIDSAIELIRRASTPAEAKANLIAQAWELGNVAAMLEQAGDDAARPEWLEPEYGIHDGKYYLTEQQAQAILDLRLQKLTGLEHEKLLDEYRELLKLIGELLFILENPERLREVIREELLAIKDQYNDARRTELTENSADINIEDLINQEDVVVTLSHQGYVKYQPLSDYEAQRRGGKGKSAARIKEEDFLERLLVANTHDTILCFSNKGKMYWMKVYQLPEASRGARGRPIVNLLPLEQEERITAILPVREYEDGLNIFMATASGTVKKTKLSEFSRPRSAGIIAVKLNDGDELIGVDLTDGSNEVMLFSAKGKVVRFLEEDEETLEDGTIRVKGVRAMGRTAAGVRGIKLSAGDKVVSLIIPRGEGEILTVTENGYGKRTAQSEYPTKSRATQGVISIKVSERNGNVIGAIQVEPTDQIMMITDAGTLVRTRVSEVSVVGRNTQGVTLIRTAEDEKVVGLQRVAEPDEDEDEENNITSPSDEGNSESEDQV

SEQ ID NO: 11949 - protein, 64 aa, Xenorhabdus bovienii
  Coding DNA sequence: Name=SeqID_5841
MCESGILTFISDIAPRNCFIENCSTESVTVLWGCVIRGYYTCLNLEIPASGFYKTVNLWYNLSL

SEQ ID NO: 11950 - protein, 254 aa, Xenorhabdus bovienii
  Coding DNA sequence: Name=SeqID_5842
  Gene classification: Gene name=UbiG; Function=2-polyprenyl-3-methyl-5- hydroxy-6-metoxy-1,4-benz oquinol methylase; Function class=H Coenzyme metabolism
  Homolog annotation: Query=21..253bp; Hit=7..239bp; Blast score=400; Percent Identity=79.0; E value=1e-112; Homolog= ZubiG COG2227
MKQFLGAISLMNVKIPDSHIPSHPNVDQQEIEKFEAVASRWWDLEGEFKPLHRINPLRLNYILQRAGGLFGKKVLDVGCGGGILSESMAREGADVTGLDMGFEPLQVARLHALESDTSVTYVQETVESHAEQHLHSYDVVTCMEMLEHVPDPESVIRACAKLVKPGGHVFFSTINRNRKAWLMAVIGAEYILNMVPKGTHDAKKFIRPSELIGWVDKTPLKDQHIIGLHYNPLTDKFRLGHNVDVNYMLHTQSV

SEQ ID NO: 11951 - protein, 61 aa, Xenorhabdus bovienii
  Coding DNA sequence: Name=SeqID_5843
MLLSQNYRRNGGNKILKIISICRFINPLTVTFKPIEYEACSSRLHCVQVEICLSAGCNVTQ

SEQ ID NO: 11952 - protein, 36 aa, Xenorhabdus bovienii
  Coding DNA sequence: Name=SeqID_5844
VKVTSSNYAGYRLFGKINPQVIHKTSPFCALEKMRI

SEQ ID NO: 11953 - protein, 30 aa, Xenorhabdus bovienii
  Coding DNA sequence: Name=SeqID_5845
MGKYTFSLSYLAFIAFLDIDILTARCTRNG

SEQ ID NO: 11954 - protein, 763 aa, Xenorhabdus bovienii
  Coding DNA sequence: Name=SeqID_5846
  Gene classification: Gene name=NrdA; Function=Ribonucleotide reductase alpha subunit; Function class=F Nucleotide transport and metabolism
  Homolog annotation: Query=1..763bp; Hit=1..761bp; Blast score=1396; Percent Identity=87.0; E value=0; Homolog= nrdA COG0209
MNQSLLVTKRDGHKEQIDLEKIHRVVAWAAEGLKNVSVSQVELRSQIQFYDGIKTADIHETMIKAAADLISGDAPDYQYLAARLAIFHLRKKAYGQFEPPALHDHVVRMVNLGKYDKHLLEDYSKEEFEQMDSFIDHLRDMDFSYAAVKQLEGKYLAQNRVTGEIYESAQFLYILVAACLFSTYPKETRLSYIRRFYDAVSTFKISLPTPIMAGVRTPTRQFSSCVLIECGDSLDSINATSSAIVKYVSQRAGIGVNAGRIRALGSPIRDGEAFHTGCIPFYKHFQTAVKSCSQGGVRGGAATLFYPLWHLEVESLLVLKNNRGVEGNRVRHMDYGVQLNKLMYERLIKGEDITLFSPSDVPGLYDAFFADQDEFERLYTQYENDVTIRKERIKAVELFSLMMQERASTGRIYIQNVDHCNTHSPFDPAVAPVRQSNLCLEIALPTKPMNNINDENGEIALCTLSAFNLGAINNLTELEELAELAVRALDSLLDYQDYPIIAAKQGSMGRRTLGIGVINFAYYLAKNGVRYSDSSANNLTHKTFEAIQYYLLKASNGLAKEKGACPWFGETTYAQGILPIDTYKKTLDTLTREPLHMDWEALRNDIRQHGLRNSTLSALMPSETSSQISNATNGIEPPRGYISIKASKDGILRQVVPEYNRLKGAYELLWQMPGTDGYLQLVGIMQKFIDQSISANTNYDPARFPNGKVPMNQLLKDLLLAYKYGVKTLYYHNTRDGAEDVQGDLEEVVESADSDCDGGACKI

SEQ ID NO: 11955 - protein, 376 aa, Xenorhabdus bovienii
  Coding DNA sequence: Name=SeqID_5847
  Gene classification: Gene name=NrdF; Function=Ribonucleotide reductase beta subunit; Function class=F Nucleotide transport and metabolism
  Homolog annotation: Query=1..376bp; Hit=1..376bp; Blast score=677; Percent Identity=88.0; E value=0; Homolog= nrdB COG0208
MSYTTFSQVKNDQLQEPMFFGQPVNVARYDQQKYPIFEKLIEKQLSFFWRPEEVDVSRDRIDYNALPDHEKHIFISNLKYQTLLDSIQGRSPNVAFLPLISIPELETWVETWSFSETIHSRSYTHIIRNIVNDPAVVFDDIVANEQILKRAKDISGYYDVLIEMTNYYHQLGEGTYNVAGKNITVSLRALKKQLYLCLMSVNALEAIRFYVSFACSFAFAERELMEGNAKIIKLIARDEALHLTGTQHMLNLLRSGQDDPEMAEIARECEQQCYDLFVLAAEQEKEWADYLFKDGSMIGLNKEILCQYVEYITNIRMQAVGLKLPFEARSNPIPWINAWLVSDNVQVAPQEVEVSSYLVGQIDSEVNAEDLSGFEL

SEQ ID NO: 11956 - protein, 99 aa, Xenorhabdus bovienii
  Coding DNA sequence: Name=SeqID_5848
  Gene classification: Gene name=Fdx; Function=Ferredoxin; Function class=C Energy production and conversion
  Homolog annotation: Query=34..98bp; Hit=19..83bp; Blast score=82; Percent Identity=61.0; E value=5e-17; Homolog= ZyfaE COG0633
MLRISAVSNSDMADYKVTLPSRQGLSVHYSSGFHRNLLEALEQGKVQLEYQCRQGYCGSCRVRLVKGKVGYPCKPLAFVNEGEILPCSCHPLTDIEIEP

SEQ ID NO: 11957 - protein, 83 aa, Xenorhabdus bovienii
  Coding DNA sequence: Name=SeqID_5849
  Homolog annotation: Query=1..83bp; Hit=456..538bp; Blast score=139; Percent Identity=77.0; E value=1e-32; Homolog= ref|NP_927497.1|
MTCSLMVYAALEHKIRTGLKQNAPFYPDMKGKPTQSPTARWVFLTFEGISTFEFQEHRMVTGIQMYQNELLKILGQPYESFYS

SEQ ID NO: 11958 - protein, 468 aa, Xenorhabdus bovienii; identical to SEQ ID NO: 8259
  Coding DNA sequence: Name=SeqID_5850
  Homolog annotation: Query=1..453bp; Hit=1..453bp; Blast score=684; Percent Identity=73.0; E value=0; Homolog= ref|NP_927678.1|

SEQ ID NO: 11959 - protein, 37 aa, Xenorhabdus bovienii
  Coding DNA sequence: Name=SeqID_5851
VDAVSQCIVLPTITKVQIISLINLSVIPHLIPDLKIM

SEQ ID NO: 11960 - protein, 146 aa, Xenorhabdus bovienii; identical to SEQ ID NO: 8316
  Coding DNA sequence: Name=SeqID_5852

SEQ ID NO: 11961 - protein, 178 aa, Xenorhabdus bovienii; identical to SEQ ID NO: 8288
  Coding DNA sequence: Name=SeqID_5853
  Gene classification: Function=Predicted transposase; Function class=L DNA replication, recombination and repair
  Homolog annotation: Query=16..144bp; Hit=3..128bp; Blast score=68; Percent Identity=36.0; E value=4e-12; Homolog= DR0255 COG3335

SEQ ID NO: 11962 - protein, 163 aa, Xenorhabdus bovienii; identical to SEQ ID NO: 7546
  Coding DNA sequence: Name=SeqID_5854
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 11963 - protein, 117 aa, Xenorhabdus bovienii; identical to SEQ ID NO: 7849
  Coding DNA sequence: Name=SeqID_5855
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 11964 - protein, 53 aa, Xenorhabdus bovienii
  Coding DNA sequence: Name=SeqID_5856
MDSISCIIIRTGRRIAFSKELAIAYVRISFHYLYHAILTSFYIFTIHFMEKIM

SEQ ID NO: 11965 - protein, 32 aa, Xenorhabdus bovienii
  Coding DNA sequence: Name=SeqID_5857
LVECFNFIVNFLSESLMNGLVSLNSDLSNFNI

SEQ ID NO: 11966 - protein, 150 aa, Xenorhabdus bovienii
  Coding DNA sequence: Name=SeqID_5858
MGKLSCFPVMVMVIAMLICNIAEAKSPYDGDYLCKINKELNDVTIKNGGMYFFPTNLDTARVSYRDESFTIYETRPEVFMSPKLTPITKFGILNKKELTEMGENTLIYGGEGRGLGYFRPSQNEFFISKIKIPNVKGAYILSLEHCVKQL

SEQ ID NO: 11967 - protein, 47 aa, Xenorhabdus bovienii
  Coding DNA sequence: Name=SeqID_5859
LNIVLSSCELFKEQPRRGFFLIWYRHRNQDTVSKQEKLCRAKKIYIW

SEQ ID NO: 11968 - protein, 50 aa, Xenorhabdus bovienii
  Coding DNA sequence: Name=SeqID_5860
LNDPILPICDDKVTRLVLYGVIREDMMHIRYTIPIVYSIVSLCSDNSDSF

SEQ ID NO: 11969 - protein, 161 aa, Xenorhabdus bovienii
  Coding DNA sequence: Name=SeqID_5861
MVELKPGKHVLETSDGKKQPFLVYSKNQGGIINPNRELYYTYNMVYAIENHENKFSPQNTEVVIDGVTLEGPIRSSDAVFIDNNVFRCTYPIGTPFPEEIVIYDKKSKGNIKSKCFRKKEFIDFYEQESGEALHSEHDSLNSNDTWIRLISYRLDGQVLIA

SEQ ID NO: 11970 - protein, 337 aa, Xenorhabdus bovienii
  Coding DNA sequence: Name=SeqID_5862
  Gene classification: Function=Transposase; Function class=L DNA replication, recombination and repair
  Homolog annotation: Query=12..329bp; Hit=2..310bp; Blast score=138; Percent Identity=31.0; E value=9e-33; Homolog= NMB1750 COG3547
MASNKRRVIMYYVGIDVSKNKLDICLLYDGVKGKRKTKSLLNNEHSACMLIAWLAKYIPALQQVNIVMEATGVYHERLAYSLHQAGGRIAIANPLRVRDFAKGMGILTKTDKVDAYILACYSALKQPDVWQPPPIEIRELKALLCRRDALLEDIQRERNRYEKSGSTHTPKRVIESIEAMMHHMKNELAELEALIAEHINQHPNLKKDFELLTSIKGVGTQIGLNMLIILRTNTFTRATQVAAYLGVIPIAKQSGTSVHGRVRLSKTGPTKIRAKLFMSALTAVRFNPHINDLYNRLVNKGKAKMLALGAAMRKLVHLCYGVLNTQQSYDENYAIRT

SEQ ID NO: 11971 - protein, 54 aa, Xenorhabdus bovienii; identical to SEQ ID NO: 10546
  Coding DNA sequence: Name=SeqID_5863

SEQ ID NO: 11972 - protein, 30 aa, Xenorhabdus bovienii
  Coding DNA sequence: Name=SeqID_5864
MRLTLFLMMVANHHNYYDTSAIFQKGGQLL

SEQ ID NO: 11973 - protein, 203 aa, Xenorhabdus bovienii
  Coding DNA sequence: Name=SeqID_5865
  Gene classification: Gene name=Tra8; Function=Transposase, IS30 family; Function class=L DNA replication, recombination and repair
  Homolog annotation: Query=1..203bp; Hit=1..203bp; Blast score=179; Percent Identity=52.0; E value=1e-45; Homolog= NMB1770 COG2826
MAYTQLTEIERYQISSLKEAGFTQRFIATSLNRNPSTISRELKRNQAVQKYCPQQAQLKASERRHSALKAVKVTPEITKWINQLIWQDLSPEQTVGYLKREMRISLHHETIYRLIYKDKINGGDLWQHLRIAKKPYRKRYGSYERRGKIKNRVSIDKRPKIVDKKQRIGDWEGDTIVGKDHKSALLTLVERKSLFTLIIKLET

SEQ ID NO: 11974 - protein, 31 aa, Xenorhabdus bovienii
  Coding DNA sequence: Name=SeqID_5866
MDFRNLKLKSELGIFDIIATNHKYNLMPFLL

SEQ ID NO: 11975 - protein, 43 aa, Xenorhabdus bovienii
  Coding DNA sequence: Name=SeqID_5867
LSDNLNQPLFISYVLDVSIFRCVVITVISMGRFFGVLVELQSI

SEQ ID NO: 11976 - protein, 35 aa, Xenorhabdus bovienii
  Coding DNA sequence: Name=SeqID_5868
VSQFITLKEIIMKSVKSFLSNVHNVVIRLSTTRFM

SEQ ID NO: 11977 - protein, 37 aa, Xenorhabdus bovienii
  Coding DNA sequence: Name=SeqID_5869
MISFRVINCDTLHENINSEGDFMLKIKRVKAFIKIFF

SEQ ID NO: 11978 - protein, 34 aa, Xenorhabdus bovienii
  Coding DNA sequence: Name=SeqID_5870
LYFLCCHIGLLLFCNCFSFGFHTDSGVISLIFLS

SEQ ID NO: 11979 - protein, 30 aa, Xenorhabdus bovienii
  Coding DNA sequence: Name=SeqID_5871
MPFSLISISYLQLLEFIVKLNFSEKTLVKC

SEQ ID NO: 11980 - protein, 144 aa, Xenorhabdus bovienii
  Coding DNA sequence: Name=SeqID_5872
  Gene classification: Function=Phage-related lysozyme (muraminidase); Function class=R General function prediction only
  Homolog annotation: Query=3..142bp; Hit=42..181bp; Blast score=103; Percent Identity=45.0; E value=6e-23; Homolog= XF1669 COG3772
MEISENGINKIKSYEGLRLHAYPDPATGAEPWTIGYGHTKGVKPEQIITEQQAETFLHEDLIPIYAEIQRIVKVPLTQGQFDALCSFIFNLGVGNFIHSTLLKKLNLADYQGAAEEFLKWDRADGRVLADLRVRRASEQKMFMS

SEQ ID NO: 11981 - protein, 33 aa, Xenorhabdus bovienii
  Coding DNA sequence: Name=SeqID_5873
VFEEHLSRKCLCHNTMLIRPYYEMQKILIAGFD

SEQ ID NO: 11982 - protein, 35 aa, Xenorhabdus bovienii
  Coding DNA sequence: Name=SeqID_5874
LISPNLLFRFKHYHNKPFYLLFLERSCVKNPYYSN

SEQ ID NO: 11983 - protein, 31 aa, Xenorhabdus bovienii
  Coding DNA sequence: Name=SeqID_5875
MAIVSYYKIHHHIFNPYFLFGLDKPEFIVQI

SEQ ID NO: 11984 - protein, 131 aa, Xenorhabdus bovienii
  Coding DNA sequence: Name=SeqID_5876
  Homolog annotation: Query=1..127bp; Hit=1..127bp; Blast score=195; Percent Identity=70.0; E value=1e-49; Homolog= gb|AAO18063.1|
MKTTPVLRIARPTDNLSIIKDMYCKGLQFTLLGEFRDHDNFDGVMLGHPNHSWHLEFTHHHNTSVGKAPTQDSLLVFYIEDESEWQKQSQLMQEAGFSLVPSYNPYWDRTGKTFEDIDGYRVVLQNTPPHI

SEQ ID NO: 11985 - protein, 118 aa, Xenorhabdus bovienii
  Coding DNA sequence: Name=SeqID_5877
  Homolog annotation: Query=1..94bp; Hit=17..109bp; Blast score=70; Percent Identity=46.0; E value=4e-12; Homolog= gb|AAM21662.1|AF497970_3
MAWHSVTQSQTLTGKSRRTLYRDMAKGRLSWQTNANGHREIETTELIRVYGELVKSGTAEWPRETQSNGTQHQSELLTEIRTLRQEIADLKATVLRLEYKPTPTRDLKDKKWWQWWRS

SEQ ID NO: 11986 - protein, 59 aa, Xenorhabdus bovienii
  Coding DNA sequence: Name=SeqID_5878
  Homolog annotation: Query=1..59bp; Hit=1..59bp; Blast score=63; Percent Identity=57.0; E value=6e-10; Homolog= pdb|1B6Q|
MNKQEKSCLNIAKFIRGQTLLLLEKINELDLDDEAEACEKLHDDAEALYHQLVSRYGEE

SEQ ID NO: 11987 - protein, 84 aa, Xenorhabdus bovienii
  Coding DNA sequence: Name=SeqID_5879
  Gene classification: Gene name=Nlp; Function=Predicted transcriptional regulator; Function class=K Transcription
  Homolog annotation: Query=6..74bp; Hit=7..75bp; Blast score=88; Percent Identity=69.0; E value=1e-18; Homolog= sfsB COG3423
MNMNQDWHPADIIAALRKQGTTLAAISRKAGLSSSTLANTLIRPWPKGEWIIANQLEMHPSQIWPSRYFDSTGHLIERKPRKTP

SEQ ID NO: 11988 - protein, 74 aa, Xenorhabdus bovienii
  Coding DNA sequence: Name=SeqID_5880
MAKLFTYQTSKNTYALARDAADLIKCAEYLCRQNDIRENMQHLHSCIYATMKKIRKVSRLLETYEVNEVIETRQ

SEQ ID NO: 11989 - protein, 66 aa, Xenorhabdus bovienii
  Coding DNA sequence: Name=SeqID_5881
MDERDELMQQISNLLINSPVRSEDKLAVMMMFCFQLLSSTQTDGVNMRVSDSRVLSLKFELETLKL

SEQ ID NO: 11990 - protein, 296 aa, Xenorhabdus bovienii
  Coding DNA sequence: Name=SeqID_5882
  Homolog annotation: Query=27..270bp; Hit=14..255bp; Blast score=161; Percent Identity=37.0; E value=1e-38; Homolog= ref|NP_927759.1|
MDIKRQNELLNFHLGGIVQIDKADGILKPRESTSQAIEKMIQQLDKNTELYVLLTLEEAVDAVKNLCGPNPNASWKDGLFSCSDIVTSFTGSIIDAYGALKLANELSSNFGVKVKEYIDKHGNRNIKLTGRTGVRNFLTAAKYGVNNWKMIEMGIGSQGMQSGIITGARYCIFVSAAYRSLELLFRDEYDVHSFFGNISMDVAKTAVGFFAGMGAKAVVGTFLTAGTYALAVSVGIFLVGFGVAIILYHLDNKYEISKKLINFMREDAIRYAERNRVNYGPHPDKVFSELGRAWRG

SEQ ID NO: 11991 - protein, 159 aa, Xenorhabdus bovienii
  Coding DNA sequence: Name=SeqID_5883
  Gene classification: Gene name=Hcp; Function=Hemolysin-coregulated protein (uncharacterized); Function class=R General function prediction only
  Homolog annotation: Query=1..158bp; Hit=1..158bp; Blast score=157; Percent Identity=50.0; E value=6e-39; Homolog= Z0248 COG3157
MSYMIYLSLNGKKQGLISAGCSTLDSIGNRYQKGHEDKIQVLSLNHSLMRQQNVSHNPVQFVKPIDKSSPLLAMAIDSNESLNGAFIFYRTSQIGQLELFYEVKITEATITDLSCVYPHSINEHDKMPYEKVVLNYKSITWNHITAGTSAYSIWEDRVL

SEQ ID NO: 11992 - protein, 43 aa, Xenorhabdus bovienii
  Coding DNA sequence: Name=SeqID_5884
MGIKPGPKPIAESTGKEDKRQRVTPENKPKHPDLKEHQHKKGE

SEQ ID NO: 11993 - protein, 77 aa, Xenorhabdus bovienii
  Coding DNA sequence: Name=SeqID_5885
MAFYENKKSVLETDKPEQYRKIRSIGEIPPGPGIYECQTCKYEDVVNRECEKLPPCSNCKKKGHTNKWKLLVKATDK

SEQ ID NO: 11994 - protein, 94 aa, Xenorhabdus bovienii
  Coding DNA sequence: Name=SeqID_5886
  Homolog annotation: Query=1..94bp; Hit=1..94bp; Blast score=142; Percent Identity=79.0; E value=1e-33; Homolog= ref|NP_757323.1|
MSFFDDLKASLEEAVDIKNGVKAPERVTRYELADVKSIRAQLNVSQSEMAQVLGTSIDTIKSWETGRRNPTGLAAKVLATIQENPKFFQELAAH

SEQ ID NO: 11995 - protein, 110 aa, Xenorhabdus bovienii
  Coding DNA sequence: Name=SeqID_5887
  Homolog annotation: Query=4..98bp; Hit=30..124bp; Blast score=145; Percent Identity=80.0; E value=1e-34; Homolog= ref|NP_757322.1|
VSHAIEFIETPLFTRQIKQIATDDELKALQKELIEFPGKGALIQKTGGLRKIRMATGSQGKSGSARVIYFLATEEIIYLVMAYPKSTKDSLTDAEKSELKKLTKLLKDEV

SEQ ID NO: 11996 - protein, 30 aa, Xenorhabdus bovienii
  Coding DNA sequence: Name=SeqID_5888
MVSLLKLLGFTMILLEVWVNSLKGIIELMI

SEQ ID NO: 11997 - protein, 173 aa, Xenorhabdus bovienii
  Coding DNA sequence: Name=SeqID_5889
MGKFFKGNHRVNDLSKLKDMNLEPNMLRAGTKKYLKSEFQKPDAAVSYAAASVTVNGKKEYYLSVNGAAWSGNSPNVVNIKGVNFNVIRKDRGSIPSAPNGKQTNFNHAEQKLFSHFQDNFQGKRVDINMSIQNTSATSPGMCAGCKPNSKVFVDQNKDFIINIFEGTTGRKP

SEQ ID NO: 11998 - protein, 143 aa, Xenorhabdus bovienii
  Coding DNA sequence: Name=SeqID_5890
MKTLNRETVSGVSFYTIRMTYEELIILRDCLHDILLKSEEIEEKNLDKLSWYRSAFLEISDYIQSNISHKTNIILKKEHLNNEIFYNLRFSYGELKLIIYTVMNLEEDINYKPFYRKFSFSKKCNAKLLNDYFHKLQSLWSVD

SEQ ID NO: 11999 - protein, 174 aa, Xenorhabdus bovienii
  Coding DNA sequence: Name=SeqID_5891
MTKTELIEYLHSAYPELTIDITYIKGYSEEDIVKLERLYDIKIQGQLLDFLIHMGRCSGGFFSNQPLSFYSETANIRDEIKFQIGCEDGLREVQRFDLVEQKPFFISMENEGILHYFLLTDSDNPDLVYYLDTNYDTIVDTGLTFNEYLRSVVDSSRGYACKIPLDYTGDLLRI

SEQ ID NO: 12000 - protein, 223 aa, Xenorhabdus bovienii
  Coding DNA sequence: Name=SeqID_5892
  Gene classification: Gene name=FhaB; Function=Putative hemagglutinin/hemolysin; Function class=M Cell envelope biogenesis, outer membrane
  Homolog annotation: Query=33..210bp; Hit=40..222bp; Blast score=115; Percent Identity=34.0; E value=3e-26; Homolog= PA0041 COG3210
MKNFKTFTKISTLTLLVSTNLAFANDIIPNDFNTQVNQVNNIPVINIATPTLNGMSRNTYKEFNVSEKGVIFNNFIDSVNSQLAGQLEKNHNLKDRTAGLIINEVVGGNQSQLKGAIEIVGEDAKLVITNPNGVFIDGAKFINIRESFISTGKPVFNKKDLLSLEVTKGKVTIGEKGLDSDNLVVFSRSLQVNGKINAYTITAMIGPNSMSMKAGVTHEILVG

SEQ ID NO: 12001 - protein, 104 aa, Xenorhabdus bovienii
  Coding DNA sequence: Name=SeqID_5893
  Homolog annotation: Query=12..100bp; Hit=267..354bp; Blast score=75; Percent Identity=43.0; E value=2e-13; Homolog= ref|NP_386255.1|
VGYFPFSKRTPYLSSCHDSPTFQLGAIRKHWAIENSLHWVLDVTFREDDSRMRERIATRVFAQLRKMALNIVKRDTNSKLSLSARRKSAGWDNGYMEALLFNQF

SEQ ID NO: 12002 - protein, 34 aa, Xenorhabdus bovienii
  Coding DNA sequence: Name=SeqID_5894
MKLVLNKAGCSGTLKLRLLRLLSRWLFMQVSQQS

SEQ ID NO: 12003 - protein, 482 aa, Xenorhabdus bovienii
  Coding DNA sequence: Name=SeqID_5895
MDLCYFCGNKFNQSSIVDHGEHVIQQAIGGNLISKGILCKGCGGDLSREIDTPFNAIFEGIATRLDIKTDRKANKSPSIPGVIVSEKDAYDMNLKDTPVFWKNFKVTPVKPFHRFTEDKKKVIVYSSEKQFENHKKIVEKEIENMGLDTPPEIVMCDDIDGNVQYQFPMENTAFKRGIAKIAIGFACTHGISREKLPLALKISNENGGLIDDKVVLIQYAPLSIIDRIIEKEKADLANYPSHTLILFTSKEKPSLLCCYVELFSTFQFYILLNNSYEGEPVYKYHYQRIEKANEYVFTPDRRHYKERNIILGGLGITDERIQSAYDKQKDKQNTKSLHEIEIDIIREETEKQKNKADFESDIKNFVDYCAQKFILNKASDFEMNMDFYRNFSLFSRSSADNSDEDENFDISSYRRFFIYKNKRVDYPEALLQVKDNNSPELNIHSFYRFDQLEKYSQDKGIREKIRQIKSLIEKSKNETRSE

SEQ ID NO: 12004 - protein, 55 aa, Xenorhabdus bovienii
  Coding DNA sequence: Name=SeqID_5896
MPFSIKLPETLIKEPYTLNIFTVYNFANQEKIKIYLKDESWTYVIFAEINSIKVP

SEQ ID NO: 12005 - protein, 477 aa, Xenorhabdus bovienii; identical to SEQ ID NO: 8140
  Coding DNA sequence: Name=SeqID_5897
  Gene classification: Function=Transposase; Function class=L DNA replication, recombination and repair
  Homolog annotation: Query=1..474bp; Hit=1..472bp; Blast score=492; Percent Identity=52.0; E value=1e-139; Homolog= PA1368 COG3666

SEQ ID NO: 12006 - protein, 192 aa, Xenorhabdus bovienii
  Coding DNA sequence: Name=SeqID_5898
  Gene classification: Gene name=PinR; Function=Site-specific recombinases, DNA invertase Pin homologs; Function class=L DNA replication, recombination and repair
  Homolog annotation: Query=1..192bp; Hit=1..192bp; Blast score=273; Percent Identity=76.0; E value=9e-74; Homolog= pinR COG1961
MSRVFAYCRVSTLEQTTENQRREIEAAGFTVRPQRLIEEQISGSVAASERPGFARLLDRMENGDVLIVTKLDRLGRDAMDVRKTVEQLATSDIRVHCLALGGVDLTSPAGKMTMQVISAVAEFERDLLLERTHAGIARARASGKRFGRPPVLSEEQRQIVTERLNAGISISAIAREFNTTRQTILRVKAGQQ

SEQ ID NO: 12007 - protein, 31 aa, Xenorhabdus bovienii
  Coding DNA sequence: Name=SeqID_5899
MPKYHVLKRSVSDNLQRHCTKVSVFYFVRKL

SEQ ID NO: 12008 - protein, 207 aa, Xenorhabdus bovienii
  Coding DNA sequence: Name=SeqID_5900
MNESFLSHLKEVYQDRERDLVTLSVRVSVEENAAIQDLVDSVGCNRQDLLYELIKKYALSEWEVMRNEELDAELSGGGASGDNHTKTYFLLNTNKANSAKDHQFMIENGFAAAFEEGYIQKIEKIHEGDTVFLYESGVGIVAYGSATGKVLKTDHLGVKDKTYYQKLDGFHVLDKPLPAKKICTLLKRRIPFVQTLIRLKDGEKLLK

SEQ ID NO: 12009 - protein, 66 aa, Xenorhabdus bovienii
  Coding DNA sequence: Name=SeqID_5901
LFIYFTDKLNVISIKGQRSHVPGAKFFSVFRTVEVATFSTRAVSRMPPLFIAISTICSLTPSLQAW

SEQ ID NO: 12010 - protein, 140 aa, Xenorhabdus bovienii
  Coding DNA sequence: Name=SeqID_5902
  Gene classification: Gene name=InsB; Function=Insertion element IS1 protein InsB, putative transposase; Function class=L DNA replication, recombination and repair
  Homolog annotation: Query=1..139bp; Hit=27..166bp; Blast score=125; Percent Identity=45.0; E value=2e-29; Homolog= insB_g4 COG1662
VTTLPLDGNNIQLICEIDEQGSFVGSNKNQRWLWYAWEPRMKRIVAHVFGDRSRKTLDKLLALLSPFKVRFYCTDDYAVYDCLSEEEHLTGKMFTQRIERTNLTHRTRLKRLNRKTIGYSKSEEMHDKVIGTFIECENYV

SEQ ID NO: 12011 - protein, 94 aa, Xenorhabdus bovienii
  Coding DNA sequence: Name=SeqID_5903
  Gene classification: Gene name=Tra8; Function=Transposase, IS30 family; Function class=L DNA replication, recombination and repair
  Homolog annotation: Query=12..79bp; Hit=245..312bp; Blast score=89; Percent Identity=58.0; E value=7e-19; Homolog= NMB0225 COG2826
LITASNLPNTNLSVKIYFAHPYSPWERGINENTNGLIRDYFPKGTDFNKVSELEINLVANRLNNRPRKTRDYKTPNELFKGIPTHLLRSLRYCA

SEQ ID NO: 12012 - protein, 67 aa, Xenorhabdus bovienii
  Coding DNA sequence: Name=SeqID_5904
MERTFYNNSEVPMTITLEGSHPVTPSVLKLINPKEIVTLSVKENYIMQLNLSINLPEINFDMVFTSK

SEQ ID NO: 12013 - protein, 44 aa, Xenorhabdus bovienii
  Coding DNA sequence: Name=SeqID_5905
VICFDLAINQIAKIGLSSLQVIYYFEILFRCENHIKVNFRQVYR

SEQ ID NO: 12014 - protein, 346 aa, Xenorhabdus bovienii
  Coding DNA sequence: Name=SeqID_5906
  Gene classification: Function=Predicted transposase; Function class=L DNA replication, recombination and repair
  Homolog annotation: Query=15..299bp; Hit=1..281bp; Blast score=294; Percent Identity=52.0; E value=1e-79; Homolog= Z4330 COG3335
MPIIAPISRNERRQMKKIIQTTRDKNYARRLMALLMLHQGMSVSYVARTLCAARSSVNRWINWLTFYGLEGLKSLPAGRPATWNLTSLFPLLSFLVQHSPQQFGYLRSRWSLELFIIQIKELIKVKFSKSPFYRYLCQAGIVWRRAAPTLKLPDPEYDEKMAKITEALSNSSEPHSVFYEDEVDIHFNPKIGSGWYFKGQQKRIATPGKNQKHYLAGCLNALTGKITYVGGLNKNSELFINLLDEINRQYSSAETITLILDNYGIHKSRKVMDWLARNSKFNLLFLPAYSPWLNKIERLWQSLHETVTRNHCCQFMWQLIQCVQVFMESASLQQQQKMKKGGVSLL

SEQ ID NO: 12015 - protein, 111 aa, Xenorhabdus bovienii
  Coding DNA sequence: Name=SeqID_5907
MNNITYDKYIYNQTEFNFYISIFINLSRQKPFVTKYVESFHWWKFEFPYIPITSGIIFHSVKNTLQLKYFLSDPSSTGIYPLLQKQTIYLHQGTEDVRFYFYLEGFDGIVQ

SEQ ID NO: 12016 - protein, 74 aa, Xenorhabdus bovienii
  Coding DNA sequence: Name=SeqID_5908
MRQNPAMNPNVFCDKAPRAGIFVRGSTVGSVCFETSFQTIIWLCENFKMYRQLTHLSIHCLLHYYCTIPSNPSK

SEQ ID NO: 12017 - protein, 62 aa, Xenorhabdus bovienii
  Coding DNA sequence: Name=SeqID_5909
  Gene classification: Gene name=InsB; Function=Insertion element IS1 protein InsB, putative transposase; Function class=L DNA replication, recombination and repair
  Homolog annotation: Query=4..61bp; Hit=109..166bp; Blast score=58; Percent Identity=46.0; E value=1e-09; Homolog= insB_g4 COG1662
VYDRLPEEEHLTGKTFTQRLERNNLTHRTRIKRLNRKTIGYSKSAEMHDKVIGTFIERENYF

SEQ ID NO: 12018 - protein, 40 aa, Xenorhabdus bovienii
  Coding DNA sequence: Name=SeqID_5910
LGIVAGKHETNCLPFYRPLIFGFTVRMIMLCMTASQRKNT

SEQ ID NO: 12019 - protein, 88 aa, Xenorhabdus bovienii
  Coding DNA sequence: Name=SeqID_5911
  Homolog annotation: Query=27..85bp; Hit=22..80bp; Blast score=90; Percent Identity=72.0; E value=5e-18; Homolog= gb|AAG53990.1|AF327446_2
MAMNNGGIRDTARVLKVATSTVMTTLKTYPRNVTTLPLDGDNIQLICEMDEQGSFVGNKKNQRGLWYVWEPRLKRIVAHVFGDRSRKT

SEQ ID NO: 12020 - protein, 69 aa, Xenorhabdus bovienii
  Coding DNA sequence: Name=SeqID_5912
MLSLFKGGSWLKLTFIVVIVTHQNMSKGMENEMVTIPVIAVMPAVRSFSWNTPIKPANPVLKSRLSIWQ

SEQ ID NO: 12021 - protein, 72 aa, Xenorhabdus bovienii
  Coding DNA sequence: Name=SeqID_5913
MTTRTAGARDTVRYTEDEWLLQNLSYWLMVKIAPVTQPSGTTLCNDFKSKPNIQVAPVFGYGMHLNPGTMMP

SEQ ID NO: 12022 - protein, 34 aa, Xenorhabdus bovienii
  Coding DNA sequence: Name=SeqID_5914
LAGIELICMLCKGQYRQKEGCPISPAAFFYQLAE

SEQ ID NO: 12023 - protein, 111 aa, Xenorhabdus bovienii
  Coding DNA sequence: Name=SeqID_5915
  Homolog annotation: Query=2..110bp; Hit=5..113bp; Blast score=125; Percent Identity=56.0; E value=2e-28; Homolog= ref|NP_930538.1|
MKFEYSFAFRDQLHGRFYYLARHIGQVTAQEFLDSFIVGFEGRVNDYPESTPVCMEAADLGFTTYHDYVDPKLQLRAIYRFSESEGVVYPLLFLSTKQSIRQALIQYCLRL

SEQ ID NO: 12024 - protein, 117 aa, Xenorhabdus bovienii
  Coding DNA sequence: Name=SeqID_5916
  Homolog annotation: Query=30..115bp; Hit=1..86bp; Blast score=123; Percent Identity=75.0; E value=5e-28; Homolog= ref|NP_930537.1|
MSIYGPYMDSSVIWVYSFISSCISLLENPMTLSTSPRITTVSAFKKELASMDVSDPVVVTQNGEPLYVVQDPVQFEMQQEQMALLRLLSFAEKDVQAGRTVSSADLRAGLKGLVDEI

SEQ ID NO: 12025 - protein, 87 aa, Xenorhabdus bovienii
  Coding DNA sequence: Name=SeqID_5917
MINGNPPLRPHFFQITQAQDVGQVPTNTLSDDINRVMQTFERFSDKGHCSGLAQKQGSLPDDRLMRQNPFTYESKSCPYMGRIWTHR

SEQ ID NO: 12026 - protein, 128 aa, Xenorhabdus bovienii
  Coding DNA sequence: Name=SeqID_5918
  Gene classification: Function=Putative transposase; Function class=L DNA replication, recombination and repair
  Homolog annotation: Query=1..128bp; Hit=73..207bp; Blast score=125; Percent Identity=50.0; E value=1e-29; Homolog= mll9070 COG3316
MDETYIKIKGQWKYLYRAVDSDGKTVDFLLTARRDKSSALRFFKKAMRQHGQPDVVTMDKSGANKAAVDELNQGKPKEEAIVIRQNKYLNNLIEQDHRNIKRRIHPMLGFKHFRRAQTLLSGIELVSM

SEQ ID NO: 12027 - protein, 39 aa, Xenorhabdus bovienii
  Coding DNA sequence: Name=SeqID_5919
MRQNPLVPFLSKSQVKLKSGKRIESISCNLYNGSISHTL

SEQ ID NO: 12028 - protein, 116 aa, Xenorhabdus bovienii
  Coding DNA sequence: Name=SeqID_5920
  Homolog annotation: Query=1..115bp; Hit=1..115bp; Blast score=174; Percent Identity=69.0; E value=2e-43; Homolog= ref|NP_395235.1|
LWTVIFTPRFDAWLQEQEEGMQEKVLADLTNLETYGPKLSRPYADTVKGSRHKNMKELRVQYSGHPVRAFFAFDPKRQAIVLCAGDKSNNKRFYDTMIRIADEEFTAHLTVIEEQK

SEQ ID NO: 12029 - protein, 99 aa, Xenorhabdus bovienii
  Coding DNA sequence: Name=SeqID_5921
  Homolog annotation: Query=1..99bp; Hit=1..99bp; Blast score=127; Percent Identity=73.0; E value=3e-29; Homolog= ref|NP_395234.1|
MKTLRDAVAARSPESQARIKEMADEMILETGLQLMREELQFSQKSLAESMGVSQPAITQIEQRGNDVKLATLKRYIEAMGGKLSLTVELPEGGGRIFHI

SEQ ID NO: 12030 - protein, 194 aa, Xenorhabdus bovienii
  Coding DNA sequence: Name=SeqID_5922
  Gene classification: Function=Putative transposase; Function class=L DNA replication, recombination and repair
  Homolog annotation: Query=1..194bp; Hit=32..232bp; Blast score=160; Percent Identity=47.0; E value=6e-40; Homolog= mll9070 COG3316
MRAERGIHVDHSTLSRWVHRLTPLIVRRYRRKMPDVGHRWRRDETDIKIKGQWRYLYRAIDSNGNTVDFLLTAQRDKAAALRFFKKAMRQHGQPEIVTMDKSGANKAAVDEWNKGTSKEEAIVIRQNKYLNNLIEQDHRNIKRRICPMLGFKNFRRTQSVLAGIELVNMLRKGQYPQEPECPLSPAEFFYQLAA

SEQ ID NO: 12031 - protein, 32 aa, Xenorhabdus bovienii
  Coding DNA sequence: Name=SeqID_5923
MPLIRKAFKRLHYPVDITPVRALVSSLRPEFA

SEQ ID NO: 12032 - protein, 373 aa, Xenorhabdus bovienii; identical to SEQ ID NO: 10284
  Coding DNA sequence: Name=SeqID_5924
  Homolog annotation: Query=1..369bp; Hit=3..372bp; Blast score=249; Percent Identity=36.0; E value=8e-65; Homolog= ref|NP_415977.1|

SEQ ID NO: 12033 - protein, 41 aa, Xenorhabdus bovienii
  Coding DNA sequence: Name=SeqID_5925
MRQNQKLLKQIESKFTAIFMNRQGYYSLIKSMLDFKKWQSC

SEQ ID NO: 12034 - protein, 62 aa, Xenorhabdus bovienii
  Coding DNA sequence: Name=SeqID_5926
MAELLKTAPYSGVKIRNNVDESYRKLIVPHFPFILLYQYIKENSNICILRVLHTSRQITSTF

SEQ ID NO: 12035 - protein, 46 aa, Xenorhabdus bovienii
  Coding DNA sequence: Name=SeqID_5927
LSKLLSISQSKSDYLALSMDFFKDEPPKAVTSSSLKFKHSSAEIKL

SEQ ID NO: 12036 - protein, 305 aa, Xenorhabdus bovienii
  Coding DNA sequence: Name=SeqID_5928
  Gene classification: Gene name=PenP (BS); Function=Beta-lactamase class A; Function class=M Cell envelope biogenesis, outer membrane
  Homolog annotation: Query=59..301bp; Hit=63..303bp; Blast score=155; Percent Identity=33.0; E value=5e-38; Homolog= BS_penP COG2367
MSNDETLNTLLAKKSVTLKNITSNLKYMPAAILCFFFISNANASMLKDKIKTLEAQGWQVGVSILDYNGNKIESVNGDERFPLDSTVKALACANILAKVDNKSLRLEDSVLIKEKDIVTYSPITEGYVNKKITLKQACEATTAFSDNTAANIAISSVGGPSELTKFMRSIGDNTTRSDRYEPDLTINPEHDLRDTTTPNAMSNSIRKLLTGNVLSEKSKEQLKEWMMGNKVADNMLRSELPKGWFIADRSGASDYGIRGITSMVWSDKEPPLFISVYLRKSNTSLEERSEKIAEIGMVIFSKYTH

SEQ ID NO: 12037 - protein, 54 aa, Xenorhabdus bovienii
  Coding DNA sequence: Name=SeqID_5929
MQPIDKISLPVAMSRTKLYFSVSKTMPINLPASAGSRLVSILAKNNHPNLSNFL

SEQ ID NO: 12038 - protein, 109 aa, Xenorhabdus bovienii
  Coding DNA sequence: Name=SeqID_5930
  Homolog annotation: Query=1..105bp; Hit=33..138bp; Blast score=151; Percent Identity=79.0; E value=2e-36; Homolog= gb|AAL79614.1|
LSLKGNQGKTFSEAVDYFQQQITQPPYLKPDHDEFEDSHGRTVRRRGRVLPLTSETKHLGSWPDIQALLVTETRRQEQYSDTVTSDFRYYLSSCQDVPAFHAHPTRCRR

SEQ ID NO: 12039 - protein, 105 aa, Xenorhabdus bovienii
  Coding DNA sequence: Name=SeqID_5931
MFPPFTLTLLDAGGKSPQEVIEIRQNKYLNNRIEQAPRHVKRRVRPMLGFKSFRRAGGDRTRCHALPDDRLMRQNPDKVRIPSDLHSSIHITSTRHTWATTYTWC

SEQ ID NO: 12040 - protein, 182 aa, Xenorhabdus bovienii
  Coding DNA sequence: Name=SeqID_5932
MSHVGSQTGRADYSVYYETQKTLLHDGNVSMAVQVNQIWYFSDSEDLAKLTRTNPQSQNTSDSFYRSVKEKGEYYFLKNNSSVEVVNVTEDNKIEMILSRLLGLLGRAPSNKEFGSLLTKQGIPFPDHIFPHLGNSLLANKSIFDVQFTIEPEPVIKSKNAKNKEKRKDKRDKAIAAGKPKR

SEQ ID NO: 12041 - protein, 84 aa, Xenorhabdus bovienii; identical to SEQ ID NO: 6530
  Coding DNA sequence: Name=SeqID_5933
  Gene classification: Gene name=InsB; Function=Insertion element IS1 protein InsB, putative transposase; Function class=L DNA replication, recombination and repair
  Homolog annotation: Query=1..79bp; Hit=87..166bp; Blast score=67; Percent Identity=41.0; E value=2e-12; Homolog= insB_g3 COG1662

SEQ ID NO: 12042 - protein, 83 aa, Xenorhabdus bovienii; identical to SEQ ID NO: 6529
  Coding DNA sequence: Name=SeqID_5934

SEQ ID NO: 12043 - protein, 91 aa, Xenorhabdus bovienii; identical to SEQ ID NO: 6528
  Coding DNA sequence: Name=SeqID_5935
  Gene classification: Function=Transposase; Function class=L DNA replication, recombination and repair
  Homolog annotation: Query=1..86bp; Hit=1..86bp; Blast score=87; Percent Identity=50.0; E value=2e-18; Homolog= insA_g5 COG3677

SEQ ID NO: 12044 - protein, 120 aa, Xenorhabdus bovienii
  Coding DNA sequence: Name=SeqID_5936
VIDGNAPQEFDGGYLKTNGDLHEKIILFPLITKSFLSGNKTSFYLIGKSDPLTYKTGTAKNINLNYIYIKKMLSVWTGRKNNDMPFMTYPNGDIVSGEVRPEYETLMGILESRNSKQTKM

SEQ ID NO: 12045 - protein, 406 aa, Xenorhabdus bovienii
  Coding DNA sequence: Name=SeqID_5937
  Gene classification: Gene name=PinR; Function=Site-specific recombinases, DNA invertase Pin homologs; Function class=L DNA replication, recombination and repair
  Homolog annotation: Query=252..390bp; Hit=21..159bp; Blast score=130; Percent Identity=47.0; E value=3e-30; Homolog= ZpinH COG1961
MKFLCNKRVLSSLFAVFFIQGCAQSDSFSPPINGENIHFTTTMPDELDALPISAMYRSEICRKERRTANMKSYSVPGFHRATYPLSIDQSNQVEVSVPKEGGGKCDWKLSNITFEVKLKDTSKIAPLIDDNFGFNTTFVIDGNAPQEFDGGYIKKTGNLNEEITLFPLLRERFLGGHSQSFYLVGKYDVMTYKMDNGRKIHLNVLYEKNFLTHWNGGKNKDADTSMTYPDGTIIYNGDVIPDFDKLMRILESRNSKQTKMTAAGINPTYLYEDQASGKREDRPGLENCLKALRSGDTLVVWKLDRLGRDLRHLINTVHDLNQRDIGLKVLTGHGAAIDTTTAAGKLVFGIFAALAEFERELISERTLAGLASARARGKKGGRLFKMTAAQITLGDGRDGATGNQGE

SEQ ID NO: 12046 - protein, 50 aa, Xenorhabdus bovienii
  Coding DNA sequence: Name=SeqID_5938
MGQLETKVSELCKELDITRQTLYRHYPLMGSCVQMGKNCLAGSGCGLISH

SEQ ID NO: 12047 - protein, 338 aa, Xenorhabdus bovienii
  Coding DNA sequence: Name=SeqID_5939
  Homolog annotation: Query=244..335bp; Hit=1..92bp; Blast score=131; Percent Identity=69.0; E value=2e-29; Homolog= ref|NP_929783.1|
MGRVKIISALTEPSKRDNLVTISIRLTVAITLLTATQPILAKIPENFVYTSSGDLEAASVIMARSDIGGAQIVYDWRLLEPEKNKYNFSQIEKDLARLKVAKKKLFIQIQDRFFEQNARYVPDYLMNDARYGGGISPQFDNPGEGKPIGSGWVVQQWDPAVRQRYQALLAAIAERFDGRVYGVNLPETAIDLDEKKLPKGFSCDNYFAGEMENLTFTRKVFTKSHVVQYVNFWPCEWNNDHNYMGRLFEFASANNIGLGGPDIVPNRKAQMKNSYPFFNKYKSKLALIAMAVQEPTLTYRNPNTGKPFIKDEFVEFAEDYLGADIIFWSTTSPWLTKK

SEQ ID NO: 12048 - protein, 320 aa, Xenorhabdus bovienii
  Coding DNA sequence: Name=SeqID_5940
  Gene classification: Function=Transposase; Function class=L DNA replication, recombination and repair
  Homolog annotation: Query=7..315bp; Hit=3..313bp; Blast score=162; Percent Identity=34.0; E value=5e-40; Homolog= NMB1750 COG3547
MSDNIVVGIDIAKHKFDVAVWAGENHYKRKHFPNDLKGFDAFINWLKPASNYHFCMEATGIYGDPLALYLSDKGLLISVVNPVQIRAFGKAELLRNKTDKIDAKLIARYCASQHPPAWQPAPLCERQLLALVRHRNKLNEMLLTEENRLSVADEVVCDSHAKIITLLKQELKDTELKLKKHIDDSPSLKKNKGLLESIPGIGERLSATLLAYIGDGSRFHHSGQVVAYAGLNPKLHESGQLKGRAHLSKQGSAELRKALYMPALAAISCNKVVKKQWEQLTARHKGGKVGVCAVMRKLLRLAYGVMKSGTLFNAEIPLAV

SEQ ID NO: 12049 - protein, 33 aa, Xenorhabdus bovienii
  Coding DNA sequence: Name=SeqID_5941
VFGDINTDYDVIRHKVILFVRDTGDIAMIRLIK

SEQ ID NO: 12050 - protein, 321 aa, Xenorhabdus bovienii
  Coding DNA sequence: Name=SeqID_5942
MTTLFLMVFSFYFIGSAKASEIIKYRTSITHTNPDGDPTLYNPVETYGGVILYNTPSPSGASVYVEIDGHTRQIDYTDQIELAVDFWRGIVRDIYPMLTIRHMRSGEEANFLIGYSSALNMLSGIAGREPAISYIPHTGHVNTLALRNTNLAGQYGIYVDNYLAEMNEERMTMMMRTFSDVHNNGEAVKRYMYILLVRHLGYALGFVPEDSNVNLFGNNIPWYSPEIYFVSLNDSATPRLMYRNNTFEYIEDLVRFNAEEDAFSINDIRISPQEEFVARMCLGNELSMIQTKTSKSYNDMCSSKSTKVTYTLIARIISIIN

SEQ ID NO: 12051 - protein, 45 aa, Xenorhabdus bovienii
  Coding DNA sequence: Name=SeqID_5943
MDRRGSRCEWREKRITITIINHKLVNNRLQRAVEIFLISMCHYFI

SEQ ID NO: 12052 - protein, 135 aa, Xenorhabdus bovienii
  Coding DNA sequence: Name=SeqID_5944
MRDKLKSLIPIVALFLFFISSITKASSVEDALRCNSSEQFTGYITGVAMGYYVGADDTNTRITIMFKKENEKNKTGTALMLRKDYGSDGGPGFLALAQTAMLTGQKININCNGSWVDGIWIGEGADVSGVKKGLP

SEQ ID NO: 12053 - protein, 104 aa, Xenorhabdus bovienii
  Coding DNA sequence: Name=SeqID_5945
  Homolog annotation: Query=33..75bp; Hit=294..336bp; Blast score=78; Percent Identity=79.0; E value=3e-14; Homolog= emb|CAC38400.1|
MFISGGTILSIDSIKKQPLAESLINSPLMRQNHKIERLWQSLHKTVTRNHCCQFMWQLIKCVEVFMESASLQQQQKIKKGVYHYYETLFRLTKICIEFILISCV

SEQ ID NO: 12054 - protein, 36 aa, Xenorhabdus bovienii
  Coding DNA sequence: Name=SeqID_5946
VQTFERFSDQGHRSGLAQKQGSLPDDRLMRQNPRGR

SEQ ID NO: 12055 - protein, 100 aa, Xenorhabdus bovienii
  Coding DNA sequence: Name=SeqID_5947
  Gene classification: Function=Putative transposase; Function class=L DNA replication, recombination and repair
  Homolog annotation: Query=3..91bp; Hit=23..111bp; Blast score=112; Percent Identity=65.0; E value=9e-26; Homolog= XF2303 COG3316
MPLIRKAFKRLHYPVDIIAQCVRGDLAYALSLRNLEEMLVERGITVDHSTLSRWVHRLIPLRVKRYRRSKPAVGRRWRRDETDIKIKGQWRGSVALTEKI

SEQ ID NO: 12056 - protein, 61 aa, Xenorhabdus bovienii
  Coding DNA sequence: Name=SeqID_5948
VEQDHRNIKRQIRPMLSFKSFRRAQTILAGIERVSMRRKRQYSQSEDKALSPTEMFYRLAA

SEQ ID NO: 12057 - protein, 143 aa, Xenorhabdus bovienii
  Coding DNA sequence: Name=SeqID_5949
  Homolog annotation: Query=11..123bp; Hit=16..128bp; Blast score=107; Percent Identity=48.0; E value=3e-23; Homolog= ref|NP_670021.1|
LLHSVVQVFTLSDSEGFLFGSIGVERRQCSGIRPTFIKGHDLRLTVMADRLAKEAQRGGSIPLGRQQEVDSLPGRIDCSVQIFSLSFDFDRGFIHAPATPHRTFMSTKSFTQQWGKPDNPAIQSGMVDGYPPLSHHLFEIALA

SEQ ID NO: 12058 - protein, 78 aa, Xenorhabdus bovienii
  Coding DNA sequence: Name=SeqID_5950
MRQNPLLCLLDGWQTMVCGLLRTLKDAQITVIISGVSYWRIGLPLAWWLSQFSLGPDGVGWGMCSGLFIACFIMQIRL

SEQ ID NO: 12059 - protein, 240 aa, Xenorhabdus bovienii
  Coding DNA sequence: Name=SeqID_5951
  Homolog annotation: Query=6..236bp; Hit=14..244bp; Blast score=297; Percent Identity=61.0; E value=9e-80; Homolog= gb|AAO17168.1|
MSSVSIKFSDGRNDVVGVDNANAILREVGVRISLVSIPEEAKPIIKVSKTRATNDEEKKKLISIFNLNRADFLEQIRLAGRTPAVNRGGYLSTTEVDVPPYPKVYDMKEMTDEMKKYVLSKFGRLHVNSSEDGSGIDEVMTVISGGPLNWFFVLNNGVTANVLVNEVGPNDQAIRLSYPGLGPHGGFINADQGLLVAYAHGPETFVMRYEDPSVAHSEMLNTNPWMDFSGDRPKLLDKVK

SEQ ID NO: 12060 - protein, 42 aa, Xenorhabdus bovienii
  Coding DNA sequence: Name=SeqID_5952
MDFKGFCCNKQSLGNVISHLFVDKGVVNVVDTKSLQTFTLSR

SEQ ID NO: 12061 - protein, 230 aa, Xenorhabdus bovienii
  Coding DNA sequence: Name=SeqID_5953
  Gene classification: Function=Putative transposase; Function class=L DNA replication, recombination and repair
  Homolog annotation: Query=3..164bp; Hit=23..185bp; Blast score=225; Percent Identity=68.0; E value=3e-59; Homolog= XF2303 COG3316
MSLIRKAFKRLHYPVDIIAQCVRGYLSYALSQRNLEEMMAERGITVDHSTLYRWVIRTPLLGKAFRRHKRPVGRRWRMDETDIKIKGQWKYLYRAVDTAGKTIDFLLTDKRDTAAALRFFRKALRQHGEPDIITLDKSGANTAAIALLNTDKSKEEAIKICQDKFLNNRIEQDHRNIKRRIRPMLGFKSFRRTQTILAGIERVSMRRKGQYSQPEDKTLSPAELFYRLTT

SEQ ID NO: 12062 - protein, 145 aa, Xenorhabdus bovienii
  Coding DNA sequence: Name=SeqID_5954
  Gene classification: Function=Putative transposase; Function class=L DNA replication, recombination and repair
  Homolog annotation: Query=3..145bp; Hit=23..165bp; Blast score=179; Percent Identity=63.0; E value=1e-45; Homolog= XF2303 COG3316
MSLIRNVFKRLHYPVDIIAQCVRWYLAYSLSLSNLEEMLVERGIAVDHSTLSRWVHRWVLLIVKRYRRSKPEVERRWRMDETDIKIKGQWRYLYRAVDSDGNTVEFLLTAHRDKKAALRFFKKAMRQHGQPDGVTLDKSGANKAA

SEQ ID NO: 12063 - protein, 40 aa, Xenorhabdus bovienii
  Coding DNA sequence: Name=SeqID_5955
MILLAISLLMRQNQQKYHQAGHNIFINALIKYSKRSGNHT

SEQ ID NO: 12064 - protein, 38 aa, Xenorhabdus bovienii
  Coding DNA sequence: Name=SeqID_5956
MIIWQTRGVHVCTLMHQNREFTLARCGSPNAYYILLMH

SEQ ID NO: 12065 - protein, 43 aa, Xenorhabdus bovienii
  Coding DNA sequence: Name=SeqID_5957
MSACTTPEFPDHGPTCLAITSRLPVQPLETAFIWTPFICTLWL

SEQ ID NO: 12066 - protein, 95 aa, Xenorhabdus bovienii
  Coding DNA sequence: Name=SeqID_5958
MDSLHLHFMALVACFRVPIICLKLPAMHQQLPDNPGIFIRQRHHSNISITSRQQTIQPVFCSTGFLFYVPYHRPGSMDQQCPKVIVTLFADPLQG

SEQ ID NO: 12067 - protein, 103 aa, Xenorhabdus bovienii
  Coding DNA sequence: Name=SeqID_5959
  Gene classification: Function=Transposase; Function class=L DNA replication, recombination and repair
  Homolog annotation: Query=10..96bp; Hit=158..244bp; Blast score=65; Percent Identity=40.0; E value=1e-11; Homolog= CC2740 COG3547
MISSRSRRLSEFGIVIAQGIRQIAVRLPEILEDASNSLPDTFRQLLQRLGEHLKELDRQVTELEQDIQHWHRGNADSRRLSEIPGIGPITASDLTAWRGLVPR

SEQ ID NO: 12068 - protein, 69 aa, Xenorhabdus bovienii
  Coding DNA sequence: Name=SeqID_5960
VANALVEKATGGIAVPVGGQQEVYRIASRAHCPIKRAPLAFNVEIGLIHPPPPPHGALVLAERLILQRG

SEQ ID NO: 12069 - protein, 117 aa, Xenorhabdus bovienii
  Coding DNA sequence: Name=SeqID_5961
MLKLPFAYHVHPFNSCQQGLGSSERAEPKHRPHPSFDVSVVLLYQIIQVCVLPYFDVVFLLLARIEAVHRRFIGSAFIKGHDLWWRTPLLKKRRAASLFRLAVNKKSTVLPAEPTAR

SEQ ID NO: 12070 - protein, 43 aa, Xenorhabdus bovienii
  Coding DNA sequence: Name=SeqID_5962
MGAHDTQRAVLTSTRARIVIGTTILSASSLKNQLTDFMITFNQ

SEQ ID NO: 12071 - protein, 323 aa, Xenorhabdus bovienii
  Coding DNA sequence: Name=SeqID_5963
  Gene classification: Gene name=Spo0J (BS); Function=Predicted transcriptional regulators; Function class=K Transcription
  Homolog annotation: Query=13..202bp; Hit=21..214bp; Blast score=74; Percent Identity=32.0; E value=2e-13; Homolog= VCA1114 COG1475
MQNKRKTIGRILSTESLPESSKVKGTEQRFTLSSGKTAVFHQEHIPADRLEAQTIVQFSVNGRDQSALTEESLSDIVRTIKLQQFFPAIGRKVGDKIEILDGSRRRAAALYCKIGLNILVTNTDISSEDARQLAADIQTAKEHNIREIGLRLIQLRDGGMTQKEIAASQKMSPAKVTRAIQCASVSNDMVAIFPIQSELSYPDYKLLLDIDVFIKSNNLSINDVVNDVREGVAQMGNSDQIAADEMKNLILKFFKQITSKLATKNDSTKAQISPIWEFKEKDVFARKRVKDRSISYEFNRVPKAFQEELERMIQVVLRKHFNE

SEQ ID NO: 12072 - protein, 405 aa, Xenorhabdus bovienii
  Coding DNA sequence: Name=SeqID_5964
  Gene classification: Gene name=Soj (BS); Function=ATPases involved in chromosome partitioning; Function class=D Cell division and chromosome partitioning
  Homolog annotation: Query=19..386bp; Hit=15..390bp; Blast score=143; Percent Identity=28.0; E value=3e-34; Homolog= VCA1115 COG1192
MNDAYKQLDRVAERSVRLLQSLTEQIQTQKEELNETSYYQVYSKAAVAKLPKLTRASVDYAVSEMEEQGYEFEKRQTGSSSKYAMTLQNIIDLYHHRGVPKYRDRYFGAFTFFVGNLKGGVSKTVSTVSLAHALRTHPHLIYEDLRILVIDLDPQASATMFLNHEQSIGSVETTSAQAMLQDVSREELLAEFIIPSVVQGVDVIAASIEDAFIASRWEELCAEHLPGRNIYTVLRDNIISKISKDYDFIFIDSGPHLDSFLSNAITAADILMTPIPPAQVDFHSTLKYLARLPELVELIESTGASTSLMGNIGFMSKLLNKTDHKLCHSLAKEIFGGDMLDFSLPRLDGFERCGESFDTVISANPSTYIGSSEALKNAKNAAEDFAKSVFDRVEFLRANRGNHAK

SEQ ID NO: 12073 - protein, 47 aa, Xenorhabdus bovienii
  Coding DNA sequence: Name=SeqID_5965
MLGFKSFRRSQTILAGIELVSMLRKGQYSQPEDKTLSPAELFYRLTE

SEQ ID NO: 12074 - protein, 52 aa, Xenorhabdus bovienii
  Coding DNA sequence: Name=SeqID_5966
METFKGVSAQGHRLELAQKPGSLPEVPLMRQNQGQYPQCPLSPAEFFYQLAA

SEQ ID NO: 12075 - protein, 231 aa, Xenorhabdus bovienii
  Coding DNA sequence: Name=SeqID_5967
  Gene classification: Function=Putative transposase; Function class=L DNA replication, recombination and repair
  Homolog annotation: Query=7..165bp; Hit=27..185bp; Blast score=215; Percent Identity=67.0; E value=3e-56; Homolog= XF2303 COG3316
MPLSRNAFKRLHYPVDIIAQCVRWYLAYALSLRNLEEMMVERGIAVDHSTLSRWVHRLIPLLVKRYRRCKPDVGHRWRMDETDIKIKGQWKYLYRAVDSDGKTVDFLLTARRDKSSALRFFKKAMRQHGQPDVVTMDKSGANKAAVDELNQGKPKEEAIVIRQNKYLNNLIEQDHRNIKRRIHPMLGFKHFRRAQTLLSGIELVSMLRKGQYPQEPECFLSPADFFYQLAA

SEQ ID NO: 12076 - protein, 79 aa, Xenorhabdus bovienii
  Coding DNA sequence: Name=SeqID_5968
  Gene classification: Function=Putative transposase; Function class=L DNA replication, recombination and repair
  Homolog annotation: Query=3..71bp; Hit=23..91bp; Blast score=99; Percent Identity=72.0; E value=4e-22; Homolog= XF2303 COG3316
MSLIRKAFKRLHYPVDIIAQCVRWYLAYALSLRNLEEMMAERGIEVDHATIPRWVLRLVPLLGKAFRPRKKGSVALTER

SEQ ID NO: 12077 - protein, 163 aa, Xenorhabdus bovienii; identical to SEQ ID NO: 7546
  Coding DNA sequence: Name=SeqID_5969
  Gene classification: Function=Predicted transposase; Function class=L DNA replication, recombination and repair
  Homolog annotation: Query=16..120bp; Hit=6..110bp; Blast score=103; Percent Identity=45.0; E value=1e-22; Homolog= CC0928 COG3293

SEQ ID NO: 12078 - protein, 117 aa, Xenorhabdus bovienii; identical to SEQ ID NO: 7849
  Coding DNA sequence: Name=SeqID_5970
  Gene classification: Function=Predicted transposase; Function class=L DNA replication, recombination and repair
  Homolog annotation: Query=1..114bp; Hit=133..247bp; Blast score=82; Percent Identity=40.0; E value=1e-16; Homolog= mll8100 COG3293

SEQ ID NO: 12079 - protein, 346 aa, Xenorhabdus bovienii
  Coding DNA sequence: Name=SeqID_5971
  Gene classification: Gene name=Tdh; Function=Threonine dehydrogenase and related Zn-dependent dehydrogenases; Function class=E Amino acid transport and metabolism
  Homolog annotation: Query=1..346bp; Hit=1..346bp; Blast score=407; Percent Identity=58.0; E value=1e-113; Homolog= NMB1395 COG1063
MKALVYHGAGKKHWEVKAPPQLIESTDAIVRIIKTTICGTDLHILKGDVPTVDAGRTLGHEGIGIVESVGESVHNIKVGDKVIISCITVCGRCRYCKRQLYSHCEEGGWILGHKIDGTQSEKVRIPHADNSLHRLPEGIDEEAALMLSDILPTGLEIGVINGKVQPGNTLALIGAGPVGLSALLASQFYSPAHIIMIDTDDNRLHVAQQFGADTVINPTHQNVVEVIQKLTDGLGVDVAIECVGIPATFKICQDIITAGGHIANVGVHGKSVELHLEDLWIKNITITTGLVNTSSTPMLLKSLQSGKISPEKLVTHRYSLSEIETAYEVFGNAAKEQALKIVLNAE

SEQ ID NO: 12080 - protein, 56 aa, Xenorhabdus bovienii
  Coding DNA sequence: Name=SeqID_5972
MINKGFHKVSPIGYLFFCRVSPIPSMSENHSILKSVVSFTIKLEQRHRSSVKSHFF

SEQ ID NO: 12081 - protein, 97 aa, Xenorhabdus bovienii
  Coding DNA sequence: Name=SeqID_5973
  Gene classification: Function=Putative transposase; Function class=L DNA replication, recombination and repair
  Homolog annotation: Query=1..97bp; Hit=129..232bp; Blast score=87; Percent Identity=48.0; E value=2e-18; Homolog= mll9070 COG3316
MIDKSGANTAALATLNADKPEEENITLRQSKYLNNLVEQDHRSINRRIRQMLGFKSFRRAQTLLAGIELIHMIRKGQYQHPQSDGLSPAEQFYLLAA

SEQ ID NO: 12082 - protein, 72 aa, Xenorhabdus bovienii
  Coding DNA sequence: Name=SeqID_5974
  Gene classification: Function=Putative transposase; Function class=L DNA replication, recombination and repair
  Homolog annotation: Query=3..47bp; Hit=23..67bp; Blast score=66; Percent Identity=68.0; E value=5e-12; Homolog= XF2303 COG3316
MSLIRKAFRRLHYPTDVIAQCVRWYLAYALSLHNLEEMMAEHGVIVDIPRFTVGSSVWCHCWIRHFAGINGR

SEQ ID NO: 12083 - protein, 35 aa, Xenorhabdus bovienii
  Coding DNA sequence: Name=SeqID_5975
MTWSGNTIKNNMLPDDSLMRQNPTARLKNNHRNFC

SEQ ID NO: 12084 - protein, 253 aa, Xenorhabdus bovienii
  Coding DNA sequence: Name=SeqID_5976
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=23..251bp; Hit=15..241bp; Blast score=144; Percent Identity=36.0; E value=8e-35; Homolog= PA4229 COG3208
LEKQEHSLERNKLFIIPEPVNSPRLRIFCFPYAGGSAKTYLDWAEHFTDNIEIVAVQPPGRTTRLDEAPYEDLYSLVDELMAHAEFITKIPYAFIGHSLGCRVAFELACKLQSCGYPVPVHFFVSGCTAPHLRHNFPDTHDLPHDEFIRELRKMNGATDEVLLNSELMDFLLPVLKADFKMAETYQAKRCLLKSPITVLSGDSDPDIKPIELYAWSELSSEGLTVQYIPGDHFFIVQNKEKVIEVMLALLSQI

SEQ ID NO: 12085 - protein, 1114 aa, Xenorhabdus bovienii
  Coding DNA sequence: Name=SeqID_5977
  Gene classification: Gene name=EntF; Function=Non-ribosomal peptide synthetase modules and related proteins; Function class=Q Secondary metabolites biosynthesis, transport and catabolism
  Homolog annotation: Query=25..1097bp; Hit=11..1019bp; Blast score =353; Percent Identity=27.0; E value=4e-97; Homolog= BS_ppsC_2 COG1020
MNTDTEMDSTFEVGATFEIDEIQASAGQQDLWLAEQLTEKQLYIVPVTYELVGALDQARLLDAIAQTIQNSEAFRTAFVETEQELVQHIYPAVELPVTVVDLSEPNGASDNDQSQLQRALTYCQHNLETPFTLSQPGLARFLLIKLGEQRHILHFCLHHLICDNDSVALILNNIATTYAGEPLFSDNTGADILEYAEFAAWQNELLRGDYLDGDEAYWLKELSGVDGRLELSIGNPIPSKNEQGGMVRRLLEPHLANSFNHCASSLGISPALAYFIVYAALLYRLTEQQTIVFGVPTSLRDDKRLEKTIGYFINVLPIKVIFHPKISFADIATQLSSQLYTGMQHQQFPYSHIVRSVSHSQQISQAPLFNVMYNYFVGQADWTLPGTRAYQHELTPVGGKFPLTLFVVNHIDTVELCFEYQYDHVATDYSGVLSNSYQRLCTAMILNANQEVLAQTLLSEDDYQRQVLTFNQTGILFQEDFCQHFFRQLNVESELTAVEYLVGSHSERMSYEKLYSLSQKVADELRRHIISETAQQARVVIFSGASPLALATIIACLTEGIVWIPVDSHLPLNRLLLIIEDACPDAIVIEGDVVEGKNASLVAEMACFNTPVIELTREWEAVSRDNNRNFGPLAPQWERITQSDCLCYMIYTSGTTGKPKGVEVYRKGLNNYLNWAAQTYMPTKAHDLGGLGVPVTTSFGFDATITSLLLPLMARGHVMLFSSQVSQDSQDEPLLRLLELNKPLGLMKTTPSQLEHLALSLGQRQTSLDVKVIVVGGEQMSRTHLDYLNAIAPESMCFNEYGPTETVVGCCVERLNIVADPQRSQGVLPIGSPIANTRMYVLNESGCHQPAGVVGELFIGGAGVAKGYWQRPDLTAAAFIEDTFSHINGERLYKTGDLGCFTMDNTLLCLGRKDKQIKLRGYRIEPEELEAWIKQVPDIDKAVVVVEKRPHERLCGYLVAASGFAGSTHQLIDQVKQYLQGQLPDYMIPTQWRVIDAIPYTVNNKIDTAALLTFGQNQYSLVAEEHVECEFSSDIARQLCSHFSEALNRSTVLPEDNFFELGGDSLMAVRLLAKINTHFTIELKLKAFYQRPSLTNLIELAEEQLRHSNTNINR

SEQ ID NO: 12086 - protein, 402 aa, Xenorhabdus bovienii
  Coding DNA sequence: Name=SeqID_5978
  Gene classification: Gene name=HcaA1; Function=Ferredoxin subunits of nitrite reductase and ring-hydroxylating dioxygenases; Function class= P Inorganic ion transport and metabolism
  Homolog annotation: Query=53..391bp; Hit=44..392bp; Blast score=99; Percent Identity=25.0; E value=7e-21; Homolog= CC3122 COG2146
MSDTTVRLLDGGEGVLNNVFSPYADYFIDMLSQRNSFIATEPVGIYESQVKHYICQDYFNDEQKDLWKKIPQFIAPIQTLENIGDFITVDYQGRVPMIVSKVDNDRCTVFENVCPHRGARLENHTEGCKKAFVCPYHSWSFSHQGHLIAARWRETFPEIPDQYRSLNSISAQQRFGMLWQIPSDPKLGFSLDNWFAAIEDQISAIDFEQHQLLNSRERMVQANWKLLIENFIEYYHVQSLHRKSLAPTLNGQLYSLDSFAQHGRILTPLKNLAQVLQQTPHKIRREMVATYLLFPNVIIGVQPYHVFVSFYHPVSANQTWSKTFNFIHKADEEIKEVCQLDVEYLAEALEEDYEAIEQVQKNLETTSAPSLLYGEAESLISQLHRNLAAILHPNGREANRHE

SEQ ID NO: 12087 - protein, 340 aa, Xenorhabdus bovienii
  Coding DNA sequence: Name=SeqID_5979
MLRIGIIGTGAVACYLAHQCKQQGCQVFLLSSRGTRHQAQPISQIQLIDETKSEQSVSQDLGSIVVDEHLTDYSAFLAKEFDQLYVCSKTVSNPHICQQLSRHKHWLRGPVILFQNGFATERPFIDEALDVTIIRGVLNFSVTQHGKQKLKLRFLKTSYLGVPEQTEERAEANILAALDLLNRAGIPFESCTDIEHKAFAKNTLNAAASVCGLVRSGVETAMRNSRSRTVIQAIIDECTAIGEKAGYIGDSENFRRQSMGYLMSIPDFKSSLVLDILHGKETEADTLLAPFIRLSQHVGIAVPNLDFVYRYFDFYNTYITQSYIIQSYTFTDMTLVEGDA

SEQ ID NO: 12088 - protein, 416 aa, Xenorhabdus bovienii
  Coding DNA sequence: Name=SeqID_5980
  Gene classification: Gene name=ProP; Function=77 Permeases of the major facilitator superfamily; Function class=G Carbohydrate transport and metabolism
  Homolog annotation: Query=7..184bp; Hit=4..181bp; Blast score=69; Percent Identity=28.0; E value=7e-12; Homolog= sll1204 COG0477
MKGINGFYPLWIGIAVSIFGSELTEFAFGLWLLEKQMSVTAYTNMYLVLVLPAFLLMPLVGYVIDHYDKRKVLLLTEGIAGLALAIVLIFNHFGYLNNIVVYLYIALTSVLTALQIDCYSTLVFRLVPAASLNRANSLGSLSDSLPQMLAPIIGAFLFSHYGLGIVLTIDLLTFMISAFAAGLLFRVSAVQFLPHDDGTLSKLNWKAIFPDIGCARLVKASSKMTYMIAYTFFKAILVGGALITIVPYFTTYFSVADAGYMMSIGGVSMVIVSLISAWRPSILRRTPLLVLEFLFAAGFVVLTQIKNIYVAGACIAISFITMRISIIKMQTLWQTTVPKIYHGRVFALRNLVKTFSSFIIYLITGIVLDLLLAQEEGWAIWGQGNPMDLYFIGITLLILPPLLISTRRLLVAIGGE

SEQ ID NO: 12089 - protein, 1890 aa, Xenorhabdus bovienii
  Coding DNA sequence: Name=SeqID_5981
  Gene classification: Gene name=EntF; Function=Non-ribosomal peptide synthetase modules and related proteins; Function class=Q Secondary metabolites biosynthesis, transport and catabolism
  Homolog annotation: Query=758..1854bp; Hit=27..1028bp; Blast score =309; Percent Identity=26.0; E value=2e-83; Homolog= BS_srfAA_3 COG1020
MTQLPNEIKHSLQSWLQSELASEHVPTDTDFLALGIESLTLIRLKNNIKSQYGVDIGIGKFFKGLSNIDKVANFVSQQTQPAPAGSVNDKPQMPLSVPEMPTPQQSQAQVQPQETVNMQREPIDSPTSPLASLSPPVSPIAMAFNEPIVNTPMANAPIDTVRETKHDIDTKQGIMVAQLNAMQQLFQQQLAVLQNVRGGTTNFATANQLPVSALTPALSTVPTTSNTVPLNSAQSTKQSVEVPTNHSEQPQPMVIRPAASSGEKAKFTYKPIVLSESVQCDAETTAFIQQYNAKTSASKTTIQKYRTALCDNRNAIQFNSKLKELCYPIVGKTAKGAHFTDLDGNVFIDIAMGFGVNFFGHNPDFIQQALQKRLQHGFHLGPVDESGMVVADLITEITGVERVAFTNSGSEAIMLACRVARAASGKQKIVIFNNAYHGHYTEILFMGGMKQGERFSQSSGIPDNLGQDIVVLNYGEQQSLDYITTHGHEIAMVMVEPVQSRNINLRPKSFIKTLRKITAQQNIVLLFDEIITGFRYHARGAQHYYQVKADLVTYGKVIGGGLPVGVLAGDAAVMDYIDGGFWQFGDASYPPNETTFFAGTFCKHPLAMAAAEATLLHMKAQGPSLQADLNDRTTGFVKRLNGLFTAANSGIDVANFGSLFKFSQKKNHELLFHHLLMNGVYTWEGRTCFLSTAHDDNVLEACFNAFEKTVEGISVPSRSSSFRPQDRPTTPKTQEIVVLAELGMQKNLAMASWYDPAASKSYNEFIQCVITDELQPHRLNSTIEYLFNRHQQLRQVFCPETFETAPGQFDYHAAMRAEQSPLDSPEKFSQWQQACLDEEFILDRGPMFRVHVVQIDLSRPLWDGTPLAQYASDHCRVDIILLVAHHTVVDGVSFDIFIDELVAVYHGASDLPPVLQYQDYLGRLAAFKRTPDFIHQKSFWHKYLSGWQTDLANLPAPVPAVLTEEGDVLATGGFHLEKLPAELTAKLLHYATEHRVTPYMLMYTVYSIFLGSVLKQSQFVMSTSVSGRNFDNFDNLVGLTTAMLPVRVNTRNEQQFFSEYLDLTCEQLLEILSHQDVTVDDLTMQNCSLGNRSEMLNRYLNYDFNFSPRKLRLNDSGSWSLLLDNPKRYIIGQLSLDVFQSENDLYLHWEYAVQAYSKVQVKILSGKMGQLLSYLVNAPELDTLTLADIATYLNSLDAPSIAIGPVRKDFLYQAPIHTLFERRAADEPQACALVDTSLPEGLKQLSFAELNHQANALAHHLLRQGLQPEEPVFVSVRRGVPLAISVLAILKSGGVYVPVDKKLPVAQVEYLLSILTPRFALIDGDYGIFKTLSHVQYFNFYDEETLLRQCGVDEGNTALLQNPEKVIPAGQTAYITCTSGSTQKANCVMNSHGAIAHHCLMMKEYLAICPEDRMLQFTDLCWDIVLEELFPVWTAGGRVVFFGDTPPNTFADFNQLLIEQQITLADLPSTYWQGWVENLGDPAMDYPSHLRRILVGTEKVDPQTLKKWQQHVPKGGIFSNAYAQTETTITATDSVITSDTWVGETVPLGKPLANTGFYVLDEARQPVPRGESGELYIGGPLVSKGYYGNNSLTAAKYVTDPYIPLEACNHATPRMYKTGDLVSMDEQGCLSFLGRTDFQIKVRGYRIEPTQLESIIGQWEGIEQVVLTTNSVIDPRIPVAETKLLCYVKTQADKAEQKALSERIRQFISRNFAHYMQPHAIIYLAEFPKTTNGKISIKRFPLQHSPLQASSSPNSALQHSSLQPHYSESVDQPPSRVDLNSAAGRLLMTHLGQHGLSMNESFVALGGDSLTAIKILSALQKEHGMTLRLPEFMACETLTDLIEWIESALAESRDTAGSQASLPNSHAEMTGQKEKPVLQARSRKKKVMVE

SEQ ID NO: 12090 - protein, 1651 aa, Xenorhabdus bovienii
  Coding DNA sequence: Name=SeqID_5982
  Gene classification: Function=Polyketide synthase modules and related proteins; Function class=Q Secondary metabolites biosynthesis, transport and catabolism
  Homolog annotation: Query=635..1595bp; Hit=38..972bp; Blast score =428; Percent Identity=31.0; E value=1e-119; Homolog= Rv0405_1 COG3321
MRKQKQNAGADRFVDQWRGCLQGLDTDNVLILALLKKALSDVDAIRFNDLQSGRQLSWCQLLCSVARIYRYLHELNVSRGQRVVTISHNCWELLAIEFACQLKGAIYAPIYANYSEEVMTYCLSLAEPVLVITERVSLAQTLPQNTSWQVMTLEHSSTFTDFASIDSETDLISPDKTVSHEVVGEALLRALTTDLQATQAEQAFCLMFTSGSSGKPKGVLLSQSNILSQQQALQTLWHFDGPQSFLSYLPWHHSFGGLFEKYTAIFSQAMLHIDNSRGMDIARLCTNLSQLKPTRFFSVPKILTVVANKMKHSEDFQRAVAPTLQMIFSAASKLPADIEDYFNHCGIYVAEGWGLTETSPCLTLKGSDCEEHNSVGRPLPNVTLCIDEDSGEILAKGPNVMLGYYADEAANRRCFKQEWFRTGDLGKMVKGELVLLGRLDSVKKLSNGEKVSSDAIEQSLFEKTDIINHAIIDIEQRPYATALLFINPELCRQRFGENCTLQHSSRLQEHIVEVVQQHNHQVAESSLKLIAVAVTETSLSLAKGEVTPSFKVSQRTVRENYQVVRDALYDTSKPFHLNPACHSFLKITENHIVSSVVSEDTAPKQRINWETFVHIIGQVRGQELAEDDVQRSLLDLGYNSVTIIQLAASLSQAIGHTVTEVVLFSGSSIHQLWQRLVVQTSAVQATDESHLCTEDTTSLPPKQGNADVAIIGYAGRFPGAEDCDQLWENMLAGKSQFSRCPEDRPFMAPLLAEFEANGIQLSGAFCDDIRQFNHSFFQINPKDARLMDPQHRLLLMVTWEAIEQANLSLNGLKESRTGVFVGISQNGYRQLLQEYLTETGEEGYPSSAINNQNSVCANRLSYFLDLRGPSLTVDTLCSSSLVALHQARLSIERGECDTAIVAGVHLQLDMAHFREMQQLSVLSHDGICRPFDAKANGTVLGEGAGVVILKRHDLAIRDNNDVKASLLASEIYHGGRSNGITAPDLLAQQQLLEQCWANADVKASDIGYFETHGTGTHLGDPIEMAGIHACFHDQKAQTPCYLGAIKANIGHLEAAAGIAGLIKLLLIDKHRMAPPVAAFSELNPRITLAEGQLAIPTTAQPLAPEKTCLAVSAFGMGGTGAHVVIKSQSKKGLSDTEPENETLPCVLSGCDQAHLKAIASRLLADVQQHVTQKQFVLRHFCQALAQRTVLPVVCTLGVNSAEQLVEQLSAIVRGEVIGYRASENGPSIAAITTDKTTMALVFAGQGTQSVAMAAQLYRHNVQFAQWIDQIDQLCSEIAYESGQLKVEVKQLLIEPVDEQTINRTEFAQVILFAFEYVLYQCLRPAIGRIDILLGHSLGEYVAACIANVFSLKEGLRIIIKRAQLMEASDPRGAMMMVNGTAEQVSALIENELKIKQQTELNIAAENSETNTIISGTRCALERFRQQLEQHGFYARFINTNRAFHSPMMSNAAQEFGAFLADIPLKAAEVPILSNLTGQPETECFATAEYWQQHMLGRVLFRRNLENLTAMTGLKIIEIGPKSMLGTWLMEKQPHHLASAYCPSQNSQQLNYCDLLAVLASDHLSGSPREWLTMYSLFTFNPALLPARKLLTETCWFTEYTATLANGARQQEKPDEYEHGNLIDHEPFFIMQQQIDCMNTIFQAQLELMKGK

SEQ ID NO: 12091 - protein, 320 aa, Xenorhabdus bovienii
  Coding DNA sequence: Name=SeqID_5983
  Homolog annotation: Query=10..300bp; Hit=29..337bp; Blast score=152; Percent Identity=33.0; E value=1e-35; Homolog= gb|AAP92493.1|
MNQSIYSIELSNSEVDDIQVLIGSLQERYHSTDDQAFVRSLPEWVESLPTRLRIEVKKFRHQGYPLVVIKGYPDMSEVMGATPNHWKNIYNTNSNYDYYCCLMSSLCGDVVGFSDLQDGKLVQEIFPIQKDAGKQLGTGSVDLLLHTEDTSLDYRADYLGFMCIRNIYQIPTSVSVPDFSKLSEKTITILKKNKFHIFNDRPCLSKEERHENYTVCSILTGSGDHIHMRYDPLYMDKDALDTEELEAVSELEALAEAAVFDLVLSPGEIAFIDNYRCAHGRKAYQPRYDGTDRWLKRTQILTRLRDFKHLSLPGRINVLP

SEQ ID NO: 12092 - protein, 389 aa, Xenorhabdus bovienii
  Coding DNA sequence: Name=SeqID_5984
  Gene classification: Gene name=AvtA; Function=PLP-dependent aminotransferases; Function class=E Amino acid transport and metabolism
  Homolog annotation: Query=10..384bp; Hit=2..385bp; Blast score=253; Percent Identity=36.0; E value=2e-67; Homolog= BS_aspB COG0436
MIQENPFSSRIANRAKNINASVAVGLADIVAKLKSEGRDIIGLNEGELDFSTGATIVNETLRALIDGRTRYSWLNGEPELREKICQKVFEDNRIKATPENVIVTNGSKQVIYEILQTVINPGDEVIIPVPCWATYLEAVKLAGGKAVLIENIGVDLDVEKIKQAITDNTKLIIINTPNNPTGAVYSKSALQTLCQIVKEKQIFVLSDEAYEQIVFDDEHHSLAAIDDNEYIITVQTFSKSFAMTGYRIGYMIAHPELICRVSDLHGHMTDNVCTFAQYGAIASLEKPKDLYQERLEILKKRRDRSYQYAREFFECELPAGAFYLFPNVEKYLNDRCRDATQFCEYLLTHAGVALIPAEACLYRGHVRISFAASMDAIEQGFERIANVLR

SEQ ID NO: 12093 - protein, 411 aa, Xenorhabdus bovienii
  Coding DNA sequence: Name=SeqID_5985
  Gene classification: Gene name=KamA; Function=Lysine 2,3-aminomutase; Function class=E Amino acid transport and metabolism
  Homolog annotation: Query=28..375bp; Hit=41..385bp; Blast score=314; Percent Identity=44.0; E value=1e-85; Homolog= DRA0027 COG1509
LKHDSHLIENPKAYEEDGMFLSKESFSDEEWNDPKFQLRNLIKTSEGLEKWVALTDGERKAIEAVKGKYLWQSTPYYASLMDKHDENCPIRLQTIPHLREMNVAENSDNDPVGDTANLKTARVVHKYPNRIVLLVSDTCPVYCRHCTRKFHTTDVSGTYFGSDLVASYEEDFAYIENHPEIDDVLLTGGDPLIHYDKFLETIIKRLRSISHINIIRIGTRYPVFAPQRVTEKFCQMLEKYHPIWVNTHFNHPKEVTEEAAAACDRLLRHGIPVQNQSVLLKGINDDVATMRSLLKALLRIRVRPYYLYHCDNVSGVSHFMTTLEKGQEIMDAMVGFETGFSVPQYVVTTTLGKLSVNRAHVTTHEDGRVTAKNYKQDSLDITEYIKPPSDLNNYSAEHRNSEIILSKTIDL

SEQ ID NO: 12094 - protein, 51 aa, Xenorhabdus bovienii
  Coding DNA sequence: Name=SeqID_5986
MLQTTTVKFKNRRNKIALVSTTKGITHGKMWVYNTECFGNVWIALINNNRV

SEQ ID NO: 12095 - protein, 34 aa, Xenorhabdus bovienii
  Coding DNA sequence: Name=SeqID_5987
MEYLFLKVLFIFKGEIYFKVCNFSGFIYIKPCCY

SEQ ID NO: 12096 - protein, 72 aa, Xenorhabdus bovienii
  Coding DNA sequence: Name=SeqID_5988
MVRCRIKACLIAHFIAYLTKCPTDFYGILDVHLDRSHVFSPTLFVDKIDILLLPSPFKLPTKNMGYTRGTIN

SEQ ID NO: 12097 - protein, 193 aa, Xenorhabdus bovienii
  Coding DNA sequence: Name=SeqID_5989
  Gene classification: Function=Putative transposase; Function class=L DNA replication, recombination and repair
  Homolog annotation: Query=124..168bp; Hit=23..67bp; Blast score=70; Percent Identity=71.0; E value=1e-12; Homolog= XF2303 COG3316
MKTYVAKVALRGISPMIWHRFRLSGETSLAAFHYIIQIAQGWQDDHLHQFRIYGKNYSISYSDGIRFPDNPDKITLDDFEFDAGDLFTYEYNFFEHWLHDRFCCIKASSGNMLFFLWCYLSISLIRKAFRRLHYPTDVIAQCVRWYLAYALSLRNLEEMMAEHGVIVDIPRFTVGSSVWCHCWIRHFAGINGR

SEQ ID NO: 12098 - protein, 97 aa, Xenorhabdus bovienii; identical to SEQ ID NO: 12081
  Coding DNA sequence: Name=SeqID_5990
  Gene classification: Function=Putative transposase; Function class=L DNA replication, recombination and repair
  Homolog annotation: Query=1..97bp; Hit=129..232bp; Blast score=87; Percent Identity=48.0; E value=2e-18; Homolog= mll9070 COG3316

SEQ ID NO: 12099 - protein, 180 aa, Xenorhabdus bovienii
  Coding DNA sequence: Name=SeqID_5991
  Gene classification: Function=Predicted transposase; Function class=L DNA replication, recombination and repair
  Homolog annotation: Query=1..178bp; Hit=1..178bp; Blast score=105; Percent Identity=32.0; E value=2e-23; Homolog= mll8100 COG3293
MPRTMLSKSLWNKLAVLMQQSGYVYHKEEHYLTFEGILYRMRTGCPWRDVPTEFGKWNTIFKRFNDGSKKAIFNLLFKLLSENTDTEWLFIDGSIVRAHQHSSGAASVEDEAMGKSRGGLSTKIHLAVDSYGLPVHFELSGGQTHDIVHAESWVTHSPSSDFVIADKGYDSSTFRRAVSR

SEQ ID NO: 12100 - protein, 60 aa, Xenorhabdus bovienii
  Coding DNA sequence: Name=SeqID_5992
MMVWGNGFFAKTMIPDHHAVQIPLIKRQQPLVTLGYTGLIFTLYGNPVRYATEFTQRDQL

SEQ ID NO: 12101 - protein, 248 aa, Xenorhabdus bovienii
  Coding DNA sequence: Name=SeqID_5993
  Gene classification: Gene name=Tra8; Function=Transposase, IS30 family; Function class=L DNA replication, recombination and repair
  Homolog annotation: Query=9..247bp; Hit=143..382bp; Blast score=222; Percent Identity=48.0; E value=3e-58; Homolog= tra8_g1 COG2826
MNRRTRIYYTPEQIAGWLKRCYPDNQEMYVSHETIYKTFFIQTRGALKKGLQQCLRSRRTVRKSRTTSLKGKGLGTIPDAIPISERPPNVADRAIPGHWEGDLIQGSKNSYIVTLVERHSRFVMLAKISDNKTTTVISALIKQAQKLPVELYKTLTWDRGAEMTNHTLFTVATDIQVYFCDPQSPWQRGSNENTNRLLRQYFPKGTDLSVHSQQRLNSVARQLNERPRKTLGYESPAERFYQCVASTR

SEQ ID NO: 12102 - protein, 73 aa, Xenorhabdus bovienii
  Coding DNA sequence: Name=SeqID_5994
VTHTFPDYRDNSVSTNRRFVLACSKCAFFDSWQHPPRLRIALHRPVELIAKSRLRRQQDYVKLAKLYDTILSC

SEQ ID NO: 12103 - protein, 152 aa, Xenorhabdus bovienii
  Coding DNA sequence: Name=SeqID_5995
  Homolog annotation: Query=16..141bp; Hit=16..140bp; Blast score=72; Percent Identity=33.0; E value=2e-12; Homolog= ref|NP_469976.1|
MHCDEFDLWANLSSNDYVEDLMTNHRYSRKKAEVEASKSFKTALPAGINTQNNHFRTYEHDAQAAGYLWFSLEDNSAFLSDIMLIPEFQGKGMGRDFIRAFLNELTRQGAYEVELRVSPDNQRALKLYKEFGFRITGFDMSLLLEPELSAIR

SEQ ID NO: 12104 - protein, 241 aa, Xenorhabdus bovienii
  Coding DNA sequence: Name=SeqID_5996
  Gene classification: Function=Putative transposase; Function class=L DNA replication, recombination and repair
  Homolog annotation: Query=70..175bp; Hit=80..185bp; Blast score=150; Percent Identity=67.0; E value=2e-36; Homolog= XF2303 COG3316
MVIVTRVELEGFLATLAIITRKPGFTCSMFAYRFGLVTIPASNFYRHRHFEIPLKRHKNIRLTLWSHDPPLLSKAFRRHKRPVGRRWRMDETDIKIKGQWKYLYRAVDTAGKTIDFLLTDKRDTAAALRFFRKALRQHGEPDIITLDKSGANTAAIALLNTDKSKEEAIKIRQDKFLNNRIEQDHRNIKRRIRPMLGFKSFRRTQTILAGIERVSMRRKGQYSQPEDKTLSPAELFYRLTT

SEQ ID NO: 12105 - protein, 40 aa, Xenorhabdus bovienii
  Coding DNA sequence: Name=SeqID_5997
MKEKIVDMAMNGSGVRDTGRVLSIGINTVMRTLKNCRQNR

SEQ ID NO: 12106 - protein, 122 aa, Xenorhabdus bovienii
  Coding DNA sequence: Name=SeqID_5998
  Gene classification: Gene name=InsB; Function=Insertion element IS1 protein InsB, putative transposase; Function class=L DNA replication, recombination and repair
  Homolog annotation: Query=1..106bp; Hit=14..119bp; Blast score=122; Percent Identity=57.0; E value=6e-29; Homolog= Z1562 COG1662
VGNKKQRHWLWYAFDTKRKQAIAHVFGPRTDATCRKLLDLLAPFHIRFITTDGWGSYAREVEPEKHLVGKILTQRIERHNLNLRIHIKRLARRTLCYSRSIEIHEKLIGTYIEKYHYNAWES

SEQ ID NO: 12107 - protein, 40 aa, Xenorhabdus bovienii
  Coding DNA sequence: Name=SeqID_5999
LKNIIITLGSHDPMVLGVLCPIQRKVSRMKINLLNSIHYD

SEQ ID NO: 12108 - protein, 251 aa, Xenorhabdus bovienii
  Coding DNA sequence: Name=SeqID_6000
  Gene classification: Gene name=PinR; Function=Site-specific recombinases, DNA invertase Pin homologs; Function class=L DNA replication, recombination and repair
  Homolog annotation: Query=47..251bp; Hit=1..206bp; Blast score=150; Percent Identity=41.0; E value=2e-36; Homolog= Z3622 COG1961
MTQSIRVVQFKLTLNTLAKCGAENSSKQCIMHQNNDTMYSALMKTHMRIYGYLRASTDEQDASRAKSELLEFTKGQGVKIACWFEENESGARLHRTELFRLLDVVMPGDVILVEQVDRLSRLNTADWEKLKYMINHKGLKVVSLDLPTSYQFMKNTDEFTERMPTALNNMMLDMLAAVARKDYEDRRRHQAQGVKKDKQEGKYKGRPIDKKLHQKIEGLLREHKSYSYIVDLLGCSRHTISKVSKEIKLIE

SEQ ID NO: 12109 - protein, 35 aa, Xenorhabdus bovienii
  Coding DNA sequence: Name=SeqID_6001
MKKIKSSRIQILTEQEIHELYSRPTFNQAQREEFF

SEQ ID NO: 12110 - protein, 119 aa, Xenorhabdus bovienii
  Coding DNA sequence: Name=SeqID_6002
  Homolog annotation: Query=1..116bp; Hit=51..166bp; Blast score=204; Percent Identity=82.0; E value=2e-52; Homolog= ref|NP_640046.1|
MGKIETRIYLIPLIGYFRAKPVVPKFKLREVKQDVDYIYATYFPNRAPKYPFVAKSTRATLIVKMYEILGFARLLKRDRQTLMDRLKDVATICTYPKYIFDECLAFFGQKRIGLVGSGA

SEQ ID NO: 12111 - protein, 48 aa, Xenorhabdus bovienii
  Coding DNA sequence: Name=SeqID_6003
MNVWLFLGKNELGWLEVEHNYENLFIMLENVSDRNGIYIQLVKKTLPK

SEQ ID NO: 12112 - protein, 1712 aa, Xenorhabdus bovienii
  Coding DNA sequence: Name=SeqID_6004
  Gene classification: Function=Polyketide synthase modules and related proteins; Function class=Q Secondary metabolites biosynthesis, transport and catabolism
  Homolog annotation: Query=6..1351bp; Hit=1..1403bp; Blast score=553; Percent Identity=32.0; E value=1e-157; Homolog= Rv2940c COG3321
MDINMMRSDNMPIAIIGMSCRFPGGVSSPEEFWQLLCGSSDAITPVPPERWSTQAYSSRDRNLPGKMVAREGGFIADVTGFDAAVFDISNTEAPFIDPQHRLMLQVTWETLERARIAPKSLAGQAVGVYIGAFTHDYMHLQFTDLRQTTGYTSTGAMGTMLSNRISHAFDFQGPSLTIDSACSSSLLAVHLACESLRRGESQLALAGGSQLMLMPDFSVVESCTGFLSLTNRCHSFSANADGYVRSEGVGAVLLKPLNAALQDGDPVLAVIHGSAANQDGRTPTITQPSSTAQQRVIRMACAQAGISPEEIDYIEAHGTGTGVGDPIEAEALGLVCRPEPTDRPLLIGACKSVIGHTEAAAGIAGLIKAVLCLQRGQVPGNLHAEPPNRYIRFTELGLQVPQQLTPLSEGKMIAGVNSFGFGGTNVHVVLSNNAESSVQLRTTQGQAFMLPLSAQSEFSLKQQAQSIADLLQQQPDIALDDLCYSLATTRHCFPLRKGIAFSNREQLRQRLTNLNVSSEHNNKKVDRLAWIFAGIGSEDWQDSIAWFQQFPEFTEQFERCEAIWTGFSAPSLYAALISADELIEPPMQFAVQISMAAQLQKWGFKPAALLGHSSGETAACYLAGIYDLTQALTLLHQRYHYLERVLNKGGGLLIVAATVEQILPHLSAPGAEPAVVIAGRNSINRCLLSGPISELTAVAERLKQQRIASSWLNYRIASHSHYIESIRAGLTADAATVPAAEPLLPVFSSVTGELINGKLSPEHWADNVVSSFRFDDAVENMLKAGFHHFLEVSPKSLLSAGLKDWSQPYRGQVFACRSGQNWPQLLGQLFEAGVEPDWQTLMPTACPIDLPTYSWHQQSYWYEPEISRRRRLRILSGVLLGEAQPGSESWQAELAVEQVPWLLDHVVMGNAMFPAAGYIEIMLAAARICFPDVGLALDNIVLQSALLLEPGIEFRLKTQLDRQRMEVQVHITRNLDESVHYQLAASAQVNIVVPGATACAIPPLAVNDRYPCMWNQEMLYQAFQHLHFSYSGVFCTLRHAFVGKEETICEIELPPAPEGMNFHPAALDGIFQSLLAIQSADVHAPIPANEFRIPVSIQHLRINGKLSGRVHAHARNTKQTQQQWLGDIDVYTDSGMLLCQISGFCVQLVGNRKNSLSAKLHNLVVGQPQWRKLPAQPSTESVTQWAILGGENALAEELVDELQRRGGCASLYSGLPDSYQKIQELVDTLPVETERILILWPLQAPRMAYHSLIHLCAALAERSIKPRLWIVTQCAHQITEQDQPDPFAAALWGMMRVIGQQEATALWGGLLDIDSITAPAKWWDALLIGDGEDQLALRHDQRYVLRLVPLPEIPALPPVRFRPDGCYLLTGAFGDMGRQLIPWMVQHGAQHLLLIGRRLALDTADQKLLEMLHQQGIEANYLPVDLGDVERTHICLAEYRQQASQPLRGVIHCAAHVEDQGYRELSPEAFDRVFATKALAAWTLHQALADAPLEHFVMFSSLGALLALPGMASYAAANAMLDSLACLRRQQGLPALSLNWGPWEAGISLRDSRTLPILENSGLQPFGSEEGLAVLERLFARIEPQLVPFLTNWSNLLSSQMRHLPLLRDIQQENVVQTLPIEAALAVSDLDDVVSLLQTFCSEIVGTSTEVFHPDLPLTNNGIDSLNGLILVQKINKQLRLDIPLELLLSDKPLAELASLITYRLQVKAITK

SEQ ID NO: 12113 - protein, 823 aa, Xenorhabdus bovienii
  Coding DNA sequence: Name=SeqID_6005
  Gene classification: Function=Uncharacterized low-complexity proteins; Function class=S Function unknown
  Homolog annotation: Query=165..450bp; Hit=20..305bp; Blast score=93; Percent Identity=29.0; E value=8e-19; Homolog= sll1446 COG1357
MSESRSFAGKWQFAATSGQLITVQTDGTLSLSAKQSGAINQMINAYGISSFWLQAGNGQYLAASGNTPQANQSRNGAVAEIRLEKMGSGFRLCRISSSGDSYLVAQQSGLVWQAATSSPPLSAQFTRTIVTKDLEFLKEWGAMGSDLRFAYLAEENLNEMVMMAVDLSNADLHGSTLIDATLTNVKVDDCNFSGCDLSKTDLTHIHGKNVLFEKCIVGSDTNMPDAELPNAIFRGCKSSGGQPILNRLKAPGADFSGALLPSVIMENADLSQANLINVDLSGASLASCNFTAAIMTLVNLQNTTLQTSNFSQATLVGTDFTGANINHVNFSGANLTNARLSLTTGYSQLNLSDSTLLATVLTEMNLVDATITAKTDFTQAQMDGVNLSSQKLDQVIFLMASMKKANLDSTSLNGAVLVGANLAGATVLGNVSLVGANLSNASLENVNLTGAQFGALSTVTHLDEADAQTLDNQQLPERLRQMLYQGKILVNGQAEVLVRQPGQNWLVEHDGKPLFIHYQDGQLNVAQDNGGNAAILANTFMPNAILTGANLYAVDMSGAHWYGSNARADNANLEQVNLSNANLATMNFTQARLFGANLSYASLVNTDFSKAMLEPTEGLKLASLAFASIQGTIFTEAKLTGANLTNGAVALPFEETGNKLTGVPLFSAALELMSSLNSGTVSKELCQVFTDNGYSLLSNAKIIEKQSDQYWIISNQPPDTDLNYRGYCNFMVIRVSEVGNNHLQVCGGSPLRIIRTAADNTLQPVNVAFGVTIDITQAMDGATTCPSGLRYQLLNTGISYQSLMTPGLPPHPPKCIPSPTTWC

SEQ ID NO: 12114 - protein, 217 aa, Xenorhabdus bovienii
  Coding DNA sequence: Name=SeqID_6006
MVADIQILGTNGVNGADGANGADGQRGIDGQNGSRRKPPTAGGPGGDGQPGQNGLDGQSGSSWWFALRCNRFDVQSVVRISNSGGNGGNGGTAGYGGNGGDGGNGGRGSSLSSGKPGGIGGNGGNGGNGGSGGAGSDGGNVWVRYIQTSLPKPISATSDGGDGGVGQPGGAGGIAGRGGVNGDGSHAPDGGYGIGGISASGGQAGRAGKVSVVQSRG

SEQ ID NO: 12115 - protein, 419 aa, Xenorhabdus bovienii
  Coding DNA sequence: Name=SeqID_6007
  Homolog annotation: Query=1..416bp; Hit=1..416bp; Blast score=322; Percent Identity=59.0; E value=6e-87; Homolog= ref|NP_930775.1|
MNKMKTVNETLAELREHYHLTGTERQPKQLNTSDFDGPVIFSNDPKIATVPPAFFTVQTIQELKELGGVPDSEYGPGGMEPHHPLPEPYSAERLANVTGNHADICKAFRAYIYGYSPLVKDYEDILNAKRFPMKVALYSGEDIVVTASNPLIIGSKESHGEPVNLNFNKITIQPGGKVIYLTNGTIQANEVIIVNTLGTDNDGSNIENVGGNGGNGGSGNSGSNGKDGSNGNPGKDNKNSCATQATSGTAGGGGTDGARGSDGEKGGNAEDVNFKTGTITGFVNMLTQGGNGGNGGNGGNGGHGGKGGNGGGSTSECRAGNGGNGGSGGNGGASGNGGNAGNGGNIYFTYNEGGSASFKARAIAGNGGNGGNGGSGGVGGGGGSGYSSGSSGKNGTSGSTGTAGKAGTVGSVYVNGKKQ

SEQ ID NO: 12116 - protein, 1482 aa, Xenorhabdus bovienii
  Coding DNA sequence: Name=SeqID_6008
MKTHILHFDLAQSHLRTQSSQLNLWVGEYNIPLQEHDESSLARAAGENPAIDMVLRYGSHNISHFAEVPEHYFLPHHVTLIKVVGDKSGPYRSSLPVLYHLSYHIPNAHLHRYAKRNREKLAVNNIEMALPGKLSALGVNSQHLARNSIHCGDLWVATNEMKTPWDVACSIVFSHPELSNSQAYAASIVMNAHIAPPEAIDPLQYNRVYELAISISSQGPATETGGFATYGQLVDPDGSAMFYEFDWVGQDGQVIFAEGDPVMQYNLSDETENYSGSPASNALKTSHNDGRLQNHNWSVSQSASLDVAEFKDQAAALAVKRDTNQIWTATNRTPNHGMDVYADSIRYDSSLSHFSIDFKNKYLRQLGVYIQFFKDTKMEQPIDNPKVDGDWPFYFPQELAALFETPSQKALGVLANVNTIMGIPMPTDPTNFGLPWPAEAQAAKFLFGGLGTSRWENPIVWPGVILTGMFQYGIPALMMLAGAMVTNSQWYKDFISNKDNVAILAGIAFPLIGGGAAVGSALFNTKKVLTSLASIAIGILAKKGMEALATYVTAQVAASAAAQAVPVVGWAFRLAAIALDVAQIAVTTGELLSSPATLEVDIKRQMTLAFTLHPDPAHGEAGRPETAIWPPVAVQCQVTVEYTNGTYYTQTIPLPATGSNTPLSFNFNSVGWGGTLKIKANVYSATGWLAGSYTSDLLNAQPDDPNEGIMRVSGNIKEMLVPLTQVTQYEYWEQLSYDSGKKEYQWIEGSVPLETQSSTNCSNVGNNICKLVNMTILNSDYQVGYCYQASGQDIPLEDPLSPPNSGQMYVLQNISTLSNDSLNERLKLSAVGFKVQPLISYNSFGEGPDEKTITPYNFIIDSRFGEYHLRRVDLRDGSHNFGLTDNPLSWGTFTIPHLDAMVVHPSGYVIAVSWQYSKMQILALGDQGYPDDQAPAAQIVSGEGIRQGLTHGPIALTVTPDGRILLLETINTRIQAFDTKGNPFPSFAGATLFQLATADYQATLDAQEFSPALQQAFREQGLTFLFSNSDPNFIRSLNAGVLDEQIIATFAQDGIYLSYNQTADGNIDPVGSTTVDVIQQGQSWLVYDPQKTATYTLTAQGQTVSVYNDLSHVRVIAIGQGAKWQIDDLSSARSWLLTLNATNPAQITVTDYLSYMPLNKPAGITYLDVAVEAKGYIYVLSYRNEGRDPTDYILDIYNPDGTFLVTVPDSTLVPDPAKRQHIVAGHLAIDSFRTLVAMNYGKFLGENQRTQPQISQWMPTTPIFDLGIDQLPIFQQHDMDKIRAVFADNKHPLSNKATIETINENGYFIITDVSTRYPVICTVDGDNQQIISVYSFSETTMPLKNYSSGFKEVLQLLGIPESDVTEKVVVASSSQGSLRPDDPQSLAPSYTAEVSSASELLTLSGIPPVEAPISFPATVDVFAIAELEIADDGVLNISNPTSRPIVVVVDTLALKQGGQLICDASVILNVQTYTKTQENSHE

SEQ ID NO: 12117 - protein, 525 aa, Xenorhabdus bovienii
  Coding DNA sequence: Name=SeqID_6009
MNPLDHTIPMRKEALHHVSAAKSALNRFANAQIPQHPWMAPNNFGSPHQDSWCSESVSLSGPIEDNLLLIEQYNPFGYTPNMVCNSKNQMIGVSLDYVSSLFWLVVFDENCNIISATSVGEYSGSTFGGGYFYMDNNDNTIVVQGNKIASYPTADVQSRDNEIYALTPNWQSDDIVELVTGSAQGNSLYSSLPVWDETRPNLYWCLIAGEFDYQNYPESTLNSSAQMAVVEIEPSTGNTTLINSLELEKQWNNNTFAVDEKGAYIVTNGIDNKGLCTEGYLWAFNLEKNEVVTRWKTSYKNAGYLKPGQKNIGSGTTPTLTKMENGTELVAITDNADPRLNVVVCNRENGAIISETPCFLRMKSADEASLIGVGDTFVVENNFGHYPTWPFSQLVPNAPGMDMIRINPENSDQPDEKKWSIPDVHFYAMNMLCRGSGIIFAHTCSWSDEISASKGGMYYISAIDSFDGRVIWQIPLGRGVNYCHEYGGIYFNRNGDLYIGTNQYLIAIKNFRDRSKPLKEKAPEI

SEQ ID NO: 12118 - protein, 51 aa, Xenorhabdus bovienii
  Coding DNA sequence: Name=SeqID_6010
LAHHSGRVQETIKTNWYITRHFRFCRISRESASKDEYDYFLCSELIEKFGG

SEQ ID NO: 12119 - protein, 194 aa, Xenorhabdus bovienii; identical to SEQ ID NO: 12030
  Coding DNA sequence: Name=SeqID_6011
  Gene classification: Function=Putative transposase; Function class=L DNA replication, recombination and repair
  Homolog annotation: Query=1..194bp; Hit=32..232bp; Blast score=160; Percent Identity=47.0; E value=6e-40; Homolog= mll9070 COG3316

SEQ ID NO: 12120 - protein, 32 aa, Xenorhabdus bovienii; identical to SEQ ID NO: 12031
  Coding DNA sequence: Name=SeqID_6012

SEQ ID NO: 12121 - protein, 51 aa, Xenorhabdus bovienii
  Coding DNA sequence: Name=SeqID_6013
MSVKEKPQKPGFASLMKQFTRVDPYQCVLCGSRMFFNSAEAGIRAEKLLEM

SEQ ID NO: 12122 - protein, 74 aa, Xenorhabdus bovienii
  Coding DNA sequence: Name=SeqID_6014
MRFKNHDGYGSLRRKDLPEIQFIVQKNTLTDEKPVNHSVVKPENGHPYKRLRSGKEEKLTFNFLTIELSLLFTG

SEQ ID NO: 12123 - protein, 122 aa, Xenorhabdus bovienii
  Coding DNA sequence: Name=SeqID_6015
MNPLFIYFLRLACSLQWSIIPVHSSYDTLHNSGYITIHSGLFAPHSSLFTVYSGRNILRAYELTVKIETGTFMNFRHLLLDRSGGYVENSAVGKIFPILPIVVTTTHQKGLFTVFIGRYCTL

SEQ ID NO: 12124 - protein, 335 aa, Xenorhabdus bovienii
  Coding DNA sequence: Name=SeqID_6016
  Homolog annotation: Query=1..334bp; Hit=1..348bp; Blast score=401; Percent Identity=62.0; E value=1e-111; Homolog= ref|NP_569603.1|
LSENSLINGELIPAFSEVRKETGELVTLMPNTNNTVQPVALMRLGLFVPTLKSTNRSKRNLISSMDATEELKQLTLAKSEGYNNIKITGERLDMDNDFKTWVGIIHSFAKHKVIGDKVTLKFVDFAKLCGIPSTRSSKRLRERLDESLRRIVSTTLSFTSDTKAYHTHLVQSAFYDTEADAVTIKADPEIFELYQFDHKVLLQLRAITELARKESAQALYTFIESLPSNPAPVSMARLRARLNLKSRANTQNATVRRAMDQLREIGYLDFTEIKKGKVVYFMIHERAPKLNKTKPVKTVKKVKTTKGSEKQGDTVLAELTREELEFIEKIRKSKY

SEQ ID NO: 12125 - protein, 116 aa, Xenorhabdus bovienii
  Coding DNA sequence: Name=SeqID_6017
MWATAVVLRKVRWLRNDTGTTLFSGRYCDLYWSCSVIWITTNSAAHFVKRVMYFKTTMESKETPIIVVDFGKRVIANINGTIYSSPELKQKTLYGQASMTQMTTIRSAYSIAVILI

SEQ ID NO: 12126 - protein, 61 aa, Xenorhabdus bovienii
  Coding DNA sequence: Name=SeqID_6018
  Gene classification: Function=Putative transposase; Function class=L DNA replication, recombination and repair
  Homolog annotation: Query=3..44bp; Hit=23..64bp; Blast score=69; Percent Identity=78.0; E value=6e-13; Homolog= XF2303 COG3316
MSLIRKAFKRLHYPVDIIAQCVRWYLAYALSLRNLEEMMAERGIGSTMPRYLAGCYVVLLQ

SEQ ID NO: 12127 - protein, 206 aa, Xenorhabdus bovienii
  Coding DNA sequence: Name=SeqID_6019
  Gene classification: Function=Putative transposase; Function class=L DNA replication, recombination and repair
  Homolog annotation: Query=3..153bp; Hit=23..173bp; Blast score=219; Percent Identity=70.0; E value=1e-57; Homolog= XF2303 COG3316
MSLILKAFKRLHYPVDIIAQCVRWYLAYALSLRNLEEMMTERGIRVDHSTLYCWIIRLTPLLGKAFRRHKRPVARRWRMDETYIKIKGQWRYLYRAVDSDGNTVDFLLTAHRDKEAALRFFKKAIRQHGQPDVVTIDKSGANKAAVDELTKEKTKDNDIIIRQNKYLNNLIEQDHRNIKRRICPMLGFKHFRRAQTLLSGIELVSM

SEQ ID NO: 12128 - protein, 47 aa, Xenorhabdus bovienii
  Coding DNA sequence: Name=SeqID_6020
MRQNHIRSGLKGFPIASHIIFFRVVENGITIVRILHQSMDYRRHIDE

SEQ ID NO: 12129 - protein, 31 aa, Xenorhabdus bovienii
  Coding DNA sequence: Name=SeqID_6021
MVQNFIFTQDTIISYNINMMCSAYRERTSLH

SEQ ID NO: 12130 - protein, 42 aa, Xenorhabdus bovienii
  Coding DNA sequence: Name=SeqID_6022
VFCLPRKNEPALIVAIFHKRMNLLTRLADWLRQYYGFLRKYI

SEQ ID NO: 12131 - protein, 113 aa, Xenorhabdus bovienii
  Coding DNA sequence: Name=SeqID_6023
  Gene classification: Gene name=GloA; Function=Lactoylglutathione lyase and related lyases; Function class=E Amino acid transport and metabolism
  Homolog annotation: Query=6..110bp; Hit=4..114bp; Blast score=66; Percent Identity=37.0; E value=4e-12; Homolog= PA3127_1 COG0346
MSDWEAVPVLAALDLDELVDFYTSKLGFHCDNFVPNEYAIISRGEAEIHFWACNDKYIAENTSCYLFVKDIQSVFQELQAQTEVSPLAETPWGMLEFHLIDPSGNLLKFGQPV

SEQ ID NO: 12132 - protein, 73 aa, Xenorhabdus bovienii
  Coding DNA sequence: Name=SeqID_6024
MTGYLTPLLNATEPVTLNVPFFRLEYNAVIRNCSCLNFYLLFNGKRSHTFEWIFQVRCPYTLNKQELGRTLNS

SEQ ID NO: 12133 - protein, 32 aa, Xenorhabdus bovienii; identical to SEQ ID NO: 12031
  Coding DNA sequence: Name=SeqID_6025

SEQ ID NO: 12134 - protein, 194 aa, Xenorhabdus bovienii; identical to SEQ ID NO: 12030
  Coding DNA sequence: Name=SeqID_6026
  Gene classification: Function=Putative transposase; Function class=L DNA replication, recombination and repair
  Homolog annotation: Query=1..194bp; Hit=32..232bp; Blast score=160; Percent Identity=47.0; E value=6e-40; Homolog= mll9070 COG3316

SEQ ID NO: 12135 - protein, 167 aa, Xenorhabdus bovienii
  Coding DNA sequence: Name=SeqID_6027
  Gene classification: Gene name=WecD; Function=Histone acetyltransferase HPA2 and related acetyltransferases; Function class=K Transcription
  Homolog annotation: Query=6..165bp; Hit=6..164bp; Blast score=85; Percent Identity=35.0; E value=2e-17; Homolog= VCA0318 COG0454
MFIEELIDKSHNRKSFNCGEPALNDYLQKLAQQDTKNNVSKTYVAISSNDSNKKIIGYYTVTPSSINFDDLPNSLSKGLAKRAVPVYLLCRLAIDVHFQNNGFGGQLLILAGYRCLKVAEQIGGIGLFIEAKNQAVAKWYESFGAIPLSSAQKLIIPFETIKQALKT

SEQ ID NO: 12136 - protein, 93 aa, Xenorhabdus bovienii
  Coding DNA sequence: Name=SeqID_6028
  Homolog annotation: Query=9..89bp; Hit=10..90bp; Blast score=67; Percent Identity=46.0; E value=3e-11; Homolog= ref|NP_931093.1|
MTHIKLATERLQFRVNSEIKESIQLAASILRVNVTDFVTQTAMKEAQRVINENESLKLSYSDKKLILDLLDNPPKPNDKLKAAAISASKNFQG

SEQ ID NO: 12137 - protein, 150 aa, Xenorhabdus bovienii
  Coding DNA sequence: Name=SeqID_6029
  Gene classification: Function=Putative transposase; Function class=L DNA replication, recombination and repair
  Homolog annotation: Query=78..149bp; Hit=160..231bp; Blast score=79; Percent Identity=55.0; E value=2e-15; Homolog= mll9070 COG3316
VSTNLKFGLVGVRLEFGKISKVPSMLLTNCSTKGNACKVSHYDGRYISFTIITHKNVTIKRLAALTLLNAEGEPQQGIEIRQNKYLNNRIEQDPRHVKRRIRPMLGFKSFRRAQTILAGIELVSMLRKGQYSQSEDKALSPAEMFYRLAE

SEQ ID NO: 12138 - protein, 99 aa, Xenorhabdus bovienii
  Coding DNA sequence: Name=SeqID_6030
  Homolog annotation: Query=5..97bp; Hit=6..98bp; Blast score=86; Percent Identity=49.0; E value=7e-17; Homolog= emb|CAC80798.1|
MANYRELLAKESPEMQARIEKRVEQASIKLALSQLRDELDMSQAELAAVMGVQQPSIARMENADHDPRLSTLKRYVAALGGELSIDVTLPTGKRVAFYL

SEQ ID NO: 12139 - protein, 43 aa, Xenorhabdus bovienii
  Coding DNA sequence: Name=SeqID_6031
MTTPSKRRAIVLCAGNKTGVNEKRFYKEMIRQADFEYRRHLEK

SEQ ID NO: 12140 - protein, 117 aa, Xenorhabdus bovienii
  Coding DNA sequence: Name=SeqID_6032
  Gene classification: Function=Predicted transposase; Function class=L DNA replication, recombination and repair
  Homolog annotation: Query=1..114bp; Hit=133..247bp; Blast score=79; Percent Identity=39.0; E value=6e-16; Homolog= mll8100 COG3293
MPIRALITSGPTAGCSQAEALIDGIDAEHLLADRGYDSNTVVEQAEKQGMAAQIPGRKNRKVKREYDRELYRLRHLVENAFLHLKRWRGIATRYAKNSASFLATVQIRCLALWLNVL

SEQ ID NO: 12141 - protein, 163 aa, Xenorhabdus bovienii
  Coding DNA sequence: Name=SeqID_6033
  Gene classification: Function=Predicted transposase; Function class=L DNA replication, recombination and repair
  Homolog annotation: Query=16..120bp; Hit=6..110bp; Blast score=99; Percent Identity=44.0; E value=1e-21; Homolog= CC0928 COG3293
MDDLTMSTPVHRRHDISDHIWSLLEPHLPGRKGAWGRVAYDNRLFINAVFWILRTGAPWRDLPPDYGDWKNTHRRFCWWRDKGVWEELLEELIFEPDFEWLMIDASHIKVHPHAAGAAGGNQDMGRTKGGSIQRYIWPWMRMVCRSERLLQAVPQRVAHKLRP

SEQ ID NO: 12142 - protein, 81 aa, Xenorhabdus bovienii
  Coding DNA sequence: Name=SeqID_6034
  Homolog annotation: Query=1..75bp; Hit=1..75bp; Blast score=97; Percent Identity=58.0; E value=4e-20; Homolog= emb|CAC80868.1|
MWEVITTECFDGWFLAQDDELRESIYEAMGVLEKFGPNLGRPYVDTLHGSDFPNMKELRVQHAGDPIRAFFAFDPRWCRHK

SEQ ID NO: 12143 - protein, 60 aa, Xenorhabdus bovienii
  Coding DNA sequence: Name=SeqID_6035
MSLIRKAFKRLHYPVDIIAQCVREYLAYVISKKCSLNGGDIFTHTFSVNATEPSTLILII

SEQ ID NO: 12144 - protein, 36 aa, Xenorhabdus bovienii
  Coding DNA sequence: Name=SeqID_6036
MTWSGNTIKKQHVTRRCLNATEPLKMVWSADIFRRA

SEQ ID NO: 12145 - protein, 156 aa, Xenorhabdus bovienii
  Coding DNA sequence: Name=SeqID_6037
  Gene classification: Gene name=CynS; Function=Cyanate lyase; Function class=P Inorganic ion transport and metabolism
  Homolog annotation: Query=1..156bp; Hit=1..156bp; Blast score=253; Percent Identity=83.0; E value=5e-68; Homolog= cynS COG1513
MIQSQVNREVRLALADKIRSVKTKKDLSFAQIADGTGLSEAFVTAALLGQHALPAKVANIVGKKLDLDSDAIMLLQTIPVRGSIEDRIPTDPTMYRFYEMLQVYGTTLKVLVHEKFGDGIISAINFKLDVKKVADPEGGERAVITLDGKYLPTKPF

SEQ ID NO: 12146 - protein, 131 aa, Xenorhabdus bovienii
  Coding DNA sequence: Name=SeqID_6038
  Gene classification: Gene name=CynT; Function=Carbonic anhydrase; Function class=P Inorganic ion transport and metabolism
  Homolog annotation: Query=30..89bp; Hit=1..60bp; Blast score=97; Percent Identity=75.0; E value=4e-21; Homolog= cynT COG0288
MIIIINETFTLWNMGCNLHRIPQRDRRFTMKKVIDDFLKFQSDTFPERVELFRSLATQQSPRTLFISCSDSRMVPNLVTQRESSDLFVIVMLATTVRNPVGSRLRWLTTLMSVQCLFGSHRRLILISTVNK

SEQ ID NO: 12147 - protein, 162 aa, Xenorhabdus bovienii
  Coding DNA sequence: Name=SeqID_6039
  Gene classification: Gene name=LysR; Function=Transcriptional regulator; Function class=K Transcription
  Homolog annotation: Query=4..153bp; Hit=4..153bp; Blast score=222; Percent Identity=74.0; E value=1e-58; Homolog= cynR COG0583
MNFRYIRYFLAVAEHHGFTRAATALHVSQPALSQQVRLLEESLGVQLFDRSGRNTRLTDAGEVYLHYVCRAFQELDEGKRAIHDVEDLSRGSLRVAVTPTFTTYFIGPLVAEFYTRYPYITLQIQEMSQERMEERLINDDLDIGIAFDGGESPGIALKNPAD

SEQ ID NO: 12148 - protein, 153 aa, Xenorhabdus bovienii
  Coding DNA sequence: Name=SeqID_6040
  Gene classification: Gene name=LysR; Function=Transcriptional regulator; Function class=K Transcription
  Homolog annotation: Query=7..144bp; Hit=154..292bp; Blast score=145; Percent Identity=61.0; E value=2e-35; Homolog= ZcynR COG0583
MAENPRELHSRTLLTETLALVVACHHPRAQQRKIALNELNDEKLILLSAGFSTREQIDRYFRETDLRPQVQMEFTSICAVLDVIRRTSLSTLLPAAIALQNNDLVAIPLADRQLERTGVLMQRKGAWQTAAGRVFIEVAQELADKTVPRYKYT

SEQ ID NO: 12149 - protein, 45 aa, Xenorhabdus bovienii
  Coding DNA sequence: Name=SeqID_6041
MKWSGNTIKKQHVTRRCLNATEPQNLLMYIYIEEPFYQPTPVQLQ

SEQ ID NO: 12150 - protein, 229 aa, Xenorhabdus bovienii
  Coding DNA sequence: Name=SeqID_6042
  Gene classification: Function=Putative transposase; Function class=L DNA replication, recombination and repair
  Homolog annotation: Query=1..163bp; Hit=23..185bp; Blast score=245; Percent Identity=74.0; E value=2e-65; Homolog= XF2303 COG3316
LIRKAFRRLHYPTDVIAQCVRWYLAYALSLRNLEEMMAERGVIVDHSTLHRWLIRLVPLLDKAFRRHKRSVGRRWRMDETDTKVKGQWKYLYRAVDSTGQTIDFLLTAKRDAAAALRFFRKAIRHHGEPERVTIDKSGANTAALTTLNADKPEEENITLRQSKYLNNLVEPDHRNIKRRIRQMLGFKSFRRAQTLLAGIELIHMIRKGQYQHPQSDGLSPAEQFYLLAA

SEQ ID NO: 12151 - protein, 47 aa, Xenorhabdus bovienii
  Coding DNA sequence: Name=SeqID_6043
MLVFKNVKRAQTVLAGIEWVSLLRKGQYRQKEGCPISPAAFFYQLAE

SEQ ID NO: 12152 - protein, 47 aa, Xenorhabdus bovienii
  Coding DNA sequence: Name=SeqID_6044
MLGFKSFRRAQTVLAGIERVSMRRKGQYSQPEDKTLSPAELFYRLTA

SEQ ID NO: 12153 - protein, 49 aa, Xenorhabdus bovienii
  Coding DNA sequence: Name=SeqID_6045
MRQNQKEGNHRFLCSQGHRSQLGFLLEIAAGLIAYTFQPKKTEPEFTGF

SEQ ID NO: 12154 - protein, 186 aa, Xenorhabdus bovienii
  Coding DNA sequence: Name=SeqID_6046
  Homolog annotation: Query=1..161bp; Hit=1..159bp; Blast score=63; Percent Identity=26.0; E value=2e-09; Homolog= ref|ZP_00084717.1|
MTITFVSAPSGADSVIVSFLQDIIDGGSLSEADTNNKINTNDVSSSNPIKMYYVDCNEFEKTKSLIKAARSTGWRYLLWSGGSAVSDLHLNMHDANLIVSSMTLDGPIPVSTVEALLAAEMDSRVQQQGYEVRQLNLPWCYFVALWLHNPIHDIIIPLKSTLIHGITIHKLYEVEEISNKITAQID

SEQ ID NO: 12155 - protein, 224 aa, Xenorhabdus bovienii
  Coding DNA sequence: Name=SeqID_6047
MTDIQNSNLPRCLSLKKVALSASKRSIETNSLYSDGKTGYLTDFWSKGYMQRQEQTYWCWIAVAASIGSYYAQKPNYYRQAPIYEKAKNITPPGACVAPYLHFPNNDKCNQEGMPDRSLAMIGAFEKAIKGKGYVPFIITELLNNRPLVVAVFFSHEIASLGDTKGHAVVISAVFNEKPFHSVWEVCNPWDKTRTLENFKTFPLYYYGDPTAKWEQTCFTKKPI

SEQ ID NO: 12156 - protein, 49 aa, Xenorhabdus bovienii
  Coding DNA sequence: Name=SeqID_6048
MCAKLELPRVTASTFRSFSKLGIGISLLFGFSVLFLSIFSCDYFYETKH

SEQ ID NO: 12157 - protein, 46 aa, Xenorhabdus bovienii
  Coding DNA sequence: Name=SeqID_6049
LESNTIVIRHLNQSIHQANLLWVKRIASRRHKTLVTSVLFHRSNHS

SEQ ID NO: 12158 - protein, 33 aa, Xenorhabdus bovienii
  Coding DNA sequence: Name=SeqID_6050
MSTPSNDRLKSDLVNKDCKFMGTFFRWQPVTNM

SEQ ID NO: 12159 - protein, 57 aa, Xenorhabdus bovienii
  Coding DNA sequence: Name=SeqID_6051
  Homolog annotation: Query=1..50bp; Hit=205..254bp; Blast score=77; Percent Identity=70.0; E value=6e-14; Homolog= ref|NP_929710.1|
MTPGKNQKHDLVGCLDAQIGQVTYVSGIKKNADLFIKMLKKLNGQYRHAKKHHVDFR

SEQ ID NO: 12160 - protein, 41 aa, Xenorhabdus bovienii
  Coding DNA sequence: Name=SeqID_6052
MQKNITLILDNYGTHKSRKVMAWLKKILNLICCFYRSIHYR

SEQ ID NO: 12161 - protein, 88 aa, Xenorhabdus bovienii
  Coding DNA sequence: Name=SeqID_6053
MLNILPASILVKTLPNNKIGFTARNATTVIDFEPLDYTSEIGNTLILAGQALITASSNNAPGPFLIEYEIRNGLNFYVGMIIPIAEMP

SEQ ID NO: 12162 - protein, 43 aa, Xenorhabdus bovienii
  Coding DNA sequence: Name=SeqID_6054
MMRLNEFLAKLIIPNHHAVQITFTKRQHALGYKISIKAFLQLV

SEQ ID NO: 12163 - protein, 76 aa, Xenorhabdus bovienii
  Coding DNA sequence: Name=SeqID_6055
LATLAIITRKPGFTCSMFAYRFGLVTIPASNFYRHRHFEIPLKRHKNIRLTLWSHDLSINWLHKKQLHHFLLLALC

SEQ ID NO: 12164 - protein, 92 aa, Xenorhabdus bovienii
  Coding DNA sequence: Name=SeqID_6056
  Gene classification: Function=Transposase; Function class=L DNA replication, recombination and repair
  Homolog annotation: Query=4..92bp; Hit=3..91bp; Blast score=81; Percent Identity=42.0; E value=2e-16; Homolog= insA_g5 COG3677
MTVTIEVACRYCNQTEPVRKHGAGKAGFPRYYCKGCQKTFQLNSRYNDHKPGMKEKIVDMAMNGSGVRDTGRVLSIGINTVMRTLKNCRQNR

SEQ ID NO: 12165 - protein, 122 aa, Xenorhabdus bovienii
  Coding DNA sequence: Name=SeqID_6057
  Gene classification: Gene name=InsB; Function=Insertion element IS1 protein InsB, putative transposase; Function class=L DNA replication, recombination and repair
  Homolog annotation: Query=1..106bp; Hit=14..119bp; Blast score=122; Percent Identity=57.0; E value=5e-29; Homolog= Z1562 COG1662
VGNKKQRHWLWYAFDTKRKQAIAHVFGPRTDATCRKLLDLLAPFHIRFITTDGWGSYAREVEPEKHLVGKILTQRIERHNLNLRIHIKRLARRTLCYSRSIEIHEKLIGTYIEKYHYNALKS

SEQ ID NO: 12166 - protein, 43 aa, Xenorhabdus bovienii
  Coding DNA sequence: Name=SeqID_6058
MAKVDIDCRYYLKSEKVKGHGKGNEGHPRYRCYDCCKVFQLGS

SEQ ID NO: 12167 - protein, 207 aa, Xenorhabdus bovienii
  Coding DNA sequence: Name=SeqID_6059
MNESFLSHLKEVYQDRERDLVTLSVRVSVEENAAIQDLVDSVGCNRQDLLYELIKKYALSEWEVMRNEELDAELSCGGASGDNHTKTYFLLNTNKANSAKDHQFMIENGFAAAFEEGYIQKIEKIHEGDTVFLYESGVGIVAYGSATGKVLKTDHLGVKDKTYYQKLDGFHVLDKPLPAKKICTLLKRRIPFVQTLIKLKDGEKLLK

SEQ ID NO: 12168 - protein, 31 aa, Xenorhabdus bovienii
  Coding DNA sequence: Name=SeqID_6060
MPKYHVLKRSVSDNLQRHCTKVSVFYFVHKL

SEQ ID NO: 12169 - protein, 1016 aa, Xenorhabdus bovienii
  Coding DNA sequence: Name=SeqID_6061
  Homolog annotation: Query=8..1016bp; Hit=1..1009bp; Blast score=1571; Percent Identity=75.0; E value=0; Homolog= gb|AAP44228.1|
MAHHTNKITGKSERLSVLTDAEQEALYGLPDFNDAQRLQFLALTELELALANNRPSLHDQLYCILQIGYFKAKQAFFRFDWHEVSDDCAFVISHYFHDESFGSELITKHERYTQREQITQLFSYQSWSGEFRPQLTQQAAHIVRRDAAPGFVAAELVIWLNQNKIVRPGYTTLQDLVSQALSVERQRLGNILADVLDETATALLDKLLVRDDTLSQLAVLRQDAKDFGWRQMAREREKRATLKPLYEIFKVLHPRLGISQQNLLHYASLVNFYTIYDLRNLKTDQTRLYLLCYAWWRYRQFTDNLVDAMAFHMKQLEDESRAIAKKTFADEQDKRHQETSQVGRLLSLYVDDRVSDMTPFGEVRQQAWAIMPRDAVQNTARRMRDKPLKKLALHWQSVDKLSGRVRRHLRPLYTVLDFACIDPASPWLKALIWAKDIFSKRQRFSQRPLAECPPATLPKRLCPYLLIFDTDGNPAHLHADRYEFWLYRQIRKRFQSGEFYLDGSLQHRHLSDELVSNEKKRDVLAQMEIPFLQQPVDVLLDTLSSELHQQWQVFNHELKQGQLKHLEYDKDTQKLHWRKPKVDNRKPQEQTFYAQLPFCDIADVLSFVNEQCHFLSVMKPLQPRYAKKQAETDSLMAVIIAQAMNHGNQVMSRTSDIPYHILENTYQQYLRQATLQAANDCISNAIATLPIFPHYSFDLDVLYGAVDGQKFGVEHTTVKARYSRKYFGRGKGVVAYTLLCNHIPLNGYLIGPNEYEAYHVFDIWYRNTSNIVPTAITGDMHSVNKANFAILHWFGLRFEPRFTSLNAQLQMLYCANDPEMYKKCLIQPVGQIDRQLIIREKANIDRIVATLGLKEMTQGLLIRKLCTYTAPNPTRRAIFEYDRLVRSLYTLRYLRDPQLERNVHRSQNRLESYHQLRSAIAQVGGKKELTGRTDIETEISNQCGRLVANAIIYYNSAILSRLLNKPEVSDSIKTLALITKMPPVAWQHILLNGHYTFQNEGKIIDLDALIAGLNFG

SEQ ID NO: 12170 - protein, 192 aa, Xenorhabdus bovienii
  Coding DNA sequence: Name=SeqID_6062
  Gene classification: Gene name=PinR; Function=Site-specific recombinases, DNA invertase Pin homologs; Function class=L DNA replication, recombination and repair
  Homolog annotation: Query=5..191bp; Hit=2..184bp; Blast score=109; Percent Identity=36.0; E value=2e-24; Homolog= XF2028 COG1961
MTKTLIGYARCSTDKQDLAAQQEALLQLGVSPDRIYIDEGLTGSNRLRPGLDQALAAVRCGDTLVVPKLDRLARSVPDARYIADSLLARGVKLALGPSVYDPTDPMGKMFFNILATFAEFEGDLIRLRTREGMAIARAKGKLRGKQPKLSDKQQKELCRMHGTGEYSISDLAELFSVSRPTVYRTLARTNNI

SEQ ID NO: 12171 - protein, 421 aa, Xenorhabdus bovienii
  Coding DNA sequence: Name=SeqID_6063
  Homolog annotation: Query=97..417bp; Hit=130..454bp; Blast score=369; Percent Identity=52.0; E value=1e-101; Homolog= ref|ZP_00014536.1|
LPGQKENYEVNNQNSRISNRKSYAACTERGSTQSAIWLNCFQYRGQPSIGLLRVQIIFKSRLCSVIIDPAMISLSGVFMLKFYSLVSLLWLSISALAHSSSAVGFKEIDLDKGELRPLSVAIWYPVKNQTKTINIGDNQTFYGINVVQNGVPGSDEYPLVVLSHGYGGSWRNLSWLANELTGQGYIVAAPDHPGTSVFNKDMEQATKLWERPHDLSRVIDAITTDSKLGGKVDMERIAAIGHSLGGWTVIALSGGRFDTGLFKKDCQKYSTLWACNPVLVLGLEKPELERNMEDSRIKAFISLDAGLIRGFSSESLAKIHIPSLIIGAGTDVGDMPVELESGYLNKYLSKTYSTYVEIPDAMHFSFMQVCKSGAIGLLEGENKDDGIICKDGGSRNRNEIHREIAFLVTGFLAKKIPNVSH

SEQ ID NO: 12172 - protein, 63 aa, Xenorhabdus bovienii
  Coding DNA sequence: Name=SeqID_6064
LNVAKCGSGHNFHTSPLLPELQARQNFGRFRLTTPRRCRHDIFSQRTRQRICTAARKDALFFA

SEQ ID NO: 12173 - protein, 117 aa, Xenorhabdus bovienii; identical to SEQ ID NO: 7232
  Coding DNA sequence: Name=SeqID_6065
  Gene classification: Function=Predicted transposase; Function class=L DNA replication, recombination and repair
  Homolog annotation: Query=1..115bp; Hit=133..248bp; Blast score=81; Percent Identity=39.0; E value=1e-16; Homolog= mll8100 COG3293

SEQ ID NO: 12174 - protein, 158 aa, Xenorhabdus bovienii
  Coding DNA sequence: Name=SeqID_6066
  Gene classification: Function=Predicted transposase; Function class=L DNA replication, recombination and repair
  Homolog annotation: Query=11..115bp; Hit=6..110bp; Blast score=106; Percent Identity=46.0; E value=1e-23; Homolog= CC0928 COG3293
MSTPAHRRHDISDRVWSLLEPHLPGRQDAWGRVAEDNRRFINGVFWILRTGAPWRDLHTDYGDWKNTHRRFCRWRDKGIWEKLLEQLVNDPDFEWLMIDASHIKVHPDAAGAKGGNQDMGLTKGGSIPRYIWPWMRMVCRSELLLQAVPQQIVHKRRP

SEQ ID NO: 12175 - protein, 198 aa, Xenorhabdus bovienii
  Coding DNA sequence: Name=SeqID_6067
  Gene classification: Gene name=PinR; Function=Site-specific recombinases, DNA invertase Pin homologs; Function class=L DNA replication, recombination and repair
  Homolog annotation: Query=1..195bp; Hit=1..195bp; Blast score=271; Percent Identity=73.0; E value=2e-73; Homolog= pinR COG1961
MSRVFAYCRVSTLEQNTENQRREIEAAGFAIRPQRLIEEYVSGSVAAGERPGFTRLLDRMENGDVLIVTKLDRLGRNAMDIRKTVELLADSEIRVHCLALGGVDLTSPAGKMTMQVISAVAEFERDLLLERTHAGIARAKASGKRFGRPPALSDEQKKTVFLRINEGKSISAIAREFSTTRQTILRVKVAMEDIDAPT

SEQ ID NO: 12176 - protein, 35 aa, Xenorhabdus bovienii
  Coding DNA sequence: Name=SeqID_6068
VHMTSDKIMSEVGCTKRDYARYSCAPRRRTTLDDW

SEQ ID NO: 12177 - protein, 59 aa, Xenorhabdus bovienii
  Coding DNA sequence: Name=SeqID_6069
MTSDILCSRLLKMTVGARDMGNASNALSELTNITLLPLDLSDINSVRALAARGCTWFVW

SEQ ID NO: 12178 - protein, 30 aa, Xenorhabdus bovienii
  Coding DNA sequence: Name=SeqID_6070
MKINKAILYLFSYLNSIGFMVIIIDSIGLK

SEQ ID NO: 12179 - protein, 87 aa, Xenorhabdus bovienii
  Coding DNA sequence: Name=SeqID_6071
MISRCFIFFFVIMVSPTVSVVQGDYPARISGYMALSQRAKTLTQPPETLSIRFSTSTLRSCFFSELFITFALFKAISRCNFLMLVSF

SEQ ID NO: 12180 - protein, 392 aa, Xenorhabdus bovienii
  Coding DNA sequence: Name=SeqID_6072
  Gene classification: Gene name=AslB; Function=Arylsulfatase regulator (Fe-S oxidoreductase); Function class=R General function prediction only
  Homolog annotation: Query=12..164bp; Hit=29..177bp; Blast score=92; Percent Identity=34.0; E value=1e-18; Homolog= sll1766 COG0641
MITKKKIKHLEIILKVSERCNINCTYCYVFNLGNEISINSKPIISHDIIKVLRAFFEQASQEYDIETIQVDFHGGEPLMMGKEKFENACNEFISGSYNKTKFNLACQTNAILIDNEWIDIFSKYNVSVGISIDGPKHINDKHRLDRKGRSTYEGTVRGLVMLQEAWSAGRLIDQPGILCVANPSVKGAEIYRHFVDVLKCKKFDFLIPDESHDTCTNPDGLSDFYCSAIDEFFSDADQDVYVRYFLTHMQSMLSSEFSPVMGLSKSGSDTIALTVSSEGDIYVDDTLRSTNDPIFTPIGNVLNLTLSETIASWQMQKYMTVNNQLPTACTDCIWKKVCGGGRHIQRYSKADDFKRESVFCPSIRKIMSRAASHLIESGISEDIIMKNLGIKS

SEQ ID NO: 12181 - protein, 287 aa, Xenorhabdus bovienii
  Coding DNA sequence: Name=SeqID_6073
MMKWFSLLIFLFSGISMADLPTDFWRLRYDERGLPLIDIKIDNKYHTLMLDTGSGEGMHLYKHSIEKLVANPSLKATHESPRKLIDVSGGENNVSVWKINRLLISNIPFDNVEVVGFKPWGLTIGGEQPINEVLGRGMFHNRLVMMDFKNDRLQMLEHLPADINNWSSYPLEKTKSGLRITAYMGNTPLHLIVDTAASHSILFSNRLPVGTLFLGCRAIDPESSNSECRVTKINLIDEKGKFRDDLVIVPNGLTPKELDFDGLLGMNFMRYHQVIIDMRKSVFYINR

SEQ ID NO: 12182 - protein, 406 aa, Xenorhabdus bovienii
  Coding DNA sequence: Name=SeqID_6074
  Gene classification: Gene name=AcrA; Function=Membrane-fusion protein; Function class=Q Secondary metabolites biosynthesis, transport and catabolism
  Homolog annotation: Query=8..395bp; Hit=4..410bp; Blast score=118; Percent Identity=24.0; E value=1e-26; Homolog= XF1216 COG0845
MMNKENSIFRPEALQYKKNAWLGDFTVSAPSVLPVALWCAIGVLLVITLLLFTTYAKRVSVNGRIIYTPAAAEVVFSQDGVIDHIKAHQGERVKKGDIIATFSRDVTYAGGRVNQALLDTAQHQITELQKREVERRKEGEEERQLLREEISTKDLEIAAIRVAVAAEQERSVSLKKRMAFYQQLLQKGVTTLQEKIEREKEYYNSIAQLNMHRISIVRAQEERLQLVDKLARSEAQEKQSITGIQQQKVTLQQQMINASAMMETRIVAPLDGVIASMNLLEGQRITEGKIAAGVVPENARPLIEMGIPPSALQEVKTGQHVVMRVASLPWERFGKVSGTIATVSTSPEGLTGNNQRFRVLIVPEAGTHVLPPGVEVEADILTTHRRIWEWLFSPVKQSINRIINES

SEQ ID NO: 12183 - protein, 708 aa, Xenorhabdus bovienii
  Coding DNA sequence: Name=SeqID_6075
  Gene classification: Gene name=SunT (BS); Function=ABC-type bacteriocin/lantibiotic exporters, contain an N-terminal double -glycine peptidase domain; Function class=Q Secondary metabolites biosynthesis, transport and catabolism
  Homolog annotation: Query=6..682bp; Hit=13..693bp; Blast score=493; Percent Identity=39.0; E value=1e-139; Homolog= PA4143 COG2274
MFFSWKKTPLILQSETNECGLACLAMITGYFGKRVDLASARTIHETTSHGMTLRELITAFERVGMTARASRIELDDLRSLSRPVILHWSFNHFVVLVKVSHRSAVIHDPGIGRRSISLRELSDKFTGVIVEAWPAETFDKKPMEMNVSVSDLFCGVRGLKRILSGVLVLSILVELLSIAVPAASQFTIDTLVQSSDREGIFFIGIVVISALLIKSTFSVIRAWVLMSLRYTLGVKWAEMFFNRLSRLTLPFFEKRHTGDITSRFQSLTAIQEAFTADMVASILDAMVIIISMVIIFTNSPLLAMGPLAAAMGYVALKAGLFSMYRTRKIEHIAFEAVQSSHFLETIRAISAIKMLNLAPIRRREWVNHVVNSTHAGNQLFKLDLLTNTAAMLLVGFSGIYVLSVGALEFDKGITTGILLAVMLYADMVITRTVRLVNAVSDFCLVSMHSQRLTDIAVSPVERDEGERSPAQLNGHIVIRNLSFRHSPSDPNIFEGINIEVMPGESVAIIGPSGCGKSTLLHVLAGLYEPTDGDILINGISISSIGKRAIRKHVAFVMQDDKLLAGTLQKNITGFSESPDMERMAECANYAAIDDEICSFPQGYDSMIGDMGSTLSGGQRQRISIARALYRQPRVLLLDEATSDLDIDNERKITHAISQLPITRIFVAHRPEMIKSADRIFNLQLNAWMEKNCGSVALSGHQVSPPVFE

SEQ ID NO: 12184 - protein, 30 aa, Xenorhabdus bovienii
  Coding DNA sequence: Name=SeqID_6076
MSLLSPFPNCNGSQSKTVEPLQLGNGRKSP

SEQ ID NO: 12185 - protein, 40 aa, Xenorhabdus bovienii
  Coding DNA sequence: Name=SeqID_6077
MIGGAMLSIGIVTGVSANVFFSRGSTPDNGIRLRGFAPIP

SEQ ID NO: 12186 - protein, 69 aa, Xenorhabdus bovienii
  Coding DNA sequence: Name=SeqID_6078
MTAFSHLVTVKRPENDFERFLYFMFGWYLKRKNRTVKLVGVFMPFRVWRRLIQCDWDSGSSSADTKGGT

SEQ ID NO: 12187 - protein, 62 aa, Xenorhabdus bovienii
  Coding DNA sequence: Name=SeqID_6079
MDLKIIHETVDGKWTFREPRPDAVFIKFSYDGRSRSGELGERVTGRSLKNSLAGMRGIAFPD

SEQ ID NO: 12188 - protein, 93 aa, Xenorhabdus bovienii
  Coding DNA sequence: Name=SeqID_6080
  Homolog annotation: Query=1..89bp; Hit=3..91bp; Blast score=117; Percent Identity=66.0; E value=4e-26; Homolog= ref|NP_046944.1|
MNSISFEQLKAEMLDTPAAIQAYQDADQELTIVEMLYQMREHAGLSKSELAKKLGISPSAITRLEGNPLGASVKTLSRYASACGANIDIRMTV

SEQ ID NO: 12189 - protein, 104 aa, Xenorhabdus bovienii
  Coding DNA sequence: Name=SeqID_6081
  Homolog annotation: Query=1..103bp; Hit=1..103bp; Blast score=158; Percent Identity=78.0; E value=2e-38; Homolog= ref|NP_046945.1|
MFDVITHPDALLELKQLPDELRGRMFRLIERLSADGNQLKMPHSRVIGGGLFELRVGAKNIARTLYAFEIGQKIYLLHAFVKKTQKTPSGSIEIARKRLQEMNE

SEQ ID NO: 12190 - protein, 86 aa, Xenorhabdus bovienii
  Coding DNA sequence: Name=SeqID_6082
VAFLIGFHPHSVVLSIGTCDLAVRQVAASIPIVHLDELSHQTFSPLIKIYQKKKFPSKINLTKKINLSKICLPFLNHRIFAGYPPV

SEQ ID NO: 12191 - protein, 33 aa, Xenorhabdus bovienii
  Coding DNA sequence: Name=SeqID_6083
MLQILGTSIVSYPLSLRAHHTQQHSKTHPQTGG

SEQ ID NO: 12192 - protein, 77 aa, Xenorhabdus bovienii
  Coding DNA sequence: Name=SeqID_6084
MKFNEDFFYEWLLDKSSIKRNSTKQKIAYCMACLLELSIEDEGQKVKSSRLFERADINKAALHYAVGGIKNLWEIDL

SEQ ID NO: 12193 - protein, 83 aa, Xenorhabdus bovienii
  Coding DNA sequence: Name=SeqID_6085
MFCILVMFLGAITQLLVKGSLILLRVLFMLNLTESEFITAIKNRGVLVSGYEPTERGHVSFDDTTVIQHGFILSVFREDIVNN

SEQ ID NO: 12194 - protein, 109 aa, Xenorhabdus bovienii
  Coding DNA sequence: Name=SeqID_6086
MRLTNAQNSLTIGAPLAQCTTLLLGYEAVANGLWIWTASDPRRSTLRSTKFDYYLYNHFCGALRGGGNNNLLYIYYFYLIIFIYIELSTFCHRDFSVRSTLFRGETRIE

SEQ ID NO: 12195 - protein, 62 aa, Xenorhabdus bovienii
  Coding DNA sequence: Name=SeqID_6087
MGLGRVSGTRIVRCARCGRGRVWTAGWLGAAGCLVCFYVYTDAYRFFLVFFIFLFSKINIIR

SEQ ID NO: 12196 - protein, 42 aa, Xenorhabdus bovienii
  Coding DNA sequence: Name=SeqID_6088
VDSCGKPDYSMELDRAKSTSRCHHRKSYELDCAIKNSTLDIL

SEQ ID NO: 12197 - protein, 49 aa, Xenorhabdus bovienii
  Coding DNA sequence: Name=SeqID_6089
MLSLYIRFLMRRIKNQGISGLDKFSHRRFVATPSRLQITVISNTALIQR

SEQ ID NO: 12198 - protein, 31 aa, Xenorhabdus bovienii
  Coding DNA sequence: Name=SeqID_6090
MHRSPIFSIINTQTTLSAIKRTQSGNLQKLL

SEQ ID NO: 12199 - protein, 79 aa, Xenorhabdus bovienii
  Coding DNA sequence: Name=SeqID_6091
MLVVTNINFAGFWRFFAPLAHCAALCVNGVLGGLFRVCYLFLRIFFLQFIILFHLEILFQGLSVVFRECLDSFYGIHDG

SEQ ID NO: 12200 - protein, 128 aa, Xenorhabdus bovienii
  Coding DNA sequence: Name=SeqID_6092
  Gene classification: Gene name=InsB; Function=Insertion element IS1 protein InsB, putative transposase; Function class=L DNA replication, recombination and repair
  Homolog annotation: Query=8..127bp; Hit=46..166bp; Blast score=100; Percent Identity=43.0; E value=4e-22; Homolog= insB_g4 COG1662
MTFILSVKWISRGRKKNQRGLWYAWEPRMKRIVAHTFGDRSRKTLEKLRALLSPFNIRFYCTDDYAVYDCLPEEVHLTGKIFTQRIERTNLTHRTRIKRLNRKTIGYSKSEEMHDKVIGTFIERENYI

SEQ ID NO: 12201 - protein, 96 aa, Xenorhabdus bovienii
  Coding DNA sequence: Name=SeqID_6093
  Gene classification: Function=Transposase; Function class=L DNA replication, recombination and repair
  Homolog annotation: Query=1..91bp; Hit=1..91bp; Blast score=76; Percent Identity=41.0; E value=4e-15; Homolog= insA_g5 COG3677
VAKVDVDCRYCHKSEDVKGHGKGHRGYPRYRCYACSKVFQLAYTYQACKPGVKEQIIDMAMNNSGIRDTARVLKVATATVMKTFKNSPPERDDASS

SEQ ID NO: 12202 - protein, 42 aa, Xenorhabdus bovienii
  Coding DNA sequence: Name=SeqID_6094
LQSRRYFRSFSPSLSLISVCTKGILLLSRVQIFLAGSGLSKT

SEQ ID NO: 12203 - protein, 75 aa, Xenorhabdus bovienii
  Coding DNA sequence: Name=SeqID_6095
  Homolog annotation: Query=1..75bp; Hit=214..291bp; Blast score=105; Percent Identity=66.0; E value=2e-22; Homolog= ref|NP_716636.1|
MKPRLLAAWDRAMLAKRFIIETINDQLKNVTQIEHSRHRSLMLNLLGGLIAYCLKPKKPSLNITSAEKTGLRVMA

SEQ ID NO: 12204 - protein, 95 aa, Xenorhabdus bovienii
  Coding DNA sequence: Name=SeqID_6096
  Homolog annotation: Query=1..92bp; Hit=1..92bp; Blast score=124; Percent Identity=69.0; E value=4e-28; Homolog= ref|NP_929783.1|
MGRLFEFASANNIGLGGPDIVPNRKAQMKNSYPFFNKYKSKLALIAMAVQEPTLTYRNPNTGKPFIKDEFVEFAEDYLGADIIFWSTTSPWLTKK

SEQ ID NO: 12205 - protein, 71 aa, Xenorhabdus bovienii
  Coding DNA sequence: Name=SeqID_6097
MDMSSSFAPCGWEQYLGRQVQYYWHSRTQTVGPYNCGRCSIRTARNLHIGVVSRNRPKFCRACSSGSSGDV

SEQ ID NO: 12206 - protein, 421 aa, Xenorhabdus bovienii; identical to SEQ ID NO: 12171
  Coding DNA sequence: Name=SeqID_6098
  Homolog annotation: Query=97..417bp; Hit=130..454bp; Blast score=369; Percent Identity=52.0; E value=1e-101; Homolog= ref|ZP_00014536.1|

SEQ ID NO: 12207 - protein, 192 aa, Xenorhabdus bovienii; identical to SEQ ID NO: 12170
  Coding DNA sequence: Name=SeqID_6099
  Gene classification: Gene name=PinR; Function=Site-specific recombinases, DNA invertase Pin homologs; Function class=L DNA replication, recombination and repair
  Homolog annotation: Query=5..191bp; Hit=2..184bp; Blast score=109; Percent Identity=36.0; E value=2e-24; Homolog= XF2028 COG1961

SEQ ID NO: 12208 - protein, 1016 aa, Xenorhabdus bovienii; identical to SEQ ID NO: 12169
  Coding DNA sequence: Name=SeqID_6100
  Homolog annotation: Query=8..1016bp; Hit=1..1009bp; Blast score=1571; Percent Identity=75.0; E value=0; Homolog= gb|AAP44228.1|

SEQ ID NO: 12209 - protein, 74 aa, Xenorhabdus bovienii
  Coding DNA sequence: Name=SeqID_6101
MCQAWKELKALLDTWINEGIERKVSLSADNQCLRSGLKGFPIASHIIFFRVVENGITIVRILHQSMDYRRHINE

SEQ ID NO: 12210 - protein, 60 aa, Xenorhabdus bovienii
  Coding DNA sequence: Name=SeqID_6102
MYPARLSAPSMPDTYNGLWLFMTQVSFSEDDCTECQKSSSENDNRIVRHTLIYRTKTLNV

SEQ ID NO: 12211 - protein, 102 aa, Xenorhabdus bovienii
  Coding DNA sequence: Name=SeqID_6103
MVLEVSLQWFGQTKSLHYSSVSILEKVTLLLKNVQRKLLRLGWLFLASILTKRLPADAGRFIGMVFDTLKYNFVRDIATGRDILSIDCIKSHHFHLRTNFLC

SEQ ID NO: 12212 - protein, 286 aa, Xenorhabdus bovienii
  Coding DNA sequence: Name=SeqID_6104
  Gene classification: Gene name=MhpC; Function=Predicted hydrolases or acyltransferases (alpha/beta hydrolase superfamily); Function class=R General function prediction only
  Homolog annotation: Query=12..278bp; Hit=15..283bp; Blast score=257; Percent Identity=47.0; E value=1e-68; Homolog= YNR064c COG0596
MNTICYQSADVDGFKIFYREAGRADAPKLLLLHGFPSAGHMFRDLIPLLADRFHIIAPDLPGFGQSDMPARGAFKYTFDNIAKVIDRFTDVVCFDRFAVYVFDYGAPTGFRLAMWHPERITGIISQNGNAYEEGLSEGWNPIRAYWQDASQANRDALRAFLAPETTNWQYTYGVPDETAISPDGQNLDNYYLTRPGAADVQLDLLGDYKSNVALYPNFQEYFRTHKPPFLAVWGRNDPFFLPLGAEAFKRDIPEAKVTFFETGHFALETHASEIATAIRDFLTRSH

SEQ ID NO: 12213 - protein, 101 aa, Xenorhabdus bovienii
  Coding DNA sequence: Name=SeqID_6105
  Gene classification: Gene name=ParE; Function=Plasmid stabilization system protein; Function class=N Cell motility and secretion
  Homolog annotation: Query=3..101bp; Hit=4..102bp; Blast score=147; Percent Identity=75.0; E value=2e-36; Homolog= XF2032 COG3668
MDYVLTKAAEADLRAIIRHTRKQWGDVQVRRYVTALEQGIARLAVGQGSFKDMSALFPALRMAHCEHHYVFCLPRENAPALIVAIFHERMDLLMRLADRLK

SEQ ID NO: 12214 - protein, 91 aa, Xenorhabdus bovienii
  Coding DNA sequence: Name=SeqID_6106
  Homolog annotation: Query=8..90bp; Hit=1..83bp; Blast score=114; Percent Identity=78.0; E value=3e-25; Homolog= ref|NP_929581.1|
MTDKEKTMSRLTIDITDRQHQSLKALAALQGKTIKQYALERLFPGMSDSDQAWQDLKALLDTRINEGMEGKVCGKSIGAILDEELAGSDRA

SEQ ID NO: 12215 - protein, 95 aa, Xenorhabdus bovienii
  Coding DNA sequence: Name=SeqID_6107
LLDRLALQGGQCLQALVLPVGDVDGQTAHGFLLIGHTQTHISTYNGLWLFIKQWSDIVLSGKRPFDGHDGHLSENILMNGISDIMIDGRNNGQMG

SEQ ID NO: 12216 - protein, 44 aa, Xenorhabdus bovienii
  Coding DNA sequence: Name=SeqID_6108
  Gene classification: Gene name=PinR; Function=Site-specific recombinases, DNA invertase Pin homologs; Function class=L DNA replication, recombination and repair
  Homolog annotation: Query=1..43bp; Hit=14..56bp; Blast score=61; Percent Identity=74.0; E value=2e-10; Homolog= mlr9265 COG1961
MALIGYARVSTIEQNTALQTDALHKAGCERVFEDRCSGAKSDRR

SEQ ID NO: 12217 - DNA, 60 bp, Xenorhabdus bovienii
  Promoter location: Contig name=SeqID_16426; Position on contig =333..392bp; Strand=-
cgatggcagcggtttatgcctcagttgaagtatgtcgagcagtgtgtaaagctgccgtta

SEQ ID NO: 12218 - DNA, 60 bp, Xenorhabdus bovienii
  Promoter location: Contig name=SeqID_16449; Position on contig =694..753bp; Strand=-
aaaaagaggggtttttttttttttgttggtaaaaaaaaaaaaaaaaataaatttggtggg

SEQ ID NO: 12219 - DNA, 60 bp, Xenorhabdus bovienii
  unsure (1)..(60): unsure at all n locations
  Promoter location: Contig name=SeqID_16458; Position on contig =957..1016bp; Strand=-
cgggggggagaaaataatttcccgncccctcctctttntattaaaataaaaaaacnnccg

SEQ ID NO: 12220 - DNA, 60 bp, Xenorhabdus bovienii
  unsure (1)..(60): unsure at all n locations
  Promoter location: Contig name=SeqID_16472; Position on contig =69..128bp; Strand=+
ngggnttaaaaaaaaaaaaaaaaaaacccccgnnccccncccccgggggggagggttttt

SEQ ID NO: 12221 - DNA, 60 bp, Xenorhabdus bovienii
  unsure (1)..(60): unsure at all n locations
  Promoter location: Contig name=SeqID_16479; Position on contig =362..421bp; Strand=-
tatttnatttttccccttttcacattttcccttttaaaaaaagggtttaaagtttttttt

SEQ ID NO: 12222 - DNA, 60 bp, Xenorhabdus bovienii
  unsure (1)..(60): unsure at all n locations
  Promoter location: Contig name=SeqID_16488; Position on contig =1287..1346bp; Strand=-
cnncaannnctngtangngaagnnnntngnnnnnactngnanaanntnagaanncaaang

SEQ ID NO: 12223 - DNA, 60 bp, Xenorhabdus bovienii
  Promoter location: Contig name=SeqID_16493; Position on contig =727..786bp; Strand=-
gagcagcgagcgccgcccgcgccccgcggaatgcaggggtaattgtttatattttttttt

SEQ ID NO: 12224 - DNA, 60 bp, Xenorhabdus bovienii
  Promoter location: Contig name=SeqID_16494; Position on contig =693..752bp; Strand=-
tttttttttcccacaaaatttttgagaaatttttttaaaaattttaaatttttttttggg

SEQ ID NO: 12225 - DNA, 60 bp, Xenorhabdus bovienii
  unsure (1)..(60): unsure at all n locations
  Promoter location: Contig name=SeqID_16496; Position on contig =257..316bp; Strand=-
nnnccccnnnnnnnntttttttntnnnnnnnnnnnntttntttngnnnnnnnnnntttnt

SEQ ID NO: 12226 - DNA, 60 bp, Xenorhabdus bovienii
  unsure (1)..(60): unsure at all n locations
  Promoter location: Contig name=SeqID_16530; Position on contig =61..120bp; Strand=+
ggtttttnnnnnnnnnnggttcccacccgttgggggggnggggnngnngnggnngggnnn

SEQ ID NO: 12227 - DNA, 60 bp, Xenorhabdus bovienii
  unsure (1)..(60): unsure at all n locations
  Promoter location: Contig name=SeqID_16539; Position on contig =738..797bp; Strand=-
ttttttttttttttttttttnncccggggggggggggtttttttcttttttaaaaaaata

SEQ ID NO: 12228 - DNA, 60 bp, Xenorhabdus bovienii
  Promoter location: Contig name=SeqID_16545; Position on contig =1048..1107bp; Strand=-
gtgtaggaggatgcggatggatctagttgcgtgtgtgtgtaattagagtatatttggttg

SEQ ID NO: 12229 - DNA, 60 bp, Xenorhabdus bovienii
  Promoter location: Contig name=SeqID_16551; Position on contig =441..500bp; Strand=-
tttttttatataattaaagagaggggtgcccccaccccccccctttttttcttttttttt

SEQ ID NO: 12230 - DNA, 60 bp, Xenorhabdus bovienii
  unsure (1)..(60): unsure at all n locations
  Promoter location: Contig name=SeqID_16555; Position on contig =798..857bp; Strand=-
gggttgtttttgttgttttttattatatatnataaacaaaaaaaacataaaatnnaattn

SEQ ID NO: 12231 - DNA, 60 bp, Xenorhabdus bovienii
  Promoter location: Contig name=SeqID_16563; Position on contig =513..572bp; Strand=-
cggccgcgtttgtttttttttttttttttttttttttttttttaaacaccaccggggggg

SEQ ID NO: 12232 - DNA, 60 bp, Xenorhabdus bovienii
  unsure (1)..(60): unsure at all n locations
  Promoter location: Contig name=SeqID_16585; Position on contig =80..139bp; Strand=+
gaaaaagttttanaaaaaaggcatgattgncagcaagcaagtcctgncaggctagtnatn

SEQ ID NO: 12233 - DNA, 60 bp, Xenorhabdus bovienii
  Promoter location: Contig name=SeqID_16601; Position on contig =719..778bp; Strand=-
gggagggggttgttttgtttatttggtgtggtcaagctcgccggtcttattttttttgtt

SEQ ID NO: 12234 - DNA, 60 bp, Xenorhabdus bovienii
  Promoter location: Contig name=SeqID_16606; Position on contig =759..818bp; Strand=-
gggatttttttatttttttttttttttttttttcggcgaccccattttttttttttttca

SEQ ID NO: 12235 - DNA, 60 bp, Xenorhabdus bovienii
  Promoter location: Contig name=SeqID_16619; Position on contig =434..493bp; Strand=+
gggtttgtttgtttacaaacaaaacacaaccacacctttttttgtttttttatataaata

SEQ ID NO: 12236 - DNA, 60 bp, Xenorhabdus bovienii
  Promoter location: Contig name=SeqID_16645; Position on contig =308..367bp; Strand=-
ggcaaaaaaaaaaaaaaaccaaacaaagttttgggggggttcttggtaaaaaaaaaaaat

SEQ ID NO: 12237 - DNA, 60 bp, Xenorhabdus bovienii
  Promoter location: Contig name=SeqID_16680; Position on contig =422..481bp; Strand=-
gctttttctcggcccctttttttttttttccccctttttgcccaatttataaaaaggggg

SEQ ID NO: 12238 - DNA, 60 bp, Xenorhabdus bovienii
  unsure (1)..(60): unsure at all n locations
  Promoter location: Contig name=SeqID_16680; Position on contig =320..379bp; Strand=+
aaccgggaaatntcaaaaaaatggccccgccccnttttccaagcccggaaaattttccac

SEQ ID NO: 12239 - DNA, 60 bp, Xenorhabdus bovienii
  unsure (1)..(60): unsure at all n locations
  Promoter location: Contig name=SeqID_16696; Position on contig =1112..1171bp; Strand=-
caagngngcgccgcccccgcggccngcnnnngngnnnnnnnnnnnnnnnnnnnnnnnnnn

SEQ ID NO: 12240 - DNA, 60 bp, Xenorhabdus bovienii
  unsure (1)..(60): unsure at all n locations
  Promoter location: Contig name=SeqID_16704; Position on contig =904..963bp; Strand=-
tccgccttttttttttttttttttttttttcnctcntncctnnnnnnnaaaaaaatttta

SEQ ID NO: 12241 - DNA, 60 bp, Xenorhabdus bovienii
  unsure (1)..(60): unsure at all n locations
  Promoter location: Contig name=SeqID_16715; Position on contig =1046..1105bp; Strand=-
cccccaacannaaaataaaaaaaatttnnnnnnntntttttnttnnataaaataatatat

SEQ ID NO: 12242 - DNA, 60 bp, Xenorhabdus bovienii
  unsure (1)..(60): unsure at all n locations
  Promoter location: Contig name=SeqID_16731; Position on contig =714..773bp; Strand=-
gggggganaagggaatataaatatccccaccgccgcagtnnnaagcacaaaatanataaa

SEQ ID NO: 12243 - DNA, 60 bp, Xenorhabdus bovienii
  unsure (1)..(60): unsure at all n locations
  Promoter location: Contig name=SeqID_16733; Position on contig =442..501bp; Strand=-
aaattttngcgaaaaanaacccnnnnccccttnnnnnnnnnnnnnnnnnnnnnnnnnnnn

SEQ ID NO: 12244 - DNA, 60 bp, Xenorhabdus bovienii
  unsure (1)..(60): unsure at all n locations
  Promoter location: Contig name=SeqID_16741; Position on contig =155..214bp; Strand=+
aaaaaaaaaatgtcctgtcnnnnnnnnanaaaaaaccgcccatccngaaagcttgggcct

SEQ ID NO: 12245 - DNA, 60 bp, Xenorhabdus bovienii
  unsure (1)..(60): unsure at all n locations
  Promoter location: Contig name=SeqID_16744; Position on contig =862..921bp; Strand=-
nnntttttttttntttnntttttnnnntntnnnnnnnnnnnnnnnnnnnnnnnnnnnnnn

SEQ ID NO: 12246 - DNA, 60 bp, Xenorhabdus bovienii
  Promoter location: Contig name=SeqID_16745; Position on contig =14..73bp; Strand=+
gacttaggcatgagctcaatattcttgattctagaaatttcttttgctagcttgcacaca

SEQ ID NO: 12247 - DNA, 60 bp, Xenorhabdus bovienii
  Promoter location: Contig name=SeqID_16746; Position on contig =292..351bp; Strand=+
aatttaatttttttttttttttcccccccggcgggggaaggaatatttattatttttttc

SEQ ID NO: 12248 - DNA, 60 bp, Xenorhabdus bovienii
  Promoter location: Contig name=SeqID_16750; Position on contig =408..467bp; Strand=+
tctgtctatcaaggctgagatgatatcagagctagattactcacgtatacactagattta

SEQ ID NO: 12249 - DNA, 60 bp, Xenorhabdus bovienii
  Promoter location: Contig name=SeqID_16761; Position on contig =273..332bp; Strand=-
ttgatttaaaacggattttatagcttgaacagtttcatgtagttgcatatcatttcatca

SEQ ID NO: 12250 - DNA, 60 bp, Xenorhabdus bovienii
  Promoter location: Contig name=SeqID_16762; Position on contig =678..737bp; Strand=-
atactcgttaccattatctgcggttttaaaccacatataagaatcggtatcaccatctcc

SEQ ID NO: 12251 - DNA, 60 bp, Xenorhabdus bovienii
  Promoter location: Contig name=SeqID_16762; Position on contig =252..311bp; Strand=+
acaattctagttattgggttacttagcaactttagtggatacatagttattatattaggt

SEQ ID NO: 12252 - DNA, 60 bp, Xenorhabdus bovienii
  unsure (1)..(60): unsure at all n locations
  Promoter location: Contig name=SeqID_16771; Position on contig =801..860bp; Strand=-
aattcgattaacgggacgcttccaaagcggngggggcaaaaggggtttaaaattttggaa

SEQ ID NO: 12253 - DNA, 60 bp, Xenorhabdus bovienii
  Promoter location: Contig name=SeqID_16776; Position on contig =152..211bp; Strand=+
aactagtcaatttggaggttcttccattagaccaggcacaggctctctatgtttcaaata

SEQ ID NO: 12254 - DNA, 60 bp, Xenorhabdus bovienii
  Promoter location: Contig name=SeqID_16776; Position on contig =973..1032bp; Strand=-
attttggtggaattactttctattgccgtgcccgcagcgtcacaatttaccattgatacg

SEQ ID NO: 12255 - DNA, 60 bp, Xenorhabdus bovienii
  Promoter location: Contig name=SeqID_16784; Position on contig =1056..1115bp; Strand=-
gttctctcattgtccatacttaatctttgaattttggacttcgaagatataatgcatata

SEQ ID NO: 12256 - DNA, 60 bp, Xenorhabdus bovienii
  Promoter location: Contig name=SeqID_16788; Position on contig =295..354bp; Strand=+
agcataacttagagaatgagaaatttaaatttgctcgtagtatgctttataatgggagac

SEQ ID NO: 12257 - DNA, 60 bp, Xenorhabdus bovienii
  Promoter location: Contig name=SeqID_16790; Position on contig =530..589bp; Strand=-
accgtttcaggattcattaatagccatcaagggcgtaatggtcttagtaaactggttctt

SEQ ID NO: 12258 - DNA, 60 bp, Xenorhabdus bovienii
  Promoter location: Contig name=SeqID_16792; Position on contig =488..547bp; Strand=-
ttctttaaaaacagtatatagatgttgagatatgaggtcattagtcgtataatattttca

SEQ ID NO: 12259 - DNA, 60 bp, Xenorhabdus bovienii
  Promoter location: Contig name=SeqID_16793; Position on contig =507..566bp; Strand=+
aagccttttttcatctcttttctttctgtttctaacacttagacaagtatattagtacat

SEQ ID NO: 12260 - DNA, 60 bp, Xenorhabdus bovienii
  Promoter location: Contig name=SeqID_16797; Position on contig =586..645bp; Strand=+
cgcttttttgttgctatcaataaataaatgatgtgaataattaatggtaaattttttttc

SEQ ID NO: 12261 - DNA, 60 bp, Xenorhabdus bovienii
  unsure (1)..(60): unsure at all n locations
  Promoter location: Contig name=SeqID_16802; Position on contig =1613..1672bp; Strand=-
nnnnnnnnnnnnnnnnnnnnnnnnnnnnnnnnnnnnnnnnnnnnnnnnnnnnnnnnnnnn

SEQ ID NO: 12262 - DNA, 60 bp, Xenorhabdus bovienii
  Promoter location: Contig name=SeqID_16806; Position on contig =181..240bp; Strand=+
taactgggtgaatttcgagatcaattcagttttacccagtttgcttctagattttgttga

SEQ ID NO: 12263 - DNA, 60 bp, Xenorhabdus bovienii
  Promoter location: Contig name=SeqID_16807; Position on contig =1466..1525bp; Strand=-
gcttgatgcctgcaggtccgctacgccttgcttcgggatctggtatcctaaggggtctaa

SEQ ID NO: 12264 - DNA, 60 bp, Xenorhabdus bovienii
  Promoter location: Contig name=SeqID_16813; Position on contig =326..385bp; Strand=+
aaagtatagctatcattcctacttttaggcagtgataaggatacatcacaaaataaaaca

SEQ ID NO: 12265 - DNA, 60 bp, Xenorhabdus bovienii
  Promoter location: Contig name=SeqID_16817; Position on contig =642..701bp; Strand=+; Gene name=TufB
gctgatatagctcagttggtagagcacacccttggtaagggtgaggtcggcagttcgaat

SEQ ID NO: 12266 - DNA, 60 bp, Xenorhabdus bovienii; identical to SEQ ID NO: 12261
  unsure (1)..(60): unsure at all n locations
  Promoter location: Contig name=SeqID_16819; Position on contig =2706..2765bp; Strand=-

SEQ ID NO: 12267 - DNA, 60 bp, Xenorhabdus bovienii
  Promoter location: Contig name=SeqID_16819; Position on contig =3844..3903bp; Strand=-
tgaaaagacaaatttgttagtttttgcaaacccgtaaagcaagtggcaaaccttctccca

SEQ ID NO: 12268 - DNA, 60 bp, Xenorhabdus bovienii
  Promoter location: Contig name=SeqID_16820; Position on contig =461..520bp; Strand=+
ggttagtttcgttactgggcctgttttttgacaaaacagtaattagagaaaaaacgattc

SEQ ID NO: 12269 - DNA, 60 bp, Xenorhabdus bovienii; identical to SEQ ID NO: 12261
  unsure (1)..(60): unsure at all n locations
  Promoter location: Contig name=SeqID_16821; Position on contig =4..63bp; Strand=+

SEQ ID NO: 12270 - DNA, 60 bp, Xenorhabdus bovienii
  Promoter location: Contig name=SeqID_16822; Position on contig =1348..1407bp; Strand=-
acgtactatcatgaataaaagtgagtattatctgttttgtaagttagaaaaatttctcaa

SEQ ID NO: 12271 - DNA, 60 bp, Xenorhabdus bovienii
  Promoter location: Contig name=SeqID_16822; Position on contig =2034..2093bp; Strand=-
acccaattttccgttcaagtcaatttgaatattaatcatgtaacatataaacttcttgaa

SEQ ID NO: 12272 - DNA, 60 bp, Xenorhabdus bovienii
  Promoter location: Contig name=SeqID_16822; Position on contig =2794..2853bp; Strand=-
atgtataattcttccctttcgttgttaatcatgtgaaacatgattaatataataaataag

SEQ ID NO: 12273 - DNA, 60 bp, Xenorhabdus bovienii
  Promoter location: Contig name=SeqID_16822; Position on contig =3606..3665bp; Strand=-
tagcatcctcgtgtgaggatgctatgaaatatcttaaaattttgaatgtattctcaacta

SEQ ID NO: 12274 - DNA, 60 bp, Xenorhabdus bovienii
  Promoter location: Contig name=SeqID_16827; Position on contig =187..246bp; Strand=+; Gene name=XerC
gaaatcggtagacacaagggatttaaaatccctcggccttatggctgtgcgggttcaagt

SEQ ID NO: 12275 - DNA, 60 bp, Xenorhabdus bovienii
  Promoter location: Contig name=SeqID_16827; Position on contig =1710..1769bp; Strand=+
tcgatactcacaggactggacaaatagacagcggtaattgtctttagtagactatcgcag

SEQ ID NO: 12276 - DNA, 60 bp, Xenorhabdus bovienii
  Promoter location: Contig name=SeqID_16827; Position on contig =3077..3136bp; Strand=+; Gene name=AlpA
tacaaccctcatagttaaattttcaaaaaagccattaggcctaatggtatgatcaaaaag

SEQ ID NO: 12277 - DNA, 60 bp, Xenorhabdus bovienii
  Promoter location: Contig name=SeqID_16827; Position on contig =5412..5471bp; Strand=-
tttcataagaaacacacgtcaaggcttttttgtatttcttttttgtgtataatgaaacac

SEQ ID NO: 12278 - DNA, 60 bp, Xenorhabdus bovienii
  Promoter location: Contig name=SeqID_16827; Position on contig =5356..5415bp; Strand=+
ctgtgactttgcatttttgtttggtgttggcatcaatgaaactccttacaattggtgtgt

SEQ ID NO: 12279 - DNA, 60 bp, Xenorhabdus bovienii
  Promoter location: Contig name=SeqID_16828; Position on contig =5210..5269bp; Strand=-; Gene name=Bfr
cttttgaatagatttcacccttatcttgcattgtcagcagatttacgtataatacgcgag

SEQ ID NO: 12280 - DNA, 60 bp, Xenorhabdus bovienii
  Promoter location: Contig name=SeqID_16829; Position on contig =1734..1793bp; Strand=-; Gene name=DadA
acattcaccttttattttattaataaattaataatgataacaatagcaactatctgtttg

SEQ ID NO: 12281 - DNA, 60 bp, Xenorhabdus bovienii
  Promoter location: Contig name=SeqID_16829; Position on contig =1613..1672bp; Strand=+; Gene name=DadA
caagataaaaatctaaacttattaataatatgtttaataattgtgacataattagcatat

SEQ ID NO: 12282 - DNA, 60 bp, Xenorhabdus bovienii
  Promoter location: Contig name=SeqID_16829; Position on contig =5193..5252bp; Strand=+
attacagcttattttcgtgatttattttcagcttgtgattaagccgctatgatatatgat

SEQ ID NO: 12283 - DNA, 60 bp, Xenorhabdus bovienii
  Promoter location: Contig name=SeqID_16830; Position on contig =6278..6337bp; Strand=+
cacatacgaaaatgaatgatacaaattactatcagtaaaatcatttttaaaatatgataa

SEQ ID NO: 12284 - DNA, 60 bp, Xenorhabdus bovienii
  Promoter location: Contig name=SeqID_16830; Position on contig =10179..10238bp; Strand=+
aaagagcctcagtcacgcgcaaaattcaatatcgaccggacgcctgttaccgttttgatc

SEQ ID NO: 12285 - DNA, 60 bp, Xenorhabdus bovienii
  Promoter location: Contig name=SeqID_16831; Position on contig =2630..2689bp; Strand=-
caattaacttttcagagtaccttgaatatttaaggaatgaccttatctagtttccagtag

SEQ ID NO: 12286 - DNA, 60 bp, Xenorhabdus bovienii
  Promoter location: Contig name=SeqID_16831; Position on contig =4449..4508bp; Strand=+; Gene name=NrfG
taaattctgtattttacgttgagttttgacggcaaagccgtttcatttaaaataatgtgc

SEQ ID NO: 12287 - DNA, 60 bp, Xenorhabdus bovienii
  Promoter location: Contig name=SeqID_16831; Position on contig =6172..6231bp; Strand=+; Gene name=PheA
tttcttctttttcttttttaccttctcatgaggaggttttttcgttttaaaaaggataag

SEQ ID NO: 12288 - DNA, 60 bp, Xenorhabdus bovienii
  Promoter location: Contig name=SeqID_16831; Position on contig =9950..10009bp; Strand=-
attataaatataactatgatattaattcacaaaatatttaaattaattaatatatttttt

SEQ ID NO: 12289 - DNA, 60 bp, Xenorhabdus bovienii
  Promoter location: Contig name=SeqID_16831; Position on contig =10100..10159bp; Strand=+
tattaacatgtaattttaatgtttatataacaccataaaataatatttataattaatagc

SEQ ID NO: 12290 - DNA, 60 bp, Xenorhabdus bovienii
  Promoter location: Contig name=SeqID_16831; Position on contig =12966..13025bp; Strand=-; Gene name=Ffh
gtcgagaaagaaagtgctctttggattgctttttgcgccaaagtgagtaaaattttcgag

SEQ ID NO: 12291 - DNA, 60 bp, Xenorhabdus bovienii
  Promoter location: Contig name=SeqID_16832; Position on contig =1646..1705bp; Strand=-
cctttggttttcatcagttttttctttttaaaaatagaaagttattttaaaataaatact

SEQ ID NO: 12292 - DNA, 60 bp, Xenorhabdus bovienii
  Promoter location: Contig name=SeqID_16832; Position on contig =2722..2781bp; Strand=-; Gene name=ProP
agccaaaggttggtaaggttcaacctttggctgccttattttagtgataaacttcacaat

SEQ ID NO: 12293 - DNA, 60 bp, Xenorhabdus bovienii
  Promoter location: Contig name=SeqID_16832; Position on contig =5037..5096bp; Strand=-; Gene name=BolA
attagggatatgccgctatcaatagcaatgctatgattgcgactgtttatactacctgta

SEQ ID NO: 12294 - DNA, 60 bp, Xenorhabdus bovienii
  Promoter location: Contig name=SeqID_16832; Position on contig =4982..5041bp; Strand=+; Gene name=BolA
attttttttagcatgtaggttttctcattcaggatacggatacccgatatattaatacag

SEQ ID NO: 12295 - DNA, 60 bp, Xenorhabdus bovienii
  Promoter location: Contig name=SeqID_16832; Position on contig =7314..7373bp; Strand=+; Gene name=ClpP
gcttgcgggtttttttattgtccttgaaaaaaacagatttaacctcatatcctttcttac

SEQ ID NO: 12296 - DNA, 60 bp, Xenorhabdus bovienii
  Promoter location: Contig name=SeqID_16832; Position on contig =8192..8251bp; Strand=+; Gene name=ClpX
cgccttactcggcggagtaatgacagcgtattttctgttatgccagataaactgggataa

SEQ ID NO: 12297 - DNA, 60 bp, Xenorhabdus bovienii
  Promoter location: Contig name=SeqID_16832; Position on contig =9558..9617bp; Strand=+; Gene name=Lon
gtaggaagtaccgattatcaatatgtattgaaaaaataaaaatgagggattctccctcat

SEQ ID NO: 12298 - DNA, 60 bp, Xenorhabdus bovienii
  Promoter location: Contig name=SeqID_16833; Position on contig =1499..1558bp; Strand=-; Gene name=HepA
atgagatgcccctgcattttaatctcacaccgtaaatcatatgctgataaaatccgcccc

SEQ ID NO: 12299 - DNA, 60 bp, Xenorhabdus bovienii
  Promoter location: Contig name=SeqID_16833; Position on contig =4667..4726bp; Strand=-; Gene name=PolB
acttttgcaggtgacggcttgctcctcttgaattaacatatcgcccctctaatgggcaat

SEQ ID NO: 12300 - DNA, 60 bp, Xenorhabdus bovienii
  Promoter location: Contig name=SeqID_16833; Position on contig =7135..7194bp; Strand=+
aatagtagtctaaactatagcagttgcagtggttatttatacagtggtttttttagtaaa

SEQ ID NO: 12301 - DNA, 60 bp, Xenorhabdus bovienii
  Promoter location: Contig name=SeqID_16834; Position on contig =2424..2483bp; Strand=-; Gene name=RibC
aacgagtcctatacaatatccgcgttaataagcgattaattttccaataaaatcgtttgc

SEQ ID NO: 12302 - DNA, 60 bp, Xenorhabdus bovienii
  Promoter location: Contig name=SeqID_16834; Position on contig =2520..2579bp; Strand=+; Gene name=RibC
cgggagcgcgcactcaccgaaatagtgtttaaaaatgatgggtaggttaaactaattcat

SEQ ID NO: 12303 - DNA, 60 bp, Xenorhabdus bovienii
  Promoter location: Contig name=SeqID_16834; Position on contig =4660..4719bp; Strand=-; Gene name=ProP
gatgattgtttaaatattatttcactcatatactcatacaggttcattattataaaaact

SEQ ID NO: 12304 - DNA, 60 bp, Xenorhabdus bovienii
  Promoter location: Contig name=SeqID_16834; Position on contig =6068..6127bp; Strand=-; Gene name=LysR
tccagcgagtattcagaccacatatttattcctttcaatttttttcataacatgatgcaa

SEQ ID NO: 12305 - DNA, 60 bp, Xenorhabdus bovienii
  Promoter location: Contig name=SeqID_16834; Position on contig =6015..6074bp; Strand=+; Gene name=LysR
agatacaaggcttattctatatggcatgatttttacttgtgaaacggtaatatttgcatc

SEQ ID NO: 12306 - DNA, 60 bp, Xenorhabdus bovienii
  Promoter location: Contig name=SeqID_16834; Position on contig =8095..8154bp; Strand=-; Gene name=SodA
attcaaggtttatcgctaagttattgccagccttcatcctatataaatatactggcaaac

SEQ ID NO: 12307 - DNA, 60 bp, Xenorhabdus bovienii
  Promoter location: Contig name=SeqID_16834; Position on contig =9200..9259bp; Strand=-
gcagttaagtcgtatctttttccctgtaatttagctgaaaagttgttaagataattatca

SEQ ID NO: 12308 - DNA, 60 bp, Xenorhabdus bovienii
  Promoter location: Contig name=SeqID_16834; Position on contig =10587..10646bp; Strand=-; Gene name=GloA
ttctaaattggataggtattacttctgcaatacatgccaaattttgtcataatatccact

SEQ ID NO: 12309 - DNA, 60 bp, Xenorhabdus bovienii
  Promoter location: Contig name=SeqID_16834; Position on contig =11282..11341bp; Strand=-
ttacccctgtgagaattgacatattgacgcagggtaatatccattgtgataatttaaaat

SEQ ID NO: 12310 - DNA, 60 bp, Xenorhabdus bovienii
  Promoter location: Contig name=SeqID_16834; Position on contig =11583..11642bp; Strand=+
tattacaccgaatcaaccttatatcttgattatcacttttacagagcgataatcccctga

SEQ ID NO: 12311 - DNA, 60 bp, Xenorhabdus bovienii
  Promoter location: Contig name=SeqID_16834; Position on contig =14650..14709bp; Strand=-
aaacttttggtcaggaattattcctttaggagttcgtcttcagtatttattatttatcga

SEQ ID NO: 12312 - DNA, 60 bp, Xenorhabdus bovienii
  Promoter location: Contig name=SeqID_16834; Position on contig =14641..14700bp; Strand=+
gctcatttctcgataaataataaatactgaagacgaactcctaaaggaataattcctgac

SEQ ID NO: 12313 - DNA, 60 bp, Xenorhabdus bovienii
  Promoter location: Contig name=SeqID_16835; Position on contig =5615..5674bp; Strand=+; Gene name=PepB
gttcacctatcattgctcaatagcttggcataacctgcatttaatggaaaactggcaatc

SEQ ID NO: 12314 - DNA, 60 bp, Xenorhabdus bovienii
  Promoter location: Contig name=SeqID_16835; Position on contig =7054..7113bp; Strand=+
agatttaagattacctttcttcatagtctcctttcaaaaggggaggctatgattgaacct

SEQ ID NO: 12315 - DNA, 60 bp, Xenorhabdus bovienii
  Promoter location: Contig name=SeqID_16835; Position on contig =7619..7678bp; Strand=+
gaaaattccgttattttttctgcgctttggttatgcgaaataggaagtatcataataact

SEQ ID NO: 12316 - DNA, 60 bp, Xenorhabdus bovienii
  Promoter location: Contig name=SeqID_16836; Position on contig =3558..3617bp; Strand=-; Gene name=PtsG
ctttttgttaattcatgatctgatgacatcacttatgtatttcttgttaaaacatttttt

SEQ ID NO: 12317 - DNA, 60 bp, Xenorhabdus bovienii
  Promoter location: Contig name=SeqID_16836; Position on contig =3505..3564bp; Strand=+; Gene name=PtsG
ttatcacatatcagaaggatttaatttgcgatacaaaataatctttttagactaaaaaat

SEQ ID NO: 12318 - DNA, 60 bp, Xenorhabdus bovienii
  Promoter location: Contig name=SeqID_16836; Position on contig =6179..6238bp; Strand=+
ttttttaaaaaaagtatttttttatttgaatttcacattgcttgctgtagtttattttta

SEQ ID NO: 12319 - DNA, 60 bp, Xenorhabdus bovienii
  Promoter location: Contig name=SeqID_16836; Position on contig =8034..8093bp; Strand=+
tgaagggtttaaataagtagttcgttattgagcttttactgctggtttatcatttcttta

SEQ ID NO: 12320 - DNA, 60 bp, Xenorhabdus bovienii
  Promoter location: Contig name=SeqID_16836; Position on contig =8793..8852bp; Strand=+; Gene name=ProP
tttgaaactatttactgttaaatatttataagtaactgaaacgtaattactttatttaaa

SEQ ID NO: 12321 - DNA, 60 bp, Xenorhabdus bovienii
  Promoter location: Contig name=SeqID_16836; Position on contig =11447..11506bp; Strand=+; Gene name=GlnS
aactcccctttcccactaacaaagagttgtttctcggttcagcttattagaatatagaag

SEQ ID NO: 12322 - DNA, 60 bp, Xenorhabdus bovienii
  Promoter location: Contig name=SeqID_16837; Position on contig =1784..1843bp; Strand=-
ctgagataattaaatttatggtgaatatttttttgttttttataaagtataataaattta

SEQ ID NO: 12323 - DNA, 60 bp, Xenorhabdus bovienii
  Promoter location: Contig name=SeqID_16837; Position on contig =1567..1626bp; Strand=+
tttttcttgtatgaattaagattattctcttttcttagtctatctgttatttttatttta

SEQ ID NO: 12324 - DNA, 60 bp, Xenorhabdus bovienii
  Promoter location: Contig name=SeqID_16837; Position on contig =2458..2517bp; Strand=+
tatctttctgatcatattgatttttatcattttcttaccggactggatatcataaaactc

SEQ ID NO: 12325 - DNA, 60 bp, Xenorhabdus bovienii
  Promoter location: Contig name=SeqID_16837; Position on contig =5135..5194bp; Strand=+
gagaagcaagaaaatcggttattacttgtttggaatacagaagccgatatacttttggct

SEQ ID NO: 12326 - DNA, 60 bp, Xenorhabdus bovienii
  Promoter location: Contig name=SeqID_16837; Position on contig =6811..6870bp; Strand=-
taatttttatataaatatggctaatgacttataaatatcttttcttttactatttgcaat

SEQ ID NO: 12327 - DNA, 60 bp, Xenorhabdus bovienii
  Promoter location: Contig name=SeqID_16837; Position on contig =9509..9568bp; Strand=-; Gene name=AcrR
aagtcaattattcttttcttctatgctgtttagaaaaacatatctgttataatgccagct

SEQ ID NO: 12328 - DNA, 60 bp, Xenorhabdus bovienii
  Promoter location: Contig name=SeqID_16837; Position on contig =9585..9644bp; Strand=+; Gene name=AcrR
gtgcctattggcagaaaacgtttgcaggaaatgacaaaaaataggcatattatttttttt

SEQ ID NO: 12329 - DNA, 60 bp, Xenorhabdus bovienii
  Promoter location: Contig name=SeqID_16837; Position on contig =16591..16650bp; Strand=-; Gene name=MoaE
taaataatatatcgctgaaattgccattaattggcggatggttttgttaatgttctatgc

SEQ ID NO: 12330 - DNA, 60 bp, Xenorhabdus bovienii
  Promoter location: Contig name=SeqID_16837; Position on contig =19102..19161bp; Strand=-
aactcgttgtgtaataagatatatatcgaaggttggtgttagctttttattatcttaaac

SEQ ID NO: 12331 - DNA, 60 bp, Xenorhabdus bovienii
  Promoter location: Contig name=SeqID_16837; Position on contig =19058..19117bp; Strand=+
tgaataattgtgtgagtaacgagattctcgttgctgattctaacgtttaagataataaaa

SEQ ID NO: 12332 - DNA, 60 bp, Xenorhabdus bovienii
  Promoter location: Contig name=SeqID_16837; Position on contig =22494..22553bp; Strand=-
ggataaaaatagtcacgtcaggtgttaactaaaagttaatatcacgataaagttattttg

SEQ ID NO: 12333 - DNA, 60 bp, Xenorhabdus bovienii
  Promoter location: Contig name=SeqID_16838; Position on contig =3886..3945bp; Strand=-; Gene name=BioA
gtaaacctttcttggttcattttggttgacatgatagcggcgttatttaaactgacaaca

SEQ ID NO: 12334 - DNA, 60 bp, Xenorhabdus bovienii
  Promoter location: Contig name=SeqID_16838; Position on contig =3863..3922bp; Strand=+; Gene name=BioA
taacatcctccagtgtgaaaaaatgttgtcagtttaaataacgccgctatcatgtcaacc

SEQ ID NO: 12335 - DNA, 60 bp, Xenorhabdus bovienii
  Promoter location: Contig name=SeqID_16838; Position on contig =5274..5333bp; Strand=+
gatattttaattatcacattattaataaaaaaataaaataatgaaggtattatcaaaaga

SEQ ID NO: 12336 - DNA, 60 bp, Xenorhabdus bovienii
  Promoter location: Contig name=SeqID_16838; Position on contig =7237..7296bp; Strand=-; Gene name=Cof
gcgatatgacatgagtaggcctctaaattgtcgatgatataagcaaatattatacggtaa

SEQ ID NO: 12337 - DNA, 60 bp, Xenorhabdus bovienii
  Promoter location: Contig name=SeqID_16838; Position on contig =7196..7255bp; Strand=+; Gene name=Cof
tgtttgttaaagtgatcgcatgacggtttaactatattttgttaccgtataatatttgct

SEQ ID NO: 12338 - DNA, 60 bp, Xenorhabdus bovienii
  Promoter location: Contig name=SeqID_16838; Position on contig =10812..10871bp; Strand=-
actggcaaacttttgtttgcttcctgaactgcaatttctgcctagattaacataaaagct

SEQ ID NO: 12339 - DNA, 60 bp, Xenorhabdus bovienii
  Promoter location: Contig name=SeqID_16838; Position on contig =11214..11273bp; Strand=-
ccgtaagaatcgcacgtttcgtcggttactgttacttttttattgtctagaatagcgaga

SEQ ID NO: 12340 - DNA, 60 bp, Xenorhabdus bovienii
  Promoter location: Contig name=SeqID_16838; Position on contig =13871..13930bp; Strand=+
aaaatccctctccgcaatgaaaaaatgactactttttaaaaattttttataatgactcaa

SEQ ID NO: 12341 - DNA, 60 bp, Xenorhabdus bovienii
  Promoter location: Contig name=SeqID_16838; Position on contig =14863..14922bp; Strand=+; Gene name=GpmA
acagggggttcaagactattgtttgccgtttcggtctatcgcgccatataatgcccgcag

SEQ ID NO: 12342 - DNA, 60 bp, Xenorhabdus bovienii
  Promoter location: Contig name=SeqID_16838; Position on contig =16888..16947bp; Strand=-; Gene name=PnuC
ctctctttttactcacaaagattatttacagcacaacgcctaacagttagattgagatca

SEQ ID NO: 12343 - DNA, 60 bp, Xenorhabdus bovienii
  Promoter location: Contig name=SeqID_16838; Position on contig =17956..18015bp; Strand=-
gactcagaaaatgagtcatttattatccattatcattttaaaaactttaaaataattaaa

SEQ ID NO: 12344 - DNA, 60 bp, Xenorhabdus bovienii
  Promoter location: Contig name=SeqID_16839; Position on contig =80..139bp; Strand=+
acgaatttaatacggttctttccattgcatggtggtctattactcaataatatcgctgat

SEQ ID NO: 12345 - DNA, 60 bp, Xenorhabdus bovienii
  Promoter location: Contig name=SeqID_16839; Position on contig =2564..2623bp; Strand=-; Gene name=Smf
cgataaacccgatgatacatcgattaattgcccccaatgtcaacaaggaaaattactcca

SEQ ID NO: 12346 - DNA, 60 bp, Xenorhabdus bovienii
  Promoter location: Contig name=SeqID_16839; Position on contig =3767..3826bp; Strand=-; Gene name=Def
tttgttaaccttctctcatcccgcatatccacctttattaaaacagatacactctccccc

SEQ ID NO: 12347 - DNA, 60 bp, Xenorhabdus bovienii
  Promoter location: Contig name=SeqID_16839; Position on contig =4080..4139bp; Strand=+; Gene name=Def
ccttgattaatttatggtcgatactgtcaatctaaataggaaatgtctagaataggcgca

SEQ ID NO: 12348 - DNA, 60 bp, Xenorhabdus bovienii
  Promoter location: Contig name=SeqID_16839; Position on contig =7035..7094bp; Strand=+; Gene name=TrkA
atcttcctcgtcaaaatatcggacgaggaggggtttagtgactttactaaaatatcaaga

SEQ ID NO: 12349 - DNA, 60 bp, Xenorhabdus bovienii
  Promoter location: Contig name=SeqID_16839; Position on contig =9357..9416bp; Strand=-; Gene name=RplQ
gtagaagcataaaaaaccgggataacacccggttttttattgctctttattttttcttcc

SEQ ID NO: 12350 - DNA, 60 bp, Xenorhabdus bovienii
  Promoter location: Contig name=SeqID_16839; Position on contig =12390..12449bp; Strand=-; Gene name=SecY
ggctaatttaatcgcatatttttcttgcaaagttgggttgagctggctaaattggccagc

SEQ ID NO: 12351 - DNA, 60 bp, Xenorhabdus bovienii
  Promoter location: Contig name=SeqID_16840; Position on contig =1681..1740bp; Strand=-
tgttttttaagatatattaggcagatagcataaattgcccacagttttataattagacaa

SEQ ID NO: 12352 - DNA, 60 bp, Xenorhabdus bovienii
  Promoter location: Contig name=SeqID_16840; Position on contig =4485..4544bp; Strand=-; Gene name=MazE
ctttttattaaaactatggaaatttatctaatgagcaatattaacttgtctaaactgttt

SEQ ID NO: 12353 - DNA, 60 bp, Xenorhabdus bovienii
  Promoter location: Contig name=SeqID_16840; Position on contig =4991..5050bp; Strand=+; Gene name=MazE
ttcgcaagtgaagtatcaacaaagttgacacttaaaataatcactgatagagtatcttca

SEQ ID NO: 12354 - DNA, 60 bp, Xenorhabdus bovienii
  Promoter location: Contig name=SeqID_16840; Position on contig =8958..9017bp; Strand=-
tggtcatgcgctcactggcattcactttgacggggcgcagcccaccgaaaaatcacaact

SEQ ID NO: 12355 - DNA, 60 bp, Xenorhabdus bovienii
  Promoter location: Contig name=SeqID_16841; Position on contig =734..793bp; Strand=-
tatcaaagtggggaaaagccaaaaaaactggcagttacgaaaagtactaaataagaaccc

SEQ ID NO: 12356 - DNA, 60 bp, Xenorhabdus bovienii
  Promoter location: Contig name=SeqID_16841; Position on contig =1853..1912bp; Strand=+
cggatgcttatttaatatgtcgtggtgtacatcgtcaaacgtgtaatttagctcagcggt

SEQ ID NO: 12357 - DNA, 60 bp, Xenorhabdus bovienii
  Promoter location: Contig name=SeqID_16841; Position on contig =6510..6569bp; Strand=+
caaaggcgtgactaagcgtggttgcttgcatggcagtttctacggttatcatggtcagta

SEQ ID NO: 12358 - DNA, 60 bp, Xenorhabdus bovienii
  Promoter location: Contig name=SeqID_16841; Position on contig =8942..9001bp; Strand=-; Gene name=XerC
aattgttaagcgtgtacgcaaagagttagctttgaatgcagtaactgtaaaagggcttat

SEQ ID NO: 12359 - DNA, 60 bp, Xenorhabdus bovienii
  Promoter location: Contig name=SeqID_16841; Position on contig =9282..9341bp; Strand=-; Gene name=EmrE
caagcattcatctggtgtcatgataaatgcgtacatgaatgtgtatataaactacattaa

SEQ ID NO: 12360 - DNA, 60 bp, Xenorhabdus bovienii
  Promoter location: Contig name=SeqID_16841; Position on contig =9758..9817bp; Strand=-; Gene name=MesJ
atttatgaaaaatttggtaatagaaatcctttttttcgttaaagcgttatatttgaaatt

SEQ ID NO: 12361 - DNA, 60 bp, Xenorhabdus bovienii
  Promoter location: Contig name=SeqID_16841; Position on contig =9835..9894bp; Strand=+; Gene name=MesJ
tggaagacttttttaccaactctgattgataatcccttttcatccgctatcattgcttcc

SEQ ID NO: 12362 - DNA, 60 bp, Xenorhabdus bovienii
  Promoter location: Contig name=SeqID_16841; Position on contig =13834..13893bp; Strand=-; Gene name=Tpx
gacgcgatattcagaaatactctgccctcctttaattaacaatgttttataatttatttt

SEQ ID NO: 12363 - DNA, 60 bp, Xenorhabdus bovienii
  Promoter location: Contig name=SeqID_16841; Position on contig =13786..13845bp; Strand=+; Gene name=Tpx
ttaaaattatgcatgaatttttgccttgtgagtctaataattatcctaaaaataaattat

SEQ ID NO: 12364 - DNA, 60 bp, Xenorhabdus bovienii
  Promoter location: Contig name=SeqID_16841; Position on contig =14872..14931bp; Strand=+; Gene name=SPS1
tggaagttatttctataaaaaaaattaatatcaataaaatttaattgaaaaataattaac

SEQ ID NO: 12365 - DNA, 60 bp, Xenorhabdus bovienii
  Promoter location: Contig name=SeqID_16841; Position on contig =17899..17958bp; Strand=-
cgtcaacttttgctgacagggggcttcatctattgcatcttaacgggtaacatttcagac

SEQ ID NO: 12366 - DNA, 60 bp, Xenorhabdus bovienii
  Promoter location: Contig name=SeqID_16841; Position on contig =20499..20558bp; Strand=-; Gene name=PspC
gatgccaaattttggcaataattctgttgatgttacccggccggatataaattgagtcac

SEQ ID NO: 12367 - DNA, 60 bp, Xenorhabdus bovienii
  Promoter location: Contig name=SeqID_16841; Position on contig =21999..22058bp; Strand=-; Gene name=PspF
tatatcaaataattcaactggataagtaagatgtgaaagttggcatgtatcttgtattta

SEQ ID NO: 12368 - DNA, 60 bp, Xenorhabdus bovienii
  Promoter location: Contig name=SeqID_16841; Position on contig =22008..22067bp; Strand=+; Gene name=PspF
gatacatgccaactttcacatcttacttatccagttgaattatttgatataatttctctt

SEQ ID NO: 12369 - DNA, 60 bp, Xenorhabdus bovienii
  Promoter location: Contig name=SeqID_16841; Position on contig =23340..23399bp; Strand=+; Gene name=OppA
attatagtgatctactcgttgtttttgagcagaaagcgttaattaagttacaatgcacaa

SEQ ID NO: 12370 - DNA, 60 bp, Xenorhabdus bovienii
  Promoter location: Contig name=SeqID_16841; Position on contig =28845..28904bp; Strand=+; Gene name=FabI
ccagcgtggtagaatcgtccccgtttattaacaacaaataccctagttatagtaagtata

SEQ ID NO: 12371 - DNA, 60 bp, Xenorhabdus bovienii
  Promoter location: Contig name=SeqID_16841; Position on contig =29882..29941bp; Strand=+; Gene name=Gst
gaatgctgcgccgacagataccacatccaatttattaccagttaatgtaagataaattga

SEQ ID NO: 12372 - DNA, 60 bp, Xenorhabdus bovienii
  Promoter location: Contig name=SeqID_16841; Position on contig =31616..31675bp; Strand=-; Gene name=TyrS
caaagttaagggcaacagcaatgttgcccttaaataattcgacttgttaataagccgctc

SEQ ID NO: 12373 - DNA, 60 bp, Xenorhabdus bovienii
  Promoter location: Contig name=SeqID_16841; Position on contig =33059..33118bp; Strand=-
gagattaattactgtttttaatactggcacttaaattactggcgttttatgctatagcac

SEQ ID NO: 12374 - DNA, 60 bp, Xenorhabdus bovienii
  Promoter location: Contig name=SeqID_16842; Position on contig =393..452bp; Strand=-; Gene name=AcnB
aaagtatattgcaaaaaataaggaggcagatgcctcctttttttatggtagcttttgtgt

SEQ ID NO: 12375 - DNA, 60 bp, Xenorhabdus bovienii
  Promoter location: Contig name=SeqID_16842; Position on contig =3244..3303bp; Strand=-; Gene name=Lpd
gtatataaaactgtaatactctctttgtgtctcgttatctaacattttatcatggcataa

SEQ ID NO: 12376 - DNA, 60 bp, Xenorhabdus bovienii
  Promoter location: Contig name=SeqID_16842; Position on contig =5062..5121bp; Strand=-; Gene name=AceF
ctagcatgttgggatttctgtcacgttaacgcgcttttcaggttatttacaattctgtaa

SEQ ID NO: 12377 - DNA, 60 bp, Xenorhabdus bovienii
  Promoter location: Contig name=SeqID_16842; Position on contig =9917..9976bp; Strand=-; Gene name=FadR
cctcaagggcgtcattgacaattaaaactcccggatggggtaggttctataatcttggct

SEQ ID NO: 12378 - DNA, 60 bp, Xenorhabdus bovienii
  Promoter location: Contig name=SeqID_16842; Position on contig =10976..11035bp; Strand=-
taaaccccatcaaatttttttacctgaaaatcctttttggttataattttttaataaaaa

SEQ ID NO: 12379 - DNA, 60 bp, Xenorhabdus bovienii
  Promoter location: Contig name=SeqID_16842; Position on contig =13813..13872bp; Strand=-; Gene name=HofG
atgatccccgatagatgtcggcgttcataaggatgacaaaaacagagaaaaataacatag

SEQ ID NO: 12380 - DNA, 60 bp, Xenorhabdus bovienii
  Promoter location: Contig name=SeqID_16842; Position on contig =13730..13789bp; Strand=+; Gene name=HofG
ttgcgaaccagctcgaaaattcctctgtaaaaaatgtaacgaatagttattttttcgagc

SEQ ID NO: 12381 - DNA, 60 bp, Xenorhabdus bovienii
  Promoter location: Contig name=SeqID_16842; Position on contig =14335..14394bp; Strand=+; Gene name=GspE
gttaaattttaaagctactctattttcaaacatattatttcgaaaaataagattttcaaa

SEQ ID NO: 12382 - DNA, 60 bp, Xenorhabdus bovienii
  Promoter location: Contig name=SeqID_16842; Position on contig =17237..17296bp; Strand=+; Gene name=CoaE
caggaattatacccgtttgtttatagcccatctgactcccttgagttacaatttaaatat

SEQ ID NO: 12383 - DNA, 60 bp, Xenorhabdus bovienii
  Promoter location: Contig name=SeqID_16842; Position on contig =19600..19659bp; Strand=-; Gene name=Uup
ctgcatattgcatgaatgatgcttccttgatttttaaagtatggttttatactttctaag

SEQ ID NO: 12384 - DNA, 60 bp, Xenorhabdus bovienii
  Promoter location: Contig name=SeqID_16842; Position on contig =19495..19554bp; Strand=+; Gene name=Uup
taatcacgtcttatcactttttgccaagcttcacccgaataaaagcctattatgtgaaca

SEQ ID NO: 12385 - DNA, 60 bp, Xenorhabdus bovienii
  Promoter location: Contig name=SeqID_16842; Position on contig =24099..24158bp; Strand=-
ctgtcttactttttgttttttgatgagacagttttgcttggacagtctagaagacacaat

SEQ ID NO: 12386 - DNA, 60 bp, Xenorhabdus bovienii
  Promoter location: Contig name=SeqID_16842; Position on contig =24643..24702bp; Strand=+
aaaggtgagaccaaaaataacgcctaccaaattgtcgccaaagatttaaaatactcattc

SEQ ID NO: 12387 - DNA, 60 bp, Xenorhabdus bovienii
  Promoter location: Contig name=SeqID_16843; Position on contig =1359..1418bp; Strand=-; Gene name=Lig
tatttccgtttacatagtgaattattgtgataataatcacaatttactattatgcattac

SEQ ID NO: 12388 - DNA, 60 bp, Xenorhabdus bovienii
  Promoter location: Contig name=SeqID_16843; Position on contig =4703..4762bp; Strand=-
acccgctcaaatgttttggcagttttgtcgaattcgtcatattttcttattctctcctag

SEQ ID NO: 12389 - DNA, 60 bp, Xenorhabdus bovienii
  Promoter location: Contig name=SeqID_16843; Position on contig =4288..4347bp; Strand=+
tgactcttgaacatgcgattttgacgaattatcaaacagttcatcgccatcattatcgtc

SEQ ID NO: 12390 - DNA, 60 bp, Xenorhabdus bovienii
  Promoter location: Contig name=SeqID_16843; Position on contig =5570..5629bp; Strand=+; Gene name=CysK
attacctttaattaactgtaaccatcacggcgcagaaataactatataaaatcataaatg

SEQ ID NO: 12391 - DNA, 60 bp, Xenorhabdus bovienii
  Promoter location: Contig name=SeqID_16843; Position on contig =7055..7114bp; Strand=-
ctcaataacttaaatattcgttgataagccctagaaaattctaaagctagtgtagctgaa

SEQ ID NO: 12392 - DNA, 60 bp, Xenorhabdus bovienii
  Promoter location: Contig name=SeqID_16843; Position on contig =6805..6864bp; Strand=+
tcagatcaaagtttaaaactttcctagatgatttattcaagtagctttagtatttaacca

SEQ ID NO: 12393 - DNA, 60 bp, Xenorhabdus bovienii
  Promoter location: Contig name=SeqID_16843; Position on contig =7771..7830bp; Strand=-; Gene name=PtsA
gaataaacagcggcatctgctgttgccagatttttcttaatcagggtaacaatttcctgt

SEQ ID NO: 12394 - DNA, 60 bp, Xenorhabdus bovienii
  Promoter location: Contig name=SeqID_16843; Position on contig =7391..7450bp; Strand=+; Gene name=PtsA
aataaagccaatttgtttcatttcaccgagttccatccccagataaataaaatctgggga

SEQ ID NO: 12395 - DNA, 60 bp, Xenorhabdus bovienii
  Promoter location: Contig name=SeqID_16843; Position on contig =10954..11013bp; Strand=-; Gene name=CysA
tatattttattaccgtcaacccgtctctcgtcatttgggggagcgggtattttttgttta

SEQ ID NO: 12396 - DNA, 60 bp, Xenorhabdus bovienii
  Promoter location: Contig name=SeqID_16843; Position on contig =15687..15746bp; Strand=+
actgttttacctttatatctattgacgggttatgtaaaccacactcttaaaaaaacattc

SEQ ID NO: 12397 - DNA, 60 bp, Xenorhabdus bovienii
  Promoter location: Contig name=SeqID_16843; Position on contig =16887..16946bp; Strand=-
tttttatataaaaataataaacatcgacaaacaccgaaacatgaaactaatatatattag

SEQ ID NO: 12398 - DNA, 60 bp, Xenorhabdus bovienii
  Promoter location: Contig name=SeqID_16843; Position on contig =16881..16940bp; Strand=+
atatacctaatatatattagtttcatgtttcggtgtttgtcgatgtttattatttttata

SEQ ID NO: 12399 - DNA, 60 bp, Xenorhabdus bovienii
  Promoter location: Contig name=SeqID_16843; Position on contig =18315..18374bp; Strand=+
tatatacgtaacaaatattgctttcttttgtaatgatttattttaagtaaaataccctca

SEQ ID NO: 12400 - DNA, 60 bp, Xenorhabdus bovienii
  Promoter location: Contig name=SeqID_16843; Position on contig =22204..22263bp; Strand=+
attttaaatatctatctgtatttaaaagaaaataataggtgtatagatattttttagcta

SEQ ID NO: 12401 - DNA, 60 bp, Xenorhabdus bovienii
  Promoter location: Contig name=SeqID_16843; Position on contig =22436..22495bp; Strand=+
ggaaaataaaaatatctttatgttttgatatatatcaaaacataattaaaattagcagat

SEQ ID NO: 12402 - DNA, 60 bp, Xenorhabdus bovienii
  Promoter location: Contig name=SeqID_16843; Position on contig =23388..23447bp; Strand=+; Gene name=Hcp
atattttagaaccctatattatattttttatcgttgttattttgttttatgataaattat

SEQ ID NO: 12403 - DNA, 60 bp, Xenorhabdus bovienii
  Promoter location: Contig name=SeqID_16843; Position on contig =25154..25213bp; Strand=-
catattctacaggaggttagtgtgaggatagaatagctgatttttgttaaaattattcta

SEQ ID NO: 12404 - DNA, 60 bp, Xenorhabdus bovienii
  Promoter location: Contig name=SeqID_16843; Position on contig =25407..25466bp; Strand=+
gtaacctttatttaattacttaaaataaattttactcagtaatattacacttgattgatt

SEQ ID NO: 12405 - DNA, 60 bp, Xenorhabdus bovienii
  Promoter location: Contig name=SeqID_16843; Position on contig =32441..32500bp; Strand=-
cttttaatcgaaataggatttaacttaacactttttaacaatcgacttatacttgaatta

SEQ ID NO: 12406 - DNA, 60 bp, Xenorhabdus bovienii
  Promoter location: Contig name=SeqID_16843; Position on contig =32198..32257bp; Strand=+
taacaaattaattttatttcttccaaaatggttggaaaagttaatatttgttgatacggt

SEQ ID NO: 12407 - DNA, 60 bp, Xenorhabdus bovienii
  Promoter location: Contig name=SeqID_16843; Position on contig =33589..33648bp; Strand=+; Gene name=Nlp
taaacatttatactgattcgcttattgaaccagataaaccaatcagttaaagtagccccg

SEQ ID NO: 12408 - DNA, 60 bp, Xenorhabdus bovienii
  Promoter location: Contig name=SeqID_16843; Position on contig =34347..34406bp; Strand=+; Gene name=HemF
acgttttatgtataagcaattgtataaataaacaaaaataaacccgttaaaaaataatat

SEQ ID NO: 12409 - DNA, 60 bp, Xenorhabdus bovienii
  Promoter location: Contig name=SeqID_16843; Position on contig =35446..35505bp; Strand=+; Gene name=LasB
cataaaaaatcaatatttaccctagtgactaactcaattattatagttagtattcaaacg

SEQ ID NO: 12410 - DNA, 60 bp, Xenorhabdus bovienii
  Promoter location: Contig name=SeqID_16843; Position on contig =36777..36836bp; Strand=-
tagtcactggtagaaatgtaaatttattatattattatatttttgattaaaatcaatata

SEQ ID NO: 12411 - DNA, 60 bp, Xenorhabdus bovienii
  Promoter location: Contig name=SeqID_16843; Position on contig =37172..37231bp; Strand=-
tgtaaggtaataaaataatttcattactattgcctgaatgaaactttattatcatttttc

SEQ ID NO: 12412 - DNA, 60 bp, Xenorhabdus bovienii
  Promoter location: Contig name=SeqID_16843; Position on contig =36759..36818bp; Strand=+
ataccgcatttgcattaatatattgattttaatcaaaaatataataatataataaattta

SEQ ID NO: 12413 - DNA, 60 bp, Xenorhabdus bovienii
  Promoter location: Contig name=SeqID_16843; Position on contig =42110..42169bp; Strand=-; Gene name=GcpE
ccagtattgtttctgattgctgattgaaccccgcgagcattcgcttttataatcgacgct

SEQ ID NO: 12414 - DNA, 60 bp, Xenorhabdus bovienii
  Promoter location: Contig name=SeqID_16843; Position on contig =43358..43417bp; Strand=-
aatagaaattcaagttcgcctgtgtgtattattcaccacagcatagttgtaatttttata

SEQ ID NO: 12415 - DNA, 60 bp, Xenorhabdus bovienii
  Promoter location: Contig name=SeqID_16843; Position on contig =46323..46382bp; Strand=-
aagtttgtacaatgtcgcgcctcactgatttgacttagtggggcgtttattattttatct

SEQ ID NO: 12416 - DNA, 60 bp, Xenorhabdus bovienii
  Promoter location: Contig name=SeqID_16843; Position on contig =46065..46124bp; Strand=+
cggtttttctcccatatcgagaaaaaattgacgcatttgtttacggttaagatcaagcag

SEQ ID NO: 12417 - DNA, 60 bp, Xenorhabdus bovienii
  Promoter location: Contig name=SeqID_16843; Position on contig =46950..47009bp; Strand=-
tttaataaaatgttatgttttttgtaggcaagcagaaagtctcctcctataatcaacgcc

SEQ ID NO: 12418 - DNA, 60 bp, Xenorhabdus bovienii
  Promoter location: Contig name=SeqID_16844; Position on contig =627..686bp; Strand=-
ggatttcatcgaaaaaatatatattcttgaaaaaataatataaaaattatagtgtcccaa

SEQ ID NO: 12419 - DNA, 60 bp, Xenorhabdus bovienii
  Promoter location: Contig name=SeqID_16844; Position on contig =2836..2895bp; Strand=-
cggttccggcggaaaacccctatcatcaaaattctctgccgaaggatataaatatatcca

SEQ ID NO: 12420 - DNA, 60 bp, Xenorhabdus bovienii
  Promoter location: Contig name=SeqID_16844; Position on contig =3646..3705bp; Strand=-
ctaatctttcagcgtgaatttgggcgtttcatggggggatcgtgtcttaaaatcgatttg

SEQ ID NO: 12421 - DNA, 60 bp, Xenorhabdus bovienii
  Promoter location: Contig name=SeqID_16844; Position on contig =4441..4500bp; Strand=+
caatttatccacagggcacaccctttttaacttgtttttcttgtttttatcttgttttca

SEQ ID NO: 12422 - DNA, 60 bp, Xenorhabdus bovienii
  Promoter location: Contig name=SeqID_16844; Position on contig =5425..5484bp; Strand=+; Gene name=Hcp
ttttattttaaattaactaatgcgagtaacaaaatgaatttttcatccatactttttttt

SEQ ID NO: 12423 - DNA, 60 bp, Xenorhabdus bovienii
  Promoter location: Contig name=SeqID_16844; Position on contig =7493..7552bp; Strand=-
cggctgaaggtcgaggaacttaaaacgcagtgtcataccccgacagataaacttgatcag

SEQ ID NO: 12424 - DNA, 60 bp, Xenorhabdus bovienii
  Promoter location: Contig name=SeqID_16844; Position on contig =8029..8088bp; Strand=-
ttaatttgagcccgtaacgatggaatgcaagcccggcaagctgattgcaagctcattatc

SEQ ID NO: 12425 - DNA, 60 bp, Xenorhabdus bovienii
  Promoter location: Contig name=SeqID_16844; Position on contig =8290..8349bp; Strand=+
aaaaaagataaatgcaagctcatttgcagttaatatgagccggaaggtattttcatttgc

SEQ ID NO: 12426 - DNA, 60 bp, Xenorhabdus bovienii
  Promoter location: Contig name=SeqID_16844; Position on contig =8943..9002bp; Strand=+
ttaacattaatcaacttaactgacttcgtactgctttcggtactacttaaaatgtactcg

SEQ ID NO: 12427 - DNA, 60 bp, Xenorhabdus bovienii
  Promoter location: Contig name=SeqID_16844; Position on contig =9802..9861bp; Strand=+
aagaaaaatgactttcggacatttaagcgactgaaattgaatacaaaaaaaatacattta

SEQ ID NO: 12428 - DNA, 60 bp, Xenorhabdus bovienii; identical to SEQ ID NO: 12418
  Promoter location: Contig name=SeqID_16844; Position on contig =11191..11250bp; Strand=-

SEQ ID NO: 12429 - DNA, 60 bp, Xenorhabdus bovienii
  Promoter location: Contig name=SeqID_16845; Position on contig =706..765bp; Strand=-
agttgttacccgatcttttttatgtgatatctctcaaatctgatcttacaatgggctgct

SEQ ID NO: 12430 - DNA, 60 bp, Xenorhabdus bovienii
  Promoter location: Contig name=SeqID_16845; Position on contig =1039..1098bp; Strand=-
atgtaatcgccttcatcctcttctggtgcaaggtcaatgacattgcgtaccattccctct

SEQ ID NO: 12431 - DNA, 60 bp, Xenorhabdus bovienii
  Promoter location: Contig name=SeqID_16845; Position on contig =748..807bp; Strand=+
aaagatcgggtaacaactttatatctttttgattattaataataatttataatatatcta

SEQ ID NO: 12432 - DNA, 60 bp, Xenorhabdus bovienii
  Promoter location: Contig name=SeqID_16845; Position on contig =1713..1772bp; Strand=-
gaatatcacagatgataatttaagaattatcttatttggaacggttttattgtcaacttg

SEQ ID NO: 12433 - DNA, 60 bp, Xenorhabdus bovienii
  Promoter location: Contig name=SeqID_16845; Position on contig =1692..1751bp; Strand=+; Gene name=GlpF
ttttctaacattaattttcatcaagttgacaataaaaccgttccaaataagataattctt

SEQ ID NO: 12434 - DNA, 60 bp, Xenorhabdus bovienii
  Promoter location: Contig name=SeqID_16845; Position on contig =2851..2910bp; Strand=+
atgccggcactggcaacccaaccagtgccaatcattatgacctccggtttaataaatttg

SEQ ID NO: 12435 - DNA, 60 bp, Xenorhabdus bovienii
  Promoter location: Contig name=SeqID_16845; Position on contig =3585..3644bp; Strand=+; Gene name=DIT1
gctctcaatatgttcagcttaatttatatattaggttggttataccttataattttttga

SEQ ID NO: 12436 - DNA, 60 bp, Xenorhabdus bovienii
  Promoter location: Contig name=SeqID_16845; Position on contig =8211..8270bp; Strand=+
ggagaaataaaccgccagataatacgaataaccatgacaaaaaaaattaaactcccaata

SEQ ID NO: 12437 - DNA, 60 bp, Xenorhabdus bovienii
  Promoter location: Contig name=SeqID_16845; Position on contig =9138..9197bp; Strand=-; Gene name=Gst
aacaagcccagtgggtgagaatgttttgaatttttcataactacttttatcatcttcaaa

SEQ ID NO: 12438 - DNA, 60 bp, Xenorhabdus bovienii
  Promoter location: Contig name=SeqID_16845; Position on contig =9970..10029bp; Strand=-
ggtatgacttgtttgataaaaattcattgttaatgggccataccaggtattctctcaagc

SEQ ID NO: 12439 - DNA, 60 bp, Xenorhabdus bovienii
  Promoter location: Contig name=SeqID_16845; Position on contig =9715..9774bp; Strand=+
ctgattaaaatcacctatttttggttgaatataatttattgagtgattattttaatttta

SEQ ID NO: 12440 - DNA, 60 bp, Xenorhabdus bovienii
  Promoter location: Contig name=SeqID_16845; Position on contig =15823..15882bp; Strand=-; Gene name=PspF
aatgtttcatttttcagaattgaaataaaaatgaaacattattgattcaatatgaaacaa

SEQ ID NO: 12441 - DNA, 60 bp, Xenorhabdus bovienii
  Promoter location: Contig name=SeqID_16845; Position on contig =15793..15852bp; Strand=+; Gene name=PspF
aactgtacatctattgggcataatgtatacttgtttcatattgaatcaataatgtttcat

SEQ ID NO: 12442 - DNA, 60 bp, Xenorhabdus bovienii
  Promoter location: Contig name=SeqID_16845; Position on contig =17776..17835bp; Strand=-
aaagacggtggttttaaacctttcatatggaaaaataaaattcaatgtataattactcat

SEQ ID NO: 12443 - DNA, 60 bp, Xenorhabdus bovienii
  Promoter location: Contig name=SeqID_16845; Position on contig =17596..17655bp; Strand=+
cttattggaataggctccttattgactaatattgtgataactatcaccaatatgacattt

SEQ ID NO: 12444 - DNA, 60 bp, Xenorhabdus bovienii
  Promoter location: Contig name=SeqID_16845; Position on contig =18286..18345bp; Strand=-
gcctttcttcgtgatcttacttctcacgtaaaatagaattttccttttattatcatatca

SEQ ID NO: 12445 - DNA, 60 bp, Xenorhabdus bovienii
  Promoter location: Contig name=SeqID_16845; Position on contig =18228..18287bp; Strand=+
aatattttcaggaaatttcagtttttggttcaaaagaggatcgcggggaaaattacaatg

SEQ ID NO: 12446 - DNA, 60 bp, Xenorhabdus bovienii
  Promoter location: Contig name=SeqID_16845; Position on contig =18775..18834bp; Strand=-
gtctaaagacggtggttttaaacctttcatatggaaaaataaattgcaataatcaacgcc

SEQ ID NO: 12447 - DNA, 60 bp, Xenorhabdus bovienii
  Promoter location: Contig name=SeqID_16845; Position on contig =18617..18676bp; Strand=+
ttttacatcaggcagacgatggcgatgaatattttcagcaggaacggaaagctctccttt

SEQ ID NO: 12448 - DNA, 60 bp, Xenorhabdus bovienii
  Promoter location: Contig name=SeqID_16845; Position on contig =19348..19407bp; Strand=+
tttcatgtgtatggaaaaatgtagttgaccttccgaaagcaattcattatcatttcctaa

SEQ ID NO: 12449 - DNA, 60 bp, Xenorhabdus bovienii
  Promoter location: Contig name=SeqID_16845; Position on contig =20505..20564bp; Strand=-
tttttactgagtacataattttaaaataagtataactatataataaatataatatattta

SEQ ID NO: 12450 - DNA, 60 bp, Xenorhabdus bovienii
  Promoter location: Contig name=SeqID_16845; Position on contig =20282..20341bp; Strand=+
aaaataaaatgggtgggctggcggaatttgatctagtttgttaactatataataaataac

SEQ ID NO: 12451 - DNA, 60 bp, Xenorhabdus bovienii
  Promoter location: Contig name=SeqID_16845; Position on contig =21051..21110bp; Strand=-
ggaatccggccttagtcctttgatttaatttgatgatacctattaggtagaatcaaaacc

SEQ ID NO: 12452 - DNA, 60 bp, Xenorhabdus bovienii
  Promoter location: Contig name=SeqID_16845; Position on contig =21722..21781bp; Strand=-
aatgaccatcccgtcatcgtcactgcacgacagcttgttattgctggtataagtcaccgc

SEQ ID NO: 12453 - DNA, 60 bp, Xenorhabdus bovienii
  Promoter location: Contig name=SeqID_16845; Position on contig =21528..21587bp; Strand=+
ggatgtgcatactcttggccacatttccccttatccaccagcgatgatattatgtacttg

SEQ ID NO: 12454 - DNA, 60 bp, Xenorhabdus bovienii
  Promoter location: Contig name=SeqID_16845; Position on contig =25011..25070bp; Strand=+
taagcgtccccgttatattttttatatttaaatcaattatttaatggtaattttttaagt

SEQ ID NO: 12455 - DNA, 60 bp, Xenorhabdus bovienii
  Promoter location: Contig name=SeqID_16845; Position on contig =25275..25334bp; Strand=+
aaaacgatacttaacgaatactaacgggcaataaaaaagccctaagtcgttatgatttag

SEQ ID NO: 12456 - DNA, 60 bp, Xenorhabdus bovienii
  Promoter location: Contig name=SeqID_16845; Position on contig =26356..26415bp; Strand=+
tattgttccaaacgccatcaggtttttatttaaccacatttaaatgatactattcagtgc

SEQ ID NO: 12457 - DNA, 60 bp, Xenorhabdus bovienii
  Promoter location: Contig name=SeqID_16845; Position on contig =27598..27657bp; Strand=-; Gene name=RecN
tgaagtcataggtaaaacgctgagaggttttcaatctcttcaatgtttattatcatcgac

SEQ ID NO: 12458 - DNA, 60 bp, Xenorhabdus bovienii
  Promoter location: Contig name=SeqID_16845; Position on contig =29375..29434bp; Strand=-
tttactgtataaagaaccagtttatactgtgtgaaagtacagacatgtttttatatacag

SEQ ID NO: 12459 - DNA, 60 bp, Xenorhabdus bovienii
  Promoter location: Contig name=SeqID_16845; Position on contig =30421..30480bp; Strand=-; Gene name=GrpE
aggtactttttggtctttactactcatgaatatctccgcgtattttgtattatttgcgct

SEQ ID NO: 12460 - DNA, 60 bp, Xenorhabdus bovienii
  Promoter location: Contig name=SeqID_16845; Position on contig =29959..30018bp; Strand=+; Gene name=GrpE
ttcgtctcgatattctccattgagtacttcggaaagctgctgcaaggcattatcgggatc

SEQ ID NO: 12461 - DNA, 60 bp, Xenorhabdus bovienii
  Promoter location: Contig name=SeqID_16845; Position on contig =31968..32027bp; Strand=-
acattaataacaaatttaatttttatttaacaaaattaatacccatatataatgaaagga

SEQ ID NO: 12462 - DNA, 60 bp, Xenorhabdus bovienii
  Promoter location: Contig name=SeqID_16845; Position on contig =31655..31714bp; Strand=+
atcctgctgtggcggataaatcgtctttccggccttacgttcattggcaacataggtcaa

SEQ ID NO: 12463 - DNA, 60 bp, Xenorhabdus bovienii
  Promoter location: Contig name=SeqID_16845; Position on contig =31864..31923bp; Strand=+
tctgaagctaattgataggatgaaattctgattttataaattatttttaaaatttataaa

SEQ ID NO: 12464 - DNA, 60 bp, Xenorhabdus bovienii
  Promoter location: Contig name=SeqID_16845; Position on contig =34720..34779bp; Strand=-
aaaagcgacctgcccacaggatatttttataggatgaagaatacgcctaacctgtttata

SEQ ID NO: 12465 - DNA, 60 bp, Xenorhabdus bovienii
  Promoter location: Contig name=SeqID_16845; Position on contig =34401..34460bp; Strand=+
gcttgtgcctgttctgcaacctgcattgccagttcgcgggtaggggtcaaaatcaagata

SEQ ID NO: 12466 - DNA, 60 bp, Xenorhabdus bovienii
  Promoter location: Contig name=SeqID_16845; Position on contig =35818..35877bp; Strand=-; Gene name=RpoE
ctgctcgctcatccgaggctcactctcctgaggtaaaactccacatttatacttaattac

SEQ ID NO: 12467 - DNA, 60 bp, Xenorhabdus bovienii
  Promoter location: Contig name=SeqID_16845; Position on contig =35604..35663bp; Strand=+; Gene name=RpoE
tgtgggttttattacgcaatgaaatgaatcgttcttttttcttgtcttaaaatcgtattc

SEQ ID NO: 12468 - DNA, 60 bp, Xenorhabdus bovienii
  Promoter location: Contig name=SeqID_16845; Position on contig =38745..38804bp; Strand=-; Gene name=LepA
tggtcgatgtgggcgataatggagaaatttcgtatttgcttcattattaaactttttttg

SEQ ID NO: 12469 - DNA, 60 bp, Xenorhabdus bovienii
  Promoter location: Contig name=SeqID_16845; Position on contig =38604..38663bp; Strand=+; Gene name=LepA
catactgaaaaccacaggcatgactaggttttcgcaggtttggcatgtagaatacgcctc

SEQ ID NO: 12470 - DNA, 60 bp, Xenorhabdus bovienii
  Promoter location: Contig name=SeqID_16845; Position on contig =41570..41629bp; Strand=+; Gene name=Rnc
aattcatctcacagtgtagaatattctgccaaacgagatgactggctttctagaatgatg

SEQ ID NO: 12471 - DNA, 60 bp, Xenorhabdus bovienii
  Promoter location: Contig name=SeqID_16845; Position on contig =45775..45834bp; Strand=-; Gene name=AlkA
atagatacagtcagtaaagccggatttccgtgccaaataattccctttttcattcgactt

SEQ ID NO: 12472 - DNA, 60 bp, Xenorhabdus bovienii
  Promoter location: Contig name=SeqID_16845; Position on contig =45580..45639bp; Strand=+; Gene name=AlkA
ataattataggccttcttccaactaagttgttgtgaatgattgtgataatatctttcgat

SEQ ID NO: 12473 - DNA, 60 bp, Xenorhabdus bovienii
  Promoter location: Contig name=SeqID_16845; Position on contig =47036..47095bp; Strand=-
caatgccgctttttctgcggccatatgagaagcaagatgtcgattgggatcatttttttc

SEQ ID NO: 12474 - DNA, 60 bp, Xenorhabdus bovienii
  Promoter location: Contig name=SeqID_16845; Position on contig =46745..46804bp; Strand=+
ctgtgctcaagatttgaggttgtcagtgtcagatggttaaggtctgtcagcatggatagt

SEQ ID NO: 12475 - DNA, 60 bp, Xenorhabdus bovienii
  Promoter location: Contig name=SeqID_16845; Position on contig =47681..47740bp; Strand=-
aggatcatgctcggtaatcggatgattatagccttctgcaataattttattatcggcaac

SEQ ID NO: 12476 - DNA, 60 bp, Xenorhabdus bovienii
  Promoter location: Contig name=SeqID_16845; Position on contig =47520..47579bp; Strand=+
actaatagttataattagcgagattttcataagtaagagaacctgtagtgacagagatat

SEQ ID NO: 12477 - DNA, 60 bp, Xenorhabdus bovienii
  Promoter location: Contig name=SeqID_16845; Position on contig =49746..49805bp; Strand=-; Gene name=PurL
gtttcctttgacgaaaccgtttgcgtgacggttattcaatcgaataatacaattagtaga

SEQ ID NO: 12478 - DNA, 60 bp, Xenorhabdus bovienii
  Promoter location: Contig name=SeqID_16845; Position on contig =49714..49773bp; Strand=+; Gene name=PurL
gatgtgcaaccttattgaatcaattttgaaattctactaattgtattattcgattgaata

SEQ ID NO: 12479 - DNA, 60 bp, Xenorhabdus bovienii
  Promoter location: Contig name=SeqID_16845; Position on contig =54162..54221bp; Strand=+
tattcatcacaaagccgagtgtatgaggatgttatttttattttcaataaaatcaatcta

SEQ ID NO: 12480 - DNA, 60 bp, Xenorhabdus bovienii
  Promoter location: Contig name=SeqID_16845; Position on contig =54781..54840bp; Strand=-; Gene name=BaeS
agtcgtgcggttaatttcggcagcttgagtactgagttgatcaagactttgataagcctg

SEQ ID NO: 12481 - DNA, 60 bp, Xenorhabdus bovienii
  Promoter location: Contig name=SeqID_16845; Position on contig =54559..54618bp; Strand=+; Gene name=BaeS
atagctctcaacaatccactattttcaaaaactagaaaaagtaacaatagaattcatcat

SEQ ID NO: 12482 - DNA, 60 bp, Xenorhabdus bovienii
  Promoter location: Contig name=SeqID_16845; Position on contig =61737..61796bp; Strand=-
tggtttttctctatttaaaaacattgccaaaagccataagttgtatttaaaatgcatgtt

SEQ ID NO: 12483 - DNA, 60 bp, Xenorhabdus bovienii
  Promoter location: Contig name=SeqID_16845; Position on contig =61436..61495bp; Strand=+
ctggtatgtttatgagcaattttttctacggcaggtaatagcgcctgtaaattatcgata

SEQ ID NO: 12484 - DNA, 60 bp, Xenorhabdus bovienii
  Promoter location: Contig name=SeqID_16845; Position on contig =63316..63375bp; Strand=-
aagccttgcttagagccattaattgttaaatatatcgaattagccatattatttcctttt

SEQ ID NO: 12485 - DNA, 60 bp, Xenorhabdus bovienii
  Promoter location: Contig name=SeqID_16845; Position on contig =63108..63167bp; Strand=+
ggattctcccgaaaaggagcgtataaaatcatatctgttcttattggttaaatcgggatt

SEQ ID NO: 12486 - DNA, 60 bp, Xenorhabdus bovienii
  Promoter location: Contig name=SeqID_16845; Position on contig =64887..64946bp; Strand=+
tcatcacctctggcatgacccaaatctatccaacccaataattcggtataaactaatcca

SEQ ID NO: 12487 - DNA, 60 bp, Xenorhabdus bovienii
  Promoter location: Contig name=SeqID_16845; Position on contig =65632..65691bp; Strand=-
gcttgccacagttcgggatcgtaattcgcaatattcatttcacgctttaacattaggttc

SEQ ID NO: 12488 - DNA, 60 bp, Xenorhabdus bovienii
  Promoter location: Contig name=SeqID_16845; Position on contig =65255..65314bp; Strand=+
gtttaaggagcaattggagaagaacatgaatttttctcaattaatattaatattgatatt

SEQ ID NO: 12489 - DNA, 60 bp, Xenorhabdus bovienii
  Promoter location: Contig name=SeqID_16846; Position on contig =1667..1726bp; Strand=-
ccatttatcaggctgaaccattatcctgacttggggtagggggtatttgtaatcgatttt

SEQ ID NO: 12490 - DNA, 60 bp, Xenorhabdus bovienii
  Promoter location: Contig name=SeqID_16846; Position on contig =2962..3021bp; Strand=-; Gene name=PaaI
cattgagttcagttcctgtcagtattttattgacaggaactgtttggtattttgctgatt

SEQ ID NO: 12491 - DNA, 60 bp, Xenorhabdus bovienii
  Promoter location: Contig name=SeqID_16846; Position on contig =6579..6638bp; Strand=-; Gene name=PerM
gattgtgatatcgttgaaagcttgcctactcagaaagctgtctgagttaccttatccaag

SEQ ID NO: 12492 - DNA, 60 bp, Xenorhabdus bovienii
  Promoter location: Contig name=SeqID_16846; Position on contig =6625..6684bp; Strand=+; Gene name=PerM
acgatatcacaatctttatcaattttgagcaatctgtaaaataacgttatatttacttac

SEQ ID NO: 12493 - DNA, 60 bp, Xenorhabdus bovienii
  Promoter location: Contig name=SeqID_16846; Position on contig =8231..8290bp; Strand=-
ctgaattaaaaagcctgttggaatatttgcaggcttttttgttttgtgtaacacaatctt

SEQ ID NO: 12494 - DNA, 60 bp, Xenorhabdus bovienii
  Promoter location: Contig name=SeqID_16846; Position on contig =7984..8043bp; Strand=+
tcgtttttcttttccaactcccatttattaagaggattcttaatgaataaactcatttat

SEQ ID NO: 12495 - DNA, 60 bp, Xenorhabdus bovienii
  Promoter location: Contig name=SeqID_16846; Position on contig =10742..10801bp; Strand=-
gttgatcgattcacctttccatatatgacaaaacaatgtgctaggctattttacgctgta

SEQ ID NO: 12496 - DNA, 60 bp, Xenorhabdus bovienii
  Promoter location: Contig name=SeqID_16846; Position on contig =10411..10470bp; Strand=+
aatctgtgcgccagccttggctaattgattaacatcatcaacattggtttcatcaagcaa

SEQ ID NO: 12497 - DNA, 60 bp, Xenorhabdus bovienii
  Promoter location: Contig name=SeqID_16846; Position on contig =10758..10817bp; Strand=+
ctagcacattgttttgtcatatatggaaaggtgaatcgatcaacccagcaatattatttt

SEQ ID NO: 12498 - DNA, 60 bp, Xenorhabdus bovienii
  Promoter location: Contig name=SeqID_16846; Position on contig =11911..11970bp; Strand=-; Gene name=AroG
gtgcatatattttctcgaattctacttcacattaaggtagtgtctgtaatgattgaaatc

SEQ ID NO: 12499 - DNA, 60 bp, Xenorhabdus bovienii
  Promoter location: Contig name=SeqID_16846; Position on contig =11858..11917bp; Strand=+; Gene name=AroG
ctcgtgcaaatgtcattattgtttgttgaatttactgggtgttgagttattgtgatttca

SEQ ID NO: 12500 - DNA, 60 bp, Xenorhabdus bovienii
  Promoter location: Contig name=SeqID_16846; Position on contig =13095..13154bp; Strand=+
aattataagcttcgaaaaaataacttgaagttagtcaaaattgaaacgataattattctc

SEQ ID NO: 12501 - DNA, 60 bp, Xenorhabdus bovienii
  Promoter location: Contig name=SeqID_16846; Position on contig =19927..19986bp; Strand=-
gtaactatcatctcagtactccattaacggtgaagcaataacgaatcaaaaatattgacg

SEQ ID NO: 12502 - DNA, 60 bp, Xenorhabdus bovienii
  Promoter location: Contig name=SeqID_16846; Position on contig =20900..20959bp; Strand=-; Gene name=AraC
gggccttttgctgaaaagataccgataaataaataataacttacgttattgtgtgggaca

SEQ ID NO: 12503 - DNA, 60 bp, Xenorhabdus bovienii
  Promoter location: Contig name=SeqID_16846; Position on contig =20714..20773bp; Strand=+; Gene name=AraC
agcaaactcgattgcattacagcctcatttataattaataacgcggctataatatcactg

SEQ ID NO: 12504 - DNA, 60 bp, Xenorhabdus bovienii
  Promoter location: Contig name=SeqID_16846; Position on contig =21350..21409bp; Strand=+
cagtgtaataaaaaaatagcccaaatgctgtttcaaagccaaatttctaaaccctattta

SEQ ID NO: 12505 - DNA, 60 bp, Xenorhabdus bovienii
  Promoter location: Contig name=SeqID_16846; Position on contig =23130..23189bp; Strand=-; Gene name=XerC
taagttaagggggtgctgatgggggtgctgttaataccaaaatagcctaaaataatctta

SEQ ID NO: 12506 - DNA, 60 bp, Xenorhabdus bovienii
  Promoter location: Contig name=SeqID_16846; Position on contig =23001..23060bp; Strand=+; Gene name=XerC
attggtacagccaattaagaatagattaaataataaaaacaaaaacctaaattccacgct

SEQ ID NO: 12507 - DNA, 60 bp, Xenorhabdus bovienii
  Promoter location: Contig name=SeqID_16846; Position on contig =25825..25884bp; Strand=-
cactatgtaattgaatgttatgttgcatagggagagaaagatttagttaggataaggttt

SEQ ID NO: 12508 - DNA, 60 bp, Xenorhabdus bovienii
  Promoter location: Contig name=SeqID_16846; Position on contig =25699..25758bp; Strand=+
tcccttgcactttctggtgcggttcttcaaacacatatgagtcagaatatactttaatta

SEQ ID NO: 12509 - DNA, 60 bp, Xenorhabdus bovienii
  Promoter location: Contig name=SeqID_16846; Position on contig =26241..26300bp; Strand=-
ttttgaactgtagtgctaactaattcactcattatattttctcttgttaaaattgatatt

SEQ ID NO: 12510 - DNA, 60 bp, Xenorhabdus bovienii
  Promoter location: Contig name=SeqID_16846; Position on contig =26190..26249bp; Strand=+
ttagctaatatattcgggctgttgaaacgggacagcatgtaaaacttccacaatatcaat

SEQ ID NO: 12511 - DNA, 60 bp, Xenorhabdus bovienii
  Promoter location: Contig name=SeqID_16846; Position on contig =33449..33508bp; Strand=-
acaccataaaactccagtgatgtgtcttgttgaagagataaccacacaaaaatagcccta

SEQ ID NO: 12512 - DNA, 60 bp, Xenorhabdus bovienii
  Promoter location: Contig name=SeqID_16846; Position on contig =35772..35831bp; Strand=+
tctatctcagctaaagcctttgtcgcgttttcatcagcatgtaattcaaaatcaaatgca

SEQ ID NO: 12513 - DNA, 60 bp, Xenorhabdus bovienii
  Promoter location: Contig name=SeqID_16846; Position on contig =38146..38205bp; Strand=-
cggttaaaagatggcgatgtgtgtttatctccgcccgtgacggaaaataaactcgtcaaa

SEQ ID NO: 12514 - DNA, 60 bp, Xenorhabdus bovienii
  Promoter location: Contig name=SeqID_16846; Position on contig =40634..40693bp; Strand=-
ctgcgcgacagcgaacaagcctaaatcccattcctgattgacgtcgttatgctggctccg

SEQ ID NO: 12515 - DNA, 60 bp, Xenorhabdus bovienii
  Promoter location: Contig name=SeqID_16846; Position on contig =40535..40594bp; Strand=+
gttctggctggttttcaggttaggaacaacctgaactaacacgttagtatcataaatatt

SEQ ID NO: 12516 - DNA, 60 bp, Xenorhabdus bovienii
  Promoter location: Contig name=SeqID_16846; Position on contig =47080..47139bp; Strand=-
ggtgtaatagtgggagggtaacgcgaggtaacacgatggtaacggcgcataattttttgg

SEQ ID NO: 12517 - DNA, 60 bp, Xenorhabdus bovienii
  Promoter location: Contig name=SeqID_16846; Position on contig =46763..46822bp; Strand=+
ttaccttggagtgtgttaccctgtttgttacctttgctgttacctgctacttttttttcc

SEQ ID NO: 12518 - DNA, 60 bp, Xenorhabdus bovienii
  Promoter location: Contig name=SeqID_16846; Position on contig =48003..48062bp; Strand=+
ctgctttctgataatgatataacagtttctgagaatgatatgacagcaatgatttcaggt

SEQ ID NO: 12519 - DNA, 60 bp, Xenorhabdus bovienii
  Promoter location: Contig name=SeqID_16846; Position on contig =49618..49677bp; Strand=-
gcggctaacagtatcgctaattttttcatatgaactcctgtgattagcaaattcattata

SEQ ID NO: 12520 - DNA, 60 bp, Xenorhabdus bovienii
  Promoter location: Contig name=SeqID_16846; Position on contig =50434..50493bp; Strand=-
cggatattgcccatgcttagggcgctgacagtaacctaagtataaagtagactgaaactt

SEQ ID NO: 12521 - DNA, 60 bp, Xenorhabdus bovienii
  Promoter location: Contig name=SeqID_16846; Position on contig =50288..50347bp; Strand=+
tttatcttacaatccctgatccctgctatcaatacaaacaataacgttatcgtaataaga

SEQ ID NO: 12522 - DNA, 60 bp, Xenorhabdus bovienii
  Promoter location: Contig name=SeqID_16846; Position on contig =51776..51835bp; Strand=+
ggcaaagaaatattgactttagtttcagaggttaactaattattaaatattattcgcttg

SEQ ID NO: 12523 - DNA, 60 bp, Xenorhabdus bovienii
  Promoter location: Contig name=SeqID_16846; Position on contig =54596..54655bp; Strand=-
agtggtgtttcaaaagtatttgatatttttaatgaactttacaactctattcttaagtct

SEQ ID NO: 12524 - DNA, 60 bp, Xenorhabdus bovienii
  Promoter location: Contig name=SeqID_16846; Position on contig =54568..54627bp; Strand=+
caggcatcattacatctttttcatcaagagacttaagaatagagttgtaaagttcattaa

SEQ ID NO: 12525 - DNA, 60 bp, Xenorhabdus bovienii
  Promoter location: Contig name=SeqID_16846; Position on contig =55645..55704bp; Strand=-
tactatctgtttgtttgaacagtgtatttattcatcttttgttttgctatatttgatgcg

SEQ ID NO: 12526 - DNA, 60 bp, Xenorhabdus bovienii
  Promoter location: Contig name=SeqID_16846; Position on contig =56443..56502bp; Strand=-
tttgtccggcattggcttaatatctccaaatagtgggaacttgtaactatactcactacg

SEQ ID NO: 12527 - DNA, 60 bp, Xenorhabdus bovienii
  Promoter location: Contig name=SeqID_16846; Position on contig =56142..56201bp; Strand=+
acatacagtaagttcagcaaatggcacaacatagaaaccatcacttttattatcattctt

SEQ ID NO: 12528 - DNA, 60 bp, Xenorhabdus bovienii
  Promoter location: Contig name=SeqID_16846; Position on contig =61270..61329bp; Strand=-
tgataaatcaaaatcgctatagcatttgattgatgctttatgatatgtataatagctata

SEQ ID NO: 12529 - DNA, 60 bp, Xenorhabdus bovienii
  Promoter location: Contig name=SeqID_16846; Position on contig =61077..61136bp; Strand=+
actgcgccgtttgtggcctcgacgattatcaccacgttctctggtgatattcttttcttc

SEQ ID NO: 12530 - DNA, 60 bp, Xenorhabdus bovienii
  Promoter location: Contig name=SeqID_16846; Position on contig =62119..62178bp; Strand=+
cattatactgcatcaattgtaacttgtttgcaataacataaattctttattttacttcat

SEQ ID NO: 12531 - DNA, 60 bp, Xenorhabdus bovienii
  Promoter location: Contig name=SeqID_16846; Position on contig =63011..63070bp; Strand=-
tttctctgacagtttttgggtgttttccaattcatgatttttatttttacaattagtatt

SEQ ID NO: 12532 - DNA, 60 bp, Xenorhabdus bovienii
  Promoter location: Contig name=SeqID_16846; Position on contig =67621..67680bp; Strand=+
tatcacggcaccccaatagcaccccaataaatcataactaattgatttataatatcattt

SEQ ID NO: 12533 - DNA, 60 bp, Xenorhabdus bovienii
  Promoter location: Contig name=SeqID_16846; Position on contig =75312..75371bp; Strand=-; Gene name=FepC
cccctgattttgtctatccgttgatgtttcgttgaacaaacgtcatttagaatttttggg

SEQ ID NO: 12534 - DNA, 60 bp, Xenorhabdus bovienii
  Promoter location: Contig name=SeqID_16846; Position on contig =77253..77312bp; Strand=-
gccgcattattgtgcggtctttttcttacctttaatatcccattgtatacaatgggatac

SEQ ID NO: 12535 - DNA, 60 bp, Xenorhabdus bovienii
  Promoter location: Contig name=SeqID_16846; Position on contig =77108..77167bp; Strand=+
aaccataattctcctgcacacaatgacaaaataaataacataataaataagatagatagg

SEQ ID NO: 12536 - DNA, 60 bp, Xenorhabdus bovienii
  Promoter location: Contig name=SeqID_16846; Position on contig =81084..81143bp; Strand=-
aaaagaaacgaaaaacagcgcttgagcctccagtgtggaggcttttttatttttatgacc

SEQ ID NO: 12537 - DNA, 60 bp, Xenorhabdus bovienii
  Promoter location: Contig name=SeqID_16846; Position on contig =80954..81013bp; Strand=+
atcctgggcttcctctacggctgcttttgcctttgcaaccagctcagtaagatgtgacat

SEQ ID NO: 12538 - DNA, 60 bp, Xenorhabdus bovienii
  Promoter location: Contig name=SeqID_16846; Position on contig =82229..82288bp; Strand=+
tcgccttcatctgtaccaggacggaatttgatttccttaacctgaataaccttttgtttc

SEQ ID NO: 12539 - DNA, 60 bp, Xenorhabdus bovienii
  Promoter location: Contig name=SeqID_16847; Position on contig =1824..1883bp; Strand=+; Gene name=PutP
gttcaacaatcatatgtgaattagttaacaacatagttatttagttccacaatggtacga

SEQ ID NO: 12540 - DNA, 60 bp, Xenorhabdus bovienii
  Promoter location: Contig name=SeqID_16847; Position on contig =7486..7545bp; Strand=+
gcatcacagatcatcagcaacaaaaaagatgccttaaaaatggggggtaaaattgagtat

SEQ ID NO: 12541 - DNA, 60 bp, Xenorhabdus bovienii
  Promoter location: Contig name=SeqID_16847; Position on contig =14636..14695bp; Strand=-; Gene name=UhpC
taatcatcatattcttcttgctgttttaaaaaacaagctaaaaaaaataacatcattttc

SEQ ID NO: 12542 - DNA, 60 bp, Xenorhabdus bovienii
  Promoter location: Contig name=SeqID_16847; Position on contig =16526..16585bp; Strand=-; Gene name=EntF
tattattttcttctatatagaaaatagttaatgagaactcttcgtttaacatcatcatcg

SEQ ID NO: 12543 - DNA, 60 bp, Xenorhabdus bovienii
  Promoter location: Contig name=SeqID_16847; Position on contig =17316..17375bp; Strand=+; Gene name=EntF
atgttaacgactaacagcattgatgtctccattcatcacaaaaagtgatgaaataaaatg

SEQ ID NO: 12544 - DNA, 60 bp, Xenorhabdus bovienii
  Promoter location: Contig name=SeqID_16847; Position on contig =20769..20828bp; Strand=+
ttaattatgaatagcaggcatgttccagaaggagcatgccttttatttatccttctattc

SEQ ID NO: 12545 - DNA, 60 bp, Xenorhabdus bovienii
  Promoter location: Contig name=SeqID_16847; Position on contig =23565..23624bp; Strand=-
ttatctcacagatcgcgcatttcctgctttggctcataacttccctgtatgttttatcgt

SEQ ID NO: 12546 - DNA, 60 bp, Xenorhabdus bovienii
  Promoter location: Contig name=SeqID_16847; Position on contig =24467..24526bp; Strand=-
ttggacataacaatctctgtaggttcaaacacactatggcgatggattatattacaaaat

SEQ ID NO: 12547 - DNA, 60 bp, Xenorhabdus bovienii
  Promoter location: Contig name=SeqID_16847; Position on contig =24065..24124bp; Strand=+
ccttgaaaaaatagcgcggaaatgaaataggaaatcagcagcgctggtagcataacagtg

SEQ ID NO: 12548 - DNA, 60 bp, Xenorhabdus bovienii
  Promoter location: Contig name=SeqID_16847; Position on contig =27433..27492bp; Strand=-
cggtattctgtcggtatcatttattttgattattcactcattggttatctaatcgaataa

SEQ ID NO: 12549 - DNA, 60 bp, Xenorhabdus bovienii
  Promoter location: Contig name=SeqID_16847; Position on contig =28642..28701bp; Strand=-; Gene name=FtsY
cattaagttattttctttacccgtttgcgggtgcaattaatgcttattaggataagctaa

SEQ ID NO: 12550 - DNA, 60 bp, Xenorhabdus bovienii
  Promoter location: Contig name=SeqID_16847; Position on contig =31827..31886bp; Strand=+; Gene name=RpoD
ccatattcataccatttagatgatttgaatatgatctctatgatggtaaaatagacatat

SEQ ID NO: 12551 - DNA, 60 bp, Xenorhabdus bovienii
  Promoter location: Contig name=SeqID_16847; Position on contig =34512..34571bp; Strand=-
atgattattaatttattcaataagttgaaattaggagcaattttttgtttgcttacagca

SEQ ID NO: 12552 - DNA, 60 bp, Xenorhabdus bovienii
  Promoter location: Contig name=SeqID_16847; Position on contig =34558..34617bp; Strand=+
aaattaataatcatgtcaggagatttaacatggggtagagtagatggtatctttatagta

SEQ ID NO: 12553 - DNA, 60 bp, Xenorhabdus bovienii
  Promoter location: Contig name=SeqID_16847; Position on contig =36836..36895bp; Strand=+
aacaatatgtgtgctgttttttgttttgacataccctcgacaacgtatatattaagcagt

SEQ ID NO: 12554 - DNA, 60 bp, Xenorhabdus bovienii
  Promoter location: Contig name=SeqID_16847; Position on contig =44627..44686bp; Strand=+
ttaaaaaataaaaaataaaaaataaaaaataaaaaataaagatgatttatagttttctat

SEQ ID NO: 12555 - DNA, 60 bp, Xenorhabdus bovienii
  Promoter location: Contig name=SeqID_16847; Position on contig =45076..45135bp; Strand=+
ccaataataagcctgattgataatcatatcgggagtattcaggcaattaatacaaatgaa

SEQ ID NO: 12556 - DNA, 60 bp, Xenorhabdus bovienii
  Promoter location: Contig name=SeqID_16847; Position on contig =45502..45561bp; Strand=+; Gene name=LivK
gctttttactgcctcattgatttgatttacaggataaaactcctgtttaatatcatgata

SEQ ID NO: 12557 - DNA, 60 bp, Xenorhabdus bovienii
  Promoter location: Contig name=SeqID_16847; Position on contig =51405..51464bp; Strand=-
ccaaaaaaattaatttttatttccaataaatctataaattatgtttctattatatcattc

SEQ ID NO: 12558 - DNA, 60 bp, Xenorhabdus bovienii
  Promoter location: Contig name=SeqID_16847; Position on contig =51789..51848bp; Strand=+
ataaggtaagtttaatttggctctttgtaatatagattattatttttaatatcagttaat

SEQ ID NO: 12559 - DNA, 60 bp, Xenorhabdus bovienii
  Promoter location: Contig name=SeqID_16847; Position on contig =62859..62918bp; Strand=-; Gene name=ProP
tctgaccaactccatcatttttaacattgataatcacagagaacatatctgatttttcca

SEQ ID NO: 12560 - DNA, 60 bp, Xenorhabdus bovienii
  Promoter location: Contig name=SeqID_16847; Position on contig =64667..64726bp; Strand=-; Gene name=HipB
ctatatccgtaataaactgcctgataccgtcccttacatgtatcaggtatattcattaat

SEQ ID NO: 12561 - DNA, 60 bp, Xenorhabdus bovienii
  Promoter location: Contig name=SeqID_16848; Position on contig =2871..2930bp; Strand=-; Gene name=TrmA
atggaccttttccatcaattgattttcataatcttccgttggcaagacattctgcattat

SEQ ID NO: 12562 - DNA, 60 bp, Xenorhabdus bovienii
  Promoter location: Contig name=SeqID_16848; Position on contig =2657..2716bp; Strand=+; Gene name=TrmA
gataaaaggatacgtttgttatttgtcatgagagaatggcatctaactatattgaatcta

SEQ ID NO: 12563 - DNA, 60 bp, Xenorhabdus bovienii
  Promoter location: Contig name=SeqID_16848; Position on contig =5277..5336bp; Strand=-
ttgcatagaggaaagacctgtttttacacaaaataacaactctatcttaacattacttga

SEQ ID NO: 12564 - DNA, 60 bp, Xenorhabdus bovienii
  Promoter location: Contig name=SeqID_16848; Position on contig =4821..4880bp; Strand=+
catgaacgttgaaacagaggttcggatgacgctgccgccttttgcgatacgctgacgcgc

SEQ ID NO: 12565 - DNA, 60 bp, Xenorhabdus bovienii
  Promoter location: Contig name=SeqID_16848; Position on contig =5242..5301bp; Strand=+; Gene name=Lpd
taggataaaaaccgtatggtcattaggttattacatcaagtaatgttaagatagagttgt

SEQ ID NO: 12566 - DNA, 60 bp, Xenorhabdus bovienii
  Promoter location: Contig name=SeqID_16848; Position on contig =7678..7737bp; Strand=-
aaaatgcctgaaatcacaagcatttgatagttttattccctcgtgcgtataatgatttat

SEQ ID NO: 12567 - DNA, 60 bp, Xenorhabdus bovienii
  Promoter location: Contig name=SeqID_16848; Position on contig =7728..7787bp; Strand=+
caggcattttttatcgaaataccttatgagaaatcaaaaaaattattattagaaagctgc

SEQ ID NO: 12568 - DNA, 60 bp, Xenorhabdus bovienii
  Promoter location: Contig name=SeqID_16848; Position on contig =10576..10635bp; Strand=+
acaaacgcgacaacttcacaattgtcataatgttctttcaaccaaggaataatcgcagat

SEQ ID NO: 12569 - DNA, 60 bp, Xenorhabdus bovienii
  Promoter location: Contig name=SeqID_16848; Position on contig =12697..12756bp; Strand=-; Gene name=ArgE
gttcagcatcggttgcgctgatggaaggtgtggcaatgagctgatgatataatttaataa

SEQ ID NO: 12570 - DNA, 60 bp, Xenorhabdus bovienii
  Promoter location: Contig name=SeqID_16848; Position on contig =12582..12641bp; Strand=+; Gene name=ArgE
tcaccttgtagtagtaacccaatcacattactgcatttatattcagttataatgcatgaa

SEQ ID NO: 12571 - DNA, 60 bp, Xenorhabdus bovienii
  Promoter location: Contig name=SeqID_16848; Position on contig =14067..14126bp; Strand=+; Gene name=MetF
catttcggataagtcactttgctgttgactaaacatattgcttcgcccattctatttaga

SEQ ID NO: 12572 - DNA, 60 bp, Xenorhabdus bovienii
  Promoter location: Contig name=SeqID_16848; Position on contig =19086..19145bp; Strand=-
cagccaatcagatctgcttataaaaaataagctgctattaaatttcataaaattcgccca

SEQ ID NO: 12573 - DNA, 60 bp, Xenorhabdus bovienii
  Promoter location: Contig name=SeqID_16848; Position on contig =22953..23012bp; Strand=-; Gene name=MetJ
aataattttagatgtctagatgtattgacgtctatctttccagtcgttattctttggtga

SEQ ID NO: 12574 - DNA, 60 bp, Xenorhabdus bovienii
  Promoter location: Contig name=SeqID_16848; Position on contig =23006..23065bp; Strand=+; Gene name=MetJ
aattatttaaggtttaattgtacaattggctcattgtccccattttttatgttagctccg

SEQ ID NO: 12575 - DNA, 60 bp, Xenorhabdus bovienii
  Promoter location: Contig name=SeqID_16848; Position on contig =23939..23998bp; Strand=+; Gene name=PriA
atcatacagaatatcggtttattgcgcaatgaaatctgctgatttgctatgataccctta

SEQ ID NO: 12576 - DNA, 60 bp, Xenorhabdus bovienii
  Promoter location: Contig name=SeqID_16848; Position on contig =26377..26436bp; Strand=+; Gene name=PurR
cacattttttatgcaaacaaagtaacagattgatctgttactttgtttaaaatgcactta

SEQ ID NO: 12577 - DNA, 60 bp, Xenorhabdus bovienii
  Promoter location: Contig name=SeqID_16848; Position on contig =28486..28545bp; Strand=+; Gene name=HslV
gtgcttttccagcaatacagcttgcaattgtggcataacaagccaaagtaccgtgtgtaa

SEQ ID NO: 12578 - DNA, 60 bp, Xenorhabdus bovienii
  Promoter location: Contig name=SeqID_16848; Position on contig =30479..30538bp; Strand=+; Gene name=MenA
atgaagaaatgggaggcttgcctcccatttcttcattttcattgcaacaaaatttatcac

SEQ ID NO: 12579 - DNA, 60 bp, Xenorhabdus bovienii
  Promoter location: Contig name=SeqID_16848; Position on contig =31710..31769bp; Strand=-; Gene name=MenG
caaaatacggccactgccattttcttcaagcacatcataaagcaggccattgtcttcaaa

SEQ ID NO: 12580 - DNA, 60 bp, Xenorhabdus bovienii
  Promoter location: Contig name=SeqID_16848; Position on contig =31501..31560bp; Strand=+; Gene name=MenG
cataaattttaagattgatgattttgccaacactagcttgaaaaggatatactgtctgtc

SEQ ID NO: 12581 - DNA, 60 bp, Xenorhabdus bovienii
  Promoter location: Contig name=SeqID_16848; Position on contig =32500..32559bp; Strand=-
ttgttcatcatggaaatgtgatctcgcttgcatttcggattagtcactatatttctcgtt

SEQ ID NO: 12582 - DNA, 60 bp, Xenorhabdus bovienii
  Promoter location: Contig name=SeqID_16848; Position on contig =32310..32369bp; Strand=+
gctgcgttcctttctttcagttcttcaatttccatttgcaggagagttatagtatcaatc

SEQ ID NO: 12583 - DNA, 60 bp, Xenorhabdus bovienii
  Promoter location: Contig name=SeqID_16848; Position on contig =36419..36478bp; Strand=-
gcgcgttatccattgattaagctgaatttaaataaattttagtttaataaactgtactta

SEQ ID NO: 12584 - DNA, 60 bp, Xenorhabdus bovienii
  Promoter location: Contig name=SeqID_16848; Position on contig =36959..37018bp; Strand=-; Gene name=Hmp
atgctgcgagccgagggctgagtttcccttcaggaacggtgactaaataaaattccagac

SEQ ID NO: 12585 - DNA, 60 bp, Xenorhabdus bovienii
  Promoter location: Contig name=SeqID_16848; Position on contig =36527..36586bp; Strand=+; Gene name=Hmp
cgttagatgtgattgacttaacaaatttatattttttccagacaggatacaatttcacat

SEQ ID NO: 12586 - DNA, 60 bp, Xenorhabdus bovienii
  Promoter location: Contig name=SeqID_16848; Position on contig =38228..38287bp; Strand=-
tatctttactgacaatgactttatattcatgcagggggatttcagggtattttttgttgt

SEQ ID NO: 12587 - DNA, 60 bp, Xenorhabdus bovienii
  Promoter location: Contig name=SeqID_16848; Position on contig =37759..37818bp; Strand=+
agtagcacccagccaccatgtttattccggtcatgcagacgtttcgctataatcgctgct

SEQ ID NO: 12588 - DNA, 60 bp, Xenorhabdus bovienii
  Promoter location: Contig name=SeqID_16848; Position on contig =40704..40763bp; Strand=-
tttaaattatttctgcgtcatactgctttctgtcagcttttatggcgataccataaatag

SEQ ID NO: 12589 - DNA, 60 bp, Xenorhabdus bovienii
  Promoter location: Contig name=SeqID_16848; Position on contig =42302..42361bp; Strand=-
gcgtcagaaaataaacataatcttaatgcagactgggtgtttttccgtatcatagatgaa

SEQ ID NO: 12590 - DNA, 60 bp, Xenorhabdus bovienii
  Promoter location: Contig name=SeqID_16848; Position on contig =42194..42253bp; Strand=+
acttgtagatgtaatatttaccaatctgctgactgatcccctaacgggaaaatttacggc

SEQ ID NO: 12591 - DNA, 60 bp, Xenorhabdus bovienii
  Promoter location: Contig name=SeqID_16848; Position on contig =44962..45021bp; Strand=-
tgggaataacgtgtccttagcccgttgttatcttgaccaatcttgattatcttaccttct

SEQ ID NO: 12592 - DNA, 60 bp, Xenorhabdus bovienii
  Promoter location: Contig name=SeqID_16848; Position on contig =46177..46236bp; Strand=-; Gene name=XerC
aagtatgccttaggacatgggttgcctgtcctttaggtaagtcgggttttactgtatgca

SEQ ID NO: 12593 - DNA, 60 bp, Xenorhabdus bovienii
  Promoter location: Contig name=SeqID_16848; Position on contig =45938..45997bp; Strand=+; Gene name=XerC
attaaggggagtggtattggtttttttcacaaagcatcgtaacagatagattttcttccc

SEQ ID NO: 12594 - DNA, 60 bp, Xenorhabdus bovienii
  Promoter location: Contig name=SeqID_16848; Position on contig =46425..46484bp; Strand=+
accgatcgtccacactcaaaaactttcaaatactttctaaccctttcgtatttttttatg

SEQ ID NO: 12595 - DNA, 60 bp, Xenorhabdus bovienii
  Promoter location: Contig name=SeqID_16848; Position on contig =47381..47440bp; Strand=-; Gene name=OmpR
acgtggcatcatgatatccagtagtagcagatcgattgaagaatcgatatattgtaatgc

SEQ ID NO: 12596 - DNA, 60 bp, Xenorhabdus bovienii
  Promoter location: Contig name=SeqID_16848; Position on contig =49895..49954bp; Strand=+
aaacttaaaccattaaaaagtactttatcaaatagatgaatagctgtcatattttcagca

SEQ ID NO: 12597 - DNA, 60 bp, Xenorhabdus bovienii
  Promoter location: Contig name=SeqID_16848; Position on contig =50634..50693bp; Strand=+; Gene name=TagD (BS)
caaaaccttcataatttttccttgtgaggaaaaaaaagccaaggctgcagcatatcatgg

SEQ ID NO: 12598 - DNA, 60 bp, Xenorhabdus bovienii
  Promoter location: Contig name=SeqID_16848; Position on contig =61345..61404bp; Strand=-; Gene name=CpsB
aataataatcggagattgatgctcaataaatataagtctctgcaatgtatcttgaagcat

SEQ ID NO: 12599 - DNA, 60 bp, Xenorhabdus bovienii
  Promoter location: Contig name=SeqID_16848; Position on contig =61098..61157bp; Strand=+; Gene name=CpsB
aatactgttattacggcaccttaatttatatagataatacacgattttctcatcagaaaa

SEQ ID NO: 12600 - DNA, 60 bp, Xenorhabdus bovienii
  Promoter location: Contig name=SeqID_16848; Position on contig =65003..65062bp; Strand=+
tgaaaataaaaatcttgaaaatcaataaaacaaaataatatctaaataaaaatgcatata

SEQ ID NO: 12601 - DNA, 60 bp, Xenorhabdus bovienii
  Promoter location: Contig name=SeqID_16848; Position on contig =66563..66622bp; Strand=+; Gene name=InsB
gagtttagtgcgggtcattttcttatgataaagcgcttttccatttttatcctgaccgtg

SEQ ID NO: 12602 - DNA, 60 bp, Xenorhabdus bovienii
  Promoter location: Contig name=SeqID_16848; Position on contig =68560..68619bp; Strand=-; Gene name=CspR (BS)
gtttagcatgttttaatcagattgttacagatatagttgtaattttctacagtatccatt

SEQ ID NO: 12603 - DNA, 60 bp, Xenorhabdus bovienii
  Promoter location: Contig name=SeqID_16848; Position on contig =68425..68484bp; Strand=+; Gene name=CspR (BS)
agaatgctgctcctgtcataatgatctaaataagatattaggaaacggtaaactttattg

SEQ ID NO: 12604 - DNA, 60 bp, Xenorhabdus bovienii
  Promoter location: Contig name=SeqID_16848; Position on contig =72135..72194bp; Strand=-; Gene name=NlpD
tgggttggcgctaattggctgtaattgacgcagcacacaggtatactctgctaccttaga

SEQ ID NO: 12605 - DNA, 60 bp, Xenorhabdus bovienii
  Promoter location: Contig name=SeqID_16848; Position on contig =72282..72341bp; Strand=+; Gene name=NlpD
acactgagtcgatacaggattttcaccaataaatgggctaaattaactaaaatttatatt

SEQ ID NO: 12606 - DNA, 60 bp, Xenorhabdus bovienii
  Promoter location: Contig name=SeqID_16848; Position on contig =77190..77249bp; Strand=+; Gene name=WcaG
caggattttcccctgtttaagctgctgtcgtcagtaatgttaagtgctattatacgcttc

SEQ ID NO: 12607 - DNA, 60 bp, Xenorhabdus bovienii
  Promoter location: Contig name=SeqID_16848; Position on contig =81210..81269bp; Strand=-
ttctattcttttcttttcctgtggttatcataggtgaaaatctttttattctatggaagg

SEQ ID NO: 12608 - DNA, 60 bp, Xenorhabdus bovienii
  Promoter location: Contig name=SeqID_16848; Position on contig =82301..82360bp; Strand=-; Gene name=RfaF
agtggccgatggtaagtaggtaaattgcgctgcctgtttacactgagtaatataaactca

SEQ ID NO: 12609 - DNA, 60 bp, Xenorhabdus bovienii
  Promoter location: Contig name=SeqID_16848; Position on contig =86930..86989bp; Strand=-
gtaaaatgcggatatgttgctcgcctctctcccaaaaggacaagggggtaaactttttgt

SEQ ID NO: 12610 - DNA, 60 bp, Xenorhabdus bovienii
  Promoter location: Contig name=SeqID_16848; Position on contig =86768..86827bp; Strand=+
ccatgatgtcttagttttatgatcaaaatcttttcaaatcgagtggttattttgcccatt

SEQ ID NO: 12611 - DNA, 60 bp, Xenorhabdus bovienii
  Promoter location: Contig name=SeqID_16848; Position on contig =90389..90448bp; Strand=+; Gene name=RfaL
tggggttcaattccccggcgactggtttcaacctctggtagctccggcatactgactcct

SEQ ID NO: 12612 - DNA, 60 bp, Xenorhabdus bovienii
  Promoter location: Contig name=SeqID_16848; Position on contig =95291..95350bp; Strand=-; Gene name=RfaG
accatctattcgtaatggtgtttgttttcatctgattacaaagtagttattttttgctta

SEQ ID NO: 12613 - DNA, 60 bp, Xenorhabdus bovienii
  Promoter location: Contig name=SeqID_16848; Position on contig =96513..96572bp; Strand=-
agcctggttgaagataggttatccatggacgtaacatctcgttccgttatactaacgcct

SEQ ID NO: 12614 - DNA, 60 bp, Xenorhabdus bovienii
  Promoter location: Contig name=SeqID_16848; Position on contig =96403..96462bp; Strand=+
aggatgcgaatctcttgccctccccaaccacacgatgattcagtgtgtaagatatttaag

SEQ ID NO: 12615 - DNA, 60 bp, Xenorhabdus bovienii
  Promoter location: Contig name=SeqID_16848; Position on contig =97154..97213bp; Strand=-
tcttgggtttggcgagaagagcctatctcagtaagtttttttattgggataatgtgagtc

SEQ ID NO: 12616 - DNA, 60 bp, Xenorhabdus bovienii
  Promoter location: Contig name=SeqID_16848; Position on contig =96772..96831bp; Strand=+
accagcttaattttatcgcgaatacctttagccatttttcagctccttagtatttctcac

SEQ ID NO: 12617 - DNA, 60 bp, Xenorhabdus bovienii
  Promoter location: Contig name=SeqID_16848; Position on contig =98166..98225bp; Strand=-
agctgtttgctggaaaatcctgccattctgattatccacatgtaagttacaattacctaa

SEQ ID NO: 12618 - DNA, 60 bp, Xenorhabdus bovienii
  Promoter location: Contig name=SeqID_16848; Position on contig =97734..97793bp; Strand=+
ctggacatatttgcatagccccatccctttatgtgaacaaaaatcggcataatccgcaga

SEQ ID NO: 12619 - DNA, 60 bp, Xenorhabdus bovienii
  Promoter location: Contig name=SeqID_16848; Position on contig =99884..99943bp; Strand=+; Gene name=AcrR
accgtcaaccgattttcatattttttgcccatgatcgtggtgggcaaaaaatagctggat

SEQ ID NO: 12620 - DNA, 60 bp, Xenorhabdus bovienii
  Promoter location: Contig name=SeqID_16848; Position on contig =100604..100663bp; Strand=+
tttcatgctgagaatgataacgtgcggttttttcgttgaattgtgttaacatgcatcttc

SEQ ID NO: 12621 - DNA, 60 bp, Xenorhabdus bovienii
  Promoter location: Contig name=SeqID_16848; Position on contig =102292..102351bp; Strand=-
ataacgccccgcgtagatgcaggataggcattcgcctcgttaggccgtataatgcgcccc

SEQ ID NO: 12622 - DNA, 60 bp, Xenorhabdus bovienii
  Promoter location: Contig name=SeqID_16848; Position on contig =103268..103327bp; Strand=+
gaacaaatcataaagccagtatatactttgttatatctggcttttttactatcagagcat

SEQ ID NO: 12623 - DNA, 60 bp, Xenorhabdus bovienii
  Promoter location: Contig name=SeqID_16848; Position on contig =105618..105677bp; Strand=-
tgacatattgttgaaccctacattaatttattccaagatttatcttgtttaatttatcgt

SEQ ID NO: 12624 - DNA, 60 bp, Xenorhabdus bovienii
  Promoter location: Contig name=SeqID_16848; Position on contig =105576..105635bp; Strand=+
atgattattgtcctgaacaccagttgagttgtgaaaagtcttacgataaattaaacaaga

SEQ ID NO: 12625 - DNA, 60 bp, Xenorhabdus bovienii
  Promoter location: Contig name=SeqID_16848; Position on contig =108807..108866bp; Strand=-
tccttcaaaccgtgaccagagccgttttcaggacgttattcaatataatcgtgtttcctg

SEQ ID NO: 12626 - DNA, 60 bp, Xenorhabdus bovienii
  Promoter location: Contig name=SeqID_16848; Position on contig =109158..109217bp; Strand=-; Gene name=PhnF
atcacataatgacaatattggactttcattggccttaataattgatgtaaagtataaatc

SEQ ID NO: 12627 - DNA, 60 bp, Xenorhabdus bovienii
  Promoter location: Contig name=SeqID_16848; Position on contig =109115..109174bp; Strand=+; Gene name=PhnF
tttaaagtaatactgccaaactcccgacttcttatataagcaagatttatactttacatc

SEQ ID NO: 12628 - DNA, 60 bp, Xenorhabdus bovienii
  Promoter location: Contig name=SeqID_16848; Position on contig =110695..110754bp; Strand=+; Gene name=AcrR
gtgattgagacatgattgtcgttccttgcattcgttgttgaggcctctataatgcgagct

SEQ ID NO: 12629 - DNA, 60 bp, Xenorhabdus bovienii
  Promoter location: Contig name=SeqID_16848; Position on contig =117661..117720bp; Strand=-
tccaaagtagcctcttgctaattttaagtttaataggggatgtattctattattttgtaa

SEQ ID NO: 12630 - DNA, 60 bp, Xenorhabdus bovienii
  Promoter location: Contig name=SeqID_16848; Position on contig =117648..117707bp; Strand=+; Gene name=MhpC
aaaaatagtttaattacaaaataatagaatacatcccctattaaacttaaaattagcaag

SEQ ID NO: 12631 - DNA, 60 bp, Xenorhabdus bovienii
  Promoter location: Contig name=SeqID_16848; Position on contig =118750..118809bp; Strand=+
tataaatatacttaagacaaggttatataaataataacaatcaaatataacatactgttt

SEQ ID NO: 12632 - DNA, 60 bp, Xenorhabdus bovienii
  Promoter location: Contig name=SeqID_16848; Position on contig =120171..120230bp; Strand=-
gggattacccatgacggttaaagctattgatgcttataggtttatggtttaattttaacc

SEQ ID NO: 12633 - DNA, 60 bp, Xenorhabdus bovienii
  Promoter location: Contig name=SeqID_16848; Position on contig =119789..119848bp; Strand=+
ataaatagaaacaatagctattatcacgatagaaaatataacttttttattctttataag

SEQ ID NO: 12634 - DNA, 60 bp, Xenorhabdus bovienii
  Promoter location: Contig name=SeqID_16848; Position on contig =121237..121296bp; Strand=-
tgtttcgttcattgcgaatttcgtttatttcgtttatttcgtttatactaacaaaaatat

SEQ ID NO: 12635 - DNA, 60 bp, Xenorhabdus bovienii
  Promoter location: Contig name=SeqID_16848; Position on contig =126700..126759bp; Strand=-; Gene name=FdhD
agtggctccgcaaatctcgtcgattattaacctgtttcctgaatttgcattatccattag

SEQ ID NO: 12636 - DNA, 60 bp, Xenorhabdus bovienii
  Promoter location: Contig name=SeqID_16848; Position on contig =126532..126591bp; Strand=+; Gene name=FdhD
acggaaaacccgtaggtatgcaattttaggcctagatttatgaatgtttttcttttcatt

SEQ ID NO: 12637 - DNA, 60 bp, Xenorhabdus bovienii
  Promoter location: Contig name=SeqID_16848; Position on contig =128403..128462bp; Strand=-
tttaatattaggaattgaatttgagtgggaataaataaatttaatgataaatttaatgat

SEQ ID NO: 12638 - DNA, 60 bp, Xenorhabdus bovienii
  Promoter location: Contig name=SeqID_16848; Position on contig =128750..128809bp; Strand=+
aattttaattaataaaccctgtaaaacccagaataaataataataattatcatttacatt

SEQ ID NO: 12639 - DNA, 60 bp, Xenorhabdus bovienii
  Promoter location: Contig name=SeqID_16848; Position on contig =129647..129706bp; Strand=+; Gene name=OmpU
taatggttcagagaacaatgccatttttggcattgttctctgttttgtttattgccgttt

SEQ ID NO: 12640 - DNA, 60 bp, Xenorhabdus bovienii
  Promoter location: Contig name=SeqID_16848; Position on contig =135644..135703bp; Strand=-; Gene name=FabG
ataatgttgcttagatgaactcgctttttattaagcgggttcatctttatgatgatatct

SEQ ID NO: 12641 - DNA, 60 bp, Xenorhabdus bovienii
  Promoter location: Contig name=SeqID_16848; Position on contig =144623..144682bp; Strand=-
aggttcttaattcatgaaattaactggctaagataaaaataattacaattcagtattaat

SEQ ID NO: 12642 - DNA, 60 bp, Xenorhabdus bovienii
  Promoter location: Contig name=SeqID_16848; Position on contig =145216..145275bp; Strand=-
attaatttaattaatggtgtttttatttttgtttgtaggattggttttcttatttattga

SEQ ID NO: 12643 - DNA, 60 bp, Xenorhabdus bovienii
  Promoter location: Contig name=SeqID_16848; Position on contig =145247..145306bp; Strand=+
aaaataaaaacaccattaattaaattaataacaaacaagaaagaatatattatttttttt

SEQ ID NO: 12644 - DNA, 60 bp, Xenorhabdus bovienii
  Promoter location: Contig name=SeqID_16848; Position on contig =150000..150059bp; Strand=-
tcgcgtcatcttagattgatggattgactaggggtagtacattttattacaatcctgcct

SEQ ID NO: 12645 - DNA, 60 bp, Xenorhabdus bovienii
  Promoter location: Contig name=SeqID_16848; Position on contig =150216..150275bp; Strand=+
gcaaggatcatacaccgatccttacaccttaatcgtgatcatcatgttgttttcacttca

SEQ ID NO: 12646 - DNA, 60 bp, Xenorhabdus bovienii
  Promoter location: Contig name=SeqID_16848; Position on contig =159273..159332bp; Strand=-; Gene name=Asd
atcgtcactaatatagtgcttaatatgagaaacataagaatttttgatatcttatatgaa

SEQ ID NO: 12647 - DNA, 60 bp, Xenorhabdus bovienii
  Promoter location: Contig name=SeqID_16848; Position on contig =160709..160768bp; Strand=-
tttgctgaaatacggttgccatagcatataaatttacttgcaccttttatcatattttgt

SEQ ID NO: 12648 - DNA, 60 bp, Xenorhabdus bovienii
  Promoter location: Contig name=SeqID_16848; Position on contig =161162..161221bp; Strand=-
gtttcatttcggatggtggaattatattattaagcattcttcatccttataattattata

SEQ ID NO: 12649 - DNA, 60 bp, Xenorhabdus bovienii
  Promoter location: Contig name=SeqID_16848; Position on contig =161541..161600bp; Strand=-; Gene name=HemK
ctgccagttcctatatcaagaacttttttcccagtaaaatcatgatctataatgtttttt

SEQ ID NO: 12650 - DNA, 60 bp, Xenorhabdus bovienii
  Promoter location: Contig name=SeqID_16848; Position on contig =161115..161174bp; Strand=+; Gene name=HemK
cagatcatactgaaaaacaacattactattactcataccatagaaaatataataattata

SEQ ID NO: 12651 - DNA, 60 bp, Xenorhabdus bovienii
  Promoter location: Contig name=SeqID_16848; Position on contig =166169..166228bp; Strand=-
ataactcattattctatcattctttatctaatatttttttagtttgttaaacttaataga

SEQ ID NO: 12652 - DNA, 60 bp, Xenorhabdus bovienii
  Promoter location: Contig name=SeqID_16848; Position on contig =166619..166678bp; Strand=-
aatgagtatttttttaatttatattgtattgttttattaaaagatgttagccttattaat

SEQ ID NO: 12653 - DNA, 60 bp, Xenorhabdus bovienii
  Promoter location: Contig name=SeqID_16848; Position on contig =166371..166430bp; Strand=+
aaataaaaataactgcaaaaaagataattcctaccaatatatctgtaaaaataataagta

SEQ ID NO: 12654 - DNA, 60 bp, Xenorhabdus bovienii
  Promoter location: Contig name=SeqID_16848; Position on contig =170272..170331bp; Strand=-
ggcttttttgcattgcgaaatatgtagcaatttattttgcaaacaggtttactttcatac

SEQ ID NO: 12655 - DNA, 60 bp, Xenorhabdus bovienii
  Promoter location: Contig name=SeqID_16848; Position on contig =170196..170255bp; Strand=+
ccagcggcaaggatcacgacactttttgcgctatttgcactaatagacataataaacctg

SEQ ID NO: 12656 - DNA, 60 bp, Xenorhabdus bovienii
  Promoter location: Contig name=SeqID_16848; Position on contig =177546..177605bp; Strand=-; Gene name=GidB
gataaatataactaatgtttttggtcgaatgtgatatacatcacgtttaatttttcagtc

SEQ ID NO: 12657 - DNA, 60 bp, Xenorhabdus bovienii
  Promoter location: Contig name=SeqID_16848; Position on contig =180490..180549bp; Strand=-
ttaattaacggcgatcaaacttacttggtctaacgtctaaacttgagtagaatcccctcc

SEQ ID NO: 12658 - DNA, 60 bp, Xenorhabdus bovienii
  Promoter location: Contig name=SeqID_16848; Position on contig =181289..181348bp; Strand=-; Gene name=Lrp
ggtttataactacattatccacaggtagatcccagtagactcacagcgtacaatagccgc

SEQ ID NO: 12659 - DNA, 60 bp, Xenorhabdus bovienii
  Promoter location: Contig name=SeqID_16848; Position on contig =181907..181966bp; Strand=-; Gene name=AsnA
ttagtgactctgtgtcctgttgatatagattaagcaacagaatgaggtataaattcaata

SEQ ID NO: 12660 - DNA, 60 bp, Xenorhabdus bovienii
  Promoter location: Contig name=SeqID_16848; Position on contig =181850..181909bp; Strand=+; Gene name=AsnA
tttttatggtgtaaaaattattgtttataaatattactcgatatttttattatcagatat

SEQ ID NO: 12661 - DNA, 60 bp, Xenorhabdus bovienii
  Promoter location: Contig name=SeqID_16848; Position on contig =186012..186071bp; Strand=-
ggatcaataaataatcaccaaaatctttgcatagattgaattttatctataaataaataa

SEQ ID NO: 12662 - DNA, 60 bp, Xenorhabdus bovienii
  Promoter location: Contig name=SeqID_16848; Position on contig =185980..186039bp; Strand=+
atgtacaccatggttcgaatagttaccttcatttatttatttatagataaaattcaatct

SEQ ID NO: 12663 - DNA, 60 bp, Xenorhabdus bovienii
  Promoter location: Contig name=SeqID_16848; Position on contig =193579..193638bp; Strand=-
tggtgttatcgacaacaatgattaaatctatacagtaggataatgtgttaaatagaaggg

SEQ ID NO: 12664 - DNA, 60 bp, Xenorhabdus bovienii
  Promoter location: Contig name=SeqID_16848; Position on contig =193550..193609bp; Strand=+
gttcttttaactgtatggatgtcacatttcccttctatttaacacattatcctactgtat

SEQ ID NO: 12665 - DNA, 60 bp, Xenorhabdus bovienii
  unsure (1)..(60): unsure at all n locations
  Promoter location: Contig name=SeqID_16849; Position on contig =2..61bp; Strand=+
nnnnnnnnnnnnnnnnnnnnnnnnnnnntgccgatgaagaaaatgtttttgacgatttca

SEQ ID NO: 12666 - DNA, 60 bp, Xenorhabdus bovienii
  Promoter location: Contig name=SeqID_16850; Position on contig =402..461bp; Strand=-
accaaaattccactcaaacttttccttaaaacagatttatctccggttaaattatgatat

SEQ ID NO: 12667 - DNA, 60 bp, Xenorhabdus bovienii
  Promoter location: Contig name=SeqID_16853; Position on contig =990..1049bp; Strand=+
ggctttattttttatctattccgatttatctcttaaaaacattgagctattcttgctcct

SEQ ID NO: 12668 - DNA, 60 bp, Xenorhabdus bovienii
  Promoter location: Contig name=SeqID_16853; Position on contig =2936..2995bp; Strand=-; Gene name=Alr
taatatctaagtgtgacattgtaacttgatggcttttaaccaatggtaatatcaagctgc

SEQ ID NO: 12669 - DNA, 60 bp, Xenorhabdus bovienii
  Promoter location: Contig name=SeqID_16853; Position on contig =5532..5591bp; Strand=-; Gene name=FadR
ataaaaatgtgattcaaatcctaaaattaaattaataatgttgcagtctattattctata

SEQ ID NO: 12670 - DNA, 60 bp, Xenorhabdus bovienii
  Promoter location: Contig name=SeqID_16853; Position on contig =6804..6863bp; Strand=-; Gene name=NhaB
gaataattccgttttttatgattcctttcactctttcgctgtttatttactatgtaacta

SEQ ID NO: 12671 - DNA, 60 bp, Xenorhabdus bovienii
  Promoter location: Contig name=SeqID_16853; Position on contig =6837..6896bp; Strand=+; Gene name=NhaB
aaggaatcataaaaaacggaattattcgctgattaattatgtcctgatacccttaaattg

SEQ ID NO: 12672 - DNA, 60 bp, Xenorhabdus bovienii
  Promoter location: Contig name=SeqID_16853; Position on contig =9847..9906bp; Strand=-
tgtacatttactacctgatggattatgaaatatttaataactatttgtataataaccaga

SEQ ID NO: 12673 - DNA, 60 bp, Xenorhabdus bovienii
  Promoter location: Contig name=SeqID_16853; Position on contig =10519..10578bp; Strand=+
caggagatactatctatcaatgggttaaagacgggaaatcccacctttatacttttatga

SEQ ID NO: 12674 - DNA, 60 bp, Xenorhabdus bovienii
  Promoter location: Contig name=SeqID_16853; Position on contig =12179..12238bp; Strand=-
ggatttttacacaagactcatcagttaaaacaaaccgccatgttagttaatatattcgga

SEQ ID NO: 12675 - DNA, 60 bp, Xenorhabdus bovienii
  Promoter location: Contig name=SeqID_16853; Position on contig =13550..13609bp; Strand=-
cgaatggtgtgatgagttcgatggattttaattccaccctgtcagcgtacgctgacaggg

SEQ ID NO: 12676 - DNA, 60 bp, Xenorhabdus bovienii
  Promoter location: Contig name=SeqID_16853; Position on contig =15111..15170bp; Strand=-
tttgtccatggtgaaattagatggtgtcgtcatgagaaatttcgtgcaataataatgccc

SEQ ID NO: 12677 - DNA, 60 bp, Xenorhabdus bovienii
  Promoter location: Contig name=SeqID_16853; Position on contig =15721..15780bp; Strand=-
tcctggaaaacggtttataaccgatttaatcgcgggtcaaaatcaggcattatcaacaaa

SEQ ID NO: 12678 - DNA, 60 bp, Xenorhabdus bovienii
  Promoter location: Contig name=SeqID_16853; Position on contig =18273..18332bp; Strand=-
atatatataaaatcatcattcatttaattgagatgaatttcaataagaatactaataggt

SEQ ID NO: 12679 - DNA, 60 bp, Xenorhabdus bovienii
  Promoter location: Contig name=SeqID_16853; Position on contig =19447..19506bp; Strand=-
tcacattgaccgataacgatggcttggccccctcctcgaatcgaaatcacaatactttct

SEQ ID NO: 12680 - DNA, 60 bp, Xenorhabdus bovienii
  Promoter location: Contig name=SeqID_16853; Position on contig =20632..20691bp; Strand=-
tgaaaatcacgtcaatgcagtcgatgaaataagagaaagaaagcaaataaaaaaagaaga

SEQ ID NO: 12681 - DNA, 60 bp, Xenorhabdus bovienii
  Promoter location: Contig name=SeqID_16853; Position on contig =23215..23274bp; Strand=+
agcctcgctgcggtcgggattcgattgagatagaagtctgacctaagtaaaatttctggt

SEQ ID NO: 12682 - DNA, 60 bp, Xenorhabdus bovienii
  Promoter location: Contig name=SeqID_16853; Position on contig =24387..24446bp; Strand=+
cttattattacttcgatactttttacgtaacctgaacccaagagtgataagataaatggc

SEQ ID NO: 12683 - DNA, 60 bp, Xenorhabdus bovienii
  Promoter location: Contig name=SeqID_16853; Position on contig =24925..24984bp; Strand=+
tgaggtctgacacaagcgtgagaactgtattaaaaccacagcaaaattaaaatggtcttc

SEQ ID NO: 12684 - DNA, 60 bp, Xenorhabdus bovienii
  Promoter location: Contig name=SeqID_16853; Position on contig =25281..25340bp; Strand=+
ttacaccaacaccccatgccatcagttaacgctggtggcttttttgttttcatcctattg

SEQ ID NO: 12685 - DNA, 60 bp, Xenorhabdus bovienii
  Promoter location: Contig name=SeqID_16853; Position on contig =27334..27393bp; Strand=-; Gene name=CaiC
ttagccgtttatagccttaagaacgattttttaaagggtaaatattttaagattgcctat

SEQ ID NO: 12686 - DNA, 60 bp, Xenorhabdus bovienii
  Promoter location: Contig name=SeqID_16853; Position on contig =29420..29479bp; Strand=-; Gene name=Slp
actattatcttcctaataattatcctttattggttcatcctgcttattactatttagaat

SEQ ID NO: 12687 - DNA, 60 bp, Xenorhabdus bovienii
  Promoter location: Contig name=SeqID_16853; Position on contig =33021..33080bp; Strand=-; Gene name=TdcF
atacagttttattgctgaattggctggtgattactactcagtattggcataattctgcca

SEQ ID NO: 12688 - DNA, 60 bp, Xenorhabdus bovienii
  Promoter location: Contig name=SeqID_16853; Position on contig =32962..33021bp; Strand=+; Gene name=TdcF
gcaagtacgccatttttcgcaaaatcgtctgacacgaaccgtctctttacaataaaatgt

SEQ ID NO: 12689 - DNA, 60 bp, Xenorhabdus bovienii
  Promoter location: Contig name=SeqID_16853; Position on contig =34260..34319bp; Strand=-; Gene name=Zwf
gctaattctgatatcacgtttttaaataattttattggcattaatggtttgatgtcttgg

SEQ ID NO: 12690 - DNA, 60 bp, Xenorhabdus bovienii
  Promoter location: Contig name=SeqID_16853; Position on contig =36365..36424bp; Strand=-; Gene name=RpiR
attacttcttaaacgttggaaattttcagtaaattgtcacagtgcggtataaatatcgac

SEQ ID NO: 12691 - DNA, 60 bp, Xenorhabdus bovienii
  Promoter location: Contig name=SeqID_16853; Position on contig =37518..37577bp; Strand=+; Gene name=PykF
tcagtatcattcttattgcggggttgataatcaagaatctaaatggttatcttacggtaa

SEQ ID NO: 12692 - DNA, 60 bp, Xenorhabdus bovienii
  Promoter location: Contig name=SeqID_16853; Position on contig =40147..40206bp; Strand=-; Gene name=NlpD
tgcattgccccctcgattattaacagacataaaagcggatgattgatatcatccgttttt

SEQ ID NO: 12693 - DNA, 60 bp, Xenorhabdus bovienii
  Promoter location: Contig name=SeqID_16854; Position on contig =703..762bp; Strand=-
ttaatgcatcagtgtaagccattgcgattacccttcatcagtatcgttaaaattgttatc

SEQ ID NO: 12694 - DNA, 60 bp, Xenorhabdus bovienii
  Promoter location: Contig name=SeqID_16854; Position on contig =659..718bp; Strand=+
caagaaatagacttatccacatcgttgtggataagtcagatattgataacaattttaacg

SEQ ID NO: 12695 - DNA, 60 bp, Xenorhabdus bovienii
  Promoter location: Contig name=SeqID_16854; Position on contig =1647..1706bp; Strand=+
tgggtggccaacttacatcgtgaattgctatttttagccagcccatctacgatagccaaa

SEQ ID NO: 12696 - DNA, 60 bp, Xenorhabdus bovienii
  Promoter location: Contig name=SeqID_16854; Position on contig =2948..3007bp; Strand=+
taggagtattaattaaccttatatcttgattatcacttttacagagcgataatcccctga

SEQ ID NO: 12697 - DNA, 60 bp, Xenorhabdus bovienii
  Promoter location: Contig name=SeqID_16854; Position on contig =4448..4507bp; Strand=-
gaaatcggctttaaggtagtgtttgacatgctgaatataaaacgttttaaaatcacgata

SEQ ID NO: 12698 - DNA, 60 bp, Xenorhabdus bovienii
  Promoter location: Contig name=SeqID_16854; Position on contig =4183..4242bp; Strand=+
gagacggtatctgaggtttgcttaagaagggaactcagtgcctgaggtacgatcaaagtt

SEQ ID NO: 12699 - DNA, 60 bp, Xenorhabdus bovienii
  Promoter location: Contig name=SeqID_16854; Position on contig =9855..9914bp; Strand=-; Gene name=PrpB
gtaagaaactgaaaatatatttgtatcccacttaatatataaacgttatatcccactcac

SEQ ID NO: 12700 - DNA, 60 bp, Xenorhabdus bovienii
  Promoter location: Contig name=SeqID_16854; Position on contig =15018..15077bp; Strand=-
accaggcaggcgagtcttgtatttttattttctaagagcctgcaatttttaataactttt

SEQ ID NO: 12701 - DNA, 60 bp, Xenorhabdus bovienii
  Promoter location: Contig name=SeqID_16854; Position on contig =15329..15388bp; Strand=+
ctaaaaaaataaaattagtttttttaataagtccatgaattatcttgaaaaatgaaattt

SEQ ID NO: 12702 - DNA, 60 bp, Xenorhabdus bovienii
  Promoter location: Contig name=SeqID_16854; Position on contig =17776..17835bp; Strand=-
gaaatccgccataaaaagattgaaattacatagtttcttaatttagcgatgatcagataa

SEQ ID NO: 12703 - DNA, 60 bp, Xenorhabdus bovienii
  Promoter location: Contig name=SeqID_16854; Position on contig =17569..17628bp; Strand=+
actaagcaagcctcggagataagcgagactgcgttgtcgtgggccggtagagtgaaataa

SEQ ID NO: 12704 - DNA, 60 bp, Xenorhabdus bovienii
  Promoter location: Contig name=SeqID_16854; Position on contig =18120..18179bp; Strand=-
atcttttcatttcctgcaagggatattaacacaacctgctgcctcaccatactctcagcc

SEQ ID NO: 12705 - DNA, 60 bp, Xenorhabdus bovienii
  Promoter location: Contig name=SeqID_16854; Position on contig =17861..17920bp; Strand=+
gtagtactagcattttttttgattaaatgtgctgatgttgttttttttaaaaaatgactg

SEQ ID NO: 12706 - DNA, 60 bp, Xenorhabdus bovienii
  Promoter location: Contig name=SeqID_16854; Position on contig =19666..19725bp; Strand=-
aactgtttgttttttatcgtcaaacatctccctctgctaatacaaggtaagataaaaaac

SEQ ID NO: 12707 - DNA, 60 bp, Xenorhabdus bovienii
  Promoter location: Contig name=SeqID_16854; Position on contig =19569..19628bp; Strand=+
ggtttcatcgatttccgtgggtagtgcctctttggtctcacccgttgtatcattcttgcc

SEQ ID NO: 12708 - DNA, 60 bp, Xenorhabdus bovienii
  Promoter location: Contig name=SeqID_16854; Position on contig =20471..20530bp; Strand=-
gcagcgacactgtacgaaagtaagtgttttttatttcgtacataagctataattagtaca

SEQ ID NO: 12709 - DNA, 60 bp, Xenorhabdus bovienii
  Promoter location: Contig name=SeqID_16854; Position on contig =20350..20409bp; Strand=+
tctgatagcaaatccagccgcctcgatttcacgacgctggttttctgtattctgttcaag

SEQ ID NO: 12710 - DNA, 60 bp, Xenorhabdus bovienii
  Promoter location: Contig name=SeqID_16854; Position on contig =20632..20691bp; Strand=+
aattttgattcatatatagtgttgattatttttttattagcatgcactattgtatatcga

SEQ ID NO: 12711 - DNA, 60 bp, Xenorhabdus bovienii
  Promoter location: Contig name=SeqID_16854; Position on contig =21779..21838bp; Strand=-; Gene name=AlkA
taacttaacttacacaggttaacttaacgtaagtcataaatcttcctaaaattggaactt

SEQ ID NO: 12712 - DNA, 60 bp, Xenorhabdus bovienii
  Promoter location: Contig name=SeqID_16854; Position on contig =21790..21849bp; Strand=+; Gene name=AlkA
ttaggaagatttatgacttacgttaagttaacctgtgtaagttaagttattctatgtgag

SEQ ID NO: 12713 - DNA, 60 bp, Xenorhabdus bovienii
  Promoter location: Contig name=SeqID_16854; Position on contig =23239..23298bp; Strand=+
ctttttagcttcgtaagtaataacgataacataaatttaattaaaactataattttatat

SEQ ID NO: 12714 - DNA, 60 bp, Xenorhabdus bovienii
  Promoter location: Contig name=SeqID_16854; Position on contig =27014..27073bp; Strand=+
tatcgcgtccggaaagcctttcagaccatcaacgcaagcaatgaggatatcattcagccc

SEQ ID NO: 12715 - DNA, 60 bp, Xenorhabdus bovienii
  Promoter location: Contig name=SeqID_16854; Position on contig =30387..30446bp; Strand=-
cgacactgcccgcgcagctccactactttagggtgcgcttttctggttatcctcggcttt

SEQ ID NO: 12716 - DNA, 60 bp, Xenorhabdus bovienii
  Promoter location: Contig name=SeqID_16854; Position on contig =30161..30220bp; Strand=+
cccagtgcacgtacagttgccgacagcatgttaatcatgtcctcggcataattttgttca

SEQ ID NO: 12717 - DNA, 60 bp, Xenorhabdus bovienii
  Promoter location: Contig name=SeqID_16854; Position on contig =32280..32339bp; Strand=+
tgtttttgttacaaatctatttcccacaagaattatcctacttctggaacaatggtggta

SEQ ID NO: 12718 - DNA, 60 bp, Xenorhabdus bovienii
  Promoter location: Contig name=SeqID_16854; Position on contig =35055..35114bp; Strand=+
aactccactaaccaatgagtaagccgtgcggtatcggttttattaggtagtctgactttc

SEQ ID NO: 12719 - DNA, 60 bp, Xenorhabdus bovienii
  Promoter location: Contig name=SeqID_16854; Position on contig =35661..35720bp; Strand=-
ggtatcgaccgcccggtaaaggtatttccactgacctttcactttgatataagtttcatc

SEQ ID NO: 12720 - DNA, 60 bp, Xenorhabdus bovienii
  Promoter location: Contig name=SeqID_16854; Position on contig =35409..35468bp; Strand=+
tgaatcatcagtaggaaacaattattgcaaccatttcatagatgagtgatttttactcag

SEQ ID NO: 12721 - DNA, 60 bp, Xenorhabdus bovienii
  Promoter location: Contig name=SeqID_16854; Position on contig =36060..36119bp; Strand=+; Gene name=RhtB
tgttaatgcgacagaacccttaatacgacataaccgaattattcatttagaatgtccgtc

SEQ ID NO: 12722 - DNA, 60 bp, Xenorhabdus bovienii
  Promoter location: Contig name=SeqID_16854; Position on contig =37912..37971bp; Strand=+
tcgactaatgacctgtgagcatgtcacggcttatcccttcctcctcttatagtaaagcca

SEQ ID NO: 12723 - DNA, 60 bp, Xenorhabdus bovienii
  Promoter location: Contig name=SeqID_16854; Position on contig =38833..38892bp; Strand=+; Gene name=ThiJ
aataagattgattcaggggaagaatgctattccgacaggtcacctgttatcctctggtca

SEQ ID NO: 12724 - DNA, 60 bp, Xenorhabdus bovienii
  Promoter location: Contig name=SeqID_16854; Position on contig =42208..42267bp; Strand=-; Gene name=InsB
ttaatctgaacaaagtgatggatgaagtggtcatgactccaaagcgttataatgatattt

SEQ ID NO: 12725 - DNA, 60 bp, Xenorhabdus bovienii
  Promoter location: Contig name=SeqID_16854; Position on contig =41954..42013bp; Strand=+; Gene name=InsB
gaacagatgccacctgcagaaaactgctcgacttattagccccttttcatattcgtttca

SEQ ID NO: 12726 - DNA, 60 bp, Xenorhabdus bovienii
  Promoter location: Contig name=SeqID_16854; Position on contig =43251..43310bp; Strand=-
accttagattagcatacatgcaatttgatggcataaaaaaactgtgtcaaaattaactaa

SEQ ID NO: 12727 - DNA, 60 bp, Xenorhabdus bovienii
  Promoter location: Contig name=SeqID_16854; Position on contig =42993..43052bp; Strand=+
gctgtgtaataaggtaaaacctgtttaattttgttatctatcttagcgaaaatattttta

SEQ ID NO: 12728 - DNA, 60 bp, Xenorhabdus bovienii
  Promoter location: Contig name=SeqID_16854; Position on contig =46876..46935bp; Strand=+
agacatggcattcttcataccatcctctttcatctgctttatccctgtattattggtact

SEQ ID NO: 12729 - DNA, 60 bp, Xenorhabdus bovienii
  Promoter location: Contig name=SeqID_16854; Position on contig =47669..47728bp; Strand=-
ccattaggaatcaataaatatatgttgaaaaatagggtcattagtcgtataatatattta

SEQ ID NO: 12730 - DNA, 60 bp, Xenorhabdus bovienii
  Promoter location: Contig name=SeqID_16854; Position on contig =48006..48065bp; Strand=-
gaatgactgacattgagccagtcattctaaattgagttacctaccgtttcaatttttttg

SEQ ID NO: 12731 - DNA, 60 bp, Xenorhabdus bovienii
  unsure (1)..(60): unsure at all n locations
  Promoter location: Contig name=SeqID_16854; Position on contig =48068..48127bp; Strand=+
aaaaagggctaaatttttgtattaagaatatatttttttaactcttttacganaataaaa

SEQ ID NO: 12732 - DNA, 60 bp, Xenorhabdus bovienii
  Promoter location: Contig name=SeqID_16854; Position on contig =48746..48805bp; Strand=-
gcccctttaatatgtcagatatatttgacatattgagcttatatgtgtatactctgatta

SEQ ID NO: 12733 - DNA, 60 bp, Xenorhabdus bovienii
  Promoter location: Contig name=SeqID_16854; Position on contig =48731..48790bp; Strand=+
ccccttttaaaccaataatcagagtatacacatataagctcaatatgtcaaatatatctg

SEQ ID NO: 12734 - DNA, 60 bp, Xenorhabdus bovienii
  Promoter location: Contig name=SeqID_16854; Position on contig =49389..49448bp; Strand=-
tcattgaaaaaatttaatgaaaaattaatttagtggatttttatttgcataatatattta

SEQ ID NO: 12735 - DNA, 60 bp, Xenorhabdus bovienii
  Promoter location: Contig name=SeqID_16855; Position on contig =3200..3259bp; Strand=+; Gene name=ProP
tttcccttatctctttattcatttacaacttgtttatttataaacgttattttttatcca

SEQ ID NO: 12736 - DNA, 60 bp, Xenorhabdus bovienii
  Promoter location: Contig name=SeqID_16855; Position on contig =6445..6504bp; Strand=-
gattatttttatttaaaatgatttccgagtagatttctatttttttatagaatgctattc

SEQ ID NO: 12737 - DNA, 60 bp, Xenorhabdus bovienii
  Promoter location: Contig name=SeqID_16855; Position on contig =7136..7195bp; Strand=-; Gene name=ApbA
cgcagaacctcccgagtatagatcttttgccaataatggaaagcggttatcatgccaact

SEQ ID NO: 12738 - DNA, 60 bp, Xenorhabdus bovienii
  Promoter location: Contig name=SeqID_16855; Position on contig =10512..10571bp; Strand=-
tgttcgatttctgatgtttgatttgctttagacataatgatttaaggtatgattatttaa

SEQ ID NO: 12739 - DNA, 60 bp, Xenorhabdus bovienii
  Promoter location: Contig name=SeqID_16855; Position on contig =11744..11803bp; Strand=+; Gene name=Dxs
atattagttactagttacattaatcactggttatattattcatcggttataatagcaatc

SEQ ID NO: 12740 - DNA, 60 bp, Xenorhabdus bovienii
  Promoter location: Contig name=SeqID_16855; Position on contig =14010..14069bp; Strand=-
gaatgaggtagggcattggaattattcattaaattaaccttaatttttattttgtgtttt

SEQ ID NO: 12741 - DNA, 60 bp, Xenorhabdus bovienii
  Promoter location: Contig name=SeqID_16855; Position on contig =13961..14020bp; Strand=+; Gene name=KamA
atacacattcaatttaaatggttattagtcaaagagacatgaattaataaaaacacaaaa

SEQ ID NO: 12742 - DNA, 60 bp, Xenorhabdus bovienii
  Promoter location: Contig name=SeqID_16855; Position on contig =19096..19155bp; Strand=-
taaatgcttatgtggtatcgtgaattttgcttttagcattattgggatataatttttaac

SEQ ID NO: 12743 - DNA, 60 bp, Xenorhabdus bovienii
  Promoter location: Contig name=SeqID_16855; Position on contig =19250..19309bp; Strand=+
gggaaataaactgtttttcattcaagaagtgatctgcattccatttttataatccaattc

SEQ ID NO: 12744 - DNA, 60 bp, Xenorhabdus bovienii
  Promoter location: Contig name=SeqID_16855; Position on contig =24233..24292bp; Strand=+
gggctgtaccgccacggataacggttcccaaagcgataaccgcatcatatttttgagtct

SEQ ID NO: 12745 - DNA, 60 bp, Xenorhabdus bovienii
  Promoter location: Contig name=SeqID_16855; Position on contig =31866..31925bp; Strand=+
ctcttctggcagttcaaatgtaaaatcagcgacacgcattttatctgtatcattcaaaaa

SEQ ID NO: 12746 - DNA, 60 bp, Xenorhabdus bovienii
  Promoter location: Contig name=SeqID_16855; Position on contig =33433..33492bp; Strand=+; Gene name=Ggt
aatgaattcccctaaaccagccgctctgtcggctggtttttcttatctaaaatttctcat

SEQ ID NO: 12747 - DNA, 60 bp, Xenorhabdus bovienii
  Promoter location: Contig name=SeqID_16855; Position on contig =37112..37171bp; Strand=-; Gene name=BaeS
cagaaaaatgatttattcatcaatatgaacaaaaaaagtgcaaatcatatagtgtgcatt

SEQ ID NO: 12748 - DNA, 60 bp, Xenorhabdus bovienii
  Promoter location: Contig name=SeqID_16855; Position on contig =39482..39541bp; Strand=-
ttcctaccgttgcccaagagtcttgcttatctgtttcaagcgctaattataatgagtgtt

SEQ ID NO: 12749 - DNA, 60 bp, Xenorhabdus bovienii
  Promoter location: Contig name=SeqID_16855; Position on contig =39269..39328bp; Strand=+
ggttaatcccattaatattattgaagtcagaaatattcactttaagtcattatgagtcaa

SEQ ID NO: 12750 - DNA, 60 bp, Xenorhabdus bovienii
  Promoter location: Contig name=SeqID_16855; Position on contig =49716..49775bp; Strand=-; Gene name=OppA
tcttattacatgaatagattaatttaattcgtaattacaacgaaatggtaatgtgatgta

SEQ ID NO: 12751 - DNA, 60 bp, Xenorhabdus bovienii
  Promoter location: Contig name=SeqID_16855; Position on contig =51480..51539bp; Strand=-; Gene name=UshA
gaaggcattaactgtaatagtcatgatcattaaggtaacagtgatatatgtaatatttat

SEQ ID NO: 12752 - DNA, 60 bp, Xenorhabdus bovienii
  Promoter location: Contig name=SeqID_16855; Position on contig =56723..56782bp; Strand=-
aaggaaagatgtaatataaataaatttaaagaacattaaagcattgtcattttttaagcg

SEQ ID NO: 12753 - DNA, 60 bp, Xenorhabdus bovienii
  Promoter location: Contig name=SeqID_16855; Position on contig =57261..57320bp; Strand=+
cttgaatgggttaatttatggtttcaaaaattatccgtaacataaaaataaaatttaaat

SEQ ID NO: 12754 - DNA, 60 bp, Xenorhabdus bovienii
  Promoter location: Contig name=SeqID_16855; Position on contig =58688..58747bp; Strand=-; Gene name=RdgC
gagcataaagagtggctataacgcttgattgtcagtgcggctcaggcaatgattatgcag

SEQ ID NO: 12755 - DNA, 60 bp, Xenorhabdus bovienii
  Promoter location: Contig name=SeqID_16855; Position on contig =58629..58688bp; Strand=+; Gene name=RdgC
ttacctttttctatttctattgttttctatcgttatttagagctgattaaattatgttac

SEQ ID NO: 12756 - DNA, 60 bp, Xenorhabdus bovienii
  Promoter location: Contig name=SeqID_16855; Position on contig =61180..61239bp; Strand=-
aatttatacctgctatgtgatttccttcacaggatggcattttttgttaatttttgttag

SEQ ID NO: 12757 - DNA, 60 bp, Xenorhabdus bovienii
  Promoter location: Contig name=SeqID_16855; Position on contig =61665..61724bp; Strand=-
tcaagcaagtcttctcgatttttgacaaaacgatagagtgttttttttgcaataccggct

SEQ ID NO: 12758 - DNA, 60 bp, Xenorhabdus bovienii
  Promoter location: Contig name=SeqID_16855; Position on contig =63348..63407bp; Strand=-
ttttattattactgaaacgttttttgtttgtcattgatctgattttttataaatgtggtg

SEQ ID NO: 12759 - DNA, 60 bp, Xenorhabdus bovienii
  Promoter location: Contig name=SeqID_16855; Position on contig =63294..63353bp; Strand=+
cactataaatacatccaatagcgctgattgatacgggggagattttttataaatcaccac

SEQ ID NO: 12760 - DNA, 60 bp, Xenorhabdus bovienii
  Promoter location: Contig name=SeqID_16855; Position on contig =63646..63705bp; Strand=+; Gene name=Chb
aaataataactaaaattatttatataatttattaatgttatattttatataataaatatt

SEQ ID NO: 12761 - DNA, 60 bp, Xenorhabdus bovienii
  Promoter location: Contig name=SeqID_16855; Position on contig =68997..69056bp; Strand=-
taaatctaattttatttatattgatatgcttacttaataaagataaataaaataaaacta

SEQ ID NO: 12762 - DNA, 60 bp, Xenorhabdus bovienii
  Promoter location: Contig name=SeqID_16855; Position on contig =68840..68899bp; Strand=+
tattgtttcttcatgagttaccttaattgagggttaatatacctttgtatttttccatct

SEQ ID NO: 12763 - DNA, 60 bp, Xenorhabdus bovienii
  Promoter location: Contig name=SeqID_16855; Position on contig =70425..70484bp; Strand=-
taaaataaactattggtgatatttttataataaatagagaatcattaaataataatttat

SEQ ID NO: 12764 - DNA, 60 bp, Xenorhabdus bovienii
  Promoter location: Contig name=SeqID_16855; Position on contig =72451..72510bp; Strand=-; Gene name=MetC
aatgatggatgaagtgcgttggatgaggggattgacagcaccttgggtatattttttctt

SEQ ID NO: 12765 - DNA, 60 bp, Xenorhabdus bovienii
  Promoter location: Contig name=SeqID_16855; Position on contig =72194..72253bp; Strand=+; Gene name=MetC
cattgagcgatttgatagtaattatcattactatttaacaaaaaagtgataattaaagga

SEQ ID NO: 12766 - DNA, 60 bp, Xenorhabdus bovienii
  Promoter location: Contig name=SeqID_16855; Position on contig =74604..74663bp; Strand=-; Gene name=ARA1
ctgatccattttttatctcctttaggttacgtcacttctggatcgagtataacgacttcg

SEQ ID NO: 12767 - DNA, 60 bp, Xenorhabdus bovienii
  Promoter location: Contig name=SeqID_16855; Position on contig =74566..74625bp; Strand=+; Gene name=ARA1
gatgataaacaatacattgcatcacgttttatttatcccgaagtcgttatactcgatcca

SEQ ID NO: 12768 - DNA, 60 bp, Xenorhabdus bovienii
  Promoter location: Contig name=SeqID_16855; Position on contig =75743..75802bp; Strand=+
ataaaaaatgcggccaccatgatagtaacctatattaatattcacaaggttaaacttaaa

SEQ ID NO: 12769 - DNA, 60 bp, Xenorhabdus bovienii
  Promoter location: Contig name=SeqID_16855; Position on contig =80952..81011bp; Strand=-; Gene name=DapB
attattttagtgtaattgcgtaatttttcgattcatttggtttttattataataatctga

SEQ ID NO: 12770 - DNA, 60 bp, Xenorhabdus bovienii
  Promoter location: Contig name=SeqID_16855; Position on contig =81992..82051bp; Strand=-
tcccggtatatagcctgtggcttatcataatatctctgctgtttagcattttttataaca

SEQ ID NO: 12771 - DNA, 60 bp, Xenorhabdus bovienii
  Promoter location: Contig name=SeqID_16855; Position on contig =82248..82307bp; Strand=-
attaattttcaattgttattgaaataattgaaaattatttcattttttattatttcttgt

SEQ ID NO: 12772 - DNA, 60 bp, Xenorhabdus bovienii
  Promoter location: Contig name=SeqID_16855; Position on contig =82579..82638bp; Strand=+
cttaatttaacaaagagggattgtatttatcatataaaaatttaattaataattaattta

SEQ ID NO: 12773 - DNA, 60 bp, Xenorhabdus bovienii
  Promoter location: Contig name=SeqID_16855; Position on contig =84101..84160bp; Strand=+
ggcgtactcaaatccctaaaatcaagtctctgccacttctgctactttaaaatctaaagg

SEQ ID NO: 12774 - DNA, 60 bp, Xenorhabdus bovienii
  Promoter location: Contig name=SeqID_16855; Position on contig =86850..86909bp; Strand=-
acatttatacctgcccgatcatttaaataatggaaatccaaaaatgataaaatatattgg

SEQ ID NO: 12775 - DNA, 60 bp, Xenorhabdus bovienii
  Promoter location: Contig name=SeqID_16855; Position on contig =86478..86537bp; Strand=+
gaaattaattaaatatccatagatttcataaaaccggctagtttcttcatcattcttatt

SEQ ID NO: 12776 - DNA, 60 bp, Xenorhabdus bovienii
  Promoter location: Contig name=SeqID_16855; Position on contig =87139..87198bp; Strand=-
atgttataatataccatgtatatattaatataatttttttatatttttataatgcaatgt

SEQ ID NO: 12777 - DNA, 60 bp, Xenorhabdus bovienii
  Promoter location: Contig name=SeqID_16855; Position on contig =89357..89416bp; Strand=+
ctttggctttttctgtaaatcagataattgatatttcaatgtcattttataaacctcaat

SEQ ID NO: 12778 - DNA, 60 bp, Xenorhabdus bovienii
  Promoter location: Contig name=SeqID_16855; Position on contig =90284..90343bp; Strand=-
gggagagttttatattttaatttttaacgctgtaatttaactaacactattatagtgctg

SEQ ID NO: 12779 - DNA, 60 bp, Xenorhabdus bovienii
  Promoter location: Contig name=SeqID_16855; Position on contig =90301..90360bp; Strand=+
tagttaaattacagcgttaaaaattaaaatataaaactctcccatttaaactgacacagc

SEQ ID NO: 12780 - DNA, 60 bp, Xenorhabdus bovienii
  Promoter location: Contig name=SeqID_16855; Position on contig =99833..99892bp; Strand=-
taattaaaaaccctttgtgatcgtgggttaaccttgtgcgctgtacaaggtataatccgg

SEQ ID NO: 12781 - DNA, 60 bp, Xenorhabdus bovienii
  Promoter location: Contig name=SeqID_16855; Position on contig =100127..100186bp; Strand=-
gcgtttcttagctgatttgatattagccaaggtccaactcccaaatatattctagcgagg

SEQ ID NO: 12782 - DNA, 60 bp, Xenorhabdus bovienii
  Promoter location: Contig name=SeqID_16855; Position on contig =100410..100469bp; Strand=-; Gene name=LysR
tacaaaaaaaccggcactaggccggttttttcagcatgatcaaaaacaataattacattg

SEQ ID NO: 12783 - DNA, 60 bp, Xenorhabdus bovienii
  Promoter location: Contig name=SeqID_16855; Position on contig =102802..102861bp; Strand=-; Gene name=RhaT
tgtaacaaggcggcagcaagtacagataataataggaaagttgtcatggctatattttag

SEQ ID NO: 12784 - DNA, 60 bp, Xenorhabdus bovienii
  Promoter location: Contig name=SeqID_16855; Position on contig =102730..102789bp; Strand=+; Gene name=RhaT
attttttctgtgatgggtatattgatataagtatcaaaagctgtttttatcatcaaccta

SEQ ID NO: 12785 - DNA, 60 bp, Xenorhabdus bovienii
  Promoter location: Contig name=SeqID_16855; Position on contig =107093..107152bp; Strand=-
aatgtgatggcataaactaaacaatgggctggaaaagaatttttttattaaacttaattt

SEQ ID NO: 12786 - DNA, 60 bp, Xenorhabdus bovienii
  Promoter location: Contig name=SeqID_16855; Position on contig =106952..107011bp; Strand=+
ggatgtttgtttttcaatggcactgattgcctgaaattcctcatttttatactttcggct

SEQ ID NO: 12787 - DNA, 60 bp, Xenorhabdus bovienii
  Promoter location: Contig name=SeqID_16855; Position on contig =119442..119501bp; Strand=-
tatcggaattatttgattttggttttaaaaaatttactacaagtaactaaaaacaatatc

SEQ ID NO: 12788 - DNA, 60 bp, Xenorhabdus bovienii
  Promoter location: Contig name=SeqID_16855; Position on contig =120235..120294bp; Strand=+
tgggcgaaccagccaatcccagtttcacctttcacgggctcagcctgtacaatgctttta

SEQ ID NO: 12789 - DNA, 60 bp, Xenorhabdus bovienii
  Promoter location: Contig name=SeqID_16855; Position on contig =120998..121057bp; Strand=-; Gene name=PspE
ccaattcatcgaccggaatattgatggcgttcggcaaatggccttgttcaaattcctctt

SEQ ID NO: 12790 - DNA, 60 bp, Xenorhabdus bovienii
  Promoter location: Contig name=SeqID_16855; Position on contig =121616..121675bp; Strand=-
taagtgtagtggtttgtgtttgaaatctgggtagtttgtcgtatcaatatactcaaaatt

SEQ ID NO: 12791 - DNA, 60 bp, Xenorhabdus bovienii
  Promoter location: Contig name=SeqID_16855; Position on contig =121381..121440bp; Strand=+
aataacaaataacaaataacaaataacaaataacaaaatagctagattagactaataaat

SEQ ID NO: 12792 - DNA, 60 bp, Xenorhabdus bovienii
  Promoter location: Contig name=SeqID_16855; Position on contig =122769..122828bp; Strand=-
ccaaacagggcttaatgcgacagagcttgtaatctgacagatgcctgtataaataatcgg

SEQ ID NO: 12793 - DNA, 60 bp, Xenorhabdus bovienii
  Promoter location: Contig name=SeqID_16855; Position on contig =122780..122839bp; Strand=+
tacaggcatctgtcagattacaagctctgtcgcattaagccctgtttggataatatgata

SEQ ID NO: 12794 - DNA, 60 bp, Xenorhabdus bovienii
  Promoter location: Contig name=SeqID_16855; Position on contig =124387..124446bp; Strand=-
attttctatacataaacatttaatccagaaattttatagttttcatctataattataaat

SEQ ID NO: 12795 - DNA, 60 bp, Xenorhabdus bovienii
  Promoter location: Contig name=SeqID_16855; Position on contig =124708..124767bp; Strand=-; Gene name=MoaB
ctggcaacaaaacgctattcttacctgtgctcaacctcacactttcttaatatgggctga

SEQ ID NO: 12796 - DNA, 60 bp, Xenorhabdus bovienii
  Promoter location: Contig name=SeqID_16855; Position on contig =126690..126749bp; Strand=-
ctccagcaatgcaggctgactatatttctctgttgcgagtggactttcataatcgagtgt

SEQ ID NO: 12797 - DNA, 60 bp, Xenorhabdus bovienii
  Promoter location: Contig name=SeqID_16855; Position on contig =126440..126499bp; Strand=+
cagggaagtcagtttatcggtcatgtttaatatctcatcgttatacgtaaaatattggca

SEQ ID NO: 12798 - DNA, 60 bp, Xenorhabdus bovienii
  Promoter location: Contig name=SeqID_16855; Position on contig =132232..132291bp; Strand=-
gattaccaccggaactatgagttacggggcgggctgacgcgtacacataaaataataaaa

SEQ ID NO: 12799 - DNA, 60 bp, Xenorhabdus bovienii
  Promoter location: Contig name=SeqID_16855; Position on contig =131864..131923bp; Strand=+
ctgtttcaggtaggcaagttcacgttccacaatgcctttcaggtattcataatcgaaatt

SEQ ID NO: 12800 - DNA, 60 bp, Xenorhabdus bovienii
  Promoter location: Contig name=SeqID_16855; Position on contig =133132..133191bp; Strand=-; Gene name=OmpR
taacccatttttacctggcagattgatatccataatcactaagttgatatcgttatctga

SEQ ID NO: 12801 - DNA, 60 bp, Xenorhabdus bovienii
  Promoter location: Contig name=SeqID_16855; Position on contig =132915..132974bp; Strand=+; Gene name=OmpR
ttcagaacaagatcagcatattttcttttaataataacagcttgcgtcatacagattctg

SEQ ID NO: 12802 - DNA, 60 bp, Xenorhabdus bovienii
  Promoter location: Contig name=SeqID_16855; Position on contig =134304..134363bp; Strand=-
gaaaatgatttcatgaaagatattgattcacattatatgtgaatagtgaatattttcact

SEQ ID NO: 12803 - DNA, 60 bp, Xenorhabdus bovienii
  Promoter location: Contig name=SeqID_16855; Position on contig =134280..134339bp; Strand=+
agtccacttgaattaaataaatgcagtgaaaatattcactattcacatataatgtgaatc

SEQ ID NO: 12804 - DNA, 60 bp, Xenorhabdus bovienii
  Promoter location: Contig name=SeqID_16855; Position on contig =134742..134801bp; Strand=+
atcattcatagcatctagaattaacaatttttacccgtgagaataggaataatttctgct

SEQ ID NO: 12805 - DNA, 60 bp, Xenorhabdus bovienii
  Promoter location: Contig name=SeqID_16855; Position on contig =136550..136609bp; Strand=-
atcgcttttatttttgcagggttagttgttgcagcaataacgtggtacataataaataaa

SEQ ID NO: 12806 - DNA, 60 bp, Xenorhabdus bovienii
  Promoter location: Contig name=SeqID_16855; Position on contig =136472..136531bp; Strand=+
tttcgccatggcgaacaagatagacctgtaacatattctttttccgttatactgcatctg

SEQ ID NO: 12807 - DNA, 60 bp, Xenorhabdus bovienii
  Promoter location: Contig name=SeqID_16855; Position on contig =139502..139561bp; Strand=-
tatcgttatgaattcactgttgtaatcaatcatgtcaataatatgattataattgaatag

SEQ ID NO: 12808 - DNA, 60 bp, Xenorhabdus bovienii
  Promoter location: Contig name=SeqID_16855; Position on contig =139181..139240bp; Strand=+
taaagtcggataagtatcaataaagtgacggatttgctgaggcgtggcaatatccaaatc

SEQ ID NO: 12809 - DNA, 60 bp, Xenorhabdus bovienii
  Promoter location: Contig name=SeqID_16855; Position on contig =139820..139879bp; Strand=-; Gene name=Uup
aacaattttgccaacccgatgcatactataaacatattgagccaatgtaatttacctttt

SEQ ID NO: 12810 - DNA, 60 bp, Xenorhabdus bovienii
  Promoter location: Contig name=SeqID_16855; Position on contig =139776..139835bp; Strand=+; Gene name=Uup
aagccccataaacgcaaacgaatttcaaaattcccttattaataaaaaggtaaattacat

SEQ ID NO: 12811 - DNA, 60 bp, Xenorhabdus bovienii
  Promoter location: Contig name=SeqID_16855; Position on contig =142548..142607bp; Strand=-; Gene name=NadR
tgctatttttatttggattgtatttccttaggcataattaatattgttaaatttttattc

SEQ ID NO: 12812 - DNA, 60 bp, Xenorhabdus bovienii
  Promoter location: Contig name=SeqID_16855; Position on contig =144262..144321bp; Strand=-
tactaataaacaaccaattttgtttttacctttcacaacaagcgtgttattttgtttagt

SEQ ID NO: 12813 - DNA, 60 bp, Xenorhabdus bovienii
  Promoter location: Contig name=SeqID_16855; Position on contig =144361..144420bp; Strand=+
tttaaaattaaataatttaagatattcataaaataaaacaaatattaaattattagttta

SEQ ID NO: 12814 - DNA, 60 bp, Xenorhabdus bovienii
  Promoter location: Contig name=SeqID_16855; Position on contig =147209..147268bp; Strand=+
tcgactcctgtaattccgtgtcattttggcaggcaaaaaatgcttttcaaactatcctat

SEQ ID NO: 12815 - DNA, 60 bp, Xenorhabdus bovienii
  Promoter location: Contig name=SeqID_16855; Position on contig =148289..148348bp; Strand=-
caattcagaaacccggaaccatgaataaagcccataaatatcatgcatatatttcgttca

SEQ ID NO: 12816 - DNA, 60 bp, Xenorhabdus bovienii
  Promoter location: Contig name=SeqID_16855; Position on contig =151830..151889bp; Strand=-; Gene name=FimD
aggcaagccagaaagttgaattgaagtggcgtattatgttgctgatttaacatggaaagt

SEQ ID NO: 12817 - DNA, 60 bp, Xenorhabdus bovienii
  Promoter location: Contig name=SeqID_16855; Position on contig =154462..154521bp; Strand=+
tcgattatttttttattagcgacgttctctttattaatgttgttttttatattaatagct

SEQ ID NO: 12818 - DNA, 60 bp, Xenorhabdus bovienii
  Promoter location: Contig name=SeqID_16855; Position on contig =155936..155995bp; Strand=-; Gene name=DeoD
tttaaaaaattattagtaaaatatactactcattccacgtacttttttataaaaactcat

SEQ ID NO: 12819 - DNA, 60 bp, Xenorhabdus bovienii
  Promoter location: Contig name=SeqID_16855; Position on contig =158159..158218bp; Strand=+
ggtgtgtctttaccagaagaaagttcactcgcataaccgtaggccccaataatttcagca

SEQ ID NO: 12820 - DNA, 60 bp, Xenorhabdus bovienii
  Promoter location: Contig name=SeqID_16855; Position on contig =159895..159954bp; Strand=-
tcaataaccacatattgaatgcatattaagatagagtgcattactgccattcttttcaga

SEQ ID NO: 12821 - DNA, 60 bp, Xenorhabdus bovienii
  Promoter location: Contig name=SeqID_16855; Position on contig =159595..159654bp; Strand=+
acatcaccgacaccgcccgtcgagtgtttatctacgatcgggccatgtaaattcaatttt

SEQ ID NO: 12822 - DNA, 60 bp, Xenorhabdus bovienii
  Promoter location: Contig name=SeqID_16855; Position on contig =160705..160764bp; Strand=+
gcatgctgagcagctgcggttaaatcggtcataaaactctccaacggtattattatcgtg

SEQ ID NO: 12823 - DNA, 60 bp, Xenorhabdus bovienii
  Promoter location: Contig name=SeqID_16855; Position on contig =162562..162621bp; Strand=-
ttagaaactagatggttttatgtgatctatgtctcattttgtgtttttatattacttttt

SEQ ID NO: 12824 - DNA, 60 bp, Xenorhabdus bovienii
  Promoter location: Contig name=SeqID_16855; Position on contig =162145..162204bp; Strand=+
gccgccgaacagttcaaacattttgtcggaaaccagcccgccaaagataaaatccgttcc

SEQ ID NO: 12825 - DNA, 60 bp, Xenorhabdus bovienii
  Promoter location: Contig name=SeqID_16855; Position on contig =162565..162624bp; Strand=+
aagtaatataaaaacacaaaatgagacatagatcacataaaaccatctagtttctaaggg

SEQ ID NO: 12826 - DNA, 60 bp, Xenorhabdus bovienii
  Promoter location: Contig name=SeqID_16855; Position on contig =164890..164949bp; Strand=-
aacgggtaaaatacttttaggtatgtaaagtcccgttcgtgtatagctacacttcggtac

SEQ ID NO: 12827 - DNA, 60 bp, Xenorhabdus bovienii
  Promoter location: Contig name=SeqID_16855; Position on contig =164694..164753bp; Strand=+
gaataatgactatctatcagtatattgttgttcaaacaatacgtttgtaaaattttcgtt

SEQ ID NO: 12828 - DNA, 60 bp, Xenorhabdus bovienii
  Promoter location: Contig name=SeqID_16855; Position on contig =165187..165246bp; Strand=-
tttttattgtatatttttaatgatttattattgtttgtaatttgatttattatgcatttt

SEQ ID NO: 12829 - DNA, 60 bp, Xenorhabdus bovienii
  Promoter location: Contig name=SeqID_16855; Position on contig =165957..166016bp; Strand=-; Gene name=FusA
tagggtcaacaaatagttgacccttgtcagtttgtaacctctttctgtattttttctata

SEQ ID NO: 12830 - DNA, 60 bp, Xenorhabdus bovienii
  Promoter location: Contig name=SeqID_16855; Position on contig =167716..167775bp; Strand=-
agcactcagccagataatcattgattgtttataaatccaagttcagcgaaaataagcccc

SEQ ID NO: 12831 - DNA, 60 bp, Xenorhabdus bovienii
  Promoter location: Contig name=SeqID_16855; Position on contig =167588..167647bp; Strand=+
cgcgacttcctgctggaatggaaaatttgacatcaattaggatcttctagtctatacgcg

SEQ ID NO: 12832 - DNA, 60 bp, Xenorhabdus bovienii
  Promoter location: Contig name=SeqID_16855; Position on contig =168766..168825bp; Strand=-
aaattgtgatgctatgctgattggcgtagagataagccctctgatagtatattacctgtt

SEQ ID NO: 12833 - DNA, 60 bp, Xenorhabdus bovienii
  Promoter location: Contig name=SeqID_16855; Position on contig =168725..168784bp; Strand=+
acgcttcgtcatcgtgttttattccatctgccataaaaaataacaggtaatatactatca

SEQ ID NO: 12834 - DNA, 60 bp, Xenorhabdus bovienii
  Promoter location: Contig name=SeqID_16856; Position on contig =864..923bp; Strand=-
gcttggagcatccgctgtggaccgcttgaataagcgctctgatcggataccatgcgcatc

SEQ ID NO: 12835 - DNA, 60 bp, Xenorhabdus bovienii
  Promoter location: Contig name=SeqID_16858; Position on contig =806..865bp; Strand=-
gcctatctttacatacacatgaatcgctagatggtgtcgtcataaataaattcatgtaat

SEQ ID NO: 12836 - DNA, 60 bp, Xenorhabdus bovienii; identical to SEQ ID NO: 12261
  unsure (1)..(60): unsure at all n locations
  Promoter location: Contig name=SeqID_16859; Position on contig =48..107bp; Strand=+

SEQ ID NO: 12837 - DNA, 60 bp, Xenorhabdus bovienii
  Promoter location: Contig name=SeqID_16860; Position on contig =2719..2778bp; Strand=-
ttatatatggcaattggctccatattttcatattcggccagacgttttaatattgtaata

SEQ ID NO: 12838 - DNA, 60 bp, Xenorhabdus bovienii
  Promoter location: Contig name=SeqID_16860; Position on contig =2515..2574bp; Strand=+
tatttttagatggtagtttgtaaatactaattcgaatgcgttttttttaaactatcaaat

SEQ ID NO: 12839 - DNA, 60 bp, Xenorhabdus bovienii
  Promoter location: Contig name=SeqID_16860; Position on contig =6103..6162bp; Strand=-; Gene name=Tra8
aaaataataaactcatacctatctgattgtgaaagagatattttgtttaaaaaattagat

SEQ ID NO: 12840 - DNA, 60 bp, Xenorhabdus bovienii
  Promoter location: Contig name=SeqID_16860; Position on contig =6107..6166bp; Strand=+; Gene name=Tra8
aattttttaaacaaaatatctctttcacaatcagataggtatgagtttattattttttcc

SEQ ID NO: 12841 - DNA, 60 bp, Xenorhabdus bovienii
  Promoter location: Contig name=SeqID_16860; Position on contig =7559..7618bp; Strand=-; Gene name=Nlp
aatgaaataagccatgagacaaaataatattcgtagttattaattttatactcatggcta

SEQ ID NO: 12842 - DNA, 60 bp, Xenorhabdus bovienii
  Promoter location: Contig name=SeqID_16860; Position on contig =9197..9256bp; Strand=-
ttctatagattgaaaaaggagaacttgacgatatcgaggctggcttttagccggtgggga

SEQ ID NO: 12843 - DNA, 60 bp, Xenorhabdus bovienii
  Promoter location: Contig name=SeqID_16860; Position on contig =8844..8903bp; Strand=+
atcaacgtaatgttctacatgcttggctttcaaatggctgagacttttaacctgaatatt

SEQ ID NO: 12844 - DNA, 60 bp, Xenorhabdus bovienii
  Promoter location: Contig name=SeqID_16860; Position on contig =9196..9255bp; Strand=+
atccccaccggctaaaagccagcctcgatatcgtcaagttctcctttttcaatctataga

SEQ ID NO: 12845 - DNA, 60 bp, Xenorhabdus bovienii
  Promoter location: Contig name=SeqID_16860; Position on contig =9534..9593bp; Strand=+
gtacgaacgccatcctgttattcattgaagataaaggaaaatatgcttatgttgatatga

SEQ ID NO: 12846 - DNA, 60 bp, Xenorhabdus bovienii
  Promoter location: Contig name=SeqID_16860; Position on contig =9945..10004bp; Strand=+
cgctgcgttgtaaggacctttgcttgagcaattaagctggcagttggtatactgaaatga

SEQ ID NO: 12847 - DNA, 60 bp, Xenorhabdus bovienii
  Promoter location: Contig name=SeqID_16860; Position on contig =10783..10842bp; Strand=+
tgctacacttgtaaaatagtttgccagcatcttctatttagctcaattttaattaaatat

SEQ ID NO: 12848 - DNA, 60 bp, Xenorhabdus bovienii
  Promoter location: Contig name=SeqID_16860; Position on contig =24141..24200bp; Strand=+
agcatcacactggcgacagtgccaattgccatggtggtgatcgtcgataaagtgaaaacg

SEQ ID NO: 12849 - DNA, 60 bp, Xenorhabdus bovienii
  Promoter location: Contig name=SeqID_16860; Position on contig =24837..24896bp; Strand=-
gcactgccaacaaagtatgatttttatacagaatgccgatgaaaaggtataagttccaaa

SEQ ID NO: 12850 - DNA, 60 bp, Xenorhabdus bovienii
  Promoter location: Contig name=SeqID_16860; Position on contig =24661..24720bp; Strand=+
tgaacttccggcaaacgaataaggttttccttcggtgctgtcattgtcatatttttctcc

SEQ ID NO: 12851 - DNA, 60 bp, Xenorhabdus bovienii
  Promoter location: Contig name=SeqID_16860; Position on contig =26173..26232bp; Strand=-
ctcctgtagtctagtaaggtatgttgaaatctacgatcttataggggtatatttaggggt

SEQ ID NO: 12852 - DNA, 60 bp, Xenorhabdus bovienii
  Promoter location: Contig name=SeqID_16860; Position on contig =26225..26284bp; Strand=+
tacaggagaacgaaaaaaggctaatagtacgtatttactggagttttgtagacttaggaa

SEQ ID NO: 12853 - DNA, 60 bp, Xenorhabdus bovienii
  Promoter location: Contig name=SeqID_16860; Position on contig =26413..26472bp; Strand=+; Gene name=XerC
aaacggattttatagcttgaacagtttcatgtagttgcatatcatttcatcataacttga

SEQ ID NO: 12854 - DNA, 60 bp, Xenorhabdus bovienii
  Promoter location: Contig name=SeqID_16860; Position on contig =27873..27932bp; Strand=+
gaattaatagtttacgtttatatattcaatgcaaatatatcatttgttattattattttt

SEQ ID NO: 12855 - DNA, 60 bp, Xenorhabdus bovienii
  Promoter location: Contig name=SeqID_16860; Position on contig =37922..37981bp; Strand=-
tgggtttcccttttaatgtttttgacactttttccaatgaaccattgtcaattaattctt

SEQ ID NO: 12856 - DNA, 60 bp, Xenorhabdus bovienii
  Promoter location: Contig name=SeqID_16860; Position on contig =37489..37548bp; Strand=+
cttaatccattgacctttcaggtgtatcgtggatggagcactggccttatcattttgttg

SEQ ID NO: 12857 - DNA, 60 bp, Xenorhabdus bovienii
  Promoter location: Contig name=SeqID_16860; Position on contig =38437..38496bp; Strand=-
acttatcaaaatcatcggagttgtatacactaaaaaaatatcacttctacaaattgggca

SEQ ID NO: 12858 - DNA, 60 bp, Xenorhabdus bovienii
  Promoter location: Contig name=SeqID_16860; Position on contig =38749..38808bp; Strand=+
tcgaggctgtacataacttcattttattaaaccggaaagatccctgtgatcttccggctt

SEQ ID NO: 12859 - DNA, 60 bp, Xenorhabdus bovienii
  Promoter location: Contig name=SeqID_16860; Position on contig =40080..40139bp; Strand=+
cctctatctaatagaggtgaacttaatgagattttaacttattctggtatgcttgggaaa

SEQ ID NO: 12860 - DNA, 60 bp, Xenorhabdus bovienii
  Promoter location: Contig name=SeqID_16860; Position on contig =41264..41323bp; Strand=-
gctttgcactgaaatggcaaaatttttcttttgcgaagtagctcgcattttattttatta

SEQ ID NO: 12861 - DNA, 60 bp, Xenorhabdus bovienii
  Promoter location: Contig name=SeqID_16860; Position on contig =41547..41606bp; Strand=+
aacggatcactaatagagaacccggcttccagcagccattttccgcttaaattgatggca

SEQ ID NO: 12862 - DNA, 60 bp, Xenorhabdus bovienii
  Promoter location: Contig name=SeqID_16860; Position on contig =59274..59333bp; Strand=-
ttgagtgaatattaatttctaattgcaatcattgcacatgccatcgttatagagggaggg

SEQ ID NO: 12863 - DNA, 60 bp, Xenorhabdus bovienii
  Promoter location: Contig name=SeqID_16860; Position on contig =59130..59189bp; Strand=+
agccatactcagaacctcccgtattcaaaaaaacagggccagagggataaaaagcctccc

SEQ ID NO: 12864 - DNA, 60 bp, Xenorhabdus bovienii
  Promoter location: Contig name=SeqID_16860; Position on contig =59719..59778bp; Strand=-
caaatagttactgaatgattaccctttttcatagtatagatatcatatatcaaccacttt

SEQ ID NO: 12865 - DNA, 60 bp, Xenorhabdus bovienii
  Promoter location: Contig name=SeqID_16860; Position on contig =61625..61684bp; Strand=-
tcagaggaaaggaggaggtatcaattctaaagataatcaaaattcagcatactattaaat

SEQ ID NO: 12866 - DNA, 60 bp, Xenorhabdus bovienii
  Promoter location: Contig name=SeqID_16860; Position on contig =61421..61480bp; Strand=+
atacacttcaccgaaaccaccacgtccgagtcttttcaagtcctcaataaaataattacc

SEQ ID NO: 12867 - DNA, 60 bp, Xenorhabdus bovienii
  Promoter location: Contig name=SeqID_16860; Position on contig =63206..63265bp; Strand=-
tgatgctattttttttctatattcatcacggattttttcatcgcttctattatagatatc

SEQ ID NO: 12868 - DNA, 60 bp, Xenorhabdus bovienii
  Promoter location: Contig name=SeqID_16860; Position on contig =64296..64355bp; Strand=+
cagccatgcaagataggccgtgacatcttgccactggttatcccagctacaatctttcac

SEQ ID NO: 12869 - DNA, 60 bp, Xenorhabdus bovienii
  Promoter location: Contig name=SeqID_16860; Position on contig =64622..64681bp; Strand=+
cgaaattgcgttaacagtaattggcaacggggttcaggcagccccattaatttagaaact

SEQ ID NO: 12870 - DNA, 60 bp, Xenorhabdus bovienii
  Promoter location: Contig name=SeqID_16860; Position on contig =68482..68541bp; Strand=-
tattctatctctaaagtgatacctttacaaatactccaatagtgatttatattgactgtt

SEQ ID NO: 12871 - DNA, 60 bp, Xenorhabdus bovienii
  Promoter location: Contig name=SeqID_16860; Position on contig =68488..68547bp; Strand=+
caatataaatcactattggagtatttgtaaaggtatcactttagagatagaataagaaaa

SEQ ID NO: 12872 - DNA, 60 bp, Xenorhabdus bovienii
  Promoter location: Contig name=SeqID_16860; Position on contig =69354..69413bp; Strand=+
ttcaaataatatcaaattaaaattatttgatatcaataagataattaaaaaatttgatat

SEQ ID NO: 12873 - DNA, 60 bp, Xenorhabdus bovienii
  Promoter location: Contig name=SeqID_16860; Position on contig =70614..70673bp; Strand=+; Gene name=FolD
gtgcatactggattgagtcaatgggcttttcgttcatatgcttattttatgattaccaat

SEQ ID NO: 12874 - DNA, 60 bp, Xenorhabdus bovienii
  Promoter location: Contig name=SeqID_16860; Position on contig =71918..71977bp; Strand=-
ttaaaatcaatatgatgttgatatttcctatgatttttacttttattaattatattttta

SEQ ID NO: 12875 - DNA, 60 bp, Xenorhabdus bovienii
  Promoter location: Contig name=SeqID_16860; Position on contig =71946..72005bp; Strand=+
cataggaaatatcaacatcatattgattttaattcatattattagattaagatccagaat

SEQ ID NO: 12876 - DNA, 60 bp, Xenorhabdus bovienii
  Promoter location: Contig name=SeqID_16860; Position on contig =74014..74073bp; Strand=-
ctggcttttcatattctagtttatttatatcgctgataaagaagcctataatcagcggat

SEQ ID NO: 12877 - DNA, 60 bp, Xenorhabdus bovienii
  Promoter location: Contig name=SeqID_16860; Position on contig =75494..75553bp; Strand=+; Gene name=PurE
tcgacaaatcaaataacgcaaacgttttccttatgctattcgcatgatatgatccgcctc

SEQ ID NO: 12878 - DNA, 60 bp, Xenorhabdus bovienii
  Promoter location: Contig name=SeqID_16860; Position on contig =77981..78040bp; Strand=-
aatataaataaattagcagagagggttttgatatgcgttttttattttattattctaaat

SEQ ID NO: 12879 - DNA, 60 bp, Xenorhabdus bovienii
  Promoter location: Contig name=SeqID_16860; Position on contig =78361..78420bp; Strand=-; Gene name=Tsx
cacttattgtctccttgttatctcattggcaattttgtgcaaaatagtaacatttattta

SEQ ID NO: 12880 - DNA, 60 bp, Xenorhabdus bovienii
  Promoter location: Contig name=SeqID_16860; Position on contig =84604..84663bp; Strand=+; Gene name=TesA
cacattttccgctcgcagctgcgccctttgttcttcgttcatacggctaatattttgccc

SEQ ID NO: 12881 - DNA, 60 bp, Xenorhabdus bovienii
  Promoter location: Contig name=SeqID_16860; Position on contig =89142..89201bp; Strand=-; Gene name=ZntA
gtgataaaaagatagtgatattgataactcaagaaaaatagcggcgatatcattaaggct

SEQ ID NO: 12882 - DNA, 60 bp, Xenorhabdus bovienii
  Promoter location: Contig name=SeqID_16860; Position on contig =89141..89200bp; Strand=+; Gene name=ZntA
tagccttaatgatatcgccgctatttttcttgagttatcaatatcactatctttttatca

SEQ ID NO: 12883 - DNA, 60 bp, Xenorhabdus bovienii
  Promoter location: Contig name=SeqID_16860; Position on contig =93601..93660bp; Strand=+
tcaaaccagaagtcatgttatttactatttcgtataacttatttatgtaatttaataaat

SEQ ID NO: 12884 - DNA, 60 bp, Xenorhabdus bovienii
  Promoter location: Contig name=SeqID_16860; Position on contig =93880..93939bp; Strand=+
aacaaaagaatacttactgtccttctcctgcccatcaaaccacgatgtagaatcattttt

SEQ ID NO: 12885 - DNA, 60 bp, Xenorhabdus bovienii
  Promoter location: Contig name=SeqID_16860; Position on contig =96191..96250bp; Strand=-
atggctcaatgggataggtttataattttcataaaactaataattgttacatcacagata

SEQ ID NO: 12886 - DNA, 60 bp, Xenorhabdus bovienii
  Promoter location: Contig name=SeqID_16860; Position on contig =96383..96442bp; Strand=-
tgatacttatcccataaaaatgaaataaaaccctaataaaaatgaaataaaaccctaatt

SEQ ID NO: 12887 - DNA, 60 bp, Xenorhabdus bovienii
  Promoter location: Contig name=SeqID_16860; Position on contig =96744..96803bp; Strand=-; Gene name=ProP
ccgtatacagaccaatgaggggttgtagcagggatgcggttacctgataaactagtgtaa

SEQ ID NO: 12888 - DNA, 60 bp, Xenorhabdus bovienii
  Promoter location: Contig name=SeqID_16860; Position on contig =96443..96502bp; Strand=+; Gene name=ProP
aattatatcaaggtaagtaaaaattttattagcggtctaatatgtattaaagtgtaacaa

SEQ ID NO: 12889 - DNA, 60 bp, Xenorhabdus bovienii
  Promoter location: Contig name=SeqID_16860; Position on contig =97903..97962bp; Strand=+; Gene name=KefB
ttttacctataaatatattttttatcagctttgttttaaatgatttatacaatacattat

SEQ ID NO: 12890 - DNA, 60 bp, Xenorhabdus bovienii
  Promoter location: Contig name=SeqID_16860; Position on contig =102516..102575bp; Strand=-; Gene name=HemH
tgagatgttattttacattttgactggcgagtattggtagctacgggtattttggtggta

SEQ ID NO: 12891 - DNA, 60 bp, Xenorhabdus bovienii
  Promoter location: Contig name=SeqID_16860; Position on contig =103585..103644bp; Strand=-; Gene name=Adk
tttgagtgtcactccatgaaatgttagatgtgactataactcatgtttatactaggttat

SEQ ID NO: 12892 - DNA, 60 bp, Xenorhabdus bovienii
  Promoter location: Contig name=SeqID_16860; Position on contig =106454..106513bp; Strand=-
ttctgattgccctaacttgaaattgttgggagttatccccatttgattaccatcgtccga

SEQ ID NO: 12893 - DNA, 60 bp, Xenorhabdus bovienii
  Promoter location: Contig name=SeqID_16860; Position on contig =106313..106372bp; Strand=+
ggagaaaaatttctttattggaatagagagaatggatcatcaactgcaataattgtttga

SEQ ID NO: 12894 - DNA, 60 bp, Xenorhabdus bovienii
  Promoter location: Contig name=SeqID_16860; Position on contig =107226..107285bp; Strand=-
gaaaaaatgtccggcgtttccaacggcatgcaattaccgcctggctttaagatgccattc

SEQ ID NO: 12895 - DNA, 60 bp, Xenorhabdus bovienii
  Promoter location: Contig name=SeqID_16860; Position on contig =109604..109663bp; Strand=-
tttgcataattgatacatcagcctcgccgttcatggtgaggctgtgctagcatgatacac

SEQ ID NO: 12896 - DNA, 60 bp, Xenorhabdus bovienii
  Promoter location: Contig name=SeqID_16860; Position on contig =110591..110650bp; Strand=-
ctgacctgctcggtacgattatctttcacacaggtctttaattgtgacatatttttttta

SEQ ID NO: 12897 - DNA, 60 bp, Xenorhabdus bovienii
  Promoter location: Contig name=SeqID_16860; Position on contig =110177..110236bp; Strand=+
gtttcgatactatctttaataaattgcagtttttgcgcattagcggtcataatcgatgcc

SEQ ID NO: 12898 - DNA, 60 bp, Xenorhabdus bovienii
  Promoter location: Contig name=SeqID_16860; Position on contig =115359..115418bp; Strand=+; Gene name=AcrA
gaagttgcagaaactccacgttcagaaaatacctttatcgcggcttctataatctgttgg

SEQ ID NO: 12899 - DNA, 60 bp, Xenorhabdus bovienii
  Promoter location: Contig name=SeqID_16860; Position on contig =120467..120526bp; Strand=+
aataaataataatcatgttttgataggccatattctaaaagaatggctataataattgtt

SEQ ID NO: 12900 - DNA, 60 bp, Xenorhabdus bovienii
  Promoter location: Contig name=SeqID_16860; Position on contig =121504..121563bp; Strand=+
caaaaatgtcactgactaactagaattgacacaaactcaaagccttttattttcccacaa

SEQ ID NO: 12901 - DNA, 60 bp, Xenorhabdus bovienii
  Promoter location: Contig name=SeqID_16860; Position on contig =121925..121984bp; Strand=-
catttattagtaaataaatagattgaattgtaaataaaatttatctttatgtttttattg

SEQ ID NO: 12902 - DNA, 60 bp, Xenorhabdus bovienii
  Promoter location: Contig name=SeqID_16860; Position on contig =121895..121954bp; Strand=+
gaaaaaattaatagtgataattcgatttcacaataaaaacataaagataaattttattta

SEQ ID NO: 12903 - DNA, 60 bp, Xenorhabdus bovienii
  Promoter location: Contig name=SeqID_16860; Position on contig =122103..122162bp; Strand=+
atacatctagaaaaaatggtcatgctcccaatagttagattattgtagtaaactttccat

SEQ ID NO: 12904 - DNA, 60 bp, Xenorhabdus bovienii
  Promoter location: Contig name=SeqID_16860; Position on contig =122899..122958bp; Strand=+; Gene name=TesB
catgaccctattttctgcgtccaggggatagccataaaccgattatttatgatgttgaaa

SEQ ID NO: 12905 - DNA, 60 bp, Xenorhabdus bovienii
  Promoter location: Contig name=SeqID_16860; Position on contig =129571..129630bp; Strand=-; Gene name=CysK
taaattgatcctgaataacaatactttaatgatatatagattacttttatattgggggaa

SEQ ID NO: 12906 - DNA, 60 bp, Xenorhabdus bovienii
  Promoter location: Contig name=SeqID_16860; Position on contig =129550..129609bp; Strand=+; Gene name=CysK
tgtagaaaaataacaatctatttcccccaatataaaagtaatctatatatcattaaagta

SEQ ID NO: 12907 - DNA, 60 bp, Xenorhabdus bovienii
  Promoter location: Contig name=SeqID_16860; Position on contig =134534..134593bp; Strand=-
ttggccattacagttaaacttaaactgacggggcggggttgataggttagaatataagcg

SEQ ID NO: 12908 - DNA, 60 bp, Xenorhabdus bovienii
  Promoter location: Contig name=SeqID_16860; Position on contig =134325..134384bp; Strand=+
ccttcacttgacaggtagcctgttacaccagtcaaaacaaaggtcaggataattagagcc

SEQ ID NO: 12909 - DNA, 60 bp, Xenorhabdus bovienii
  Promoter location: Contig name=SeqID_16860; Position on contig =135069..135128bp; Strand=-; Gene name=Lon
aatagtgagctaactcaagaagtttgtataaaatttaggttggcgagtatattaagactt

SEQ ID NO: 12910 - DNA, 60 bp, Xenorhabdus bovienii
  Promoter location: Contig name=SeqID_16862; Position on contig =5165..5224bp; Strand=-
cataaaaaaatctacgcctgtagtagcgcaaccgatatgatgagatttattttttgtcgg

SEQ ID NO: 12911 - DNA, 60 bp, Xenorhabdus bovienii; identical to SEQ ID NO: 12261
  unsure (1)..(60): unsure at all n locations
  Promoter location: Contig name=SeqID_16863; Position on contig =2..61bp; Strand=+

SEQ ID NO: 12912 - DNA, 60 bp, Xenorhabdus bovienii
  Promoter location: Contig name=SeqID_16865; Position on contig =804..863bp; Strand=-; Gene name=PutP
ttttgttcatccaatctgagtagtagattatttttcaaaagtctttttaaaattcatcaa

SEQ ID NO: 12913 - DNA, 60 bp, Xenorhabdus bovienii
  Promoter location: Contig name=SeqID_16865; Position on contig =5163..5222bp; Strand=-; Gene name=SodA
ataactatggtttcctttccatttctcagttgcattttttcattggatagaataactaaa

SEQ ID NO: 12914 - DNA, 60 bp, Xenorhabdus bovienii
  Promoter location: Contig name=SeqID_16865; Position on contig =5173..5232bp; Strand=+; Gene name=SodA
ctatccaatgaaaaaatgcaactgagaaatggaaaggaaaccatagttataatatggaat

SEQ ID NO: 12915 - DNA, 60 bp, Xenorhabdus bovienii
  Promoter location: Contig name=SeqID_16865; Position on contig =10403..10462bp; Strand=-
tcagatagaacattatcggttttagttagatcaggctgccaaacctctaaaataacaatt

SEQ ID NO: 12916 - DNA, 60 bp, Xenorhabdus bovienii
  Promoter location: Contig name=SeqID_16865; Position on contig =12330..12389bp; Strand=-
cggttcgtgccagatatatatagttgcaatacaggttgatgtgctgagataattttccca

SEQ ID NO: 12917 - DNA, 60 bp, Xenorhabdus bovienii
  Promoter location: Contig name=SeqID_16865; Position on contig =15666..15725bp; Strand=+; Gene name=MrcA
catatccatagtgctgtatagcctttatactacgtactaatcgtttataaactgcccgat

SEQ ID NO: 12918 - DNA, 60 bp, Xenorhabdus bovienii
  Promoter location: Contig name=SeqID_16865; Position on contig =26869..26928bp; Strand=-
ttaattttattaacaaaatgttaaataaattttattacaccatttcgcaaaataaagcct

SEQ ID NO: 12919 - DNA, 60 bp, Xenorhabdus bovienii
  Promoter location: Contig name=SeqID_16865; Position on contig =26428..26487bp; Strand=+
aatggcacctttaggaaaacccaattcgtattgttcaatgccaacggcatactcgcggat

SEQ ID NO: 12920 - DNA, 60 bp, Xenorhabdus bovienii
  Promoter location: Contig name=SeqID_16865; Position on contig =30619..30678bp; Strand=+; Gene name=PckA
aagtaatgcaattatcaattttttgataacaatcgctgttaattagtcataattatttat

SEQ ID NO: 12921 - DNA, 60 bp, Xenorhabdus bovienii
  Promoter location: Contig name=SeqID_16865; Position on contig =33226..33285bp; Strand=-
gcttccagtgtttattttatagccaacttgaatgttggcttttttttatacttaactcag

SEQ ID NO: 12922 - DNA, 60 bp, Xenorhabdus bovienii
  Promoter location: Contig name=SeqID_16865; Position on contig =33537..33596bp; Strand=-
tgctttcttgttttatttgattattaaatcgtccatttttctatttttatcatttttatc

SEQ ID NO: 12923 - DNA, 60 bp, Xenorhabdus bovienii
  Promoter location: Contig name=SeqID_16865; Position on contig =33492..33551bp; Strand=+
tattatcatttaataatacaaatattatcaaaaaatgataaaaatgataaaaatgataaa

SEQ ID NO: 12924 - DNA, 60 bp, Xenorhabdus bovienii
  Promoter location: Contig name=SeqID_16865; Position on contig =36492..36551bp; Strand=+
tattttatttattccgctagcccttgacgtatctattgcaatttttttaatatgttaacg

SEQ ID NO: 12925 - DNA, 60 bp, Xenorhabdus bovienii
  Promoter location: Contig name=SeqID_16865; Position on contig =37466..37525bp; Strand=-
agatgaataataaaaataaattaactttagcaattgggacatttttttatttttaataat

SEQ ID NO: 12926 - DNA, 60 bp, Xenorhabdus bovienii
  Promoter location: Contig name=SeqID_16865; Position on contig =38501..38560bp; Strand=-
gcttcccaataattcagaaaatctaaagaaaaaatagctgagtccgataagatattagac

SEQ ID NO: 12927 - DNA, 60 bp, Xenorhabdus bovienii
  Promoter location: Contig name=SeqID_16865; Position on contig =38296..38355bp; Strand=+
aagatcttcattgtcatttaattttttttgaaattcattttgaagttcagaatatctttt

SEQ ID NO: 12928 - DNA, 60 bp, Xenorhabdus bovienii
  Promoter location: Contig name=SeqID_16865; Position on contig =39268..39327bp; Strand=-
actgtaatcaatattactatcaggtttgccagacaatgctttcagttcagactccctgtt

SEQ ID NO: 12929 - DNA, 60 bp, Xenorhabdus bovienii
  Promoter location: Contig name=SeqID_16865; Position on contig =40659..40718bp; Strand=-
ttccactagattcattcccttttactaattttgttctaccaactgttataatttaagatt

SEQ ID NO: 12930 - DNA, 60 bp, Xenorhabdus bovienii
  Promoter location: Contig name=SeqID_16865; Position on contig =41065..41124bp; Strand=-
aagttaaacggacgggttagttagttaaacagcccgctcataccatttaaaacacatcaa

SEQ ID NO: 12931 - DNA, 60 bp, Xenorhabdus bovienii
  Promoter location: Contig name=SeqID_16865; Position on contig =41465..41524bp; Strand=-
aaatatcagagcaaccgaaaatcattggctttttaactctatagttttaatataaattta

SEQ ID NO: 12932 - DNA, 60 bp, Xenorhabdus bovienii
  Promoter location: Contig name=SeqID_16865; Position on contig =42527..42586bp; Strand=+; Gene name=PutA
ccggatttcatcgatagcctagatacacacgctgttcagtttgttcgtactatccagtcc

SEQ ID NO: 12933 - DNA, 60 bp, Xenorhabdus bovienii
  Promoter location: Contig name=SeqID_16865; Position on contig =50126..50185bp; Strand=-
ttttccgccttttttgtatctaggggttgcctcagaaaacgggaaaaatagtactaatcg

SEQ ID NO: 12934 - DNA, 60 bp, Xenorhabdus bovienii
  Promoter location: Contig name=SeqID_16865; Position on contig =51230..51289bp; Strand=-; Gene name=MalY
taagtaatttcaaaataaacagcattgtagtctaagcctttcatcgctatgttttaatat

SEQ ID NO: 12935 - DNA, 60 bp, Xenorhabdus bovienii
  Promoter location: Contig name=SeqID_16865; Position on contig =58155..58214bp; Strand=-
aatgaaattaaaaataaaatttatttttaatagtctgcatcagactcaattatgtgttta

SEQ ID NO: 12936 - DNA, 60 bp, Xenorhabdus bovienii
  Promoter location: Contig name=SeqID_16865; Position on contig =58061..58120bp; Strand=+
aattcatcccaaaattggatgtttttaccatcataaaaatttttaaacatataattttat

SEQ ID NO: 12937 - DNA, 60 bp, Xenorhabdus bovienii
  Promoter location: Contig name=SeqID_16865; Position on contig =60794..60853bp; Strand=-
attcaaatttaatattttgatatttttttgacaaaaaataactttttacgataaaaagtt

SEQ ID NO: 12938 - DNA, 60 bp, Xenorhabdus bovienii
  Promoter location: Contig name=SeqID_16865; Position on contig =60524..60583bp; Strand=+
ggttcagtgtacatattggtgaaattacagcgtccgccaccggacatcaaaattttgcga

SEQ ID NO: 12939 - DNA, 60 bp, Xenorhabdus bovienii
  Promoter location: Contig name=SeqID_16865; Position on contig =60817..60876bp; Strand=+; Gene name=PitA
tttttgtcaaaaaaatatcaaaatattaaatttgaataacaacttgatataattgataaa

SEQ ID NO: 12940 - DNA, 60 bp, Xenorhabdus bovienii
  Promoter location: Contig name=SeqID_16865; Position on contig =62960..63019bp; Strand=-; Gene name=UspA
tgctcaatatatctttttagtgttgttttgatcacaacttatcattttattttcttaact

SEQ ID NO: 12941 - DNA, 60 bp, Xenorhabdus bovienii
  Promoter location: Contig name=SeqID_16865; Position on contig =62924..62983bp; Strand=+; Gene name=UspA
ttgtgatgttcaaatgagatatccatattttcatatagttaagaaaataaaatgataagt

SEQ ID NO: 12942 - DNA, 60 bp, Xenorhabdus bovienii
  Promoter location: Contig name=SeqID_16865; Position on contig =63685..63744bp; Strand=+; Gene name=GdhA
atattcagaaagcaaaccacaattacctcacattttcgacaaaaaaataatatggaaaat

SEQ ID NO: 12943 - DNA, 60 bp, Xenorhabdus bovienii
  Promoter location: Contig name=SeqID_16865; Position on contig =68129..68188bp; Strand=-
cgtcccacgaaacatctaaactcattcgtcatctcacagatctctgatataaaaagaccc

SEQ ID NO: 12944 - DNA, 60 bp, Xenorhabdus bovienii
  Promoter location: Contig name=SeqID_16865; Position on contig =67975..68034bp; Strand=+
tacagaaggagtcagtaacgggttagtcatagtgagcgccttagttgtatgtttgggtat

SEQ ID NO: 12945 - DNA, 60 bp, Xenorhabdus bovienii
  Promoter location: Contig name=SeqID_16865; Position on contig =68620..68679bp; Strand=-
aacagcataaataaataataatgtaaaaatattctatttaaataagctatatttaactaa

SEQ ID NO: 12946 - DNA, 60 bp, Xenorhabdus bovienii
  Promoter location: Contig name=SeqID_16865; Position on contig =68730..68789bp; Strand=+
gatttttgagtgtaataagatcgctttatatattaattacttaaatttatattatattat

SEQ ID NO: 12947 - DNA, 60 bp, Xenorhabdus bovienii
  Promoter location: Contig name=SeqID_16865; Position on contig =69808..69867bp; Strand=-; Gene name=AmyA
gtaaattcacatcattattcattgcaatattgaccagaatgctctgttaatattaattaa

SEQ ID NO: 12948 - DNA, 60 bp, Xenorhabdus bovienii
  Promoter location: Contig name=SeqID_16865; Position on contig =73178..73237bp; Strand=-
atcaataaaacaaatataaaaagccttttagtttcaaaccaatagaataaaatgtgatcc

SEQ ID NO: 12949 - DNA, 60 bp, Xenorhabdus bovienii
  Promoter location: Contig name=SeqID_16865; Position on contig =73815..73874bp; Strand=-
cagtcgccataatcgggcggtaaatctcgccagggtgcgcctgtccgtaaaatccagaac

SEQ ID NO: 12950 - DNA, 60 bp, Xenorhabdus bovienii
  Promoter location: Contig name=SeqID_16865; Position on contig =73588..73647bp; Strand=+
aggatatcgcctttatggaatttcttcctagatggtgtcgtcataaataaattcatgtaa

SEQ ID NO: 12951 - DNA, 60 bp, Xenorhabdus bovienii
  Promoter location: Contig name=SeqID_16865; Position on contig =74718..74777bp; Strand=+
gaaatctgtaattagttaattaaatttagcttaattgcttatgtcattaataataaaata

SEQ ID NO: 12952 - DNA, 60 bp, Xenorhabdus bovienii
  Promoter location: Contig name=SeqID_16865; Position on contig =75853..75912bp; Strand=+
attatattttaagattaacgaagacgtcatacgacgaatgatgagtgtaaattgattcta

SEQ ID NO: 12953 - DNA, 60 bp, Xenorhabdus bovienii
  Promoter location: Contig name=SeqID_16865; Position on contig =76353..76412bp; Strand=+
aaaaatatttaatttatgactaggtgatttctgaattctgtttgttttttgatttataaa

SEQ ID NO: 12954 - DNA, 60 bp, Xenorhabdus bovienii
  Promoter location: Contig name=SeqID_16865; Position on contig =77480..77539bp; Strand=+
gatttgccacgaatgtaacctgtactttttcacgttctgctgcacgatataatacttctt

SEQ ID NO: 12955 - DNA, 60 bp, Xenorhabdus bovienii
  Promoter location: Contig name=SeqID_16865; Position on contig =78174..78233bp; Strand=-; Gene name=SelA
tattgacacactaattattaattaaaaaatacctttaataaatattatatatttgtattt

SEQ ID NO: 12956 - DNA, 60 bp, Xenorhabdus bovienii
  Promoter location: Contig name=SeqID_16865; Position on contig =83285..83344bp; Strand=-
ttgatttccacttcgaagcggaaattagcctgctccaaagccacaaataaaatcgataag

SEQ ID NO: 12957 - DNA, 60 bp, Xenorhabdus bovienii
  Promoter location: Contig name=SeqID_16865; Position on contig =85425..85484bp; Strand=-
tgcctgatagggtaatgggtttattcaacgaagaaatcgctcgaagttacaccgaataat

SEQ ID NO: 12958 - DNA, 60 bp, Xenorhabdus bovienii
  Promoter location: Contig name=SeqID_16865; Position on contig =85738..85797bp; Strand=-
taaagttaatatacaaaacaaatagtcatcctcattatttattacagtaaaatatccgca

SEQ ID NO: 12959 - DNA, 60 bp, Xenorhabdus bovienii
  Promoter location: Contig name=SeqID_16865; Position on contig =85883..85942bp; Strand=+
gatgtatcttactggacagggatttgatttatcaataaaatattttttattatggcatgg

SEQ ID NO: 12960 - DNA, 60 bp, Xenorhabdus bovienii
  Promoter location: Contig name=SeqID_16865; Position on contig =91114..91173bp; Strand=-; Gene name=WbbJ
aatactcatagaaataattaataattatttttattttcttctttttttaaaataaagcac

SEQ ID NO: 12961 - DNA, 60 bp, Xenorhabdus bovienii
  Promoter location: Contig name=SeqID_16865; Position on contig =92182..92241bp; Strand=-; Gene name=PaaX
gcaaacggctgacattcagccaagactttatgccgaaaaaccaattgtaattttcaaatt

SEQ ID NO: 12962 - DNA, 60 bp, Xenorhabdus bovienii
  Promoter location: Contig name=SeqID_16865; Position on contig =93419..93478bp; Strand=-; Gene name=PaaK
gaacgtatacccagtagatttcaagttgcagggtatatttctccggttatgctaatggca

SEQ ID NO: 12963 - DNA, 60 bp, Xenorhabdus bovienii
  Promoter location: Contig name=SeqID_16865; Position on contig =94856..94915bp; Strand=-
cgggtattggcaaataacccacacctgcacataaaaacaacaacctgttacaaacaaatc

SEQ ID NO: 12964 - DNA, 60 bp, Xenorhabdus bovienii
  Promoter location: Contig name=SeqID_16865; Position on contig =103520..103579bp; Strand=-; Gene name=PutA
atatttttgttatcaatttgtagatttacagttatataaaatgattctattttttattta

SEQ ID NO: 12965 - DNA, 60 bp, Xenorhabdus bovienii
  Promoter location: Contig name=SeqID_16865; Position on contig =103498..103557bp; Strand=+; Gene name=PutA
tatgattcttatttttttattttaaataaaaaatagaatcattttatataactgtaaatc

SEQ ID NO: 12966 - DNA, 60 bp, Xenorhabdus bovienii
  Promoter location: Contig name=SeqID_16865; Position on contig =106147..106206bp; Strand=-
tgagccgaacgctggcgcacttctgccaaattctggatccggctttttaaattatcgtca

SEQ ID NO: 12967 - DNA, 60 bp, Xenorhabdus bovienii
  Promoter location: Contig name=SeqID_16865; Position on contig =105977..106036bp; Strand=+
tcctcaggctgttctctaaagtttgaattcgggttgaattttatctgtagaataggtgag

SEQ ID NO: 12968 - DNA, 60 bp, Xenorhabdus bovienii
  Promoter location: Contig name=SeqID_16865; Position on contig =112206..112265bp; Strand=-; Gene name=Php
tctaacccctgtattttccgaaaattagctttttcaataaatcagcaattcgatacaaaa

SEQ ID NO: 12969 - DNA, 60 bp, Xenorhabdus bovienii
  Promoter location: Contig name=SeqID_16865; Position on contig =113392..113451bp; Strand=-
tccaatcagggcattacagttaatatcatttatcccttaaataatgttattttcgctcta

SEQ ID NO: 12970 - DNA, 60 bp, Xenorhabdus bovienii
  Promoter location: Contig name=SeqID_16865; Position on contig =114673..114732bp; Strand=-
tttgtttacactataaatattcaaaaaaatgaatattttggatttctcagcctttttaac

SEQ ID NO: 12971 - DNA, 60 bp, Xenorhabdus bovienii
  Promoter location: Contig name=SeqID_16865; Position on contig =114539..114598bp; Strand=+
taagtgtctggtaatattgcgccttgctgccaaaggtcttttgctatttcaatcaatttg

SEQ ID NO: 12972 - DNA, 60 bp, Xenorhabdus bovienii
  Promoter location: Contig name=SeqID_16865; Position on contig =116153..116212bp; Strand=-
taaatatatattcaaaatattgataatattgaatttaattacttttttaaattttcattt

SEQ ID NO: 12973 - DNA, 60 bp, Xenorhabdus bovienii
  Promoter location: Contig name=SeqID_16865; Position on contig =117288..117347bp; Strand=-; Gene name=GlpA
ctcttatcgccattttatctttcctcgcgcataatctttttcatccctatcctaaaagta

SEQ ID NO: 12974 - DNA, 60 bp, Xenorhabdus bovienii
  Promoter location: Contig name=SeqID_16865; Position on contig =119023..119082bp; Strand=-; Gene name=GlpR
ctgctcccagatttctgccctcaatttgcttcccacaaattccttattaatcttatatat

SEQ ID NO: 12975 - DNA, 60 bp, Xenorhabdus bovienii
  Promoter location: Contig name=SeqID_16865; Position on contig =121257..121316bp; Strand=-
tttagccagtatttccacgcctttccaatggaaacgttgggaaggcgtaaagtcataaaa

SEQ ID NO: 12976 - DNA, 60 bp, Xenorhabdus bovienii
  Promoter location: Contig name=SeqID_16865; Position on contig =122639..122698bp; Strand=+; Gene name=MhpC
gcaaaatacaaactttgatggcatagccaacagtatccaaccattgttagcataggttcc

SEQ ID NO: 12977 - DNA, 60 bp, Xenorhabdus bovienii
  Promoter location: Contig name=SeqID_16865; Position on contig =124468..124527bp; Strand=-; Gene name=RelB
accctaacccgtttggctggatttctgatacgttcacgaacaacgtctaaaatatcttca

SEQ ID NO: 12978 - DNA, 60 bp, Xenorhabdus bovienii
  Promoter location: Contig name=SeqID_16865; Position on contig =124048..124107bp; Strand=+; Gene name=RelB
agagaacggtttttatttttcaatttatgtttggggaatgcgattttaacctttcatatg

SEQ ID NO: 12979 - DNA, 60 bp, Xenorhabdus bovienii
  Promoter location: Contig name=SeqID_16865; Position on contig =127935..127994bp; Strand=-
atagtagcaatgtcttttattttcaattaaataaccattaatttgattaatatcaatttc

SEQ ID NO: 12980 - DNA, 60 bp, Xenorhabdus bovienii
  Promoter location: Contig name=SeqID_16865; Position on contig =128729..128788bp; Strand=-
cgtataatctatcattcaataaatttcatattcatgaaagcctattgaataatataaaaa

SEQ ID NO: 12981 - DNA, 60 bp, Xenorhabdus bovienii
  Promoter location: Contig name=SeqID_16865; Position on contig =128909..128968bp; Strand=+
ttatttctcctaatgccatcatgttttgaaataaaaatatatttagtgataattagatgg

SEQ ID NO: 12982 - DNA, 60 bp, Xenorhabdus bovienii
  Promoter location: Contig name=SeqID_16865; Position on contig =132465..132524bp; Strand=-; Gene name=GreA
cgggtaatgtagttactcttagccatgaaaaaacccacttgagaaaatatgattaatggc

SEQ ID NO: 12983 - DNA, 60 bp, Xenorhabdus bovienii
  Promoter location: Contig name=SeqID_16865; Position on contig =132403..132462bp; Strand=+; Gene name=GreA
atatttcggtcatgttgagacagatttcatcgaatatcttatgggttaagatatagtact

SEQ ID NO: 12984 - DNA, 60 bp, Xenorhabdus bovienii
  Promoter location: Contig name=SeqID_16865; Position on contig =135105..135164bp; Strand=-; Gene name=PstS
ggtatgggcaataatctgtttcacgccacccgaagaaccaataccttgatagttgatttt

SEQ ID NO: 12985 - DNA, 60 bp, Xenorhabdus bovienii
  Promoter location: Contig name=SeqID_16865; Position on contig =134792..134851bp; Strand=+; Gene name=PstS
ggttgtcataaaaatgtcatgattaatacattttactgtcattgaattaacctatttttc

SEQ ID NO: 12986 - DNA, 60 bp, Xenorhabdus bovienii
  Promoter location: Contig name=SeqID_16865; Position on contig =139645..139704bp; Strand=-; Gene name=ArtI
ctacgcgggattgattgcgaaatttcattgaacacccctgttggtaataaaatatttatt

SEQ ID NO: 12987 - DNA, 60 bp, Xenorhabdus bovienii
  Promoter location: Contig name=SeqID_16865; Position on contig =139552..139611bp; Strand=+; Gene name=ArtI
cggcgtttttggctttcttattcctaaagatgataaacatatcattttatattatttcaa

SEQ ID NO: 12988 - DNA, 60 bp, Xenorhabdus bovienii
  Promoter location: Contig name=SeqID_16865; Position on contig =142130..142189bp; Strand=+; Gene name=Hcp
gttaaggcaggggatttttttataacaagctaaaaaaactgtagattatactgtttactc

SEQ ID NO: 12989 - DNA, 60 bp, Xenorhabdus bovienii
  Promoter location: Contig name=SeqID_16865; Position on contig =146182..146241bp; Strand=-
aggcaggtggtaacaaatacggctttgatatccattcccgccaccgccaaaatttgcgga

SEQ ID NO: 12990 - DNA, 60 bp, Xenorhabdus bovienii
  Promoter location: Contig name=SeqID_16865; Position on contig =145947..146006bp; Strand=+
tttactttttttaccttttcagggtaacgatttgaataagtttcctgtaggataggtcga

SEQ ID NO: 12991 - DNA, 60 bp, Xenorhabdus bovienii
  Promoter location: Contig name=SeqID_16865; Position on contig =148936..148995bp; Strand=-
ccacctataacatccaatgtcattcactaattgttcaaaattcagctaatattctacgga

SEQ ID NO: 12992 - DNA, 60 bp, Xenorhabdus bovienii
  Promoter location: Contig name=SeqID_16865; Position on contig =148893..148952bp; Strand=+
aaaaacgcatagcggcaaatgatcatattaattgagttaaagttccgtagaatattagct

SEQ ID NO: 12993 - DNA, 60 bp, Xenorhabdus bovienii
  Promoter location: Contig name=SeqID_16865; Position on contig =150010..150069bp; Strand=-; Gene name=HemN
cgtgccgtgatttctttttccagaatattcagatagtcatctgccttatgcttctggcga

SEQ ID NO: 12994 - DNA, 60 bp, Xenorhabdus bovienii
  Promoter location: Contig name=SeqID_16865; Position on contig =149619..149678bp; Strand=+; Gene name=HemN
ctacttataaccacagtattagtatgttatttattgtggttattgggtaaactatggcag

SEQ ID NO: 12995 - DNA, 60 bp, Xenorhabdus bovienii
  Promoter location: Contig name=SeqID_16865; Position on contig =153857..153916bp; Strand=-
aatcacagactgaacggagagactgctcgatttatgtctgaataaggtacaatgcaccaa

SEQ ID NO: 12996 - DNA, 60 bp, Xenorhabdus bovienii
  Promoter location: Contig name=SeqID_16865; Position on contig =153706..153765bp; Strand=+
cgcgtactttgtgccagtagttgcatggcggaatgattggcatagcggataatcaaatcg

SEQ ID NO: 12997 - DNA, 60 bp, Xenorhabdus bovienii
  Promoter location: Contig name=SeqID_16865; Position on contig =155616..155675bp; Strand=-
acttagtgcaattttacttaaaacttgactgtgatctcttcggtttttaccctccaaccc

SEQ ID NO: 12998 - DNA, 60 bp, Xenorhabdus bovienii
  Promoter location: Contig name=SeqID_16865; Position on contig =155719..155778bp; Strand=+
tgaaaaataagggaagtgcagaccattttgactgatgtgtgagagtataaaatctatggt

SEQ ID NO: 12999 - DNA, 60 bp, Xenorhabdus bovienii
  Promoter location: Contig name=SeqID_16865; Position on contig =156372..156431bp; Strand=-
taataaaaatcatcaaccagattttgacaggtggttgcatgtggtgcctccctttatttt

SEQ ID NO: 13000 - DNA, 60 bp, Xenorhabdus bovienii
  Promoter location: Contig name=SeqID_16865; Position on contig =156165..156224bp; Strand=+
gatgatgtgaatatctttaagcgtggcatacaatgtgttgatttgcataaaatataatat

SEQ ID NO: 13001 - DNA, 60 bp, Xenorhabdus bovienii
  Promoter location: Contig name=SeqID_16865; Position on contig =156586..156645bp; Strand=+
tattacatgctctatcaagtcatcttaagcaacgtgaatgcgttatttataattcaggaa

SEQ ID NO: 13002 - DNA, 60 bp, Xenorhabdus bovienii
  Promoter location: Contig name=SeqID_16865; Position on contig =157057..157116bp; Strand=-
tatgcaacaccagttttataaaaattgatcatccagaaatgctcctttaagataaaatga

SEQ ID NO: 13003 - DNA, 60 bp, Xenorhabdus bovienii
  Promoter location: Contig name=SeqID_16865; Position on contig =159243..159302bp; Strand=-
accatataatatataaatgtgataattattattcattagataatcattatatttttattt

SEQ ID NO: 13004 - DNA, 60 bp, Xenorhabdus bovienii
  Promoter location: Contig name=SeqID_16865; Position on contig =160901..160960bp; Strand=-
attcataccctgattataaaaattgatctaacataatgttctcatgtcaatataatctat

SEQ ID NO: 13005 - DNA, 60 bp, Xenorhabdus bovienii
  Promoter location: Contig name=SeqID_16865; Position on contig =162303..162362bp; Strand=-
tcatttaataaatatagatttgcattaaatttaaatttttgtcattttattttttaatat

SEQ ID NO: 13006 - DNA, 60 bp, Xenorhabdus bovienii
  Promoter location: Contig name=SeqID_16865; Position on contig =165679..165738bp; Strand=-
tgatatagagcggttatcagatgataattttttgtcattatactttttatattgatgtat

SEQ ID NO: 13007 - DNA, 60 bp, Xenorhabdus bovienii
  Promoter location: Contig name=SeqID_16865; Position on contig =166585..166644bp; Strand=-
cagaccatagttgaaaggtcataaatgaaacggttttaaataataattatatttttattc

SEQ ID NO: 13008 - DNA, 60 bp, Xenorhabdus bovienii
  Promoter location: Contig name=SeqID_16865; Position on contig =167128..167187bp; Strand=-
attttgatttatttttatgccgttagttgatagaaataggcctccggtgaaattggatat

SEQ ID NO: 13009 - DNA, 60 bp, Xenorhabdus bovienii
  Promoter location: Contig name=SeqID_16865; Position on contig =167260..167319bp; Strand=+
ataagataacttttagttatcaattgataattatctttcattacaataataaaaatattt

SEQ ID NO: 13010 - DNA, 60 bp, Xenorhabdus bovienii
  Promoter location: Contig name=SeqID_16865; Position on contig =171580..171639bp; Strand=+
aaatcgttctgcggggcataaacgttgctgatggggatagagtgagccatcatgctgagt

SEQ ID NO: 13011 - DNA, 60 bp, Xenorhabdus bovienii
  Promoter location: Contig name=SeqID_16865; Position on contig =172335..172394bp; Strand=+
gaatctgaaaatttcttccctatttattcagttttaataagtaaagttatattaaatcat

SEQ ID NO: 13012 - DNA, 60 bp, Xenorhabdus bovienii
  Promoter location: Contig name=SeqID_16865; Position on contig =172715..172774bp; Strand=+; Gene name=TypA
agcttcacatttatttcactctgtagatataacgtgtaaaataacagcatatttgtgtta

SEQ ID NO: 13013 - DNA, 60 bp, Xenorhabdus bovienii
  Promoter location: Contig name=SeqID_16865; Position on contig =174807..174866bp; Strand=+
ttagctttttcaacaactcttaatcaaaagcgtaatttgtctgttttttatcatttcact

SEQ ID NO: 13014 - DNA, 60 bp, Xenorhabdus bovienii
  Promoter location: Contig name=SeqID_16865; Position on contig =176095..176154bp; Strand=+; Gene name=WecD
gtataacaataaaaaaactcatcgtttgctgcatgcgctctcctgactacacatgacaac

SEQ ID NO: 13015 - DNA, 60 bp, Xenorhabdus bovienii
  Promoter location: Contig name=SeqID_16865; Position on contig =179022..179081bp; Strand=-; Gene name=UraA
ccgctttttcagtgggagttttttcactttgtttgcgtaacccctcgcaatatcaacatg

SEQ ID NO: 13016 - DNA, 60 bp, Xenorhabdus bovienii
  Promoter location: Contig name=SeqID_16865; Position on contig =180524..180583bp; Strand=-
cattataaaaatttagcgcaaacgattgccttaataaggcagatcattaaaatatgtttt

SEQ ID NO: 13017 - DNA, 60 bp, Xenorhabdus bovienii
  Promoter location: Contig name=SeqID_16865; Position on contig =180829..180888bp; Strand=-; Gene name=GltS
caaaacgacagcgaccaatagcccgcctgcaaccggttcagggatggtatatttctcaag

SEQ ID NO: 13018 - DNA, 60 bp, Xenorhabdus bovienii
  Promoter location: Contig name=SeqID_16865; Position on contig =180573..180632bp; Strand=+; Gene name=GltS
tttttataatgaataacgatttgatttcgtcacacttttaaattttttaacttgtgttta

SEQ ID NO: 13019 - DNA, 60 bp, Xenorhabdus bovienii
  Promoter location: Contig name=SeqID_16865; Position on contig =187613..187672bp; Strand=-; Gene name=Lig
tttaccaagcaggaaaagactaatttgcgaaacgcttcgaaaaatacataatcattttct

SEQ ID NO: 13020 - DNA, 60 bp, Xenorhabdus bovienii
  Promoter location: Contig name=SeqID_16865; Position on contig =187641..187700bp; Strand=+; Gene name=Lig
tttcgcaaattagtcttttcctgcttggtaaaagttccactgctttttattctttgctcg

SEQ ID NO: 13021 - DNA, 60 bp, Xenorhabdus bovienii
  Promoter location: Contig name=SeqID_16865; Position on contig =190358..190417bp; Strand=-
gggcgaacgtcgtataccagccattggctatcaggagtccagatatttatattagttatc

SEQ ID NO: 13022 - DNA, 60 bp, Xenorhabdus bovienii
  Promoter location: Contig name=SeqID_16865; Position on contig =190230..190289bp; Strand=+
acgtctcgactgaaattttttagccacatttacataagattagtttttattatgcgaaac

SEQ ID NO: 13023 - DNA, 60 bp, Xenorhabdus bovienii
  Promoter location: Contig name=SeqID_16865; Position on contig =192206..192265bp; Strand=-
aaacattcattaaatataaataaatagtttaaatcgatattaaattgaataatttattcg

SEQ ID NO: 13024 - DNA, 60 bp, Xenorhabdus bovienii
  Promoter location: Contig name=SeqID_16865; Position on contig =194071..194130bp; Strand=-
agaaattcaaaagacccagtttttaaattcaatgaataatcataatgtaatatataacaa

SEQ ID NO: 13025 - DNA, 60 bp, Xenorhabdus bovienii
  Promoter location: Contig name=SeqID_16865; Position on contig =193782..193841bp; Strand=+
ggtttcgcccaactggccgcttgacaccagatcagccaatatctgctgaaaataatcatc

SEQ ID NO: 13026 - DNA, 60 bp, Xenorhabdus bovienii
  Promoter location: Contig name=SeqID_16865; Position on contig =195189..195248bp; Strand=-; Gene name=GlyQ
gctcctgaatattgtctggagatggcttgatgatgacctgaaactggtaatagtgctgaa

SEQ ID NO: 13027 - DNA, 60 bp, Xenorhabdus bovienii
  Promoter location: Contig name=SeqID_16865; Position on contig =194784..194843bp; Strand=+; Gene name=GlyQ
aattaaacttatattaactgtataaatatacaagtaaagaggctcggataagattttttt

SEQ ID NO: 13028 - DNA, 60 bp, Xenorhabdus bovienii
  Promoter location: Contig name=SeqID_16866; Position on contig =7767..7826bp; Strand=-
tagattttgatatagattgattgaatcatggcgatgttcagacaggatacgatgaaaagg

SEQ ID NO: 13029 - DNA, 60 bp, Xenorhabdus bovienii
  Promoter location: Contig name=SeqID_16866; Position on contig =7677..7736bp; Strand=+
cgttccatacctgtcagtttttgttgaatcatctaccgcaccatagttccaatgacattg

SEQ ID NO: 13030 - DNA, 60 bp, Xenorhabdus bovienii
  Promoter location: Contig name=SeqID_16866; Position on contig =9111..9170bp; Strand=-
tgttattttgttattaaacaattagttaaatatgtctataatatgtctataatatgtcta

SEQ ID NO: 13031 - DNA, 60 bp, Xenorhabdus bovienii
  Promoter location: Contig name=SeqID_16866; Position on contig =9387..9446bp; Strand=-
ctacaacttaaaacttatgtgtttttatgattggtttagcaagtcagtagactgggtatt

SEQ ID NO: 13032 - DNA, 60 bp, Xenorhabdus bovienii
  Promoter location: Contig name=SeqID_16866; Position on contig =18281..18340bp; Strand=-
ttaagttgtctgaggaatatgcagtttcttcgataaagcagccgatcatcgcgacacggc

SEQ ID NO: 13033 - DNA, 60 bp, Xenorhabdus bovienii
  Promoter location: Contig name=SeqID_16866; Position on contig =18016..18075bp; Strand=+
agcgcacaagctagtgcccaaggggttggcaatatacttaaccccggtagcatcaaaatt

SEQ ID NO: 13034 - DNA, 60 bp, Xenorhabdus bovienii
  Promoter location: Contig name=SeqID_16866; Position on contig =21565..21624bp; Strand=-; Gene name=MalT
aaataaatattaatactaaattatatgcaatttaaatataaattaatttttaaaataact

SEQ ID NO: 13035 - DNA, 60 bp, Xenorhabdus bovienii
  Promoter location: Contig name=SeqID_16866; Position on contig =24820..24879bp; Strand=-; Gene name=GlgP
tgccactggcgtgtaagcgcggcttgaaagacggctttatctaatttgggctgttgcatg

SEQ ID NO: 13036 - DNA, 60 bp, Xenorhabdus bovienii
  Promoter location: Contig name=SeqID_16866; Position on contig =24515..24574bp; Strand=+; Gene name=GlgP
ttggttgatttcattgtgttaagttgcaccctgtcacattctttgcttacaatttttcct

SEQ ID NO: 13037 - DNA, 60 bp, Xenorhabdus bovienii
  Promoter location: Contig name=SeqID_16866; Position on contig =31937..31996bp; Strand=-; Gene name=MalE
tttatacccaatagatttcaagttgccgctttgttggcggcaatttgaaagatgaacggt

SEQ ID NO: 13038 - DNA, 60 bp, Xenorhabdus bovienii
  Promoter location: Contig name=SeqID_16866; Position on contig =38490..38549bp; Strand=-; Gene name=RpoC
ttatggtgtatagaatcatcttctatacacatcgctaatcataaaatgccctctcttggt

SEQ ID NO: 13039 - DNA, 60 bp, Xenorhabdus bovienii
  Promoter location: Contig name=SeqID_16866; Position on contig =47212..47271bp; Strand=-; Gene name=RplL
cagttttaagttcgcagcctgactttaaaggctgatggctggcgatttttaatcgccagc

SEQ ID NO: 13040 - DNA, 60 bp, Xenorhabdus bovienii
  Promoter location: Contig name=SeqID_16866; Position on contig =48437..48496bp; Strand=-; Gene name=RplA
gtctaaaatctggcgcttaaaatttgccttatattgtatataacaactaatataagtcgt

SEQ ID NO: 13041 - DNA, 60 bp, Xenorhabdus bovienii
  Promoter location: Contig name=SeqID_16866; Position on contig =49764..49823bp; Strand=-; Gene name=NusG
atctggcttgcaaagggtgtgaaattatcatacaatttcgcgccttttatttttaagtat

SEQ ID NO: 13042 - DNA, 60 bp, Xenorhabdus bovienii
  Promoter location: Contig name=SeqID_16866; Position on contig =50993..51052bp; Strand=-; Gene name=TufB
gacagatgccctttttatacgttgtcttaagaagaacctatctcatcaatagttgtctga

SEQ ID NO: 13043 - DNA, 60 bp, Xenorhabdus bovienii
  Promoter location: Contig name=SeqID_16866; Position on contig =57699..57758bp; Strand=-
ccataacgacagaaaaataatttttgctatttattattttttaacggtattaaatgaaat

SEQ ID NO: 13044 - DNA, 60 bp, Xenorhabdus bovienii
  Promoter location: Contig name=SeqID_16866; Position on contig =57336..57395bp; Strand=+
ccaccaatcagcatagccaagccatcaacagcagcttcgtaagattttaaaatttcatga

SEQ ID NO: 13045 - DNA, 60 bp, Xenorhabdus bovienii
  Promoter location: Contig name=SeqID_16866; Position on contig =58719..58778bp; Strand=-
atactcaaaacattctataaaagagggttaccatgaaacctctttgttttaatggttctg

SEQ ID NO: 13046 - DNA, 60 bp, Xenorhabdus bovienii
  Promoter location: Contig name=SeqID_16866; Position on contig =58303..58362bp; Strand=+
aaaagcgccaaggatctgctgaatttcttgatcattcagtttgcttttatcctttaatgc

SEQ ID NO: 13047 - DNA, 60 bp, Xenorhabdus bovienii
  Promoter location: Contig name=SeqID_16866; Position on contig =58750..58809bp; Strand=+
aaccctcttttatagaatgttttgagtattatagtgccaacttgattaaaataatcattc

SEQ ID NO: 13048 - DNA, 60 bp, Xenorhabdus bovienii
  Promoter location: Contig name=SeqID_16866; Position on contig =59770..59829bp; Strand=-
aacaaataatggataaattttgctgtcgctaggtacagagaagtagaattccgttacaat

SEQ ID NO: 13049 - DNA, 60 bp, Xenorhabdus bovienii
  Promoter location: Contig name=SeqID_16866; Position on contig =62503..62562bp; Strand=-; Gene name=Uup
gcagagatgagaaaacaatcatagaggttgtctgttatagaatatgttaagttaataatt

SEQ ID NO: 13050 - DNA, 60 bp, Xenorhabdus bovienii
  Promoter location: Contig name=SeqID_16866; Position on contig =65428..65487bp; Strand=+
taaatgcctgataatatcttcctttgaatcaaaatgaacccgacttttaaactgttcata

SEQ ID NO: 13051 - DNA, 60 bp, Xenorhabdus bovienii
  Promoter location: Contig name=SeqID_16866; Position on contig =65813..65872bp; Strand=+
tcaaaatgttaactaataaaatgttagttaacaagggtacaattagcaaaatatttatta

SEQ ID NO: 13052 - DNA, 60 bp, Xenorhabdus bovienii
  Promoter location: Contig name=SeqID_16866; Position on contig =66324..66383bp; Strand=+
ctttaattaaaaataacacattaaatacaactgtaaatgctaaacactatcataaaacga

SEQ ID NO: 13053 - DNA, 60 bp, Xenorhabdus bovienii
  Promoter location: Contig name=SeqID_16866; Position on contig =68052..68111bp; Strand=-
ctgaaggagcttgatcgggtcatgctcccaatagttagattattgtagtaaactttccat

SEQ ID NO: 13054 - DNA, 60 bp, Xenorhabdus bovienii
  Promoter location: Contig name=SeqID_16866; Position on contig =67856..67915bp; Strand=+
catatcagtgatttgttctttcactccgggtttgcaggcttgataggtgtaattcagttg

SEQ ID NO: 13055 - DNA, 60 bp, Xenorhabdus bovienii
  Promoter location: Contig name=SeqID_16866; Position on contig =68363..68422bp; Strand=+
cactgttgtcatcttcatagtggacactcccgttattaaatggctgttttaatacacttc

SEQ ID NO: 13056 - DNA, 60 bp, Xenorhabdus bovienii
  Promoter location: Contig name=SeqID_16866; Position on contig =69086..69145bp; Strand=+
tgggcaggtaacatcaatctttgccatctgaattttctccaaataggcagactatacata

SEQ ID NO: 13057 - DNA, 60 bp, Xenorhabdus bovienii
  Promoter location: Contig name=SeqID_16866; Position on contig =72318..72377bp; Strand=-
ggattaatttcatgattagtcatcttgtgtagtgaataacatactgctattttcgtcgaa

SEQ ID NO: 13058 - DNA, 60 bp, Xenorhabdus bovienii
  Promoter location: Contig name=SeqID_16866; Position on contig =72260..72319bp; Strand=+
atatcaggcttgcggtcatggggggttgttcctcttacccaaattgttaacatttccttt

SEQ ID NO: 13059 - DNA, 60 bp, Xenorhabdus bovienii
  Promoter location: Contig name=SeqID_16866; Position on contig =74051..74110bp; Strand=-; Gene name=Crp
acatattaacttgctgaaaaactgacaagcgggaattttatatagattataatcatacaa

SEQ ID NO: 13060 - DNA, 60 bp, Xenorhabdus bovienii
  Promoter location: Contig name=SeqID_16866; Position on contig =74056..74115bp; Strand=+; Gene name=Crp
tgattataatctatataaaattcccgcttgtcagtttttcagcaagttaatatgttaagc

SEQ ID NO: 13061 - DNA, 60 bp, Xenorhabdus bovienii
  Promoter location: Contig name=SeqID_16866; Position on contig =75842..75901bp; Strand=-
cttttcatatcaagctctcatcataggtgaatgctgctgtttgctggtaagctatcctac

SEQ ID NO: 13062 - DNA, 60 bp, Xenorhabdus bovienii
  Promoter location: Contig name=SeqID_16866; Position on contig =75593..75652bp; Strand=+
ctgtaattcatcattacgcttaactaaaacatttgtccctaactcgcaaaaatattgata

SEQ ID NO: 13063 - DNA, 60 bp, Xenorhabdus bovienii
  Promoter location: Contig name=SeqID_16866; Position on contig =76701..76760bp; Strand=-
cccacataaacaaaattcaggttatgagaccataatagccattcagatagaattcatctc

SEQ ID NO: 13064 - DNA, 60 bp, Xenorhabdus bovienii
  Promoter location: Contig name=SeqID_16866; Position on contig =76677..76736bp; Strand=+
tttacgagtaagcagctatttgttgagatgaattctatctgaatggctattatggtctca

SEQ ID NO: 13065 - DNA, 60 bp, Xenorhabdus bovienii
  Promoter location: Contig name=SeqID_16866; Position on contig =77701..77760bp; Strand=+
atttttttcaccagaaaaagatttttttgtaactaattttcatgtgataccgtgattcag

SEQ ID NO: 13066 - DNA, 60 bp, Xenorhabdus bovienii
  Promoter location: Contig name=SeqID_16866; Position on contig =81131..81190bp; Strand=-
catgataaagctggcacaataattgctgaaaagcccctttcataacataaactccggtta

SEQ ID NO: 13067 - DNA, 60 bp, Xenorhabdus bovienii
  Promoter location: Contig name=SeqID_16866; Position on contig =80880..80939bp; Strand=+
gattaaagcgtagaatgccatactgtgtcgttatagacgaattttgcgataattttctcg

SEQ ID NO: 13068 - DNA, 60 bp, Xenorhabdus bovienii
  Promoter location: Contig name=SeqID_16866; Position on contig =83238..83297bp; Strand=-; Gene name=MobA
tcagcagttcttgcacctgcggctgcaatcttgtggcaatgtgttggtataatggtatgc

SEQ ID NO: 13069 - DNA, 60 bp, Xenorhabdus bovienii
  Promoter location: Contig name=SeqID_16866; Position on contig =83049..83108bp; Strand=+; Gene name=MobA
ttatactctcttccatgaaagcattgttacatattggtttacaaaggttataagccaaat

SEQ ID NO: 13070 - DNA, 60 bp, Xenorhabdus bovienii
  Promoter location: Contig name=SeqID_16866; Position on contig =85112..85171bp; Strand=-
cctactcgtattgatactttctgaaatcaattctcatcagcctgatttatattgcaagaa

SEQ ID NO: 13071 - DNA, 60 bp, Xenorhabdus bovienii
  Promoter location: Contig name=SeqID_16866; Position on contig =85053..85112bp; Strand=+
gtttttcactttgtagttaggtggaaatttatttccttatgaacacatataatttacggt

SEQ ID NO: 13072 - DNA, 60 bp, Xenorhabdus bovienii
  Promoter location: Contig name=SeqID_16866; Position on contig =86895..86954bp; Strand=-
tgcacttttttgaatttttagctttatctgccattggcaccatcaagtaaaattagatgc

SEQ ID NO: 13073 - DNA, 60 bp, Xenorhabdus bovienii
  Promoter location: Contig name=SeqID_16866; Position on contig =86534..86593bp; Strand=+
aattctatatcatcattatgctgttccgacttttctctggcatgctctatcattgcttca

SEQ ID NO: 13074 - DNA, 60 bp, Xenorhabdus bovienii
  Promoter location: Contig name=SeqID_16866; Position on contig =92966..93025bp; Strand=-; Gene name=DeoR (BS)
atattttaatggagatctaattttttcacaaaatgtgatagaaatattgtaaaaacttca

SEQ ID NO: 13075 - DNA, 60 bp, Xenorhabdus bovienii
  Promoter location: Contig name=SeqID_16866; Position on contig =92884..92943bp; Strand=+; Gene name=DeoR (BS)
ttacagactttcgttttgcggacacggacattgaacatttattaatttaaaatacttttg

SEQ ID NO: 13076 - DNA, 60 bp, Xenorhabdus bovienii
  Promoter location: Contig name=SeqID_16866; Position on contig =96000..96059bp; Strand=-
agagggctttttggtcatgtgttcaatttgttgatcagcatcagacatagtattcactca

SEQ ID NO: 13077 - DNA, 60 bp, Xenorhabdus bovienii
  Promoter location: Contig name=SeqID_16866; Position on contig =95856..95915bp; Strand=+
ccagtatattaaaccggacaaaattaacacaaaaaggaaatagtatgtaaaatatcatac

SEQ ID NO: 13078 - DNA, 60 bp, Xenorhabdus bovienii
  Promoter location: Contig name=SeqID_16866; Position on contig =97026..97085bp; Strand=-
gatcacatataaaactatataacctgagatttgcttaagaagggaactaaagtgcctgag

SEQ ID NO: 13079 - DNA, 60 bp, Xenorhabdus bovienii
  Promoter location: Contig name=SeqID_16866; Position on contig =96747..96806bp; Strand=+
aaaatcggccttaagatgttgttttacatatttaatataaaacgttttaaaatcacgata

SEQ ID NO: 13080 - DNA, 60 bp, Xenorhabdus bovienii
  Promoter location: Contig name=SeqID_16866; Position on contig =97656..97715bp; Strand=-; Gene name=Lpd
tttcttttttatgtcatcgttgaaattcacttaaggttatgagttgtcagactcataacc

SEQ ID NO: 13081 - DNA, 60 bp, Xenorhabdus bovienii
  Promoter location: Contig name=SeqID_16866; Position on contig =99093..99152bp; Strand=-
aactttttgtcataatagacgccaggttgaactttagcttgtacttgtaagttaattgat

SEQ ID NO: 13082 - DNA, 60 bp, Xenorhabdus bovienii
  Promoter location: Contig name=SeqID_16866; Position on contig =100097..100156bp; Strand=-
gggtaatatctggggtaataaaatgaataatctgtcttttcttgaattaaaatccattaa

SEQ ID NO: 13083 - DNA, 60 bp, Xenorhabdus bovienii
  Promoter location: Contig name=SeqID_16866; Position on contig =100716..100775bp; Strand=-
attggcaaaatccaatggtcaaggttttgcagccttgtgtaactatatacactggtagga

SEQ ID NO: 13084 - DNA, 60 bp, Xenorhabdus bovienii
  Promoter location: Contig name=SeqID_16866; Position on contig =100975..101034bp; Strand=+
tgatcaatgggtcttagctaccgatccaatttcaaagccaagtccagtatcatcagattg

SEQ ID NO: 13085 - DNA, 60 bp, Xenorhabdus bovienii
  Promoter location: Contig name=SeqID_16866; Position on contig =102889..102948bp; Strand=-
tattttgtttcgttaacaatctaccttttaaaatatatctccgaagaaacaatgttgact

SEQ ID NO: 13086 - DNA, 60 bp, Xenorhabdus bovienii
  Promoter location: Contig name=SeqID_16866; Position on contig =105013..105072bp; Strand=-
acctcgatacgtaaaattctctattatcggatgtatgcgttcatacttatactcaaataa

SEQ ID NO: 13087 - DNA, 60 bp, Xenorhabdus bovienii
  Promoter location: Contig name=SeqID_16866; Position on contig =111639..111698bp; Strand=-
aatgtaatttttttgtattcatgctttcatatgtttcgccctcatcttatgagggctttt

SEQ ID NO: 13088 - DNA, 60 bp, Xenorhabdus bovienii
  Promoter location: Contig name=SeqID_16866; Position on contig =112807..112866bp; Strand=+
aacatcaagggcagtcattttgttttcaataaaaattttctgctgactataataacttag

SEQ ID NO: 13089 - DNA, 60 bp, Xenorhabdus bovienii
  Promoter location: Contig name=SeqID_16866; Position on contig =117103..117162bp; Strand=-
tcatggaaaaaattactgccttgattggcagcggtcaaactcactctaaaaatagtttga

SEQ ID NO: 13090 - DNA, 60 bp, Xenorhabdus bovienii
  Promoter location: Contig name=SeqID_16866; Position on contig =117480..117539bp; Strand=-; Gene name=XerC
atagacacgcaacaatgttgctttcttttgtaatgatttcatttaagtaaaataccctca

SEQ ID NO: 13091 - DNA, 60 bp, Xenorhabdus bovienii
  Promoter location: Contig name=SeqID_16866; Position on contig =118996..119055bp; Strand=-
attgtctgataagacatcagacaagttatcaatattctgtactggggtttaaaaatcgaa

SEQ ID NO: 13092 - DNA, 60 bp, Xenorhabdus bovienii; identical to SEQ ID NO: 12949
  Promoter location: Contig name=SeqID_16866; Position on contig =119773..119832bp; Strand=+

SEQ ID NO: 13093 - DNA, 60 bp, Xenorhabdus bovienii
  Promoter location: Contig name=SeqID_16866; Position on contig =121281..121340bp; Strand=-
ttatttgcttaccatattttcctatttgtaacaaaagaaattgctagtacaattactata

SEQ ID NO: 13094 - DNA, 60 bp, Xenorhabdus bovienii
  Promoter location: Contig name=SeqID_16866; Position on contig =120937..120996bp; Strand=+
atatgagaaaacggtttttggaattttacccttggcaatcaaatcattactattaaagct

SEQ ID NO: 13095 - DNA, 60 bp, Xenorhabdus bovienii
  Promoter location: Contig name=SeqID_16866; Position on contig =121572..121631bp; Strand=+
acgagcatacttttttaacagctattgaataagaagtaatgacatgatctaattaacctt

SEQ ID NO: 13096 - DNA, 60 bp, Xenorhabdus bovienii
  Promoter location: Contig name=SeqID_16866; Position on contig =127145..127204bp; Strand=-
ataaatactggatatacatccaatttcaaagaacctgttaaatcacgccataatttccct

SEQ ID NO: 13097 - DNA, 60 bp, Xenorhabdus bovienii
  Promoter location: Contig name=SeqID_16866; Position on contig =127340..127399bp; Strand=+
gaatagttattatggctaacacgcattctagatggtgtcgtcataaataaattcatgtaa

SEQ ID NO: 13098 - DNA, 60 bp, Xenorhabdus bovienii
  Promoter location: Contig name=SeqID_16866; Position on contig =129628..129687bp; Strand=-
atgttctttaaatgtagtaatatatttaagaatcatcttattttataattaatagaaagt

SEQ ID NO: 13099 - DNA, 60 bp, Xenorhabdus bovienii
  Promoter location: Contig name=SeqID_16866; Position on contig =129844..129903bp; Strand=+
tatttttttgttttctgttaatacgaattccccatatcaaaaactatttttatagtaatt

SEQ ID NO: 13100 - DNA, 60 bp, Xenorhabdus bovienii
  Promoter location: Contig name=SeqID_16866; Position on contig =130608..130667bp; Strand=-
ttttatatggggtaaaaatgaatcctatgattttaatgttactaacgtaaaatatgttga

SEQ ID NO: 13101 - DNA, 60 bp, Xenorhabdus bovienii
  Promoter location: Contig name=SeqID_16866; Position on contig =131371..131430bp; Strand=-
gtgtatattgtaaacaaacctcattcgaatttatgaggtttgttttttattttcacaaat

SEQ ID NO: 13102 - DNA, 60 bp, Xenorhabdus bovienii
  Promoter location: Contig name=SeqID_16866; Position on contig =137395..137454bp; Strand=+
ttcaatttgcagccgctgatgttcctgatagtccggcaggtgggtcacaaactgcgtcag

SEQ ID NO: 13103 - DNA, 60 bp, Xenorhabdus bovienii
  Promoter location: Contig name=SeqID_16866; Position on contig =139909..139968bp; Strand=-
cagtaataatttactaatatagtggattatttataaataaaaccatttaagctggaagat

SEQ ID NO: 13104 - DNA, 60 bp, Xenorhabdus bovienii
  Promoter location: Contig name=SeqID_16866; Position on contig =167663..167722bp; Strand=-
agcctattttttttagggagatattttgtatttgttatatgggtaaaattagaataattc

SEQ ID NO: 13105 - DNA, 60 bp, Xenorhabdus bovienii
  Promoter location: Contig name=SeqID_16866; Position on contig =168208..168267bp; Strand=-
ataaataatcttggttttttaattaaatgtaatagattgatatttatctattttttattt

SEQ ID NO: 13106 - DNA, 60 bp, Xenorhabdus bovienii
  Promoter location: Contig name=SeqID_16866; Position on contig =168088..168147bp; Strand=+
taccatcaataacaatatttattttatttagattaattattcgacattacaatccgaatt

SEQ ID NO: 13107 - DNA, 60 bp, Xenorhabdus bovienii
  Promoter location: Contig name=SeqID_16866; Position on contig =169149..169208bp; Strand=+
tcttctttttctttttcatatttgtttctttgattttttctaaatgtcagatttttatat

SEQ ID NO: 13108 - DNA, 60 bp, Xenorhabdus bovienii
  Promoter location: Contig name=SeqID_16866; Position on contig =169669..169728bp; Strand=-; Gene name=FhaC
gttagattaggtttaaatatggtttgttaattaaatattaaagcatagaaaatattttat

SEQ ID NO: 13109 - DNA, 60 bp, Xenorhabdus bovienii
  Promoter location: Contig name=SeqID_16866; Position on contig =169599..169658bp; Strand=+; Gene name=FhaC
aaatcattaagataaatatataactacaaaccataagtttgggcaaaatacacacattaa

SEQ ID NO: 13110 - DNA, 60 bp, Xenorhabdus bovienii
  Promoter location: Contig name=SeqID_16866; Position on contig =176235..176294bp; Strand=-; Gene name=Rbn
gtgttgtctttttccgtgttagagcgttccttcttttcaatatcacttagcattacatcc

SEQ ID NO: 13111 - DNA, 60 bp, Xenorhabdus bovienii
  Promoter location: Contig name=SeqID_16866; Position on contig =176113..176172bp; Strand=+; Gene name=Rbn
actgccacagacctatccgtatctgttgccttttccgttttgcctgttactctttttcta

SEQ ID NO: 13112 - DNA, 60 bp, Xenorhabdus bovienii
  Promoter location: Contig name=SeqID_16866; Position on contig =179335..179394bp; Strand=-; Gene name=LysR
attggttattcatcatggttaattacagctaaacggaatgttcaatttatattcatagtt

SEQ ID NO: 13113 - DNA, 60 bp, Xenorhabdus bovienii
  Promoter location: Contig name=SeqID_16866; Position on contig =179072..179131bp; Strand=+; Gene name=LysR
atgatttggcgggtgccaaaccgacttgccaaccagttacttataggaataataagcgtt

SEQ ID NO: 13114 - DNA, 60 bp, Xenorhabdus bovienii
  Promoter location: Contig name=SeqID_16866; Position on contig =181986..182045bp; Strand=-
ttagtagagataatctatctgggtattaatggtttggcatgaatagttaaactgtggcag

SEQ ID NO: 13115 - DNA, 60 bp, Xenorhabdus bovienii
  Promoter location: Contig name=SeqID_16866; Position on contig =181810..181869bp; Strand=+
ctgaacccattttcaagtttaccttgttgccaagccggatcaggctgtaaggtctctgcc

SEQ ID NO: 13116 - DNA, 60 bp, Xenorhabdus bovienii
  Promoter location: Contig name=SeqID_16866; Position on contig =189078..189137bp; Strand=-
tatttttctctttattcataaattaactttactcaataaagtattgctttaatgagtaac

SEQ ID NO: 13117 - DNA, 60 bp, Xenorhabdus bovienii
  Promoter location: Contig name=SeqID_16866; Position on contig =188923..188982bp; Strand=+
aattaatttctattggtgataatttgaaatttgtgactgaatacttaaaaaatgaacaat

SEQ ID NO: 13118 - DNA, 60 bp, Xenorhabdus bovienii
  Promoter location: Contig name=SeqID_16867; Position on contig =3..62bp; Strand=+
cttgcggtcggcaacggagagttacctgtggcaaagtatcgcacggttactactaaataa

SEQ ID NO: 13119 - DNA, 60 bp, Xenorhabdus bovienii
  Promoter location: Contig name=SeqID_16867; Position on contig =1821..1880bp; Strand=+
gaaatagcaatagagtgaagattggcgatatagcaggctctgttaatgataatggataca

SEQ ID NO: 13120 - DNA, 60 bp, Xenorhabdus bovienii
  Promoter location: Contig name=SeqID_16867; Position on contig =2515..2574bp; Strand=+
ttatttctataggaatacgcaatatgcacacaatcacagtccccttttatgatgatgaac

SEQ ID NO: 13121 - DNA, 60 bp, Xenorhabdus bovienii
  Promoter location: Contig name=SeqID_16867; Position on contig =6736..6795bp; Strand=-
taactaaataatgttcataacggcttttttacctcattgatagaagataaaatcatcata

SEQ ID NO: 13122 - DNA, 60 bp, Xenorhabdus bovienii
  Promoter location: Contig name=SeqID_16867; Position on contig =9383..9442bp; Strand=-; Gene name=FlgL
ctccttaaaaagaacctttaatttttcttgaaaaactttttctttttttttctctttatt

SEQ ID NO: 13123 - DNA, 60 bp, Xenorhabdus bovienii
  Promoter location: Contig name=SeqID_16867; Position on contig =9273..9332bp; Strand=+; Gene name=FlgL
agcatcactgggtatgttatcggattaatttgcgaaaagtttactgacaaaatgattttt

SEQ ID NO: 13124 - DNA, 60 bp, Xenorhabdus bovienii
  Promoter location: Contig name=SeqID_16867; Position on contig =10543..10602bp; Strand=+; Gene name=FliA
taaataacctctataaaataaggatcggcttgccgatccttattttttaacctttgtcag

SEQ ID NO: 13125 - DNA, 60 bp, Xenorhabdus bovienii
  Promoter location: Contig name=SeqID_16867; Position on contig =16174..16233bp; Strand=-; Gene name=PutP
cttttaacatggttgcacaaagttgcaacatgacagatattgttatgtaacttggttaag

SEQ ID NO: 13126 - DNA, 60 bp, Xenorhabdus bovienii
  Promoter location: Contig name=SeqID_16867; Position on contig =16435..16494bp; Strand=+; Gene name=PutP
attagttgttaaaaatgtttgagctaatctaggatagaaagtgattttaaaataattaca

SEQ ID NO: 13127 - DNA, 60 bp, Xenorhabdus bovienii
  Promoter location: Contig name=SeqID_16867; Position on contig =18490..18549bp; Strand=+
tggtataaatagataataaagattattgattttttctttttatttcataaagtgataatt

SEQ ID NO: 13128 - DNA, 60 bp, Xenorhabdus bovienii
  Promoter location: Contig name=SeqID_16867; Position on contig =21091..21150bp; Strand=-
atacggtgttcctgaaactcgaaagtactaggctgtgtcccttaatgtaaattgatagta

SEQ ID NO: 13129 - DNA, 60 bp, Xenorhabdus bovienii
  Promoter location: Contig name=SeqID_16867; Position on contig =23051..23110bp; Strand=+
gcccaacggtttgctgggctttgggttttcctctgtaaagcagtacctacaatgaatgcc

SEQ ID NO: 13130 - DNA, 60 bp, Xenorhabdus bovienii
  Promoter location: Contig name=SeqID_16867; Position on contig =23950..24009bp; Strand=-
ccacatcaggcgaggtggttctgctactccccagcaacaaaatcggttagaataaattcc

SEQ ID NO: 13131 - DNA, 60 bp, Xenorhabdus bovienii
  Promoter location: Contig name=SeqID_16867; Position on contig =23886..23945bp; Strand=+
ccagccgacaacctttctccgaaaatttctatccatagattaaattttattctcattatt

SEQ ID NO: 13132 - DNA, 60 bp, Xenorhabdus bovienii
  Promoter location: Contig name=SeqID_16867; Position on contig =24714..24773bp; Strand=+; Gene name=AnsP
cgattaatcagatcgcgaaaatcggactgagttcccttcaagtgatctattattttgaaa

SEQ ID NO: 13133 - DNA, 60 bp, Xenorhabdus bovienii
  Promoter location: Contig name=SeqID_16867; Position on contig =26846..26905bp; Strand=+; Gene name=WecD
atacttttgttattatttaaataaatttcaaacattctatttacatttatttttttatca

SEQ ID NO: 13134 - DNA, 60 bp, Xenorhabdus bovienii
  Promoter location: Contig name=SeqID_16867; Position on contig =28432..28491bp; Strand=+; Gene name=RhaT
gatatcatcccaaaccaatgattgctctgttttatttttcatttttggaaaattgatttc

SEQ ID NO: 13135 - DNA, 60 bp, Xenorhabdus bovienii
  Promoter location: Contig name=SeqID_16867; Position on contig =30234..30293bp; Strand=-
attaaaaagtacaagaatatcaaattaacgctttgaagtcatgaccgtatttttcaggcc

SEQ ID NO: 13136 - DNA, 60 bp, Xenorhabdus bovienii
  Promoter location: Contig name=SeqID_16867; Position on contig =30097..30156bp; Strand=+
atcaccagtgttgcctcaatatcttgataagggccaagtagagttggtaaggtgacagca

SEQ ID NO: 13137 - DNA, 60 bp, Xenorhabdus bovienii
  Promoter location: Contig name=SeqID_16867; Position on contig =31420..31479bp; Strand=-
tttagccggctaaaatttcatgcgtaacccctgatactcaggccgtttacgatctacaaa

SEQ ID NO: 13138 - DNA, 60 bp, Xenorhabdus bovienii
  Promoter location: Contig name=SeqID_16867; Position on contig =33588..33647bp; Strand=-
tttatccaagaaatcacatcatattttacgtacaagctcctaaagattaatttttaagca

SEQ ID NO: 13139 - DNA, 60 bp, Xenorhabdus bovienii
  Promoter location: Contig name=SeqID_16867; Position on contig =37871..37930bp; Strand=-
accacatttgaatcattcaagttatctttcctctctttttctaaatttaaaataatttgg

SEQ ID NO: 13140 - DNA, 60 bp, Xenorhabdus bovienii
  Promoter location: Contig name=SeqID_16867; Position on contig =38970..39029bp; Strand=-
ttaaataaaaacattttattaattaatttacaaatgtaatcaataattaaaattatccta

SEQ ID NO: 13141 - DNA, 60 bp, Xenorhabdus bovienii
  Promoter location: Contig name=SeqID_16867; Position on contig =38965..39024bp; Strand=+
caatataggataattttaattattgattacatttgtaaattaattaataaaatgttttta

SEQ ID NO: 13142 - DNA, 60 bp, Xenorhabdus bovienii
  Promoter location: Contig name=SeqID_16867; Position on contig =41371..41430bp; Strand=-
aaaagcaaattatcttttttatttgtgcattgtcacaaaactttagttaaaattttaccg

SEQ ID NO: 13143 - DNA, 60 bp, Xenorhabdus bovienii
  Promoter location: Contig name=SeqID_16867; Position on contig =41244..41303bp; Strand=+
taccaatgaaatattgttgttccatacgataccttattgttttatttatatgatgttact

SEQ ID NO: 13144 - DNA, 60 bp, Xenorhabdus bovienii
  Promoter location: Contig name=SeqID_16867; Position on contig =42780..42839bp; Strand=+
actgctttttatagcagcgatgattggatcaatggccccaaaatagagattatcgagaaa

SEQ ID NO: 13145 - DNA, 60 bp, Xenorhabdus bovienii
  Promoter location: Contig name=SeqID_16867; Position on contig =43456..43515bp; Strand=+; Gene name=CitB
aaattattccctcatattttttgatataaatatatgtctaagaataatatattttaattc

SEQ ID NO: 13146 - DNA, 60 bp, Xenorhabdus bovienii
  Promoter location: Contig name=SeqID_16868; Position on contig =990..1049bp; Strand=-; Gene name=VacB
aaatacagagaatcagggcggcttctgctgccctccatttttcaggtatcatttaagata

SEQ ID NO: 13147 - DNA, 60 bp, Xenorhabdus bovienii
  Promoter location: Contig name=SeqID_16868; Position on contig =4046..4105bp; Strand=-; Gene name=PurA
agaggttataaaacgcagctcgttttgcttaatttttaaaatgcccacataatgtgaaca

SEQ ID NO: 13148 - DNA, 60 bp, Xenorhabdus bovienii
  Promoter location: Contig name=SeqID_16868; Position on contig =5507..5566bp; Strand=-
aaataacagaagtgagaaaaaatactgaaaggtgctaaatgagatggtagaatccatttt

SEQ ID NO: 13149 - DNA, 60 bp, Xenorhabdus bovienii
  Promoter location: Contig name=SeqID_16868; Position on contig =5229..5288bp; Strand=+
ttcatttctttcatcaaagcatctggtgctaaaacgaccccatttgcgataatgctaatg

SEQ ID NO: 13150 - DNA, 60 bp, Xenorhabdus bovienii
  Promoter location: Contig name=SeqID_16868; Position on contig =8238..8297bp; Strand=-
tcaggaagacaaacaaggtatcattttgtcagccatttcaaggcgcttatagtcatgtag

SEQ ID NO: 13151 - DNA, 60 bp, Xenorhabdus bovienii
  Promoter location: Contig name=SeqID_16868; Position on contig =7874..7933bp; Strand=+
cccacggtttcgaccacctttattgttgccgccggagttgccgccattattattgctgct

SEQ ID NO: 13152 - DNA, 60 bp, Xenorhabdus bovienii
  Promoter location: Contig name=SeqID_16868; Position on contig =14828..14887bp; Strand=-
gttatggttattggttaaactatttaactgataaacctaaatctcattaggctttaattc

SEQ ID NO: 13153 - DNA, 60 bp, Xenorhabdus bovienii
  Promoter location: Contig name=SeqID_16868; Position on contig =18132..18191bp; Strand=+
gctcgcccatcacgtaagttaatcaatgaaattatctgcacttttgttatagtcggtaat

SEQ ID NO: 13154 - DNA, 60 bp, Xenorhabdus bovienii
  Promoter location: Contig name=SeqID_16868; Position on contig =19486..19545bp; Strand=-
gcggaatgtcgggttaatatgataatgctggaatttgatatcgcttttatagttaatcca

SEQ ID NO: 13155 - DNA, 60 bp, Xenorhabdus bovienii
  Promoter location: Contig name=SeqID_16868; Position on contig =19293..19352bp; Strand=+
cttttaaaagtcaagaaaagaaatctttctattcagtacagagcgcttaatatacaaaga

SEQ ID NO: 13156 - DNA, 60 bp, Xenorhabdus bovienii
  Promoter location: Contig name=SeqID_16868; Position on contig =21375..21434bp; Strand=-
tatataaattaagataaaaaagaaatccttggaaataaataaagatttatatttttaatt

SEQ ID NO: 13157 - DNA, 60 bp, Xenorhabdus bovienii
  Promoter location: Contig name=SeqID_16868; Position on contig =23756..23815bp; Strand=-
aacttttgaactgagtcaatggttaccgttaatcagcgccgaaattgtacaatcacaatg

SEQ ID NO: 13158 - DNA, 60 bp, Xenorhabdus bovienii
  Promoter location: Contig name=SeqID_16868; Position on contig =26199..26258bp; Strand=-; Gene name=LysR
actcttacaaacactaaaatgtcggataaatgatcgaaaggcatttgtattatattagcc

SEQ ID NO: 13159 - DNA, 60 bp, Xenorhabdus bovienii
  Promoter location: Contig name=SeqID_16868; Position on contig =26114..26173bp; Strand=+; Gene name=LysR
aacaacgccactgaactgcaacattgtaactgtatccaatcagatgataaactacactat

SEQ ID NO: 13160 - DNA, 60 bp, Xenorhabdus bovienii
  Promoter location: Contig name=SeqID_16868; Position on contig =27693..27752bp; Strand=-; Gene name=PorB
ataatgtcgagtcatacacttggccctttttgaggagcattattgtctaagatacgacca

SEQ ID NO: 13161 - DNA, 60 bp, Xenorhabdus bovienii
  Promoter location: Contig name=SeqID_16868; Position on contig =27559..27618bp; Strand=+; Gene name=PorB
cattcgccaatgagagtatacatccattttagaaacatttgtgattctaaaaattaacac

SEQ ID NO: 13162 - DNA, 60 bp, Xenorhabdus bovienii
  Promoter location: Contig name=SeqID_16868; Position on contig =39778..39837bp; Strand=-
atgtcatttgacacaatatgtcattgagtgacatattgtgcgttcgataacatattatgt

SEQ ID NO: 13163 - DNA, 60 bp, Xenorhabdus bovienii
  Promoter location: Contig name=SeqID_16868; Position on contig =39484..39543bp; Strand=+
cttgttcagcaaccctcttgagattcacgagatcgatagatctgggtaacaattcactaa

SEQ ID NO: 13164 - DNA, 60 bp, Xenorhabdus bovienii
  Promoter location: Contig name=SeqID_16868; Position on contig =41115..41174bp; Strand=-
agatagagcgatatgctgccattcaatgtaatgattgaatgataggttattatgacttta

SEQ ID NO: 13165 - DNA, 60 bp, Xenorhabdus bovienii
  Promoter location: Contig name=SeqID_16868; Position on contig =42510..42569bp; Strand=-
cccgaatcggctgataaccagcccttcctgtggctcaccaaacaggctgtcatccatttc

SEQ ID NO: 13166 - DNA, 60 bp, Xenorhabdus bovienii
  Promoter location: Contig name=SeqID_16868; Position on contig =42258..42317bp; Strand=+
tctctaaatctatccagataagattgttctcattttttgacatgatatatcctagtttcc

SEQ ID NO: 13167 - DNA, 60 bp, Xenorhabdus bovienii
  Promoter location: Contig name=SeqID_16868; Position on contig =51178..51237bp; Strand=-
aattgagaagttggttttgcatactcataaaatcgccgatcaaaaattatgatcggcggt

SEQ ID NO: 13168 - DNA, 60 bp, Xenorhabdus bovienii
  Promoter location: Contig name=SeqID_16868; Position on contig =51641..51700bp; Strand=-
ggattatagactttaaaatataatttggtataaaatccgtcatcttttatagtttgtctg

SEQ ID NO: 13169 - DNA, 60 bp, Xenorhabdus bovienii
  Promoter location: Contig name=SeqID_16868; Position on contig =51897..51956bp; Strand=-
ttatctttgcttgtaatgattttgttttttacagaaataaccaaattaataataagtatg

SEQ ID NO: 13170 - DNA, 60 bp, Xenorhabdus bovienii
  Promoter location: Contig name=SeqID_16868; Position on contig =53205..53264bp; Strand=-; Gene name=ProP
ggattaacatgaattgaagtgttcaaacgcttttttatatgccaaggcatgatattttat

SEQ ID NO: 13171 - DNA, 60 bp, Xenorhabdus bovienii
  Promoter location: Contig name=SeqID_16868; Position on contig =54768..54827bp; Strand=-
ttaaattatctaactttcttttttagtattctacgcgagtagatagttttgatataaaaa

SEQ ID NO: 13172 - DNA, 60 bp, Xenorhabdus bovienii
  Promoter location: Contig name=SeqID_16868; Position on contig =59481..59540bp; Strand=-; Gene name=PaaI
ggccatgttgccgaccagcttatcttgattgcggaatcgaagctctgcatagtcgtgatc

SEQ ID NO: 13173 - DNA, 60 bp, Xenorhabdus bovienii
  Promoter location: Contig name=SeqID_16868; Position on contig =59216..59275bp; Strand=+; Gene name=PaaI
aagttttccttcaataaattgttttccgaggtgcttcgcaaactggtaagatgagttata

SEQ ID NO: 13174 - DNA, 60 bp, Xenorhabdus bovienii
  Promoter location: Contig name=SeqID_16868; Position on contig =60243..60302bp; Strand=-
aattagtttgttctaatcttatacaatcaatgtaactggctattttttataattaaatta

SEQ ID NO: 13175 - DNA, 60 bp, Xenorhabdus bovienii
  Promoter location: Contig name=SeqID_16868; Position on contig =60222..60281bp; Strand=+
aatatatatccgggaagaagataatttaattataaaaaatagccagttacattgattgta

SEQ ID NO: 13176 - DNA, 60 bp, Xenorhabdus bovienii
  Promoter location: Contig name=SeqID_16868; Position on contig =61086..61145bp; Strand=-; Gene name=InsB
agatttggaataaccgattgtttttctattcagcctttttattcgggtacgatgggtaag

SEQ ID NO: 13177 - DNA, 60 bp, Xenorhabdus bovienii
  Promoter location: Contig name=SeqID_16868; Position on contig =63279..63338bp; Strand=-; Gene name=UvrD
ggtcgaatgttgacaggctttttcgtctaagcgtaacattcgcgccttacgataaacgta

SEQ ID NO: 13178 - DNA, 60 bp, Xenorhabdus bovienii
  Promoter location: Contig name=SeqID_16868; Position on contig =67958..68017bp; Strand=-
ggcaagccgctctatatgacggggcctgcaactcacgtttatgaaggtacgattcatttg

SEQ ID NO: 13179 - DNA, 60 bp, Xenorhabdus bovienii
  Promoter location: Contig name=SeqID_16868; Position on contig =69233..69292bp; Strand=-; Gene name=CyaY
ccacttttggttgccaaccagatttgatgaaagggttcttggcgattgataatgattttg

SEQ ID NO: 13180 - DNA, 60 bp, Xenorhabdus bovienii
  Promoter location: Contig name=SeqID_16868; Position on contig =69005..69064bp; Strand=+; Gene name=CyaY
tttcatcataataattaatgcctgtaattcatgcgccaatactctctataatcgcagtta

SEQ ID NO: 13181 - DNA, 60 bp, Xenorhabdus bovienii
  Promoter location: Contig name=SeqID_16868; Position on contig =69594..69653bp; Strand=+
attaatgaattataatataaaaataattcaattaaataacaatatttaattataagttaa

SEQ ID NO: 13182 - DNA, 60 bp, Xenorhabdus bovienii
  Promoter location: Contig name=SeqID_16868; Position on contig =73265..73324bp; Strand=+
gccatgaggaacgttgcttttgatatagcctggcatcattgggtgatgataatgcaataa

SEQ ID NO: 13183 - DNA, 60 bp, Xenorhabdus bovienii
  Promoter location: Contig name=SeqID_16868; Position on contig =73891..73950bp; Strand=+
tattattttaatatttaaaattatttttatctcacaacctgtatatctataatctattca

SEQ ID NO: 13184 - DNA, 60 bp, Xenorhabdus bovienii
  Promoter location: Contig name=SeqID_16868; Position on contig =78853..78912bp; Strand=-
atttttgtagggctttttctttttgtatctctgggagagatgctatttctaatcgttatt

SEQ ID NO: 13185 - DNA, 60 bp, Xenorhabdus bovienii
  Promoter location: Contig name=SeqID_16868; Position on contig =78736..78795bp; Strand=+
cataaaagacatttaaaaacaaatagttataacacctataaaagtgcaaaaataatagat

SEQ ID NO: 13186 - DNA, 60 bp, Xenorhabdus bovienii
  Promoter location: Contig name=SeqID_16870; Position on contig =864..923bp; Strand=-
tccatgccataaccgccggaaaatgtgtatgatttttcggcggtttttattttgacggct

SEQ ID NO: 13187 - DNA, 60 bp, Xenorhabdus bovienii
  Promoter location: Contig name=SeqID_16870; Position on contig =1694..1753bp; Strand=-
tgcctcggttatagctaggtagattgttttttatactggtataatgctaggatgaatttt

SEQ ID NO: 13188 - DNA, 60 bp, Xenorhabdus bovienii
  Promoter location: Contig name=SeqID_16870; Position on contig =2467..2526bp; Strand=-
tataattcacttggtggagagctgttcattactttaatttaggtaattttatacttttaa

SEQ ID NO: 13189 - DNA, 60 bp, Xenorhabdus bovienii
  Promoter location: Contig name=SeqID_16870; Position on contig =4852..4911bp; Strand=-; Gene name=FabG
aaaccgttttttcttttctaccattgtggtaaggcagaagaaaaagataagataatcacc

SEQ ID NO: 13190 - DNA, 60 bp, Xenorhabdus bovienii
  Promoter location: Contig name=SeqID_16870; Position on contig =5761..5820bp; Strand=-
tcgatgttttatttgtgatttatatttattaatatatttgtgatctttattattattgtc

SEQ ID NO: 13191 - DNA, 60 bp, Xenorhabdus bovienii
  Promoter location: Contig name=SeqID_16870; Position on contig =5468..5527bp; Strand=+
atcaatcacatttttacatgccgcctgatccgtcacatcaagaggaataaaatcaatatc

SEQ ID NO: 13192 - DNA, 60 bp, Xenorhabdus bovienii
  Promoter location: Contig name=SeqID_16870; Position on contig =5764..5823bp; Strand=+; Gene name=CaiC
aataataataaagatcacaaatatattaataaatataaatcacaaataaaacatcgagat

SEQ ID NO: 13193 - DNA, 60 bp, Xenorhabdus bovienii
  Promoter location: Contig name=SeqID_16870; Position on contig =25629..25688bp; Strand=-; Gene name=CysG
gtggtatgaatgatttttaatttaacgcattattacgtgagtgtgaataaaatgaatttg

SEQ ID NO: 13194 - DNA, 60 bp, Xenorhabdus bovienii
  Promoter location: Contig name=SeqID_16870; Position on contig =28680..28739bp; Strand=+
atattcaacatgagaacttcatacataacaaattgatattaccactaataaattttatta

SEQ ID NO: 13195 - DNA, 60 bp, Xenorhabdus bovienii
  Promoter location: Contig name=SeqID_16870; Position on contig =28934..28993bp; Strand=+
caaaaatatcaatggaatatagattgattcaggcaaaaaatatttttcagtattcccatt

SEQ ID NO: 13196 - DNA, 60 bp, Xenorhabdus bovienii
  Promoter location: Contig name=SeqID_16870; Position on contig =29445..29504bp; Strand=-
ggtggcaggttcgagatgtatattttccataatgtatgatgagttgttcaaataatatta

SEQ ID NO: 13197 - DNA, 60 bp, Xenorhabdus bovienii
  Promoter location: Contig name=SeqID_16870; Position on contig =29231..29290bp; Strand=+
gttacccagccaatcattgagaggaactgaccactctcctgactgaataaaataagtaca

SEQ ID NO: 13198 - DNA, 60 bp, Xenorhabdus bovienii
  Promoter location: Contig name=SeqID_16870; Position on contig =31448..31507bp; Strand=-
gcattatgtaaataaatattaaaaatgaaaatttcatcagcaataataaaatttactagg

SEQ ID NO: 13199 - DNA, 60 bp, Xenorhabdus bovienii
  Promoter location: Contig name=SeqID_16870; Position on contig =37076..37135bp; Strand=-
actcaaacggtgcgggcgggcggtaaattgacattgcgccatgcagataagttctggatg

SEQ ID NO: 13200 - DNA, 60 bp, Xenorhabdus bovienii
  Promoter location: Contig name=SeqID_16870; Position on contig =36838..36897bp; Strand=+
atctttgtttatatctccatgctctttatagtcagacttttcgttttcattctctctgcc

SEQ ID NO: 13201 - DNA, 60 bp, Xenorhabdus bovienii
  Promoter location: Contig name=SeqID_16870; Position on contig =42353..42412bp; Strand=-
acttaaaataaattagattatgcttaaaacaccgttttattagtaatctgcaatataaaa

SEQ ID NO: 13202 - DNA, 60 bp, Xenorhabdus bovienii
  Promoter location: Contig name=SeqID_16870; Position on contig =42439..42498bp; Strand=+
gtcaataaaataactaacactcactcctacaaaaaagaaaatagcattataattattttc

SEQ ID NO: 13203 - DNA, 60 bp, Xenorhabdus bovienii
  Promoter location: Contig name=SeqID_16870; Position on contig =44522..44581bp; Strand=-
attcggtaagcgttatattgcggttgactaatcttaaaaccctctgttagattaaataca

SEQ ID NO: 13204 - DNA, 60 bp, Xenorhabdus bovienii
  Promoter location: Contig name=SeqID_16870; Position on contig =44419..44478bp; Strand=+
atgattttctgacagctaagttatggaaaatacttccgttatgtgcttattctggcttta

SEQ ID NO: 13205 - DNA, 60 bp, Xenorhabdus bovienii
  Promoter location: Contig name=SeqID_16870; Position on contig =45915..45974bp; Strand=-
gcgtttactcaccccagtcacatcgttatctatacagatgaataagatattattcagttt

SEQ ID NO: 13206 - DNA, 60 bp, Xenorhabdus bovienii
  Promoter location: Contig name=SeqID_16870; Position on contig =47233..47292bp; Strand=-
ctggctaatatgataataaggttatctatttgaggtttatatataaataaattctcaaga

SEQ ID NO: 13207 - DNA, 60 bp, Xenorhabdus bovienii
  Promoter location: Contig name=SeqID_16870; Position on contig =46951..47010bp; Strand=+
ctcaggagctcttggttcattgcttgtatattctgcgcgactctctttattattctcaga

SEQ ID NO: 13208 - DNA, 60 bp, Xenorhabdus bovienii
  Promoter location: Contig name=SeqID_16870; Position on contig =48422..48481bp; Strand=-; Gene name=LysR
aatgatttgatgtaatgcgggaattataaaatttctaccaacataattattctgattata

SEQ ID NO: 13209 - DNA, 60 bp, Xenorhabdus bovienii
  Promoter location: Contig name=SeqID_16870; Position on contig =48981..49040bp; Strand=-
tgatttattattgtgttttaacattcaattgttatttaattagtatttattatttaagaa

SEQ ID NO: 13210 - DNA, 60 bp, Xenorhabdus bovienii
  Promoter location: Contig name=SeqID_16870; Position on contig =49980..50039bp; Strand=-; Gene name=SpoVK (BS)
aacagcaataaaaacactaaaatattaaataaaattattaacaaatagttattataataa

SEQ ID NO: 13211 - DNA, 60 bp, Xenorhabdus bovienii
  Promoter location: Contig name=SeqID_16870; Position on contig =53731..53790bp; Strand=-
gaatgtaaagcgactattattgtgaaaaaaaatcacaaaataaattttaaaagtgtgatt

SEQ ID NO: 13212 - DNA, 60 bp, Xenorhabdus bovienii
  Promoter location: Contig name=SeqID_16870; Position on contig =68420..68479bp; Strand=-
ttgtcattttgtggcggtagctttctttaatatattgtcttccatcgtatcttaattgta

SEQ ID NO: 13213 - DNA, 60 bp, Xenorhabdus bovienii
  Promoter location: Contig name=SeqID_16870; Position on contig =68921..68980bp; Strand=-
gccaataataatctctacctgatttaatctattgccataaatattagtattattagatat

SEQ ID NO: 13214 - DNA, 60 bp, Xenorhabdus bovienii
  Promoter location: Contig name=SeqID_16870; Position on contig =81212..81271bp; Strand=-
tttattaattaataacattaagttaattttccatttgttactatttatataattgattat

SEQ ID NO: 13215 - DNA, 60 bp, Xenorhabdus bovienii
  Promoter location: Contig name=SeqID_16870; Position on contig =80858..80917bp; Strand=+
tggcgaggccagaatgttatccatatcgatactcccttcggattttttattaaataaaaa

SEQ ID NO: 13216 - DNA, 60 bp, Xenorhabdus bovienii
  Promoter location: Contig name=SeqID_16870; Position on contig =82524..82583bp; Strand=-; Gene name=AcrR
tccatattcctgacaaatcgaacgttgccttttagtgtacagatctgtaccatttgttgc

SEQ ID NO: 13217 - DNA, 60 bp, Xenorhabdus bovienii
  Promoter location: Contig name=SeqID_16870; Position on contig =82544..82603bp; Strand=+; Gene name=AcrR
gtacactaaaaggcaacgttcgatttgtcaggaatatggacgatcattagaactaattag

SEQ ID NO: 13218 - DNA, 60 bp, Xenorhabdus bovienii
  Promoter location: Contig name=SeqID_16870; Position on contig =83281..83340bp; Strand=+
aaaagatctggttaagggactgactattataagaataaaaaatgtactaatattctggtg

SEQ ID NO: 13219 - DNA, 60 bp, Xenorhabdus bovienii
  Promoter location: Contig name=SeqID_16870; Position on contig =83548..83607bp; Strand=+
atgcctcatgaacaaaacaacaaataaaacaccatatctaattgatatttaattaaattt

SEQ ID NO: 13220 - DNA, 60 bp, Xenorhabdus bovienii
  Promoter location: Contig name=SeqID_16870; Position on contig =85684..85743bp; Strand=-; Gene name=CitB
atttttataggaaaaactcatttttatctcatataatttatatatgttaaattttatatt

SEQ ID NO: 13221 - DNA, 60 bp, Xenorhabdus bovienii
  Promoter location: Contig name=SeqID_16870; Position on contig =85636..85695bp; Strand=+; Gene name=CitB
catacatcagaagttaataagcacatagatacaattgttattatttttaatataaaattt

SEQ ID NO: 13222 - DNA, 60 bp, Xenorhabdus bovienii
  Promoter location: Contig name=SeqID_16870; Position on contig =94333..94392bp; Strand=-
aataaaattttcaaagagtaaaaaattgaaataaatattttgcttgatatatttttattc

SEQ ID NO: 13223 - DNA, 60 bp, Xenorhabdus bovienii
  Promoter location: Contig name=SeqID_16870; Position on contig =94550..94609bp; Strand=-; Gene name=IlvB
atgttggatatggaatttttatttcatatcccgtaatgctattgctctccaattccatct

SEQ ID NO: 13224 - DNA, 60 bp, Xenorhabdus bovienii
  Promoter location: Contig name=SeqID_16870; Position on contig =96973..97032bp; Strand=-
ttgttcttgcagctcattcaggttcgacgcagcagacataatgcctccataataaattgt

SEQ ID NO: 13225 - DNA, 60 bp, Xenorhabdus bovienii
  Promoter location: Contig name=SeqID_16870; Position on contig =100020..100079bp; Strand=-
tatatagatattaaaacaactaatttatatatattgtttttatttttatctttaatataa

SEQ ID NO: 13226 - DNA, 60 bp, Xenorhabdus bovienii
  Promoter location: Contig name=SeqID_16870; Position on contig =101914..101973bp; Strand=-
taaataatttctttttggtaattaaatttatttaaaaaagctaatttttataaattttta

SEQ ID NO: 13227 - DNA, 60 bp, Xenorhabdus bovienii
  Promoter location: Contig name=SeqID_16870; Position on contig =101621..101680bp; Strand=+
actgaacacctgctggagttgtatttaatgcatgtgaaatagcggggaataatggcaggt

SEQ ID NO: 13228 - DNA, 60 bp, Xenorhabdus bovienii
  Promoter location: Contig name=SeqID_16870; Position on contig =106560..106619bp; Strand=-; Gene name=CirA
aggtgtaatacgtttttctaattcgaaccgtaacaggcagaaaaaaataaaataacagtc

SEQ ID NO: 13229 - DNA, 60 bp, Xenorhabdus bovienii
  Promoter location: Contig name=SeqID_16870; Position on contig =109097..109156bp; Strand=-; Gene name=Fes
ccacgcaggtaaagataaatggttatcatttgctaaacaatattgattatcatttttatt

SEQ ID NO: 13230 - DNA, 60 bp, Xenorhabdus bovienii
  Promoter location: Contig name=SeqID_16870; Position on contig =108914..108973bp; Strand=+; Gene name=Fes
ccatatatttcatctcttaaaataggatttcttggaaataatttctttataatcagatta

SEQ ID NO: 13231 - DNA, 60 bp, Xenorhabdus bovienii
  Promoter location: Contig name=SeqID_16870; Position on contig =122640..122699bp; Strand=-; Gene name=ProP
agcatacgggcgataaagatagcgcggaagtgtgcattatttttaagtaaactgaagtcc

SEQ ID NO: 13232 - DNA, 60 bp, Xenorhabdus bovienii
  Promoter location: Contig name=SeqID_16870; Position on contig =122470..122529bp; Strand=+; Gene name=ProP
tattgattgtgataatcatttgtattgccattatcattaacggtcgatatgctagcacag

SEQ ID NO: 13233 - DNA, 60 bp, Xenorhabdus bovienii
  Promoter location: Contig name=SeqID_16870; Position on contig =125052..125111bp; Strand=-
attcccattttcatttatggttgcgtaatgtgtcccttacttctgggtaaaatgtactct

SEQ ID NO: 13234 - DNA, 60 bp, Xenorhabdus bovienii
  Promoter location: Contig name=SeqID_16870; Position on contig =124901..124960bp; Strand=+
tgcgataaaagcaaaaataacggtgattaatcggtaataagaaaaagtaaatttgcactg

SEQ ID NO: 13235 - DNA, 60 bp, Xenorhabdus bovienii
  Promoter location: Contig name=SeqID_16870; Position on contig =150724..150783bp; Strand=-; Gene name=CirA
tgtgaatacataaagcccttattcaatcacaaattaattatacccaataaactttaagtc

SEQ ID NO: 13236 - DNA, 60 bp, Xenorhabdus bovienii
  Promoter location: Contig name=SeqID_16870; Position on contig =153041..153100bp; Strand=-
aattatttttttgttaaatttgttattaaatttgttattaaatttgttattaaatgttga

SEQ ID NO: 13237 - DNA, 60 bp, Xenorhabdus bovienii
  Promoter location: Contig name=SeqID_16870; Position on contig =153285..153344bp; Strand=-; Gene name=MarR
tttttttaataggtctgtcgggcatattgatacgcgtttttatcattcataataaaaaaa

SEQ ID NO: 13238 - DNA, 60 bp, Xenorhabdus bovienii
  Promoter location: Contig name=SeqID_16870; Position on contig =154141..154200bp; Strand=-; Gene name=MhpD
taaggtcatttggcattgagtttaacttatttttaacttttatttggcaaaataatttta

SEQ ID NO: 13239 - DNA, 60 bp, Xenorhabdus bovienii
  Promoter location: Contig name=SeqID_16870; Position on contig =154130..154189bp; Strand=+; Gene name=MhpD
taacaaataaataaaattattttgccaaataaaagttaaaaataagttaaactcaatgcc

SEQ ID NO: 13240 - DNA, 60 bp, Xenorhabdus bovienii
  Promoter location: Contig name=SeqID_16870; Position on contig =162053..162112bp; Strand=-; Gene name=ProP
gaaaggaaaacacaaatagaacaaataaaaacaggatcaagcgtcggaacaatttgttga

SEQ ID NO: 13241 - DNA, 60 bp, Xenorhabdus bovienii
  Promoter location: Contig name=SeqID_16870; Position on contig =161879..161938bp; Strand=+; Gene name=ProP
gatcgccgcatctgccagcacagtgatagttttcatgccagtttccataaaaacgcgaca

SEQ ID NO: 13242 - DNA, 60 bp, Xenorhabdus bovienii
  Promoter location: Contig name=SeqID_16870; Position on contig =174231..174290bp; Strand=-
gttttttatttcacttgatttaatttggtctttactccttcgttatttattattgccccc

SEQ ID NO: 13243 - DNA, 60 bp, Xenorhabdus bovienii
  Promoter location: Contig name=SeqID_16870; Position on contig =173828..173887bp; Strand=+
cgccgcacctgacatgccgctccctgaatgtccgcctattccgccggtaaaaccgccacc

SEQ ID NO: 13244 - DNA, 60 bp, Xenorhabdus bovienii
  Promoter location: Contig name=SeqID_16870; Position on contig =174368..174427bp; Strand=+
agtgaatcgaaccgtttaatatttaatcataaaaggtgtttttttcgtaacatcatgaag

SEQ ID NO: 13245 - DNA, 60 bp, Xenorhabdus bovienii
  Promoter location: Contig name=SeqID_16870; Position on contig =175131..175190bp; Strand=-
tccaatagcataattttatttatttttatttttattttttggaaatgtattttttattaa

SEQ ID NO: 13246 - DNA, 60 bp, Xenorhabdus bovienii
  Promoter location: Contig name=SeqID_16870; Position on contig =174989..175048bp; Strand=+
aaattaataaattaatattttcaccataatatataaatatataaatatataaatatataa

SEQ ID NO: 13247 - DNA, 60 bp, Xenorhabdus bovienii
  Promoter location: Contig name=SeqID_16870; Position on contig =175380..175439bp; Strand=+
tcaagtgcgaccacttagtcgcttcaatcaagcaatggaagtaaacataaaattaacacc

SEQ ID NO: 13248 - DNA, 60 bp, Xenorhabdus bovienii
  Promoter location: Contig name=SeqID_16870; Position on contig =177792..177851bp; Strand=-
ccatctagtgataaaaaataaaatttcatcattttattcaaaattaatactattgaattc

SEQ ID NO: 13249 - DNA, 60 bp, Xenorhabdus bovienii
  Promoter location: Contig name=SeqID_16870; Position on contig =178660..178719bp; Strand=-
aattcgatataatacaattagtaatgcttagatggtgtcgtcataaataaattcatgtaa

SEQ ID NO: 13250 - DNA, 60 bp, Xenorhabdus bovienii; identical to SEQ ID NO: 12949
  Promoter location: Contig name=SeqID_16870; Position on contig =178433..178492bp; Strand=+

SEQ ID NO: 13251 - DNA, 60 bp, Xenorhabdus bovienii
  Promoter location: Contig name=SeqID_16870; Position on contig =179042..179101bp; Strand=+; Gene name=PTR2
tcccgcgttctacgatcacttgaataaataaacaaaatcacaacccgtacaatacattat

SEQ ID NO: 13252 - DNA, 60 bp, Xenorhabdus bovienii
  Promoter location: Contig name=SeqID_16870; Position on contig =184216..184275bp; Strand=-
tatctcaatgttcagtctattgcgaagcgacatcgataacggtagtttatgttgattccc

SEQ ID NO: 13253 - DNA, 60 bp, Xenorhabdus bovienii
  Promoter location: Contig name=SeqID_16870; Position on contig =185957..186016bp; Strand=-
cctggaaaaacaggatttgttttttctactgcgggtttaagctgttttaaaataaccgaa

SEQ ID NO: 13254 - DNA, 60 bp, Xenorhabdus bovienii
  Promoter location: Contig name=SeqID_16870; Position on contig =186758..186817bp; Strand=-
ctgctgctcactttgttggtcatgctcccaatagttagattattgtagtaaactttccat

SEQ ID NO: 13255 - DNA, 60 bp, Xenorhabdus bovienii; identical to SEQ ID NO: 13054
  Promoter location: Contig name=SeqID_16870; Position on contig =186562..186621bp; Strand=+

SEQ ID NO: 13256 - DNA, 60 bp, Xenorhabdus bovienii
  Promoter location: Contig name=SeqID_16870; Position on contig =188331..188390bp; Strand=-; Gene name=Fba
cccgtaagcgataattatttagctttgaaaggtgcagttttattaattatatttggcagt

SEQ ID NO: 13257 - DNA, 60 bp, Xenorhabdus bovienii
  Promoter location: Contig name=SeqID_16870; Position on contig =189156..189215bp; Strand=+
gtttgcgtgcacagtggtcggtatgcaggataacaggaacgccgtagtattctgccatct

SEQ ID NO: 13258 - DNA, 60 bp, Xenorhabdus bovienii
  Promoter location: Contig name=SeqID_16870; Position on contig =191882..191941bp; Strand=-
aatgtcttgtctgtcacaatctgattaattttgtgatgaatcatccgtacaatcagcagt

SEQ ID NO: 13259 - DNA, 60 bp, Xenorhabdus bovienii
  Promoter location: Contig name=SeqID_16870; Position on contig =191729..191788bp; Strand=+
gcgatcaccgaaatttcagcttgacgcccggattcgtagagagcacgtaagatactgcgc

SEQ ID NO: 13260 - DNA, 60 bp, Xenorhabdus bovienii
  Promoter location: Contig name=SeqID_16870; Position on contig =194340..194399bp; Strand=-; Gene name=WecD
ctcataggcaaaaaactcgctctttttgccttgatcaacctataaagtatcatgtctaat

SEQ ID NO: 13261 - DNA, 60 bp, Xenorhabdus bovienii
  Promoter location: Contig name=SeqID_16870; Position on contig =194410..194469bp; Strand=+; Gene name=WecD
tttaattgatattgaggcttatttgaattgaaacactgatgattttgtatagtatttggt

SEQ ID NO: 13262 - DNA, 60 bp, Xenorhabdus bovienii
  Promoter location: Contig name=SeqID_16870; Position on contig =195251..195310bp; Strand=-; Gene name=DnaQ
aataagataaaataacttcgtcattaaggtgaaaaactgtgcaagcgcacaattttgtta

SEQ ID NO: 13263 - DNA, 60 bp, Xenorhabdus bovienii
  Promoter location: Contig name=SeqID_16870; Position on contig =196115..196174bp; Strand=-; Gene name=RnhA
aggcaagatccatcggtgaaaatttctacctttttactcatatttggtagactcttccta

SEQ ID NO: 13264 - DNA, 60 bp, Xenorhabdus bovienii
  Promoter location: Contig name=SeqID_16870; Position on contig =196039..196098bp; Strand=+; Gene name=RnhA
aggacaatttggcgggtaattgcagtgctcatagtgtttttttgtgtcagacttagagtt

SEQ ID NO: 13265 - DNA, 60 bp, Xenorhabdus bovienii
  Promoter location: Contig name=SeqID_16870; Position on contig =196900..196959bp; Strand=-
ttctaataatgtgaattacaataatttattgaataatataatttttttaaattaaatcgc

SEQ ID NO: 13266 - DNA, 60 bp, Xenorhabdus bovienii
  Promoter location: Contig name=SeqID_16870; Position on contig =196612..196671bp; Strand=+
tattcaacaataactatcaccaattagcctcatattcttatggggcttaacatatacaat

SEQ ID NO: 13267 - DNA, 60 bp, Xenorhabdus bovienii
  Promoter location: Contig name=SeqID_16870; Position on contig =196915..196974bp; Strand=+
aaaattatattattcaataaattattgtaattcacattattagaaataaattcacacgtt

SEQ ID NO: 13268 - DNA, 60 bp, Xenorhabdus bovienii
  Promoter location: Contig name=SeqID_16870; Position on contig =198547..198606bp; Strand=-; Gene name=GloB
atcacaaagtaaccaaatgtagttatctgaaagggcggggatcctgataagctccattat

SEQ ID NO: 13269 - DNA, 60 bp, Xenorhabdus bovienii
  Promoter location: Contig name=SeqID_16870; Position on contig =198390..198449bp; Strand=+; Gene name=GloB
aatcttcggccaccacggttccaattgacgttccagagcgacgcggtaatactctcccca

SEQ ID NO: 13270 - DNA, 60 bp, Xenorhabdus bovienii
  Promoter location: Contig name=SeqID_16870; Position on contig =201059..201118bp; Strand=+
ttcatttaatttttaagttataataatcacaataaaataaagaaatatataatttaagtt

SEQ ID NO: 13271 - DNA, 60 bp, Xenorhabdus bovienii
  Promoter location: Contig name=SeqID_16870; Position on contig =201786..201845bp; Strand=+
taactaataaaacaataaattatcattttgcctacacagtattttaagtgtatatttatt

SEQ ID NO: 13272 - DNA, 60 bp, Xenorhabdus bovienii
  Promoter location: Contig name=SeqID_16870; Position on contig =202425..202484bp; Strand=-
ttttatattacaggtaatatagttgaaaaacaggctgttgatgctgaataaagcaagcag

SEQ ID NO: 13273 - DNA, 60 bp, Xenorhabdus bovienii
  Promoter location: Contig name=SeqID_16870; Position on contig =202820..202879bp; Strand=-
aaataaaagtgcttacttctttttatatatttaaattgatatgtatgtataatttatgtt

SEQ ID NO: 13274 - DNA, 60 bp, Xenorhabdus bovienii
  Promoter location: Contig name=SeqID_16870; Position on contig =218036..218095bp; Strand=-
atcgcgcaataaaaacacaggggttttactgagctttccgttgtcgttacaatggcattt

SEQ ID NO: 13275 - DNA, 60 bp, Xenorhabdus bovienii
  Promoter location: Contig name=SeqID_16870; Position on contig =219758..219817bp; Strand=-
cagtcgcttttattgaatcagaaattgatagctggatacaatgaacttataatattatta

SEQ ID NO: 13276 - DNA, 60 bp, Xenorhabdus bovienii
  Promoter location: Contig name=SeqID_16870; Position on contig =220035..220094bp; Strand=-
gtgctcatatttattccctcatttaatcaacaatacatattgctaagtaacatgaaggcg

SEQ ID NO: 13277 - DNA, 60 bp, Xenorhabdus bovienii
  Promoter location: Contig name=SeqID_16870; Position on contig =223060..223119bp; Strand=-
actatttgaaataaataaaaaaatatctatatatcccgttatcccgtgaaaatctatgta

SEQ ID NO: 13278 - DNA, 60 bp, Xenorhabdus bovienii
  Promoter location: Contig name=SeqID_16870; Position on contig =222805..222864bp; Strand=+
aacatcaagggcagtcattttgttttcaataaaaattttctgctgactataataacctag

SEQ ID NO: 13279 - DNA, 60 bp, Xenorhabdus bovienii
  Promoter location: Contig name=SeqID_16870; Position on contig =223984..224043bp; Strand=-
cagataatttgattagtctaatttataattattgaaattaggctatcttatttcacttta

SEQ ID NO: 13280 - DNA, 60 bp, Xenorhabdus bovienii
  Promoter location: Contig name=SeqID_16870; Position on contig =224761..224820bp; Strand=-
tagggtttggcacattatcaaaagcagaatatgcacgttgcgatggttatttttatcttc

SEQ ID NO: 13281 - DNA, 60 bp, Xenorhabdus bovienii
  Promoter location: Contig name=SeqID_16870; Position on contig =225480..225539bp; Strand=-
gggcgctgaggaatccccagaaaatagacaggcatagcgttgtgtgatctactgattgtt

SEQ ID NO: 13282 - DNA, 60 bp, Xenorhabdus bovienii
  Promoter location: Contig name=SeqID_16870; Position on contig =225264..225323bp; Strand=+
agccgatcaatacgtttaattttatgtttgacgtgagcgtttcctggtaaaaagcgccca

SEQ ID NO: 13283 - DNA, 60 bp, Xenorhabdus bovienii
  Promoter location: Contig name=SeqID_16870; Position on contig =226752..226811bp; Strand=+
gcttgattttaaatccttacaggattcgataatgtaatttaactaattatttttaatgaa

SEQ ID NO: 13284 - DNA, 60 bp, Xenorhabdus bovienii
  Promoter location: Contig name=SeqID_16870; Position on contig =228833..228892bp; Strand=+
gctgatctttttaaagacattattgatgatgtcaggagatttggtggtatcagggagggt

SEQ ID NO: 13285 - DNA, 60 bp, Xenorhabdus bovienii
  Promoter location: Contig name=SeqID_16870; Position on contig =234505..234564bp; Strand=-
tctctacacctaaataattagctcattgctaccgtttgatacttaacctcacggcagctt

SEQ ID NO: 13286 - DNA, 60 bp, Xenorhabdus bovienii
  Promoter location: Contig name=SeqID_16870; Position on contig =234230..234289bp; Strand=+
ttgagtacgctgtactgccgcctgcataaacaggtcatccccactggcaaaatgccagcc

SEQ ID NO: 13287 - DNA, 60 bp, Xenorhabdus bovienii
  Promoter location: Contig name=SeqID_16870; Position on contig =234742..234801bp; Strand=-
tttcctttcgtagctgacgttgaggtggggaagatccacttcggttttatcttaacttca

SEQ ID NO: 13288 - DNA, 60 bp, Xenorhabdus bovienii
  Promoter location: Contig name=SeqID_16870; Position on contig =234791..234850bp; Strand=+
acgaaaggaaatggaaaccataacctaacgcgcctaagtaccgttggtactcttaagtta

SEQ ID NO: 13289 - DNA, 60 bp, Xenorhabdus bovienii
  Promoter location: Contig name=SeqID_16870; Position on contig =235045..235104bp; Strand=+
aactggatcttttaaatgtggcaatgagaaactgagagttttaatagtatattcataaat

SEQ ID NO: 13290 - DNA, 60 bp, Xenorhabdus bovienii
  Promoter location: Contig name=SeqID_16872; Position on contig =907..966bp; Strand=-
tgcaggtcccctgcaaaagtcattatcgttatggaagcaccggagtctatcatgaacggt

SEQ ID NO: 13291 - DNA, 60 bp, Xenorhabdus bovienii
  Promoter location: Contig name=SeqID_16873; Position on contig =1778..1837bp; Strand=+
ggcttgtagctcaggtggttagagcgcacccctgataagggtgaggtcggtggttcaagt

SEQ ID NO: 13292 - DNA, 60 bp, Xenorhabdus bovienii
  Promoter location: Contig name=SeqID_16873; Position on contig =5766..5825bp; Strand=-
ctcgctatcgctagaggggattttttgtatcttatttatcaacaagctatgatttacaga

SEQ ID NO: 13293 - DNA, 60 bp, Xenorhabdus bovienii
  Promoter location: Contig name=SeqID_16873; Position on contig =5441..5500bp; Strand=+
aacaaaatcctgccaactccagcctgttcctggtggacgactatcataaaattctttcgc

SEQ ID NO: 13294 - DNA, 60 bp, Xenorhabdus bovienii
  Promoter location: Contig name=SeqID_16873; Position on contig =7283..7342bp; Strand=-
tcaacacttgagagttaattcatactcacaattaaccaaactaatggtattatcgccaga

SEQ ID NO: 13295 - DNA, 60 bp, Xenorhabdus bovienii
  Promoter location: Contig name=SeqID_16873; Position on contig =6965..7024bp; Strand=+
ttgatatccagctcagggcgtttttgtttggcgacatacagagcattcataatatctcgc

SEQ ID NO: 13296 - DNA, 60 bp, Xenorhabdus bovienii
  Promoter location: Contig name=SeqID_16873; Position on contig =10046..10105bp; Strand=-
atggtggctaaagttattcatagtaattgtttaatcaagggtgattgtttattgatgtga

SEQ ID NO: 13297 - DNA, 60 bp, Xenorhabdus bovienii
  Promoter location: Contig name=SeqID_16873; Position on contig =9856..9915bp; Strand=+
tccgagaatagctgttttattcggcgttacaggaagaattgggccagtaaaatgccccat

SEQ ID NO: 13298 - DNA, 60 bp, Xenorhabdus bovienii
  Promoter location: Contig name=SeqID_16873; Position on contig =10875..10934bp; Strand=+; Gene name=SpoU
ttaatggattgtcgttgccagaggtagcttcgggcgcgtacatcgggtaatctgcgcgcc

SEQ ID NO: 13299 - DNA, 60 bp, Xenorhabdus bovienii
  Promoter location: Contig name=SeqID_16873; Position on contig =12609..12668bp; Strand=-
aggattgtgccttgaaatggtattgaaattgatcaattttaatcgaataagatttatccg

SEQ ID NO: 13300 - DNA, 60 bp, Xenorhabdus bovienii
  Promoter location: Contig name=SeqID_16873; Position on contig =21807..21866bp; Strand=-; Gene name=IucD
ataagttttagttgtcataatcactcctaataaatataagatgaatttataatttcgatt

SEQ ID NO: 13301 - DNA, 60 bp, Xenorhabdus bovienii
  Promoter location: Contig name=SeqID_16873; Position on contig =21686..21745bp; Strand=+; Gene name=IucD
gttattgtcaagataaaaagaatattaaataagataaattttccttttatttttagcatc

SEQ ID NO: 13302 - DNA, 60 bp, Xenorhabdus bovienii
  Promoter location: Contig name=SeqID_16873; Position on contig =25674..25733bp; Strand=+
gttttattatatggttatatctctgaattgtatttaattaaataatctatattgaaaaac

SEQ ID NO: 13303 - DNA, 60 bp, Xenorhabdus bovienii
  Promoter location: Contig name=SeqID_16873; Position on contig =26087..26146bp; Strand=-
gaaattacagcccagataatttgttggctcataaaactggcaatcgataaactgggtatc

SEQ ID NO: 13304 - DNA, 60 bp, Xenorhabdus bovienii
  Promoter location: Contig name=SeqID_16873; Position on contig =25883..25942bp; Strand=+
aacagaatttttataaccatcgggtggacacatcagtaagaatgcttcaaaatcgctgct

SEQ ID NO: 13305 - DNA, 60 bp, Xenorhabdus bovienii
  Promoter location: Contig name=SeqID_16873; Position on contig =29511..29570bp; Strand=-
accctttccagtagtgtaaatgcacactactggaggtgtgttctgtctacaatggtttta

SEQ ID NO: 13306 - DNA, 60 bp, Xenorhabdus bovienii
  Promoter location: Contig name=SeqID_16873; Position on contig =29447..29506bp; Strand=+
tttatttcctctttaatattcatggtgaatctccgtgtttttcttgtttaacttgctgtt

SEQ ID NO: 13307 - DNA, 60 bp, Xenorhabdus bovienii
  Promoter location: Contig name=SeqID_16873; Position on contig =31518..31577bp; Strand=-
aattaaataatttatacatttcatattttcactttcaccatattttgttaatgttgtttc

SEQ ID NO: 13308 - DNA, 60 bp, Xenorhabdus bovienii
  Promoter location: Contig name=SeqID_16873; Position on contig =31205..31264bp; Strand=+
agcagaaacccacagagacatacctgcactaagcagagcggtgatgataaattggcttgc

SEQ ID NO: 13309 - DNA, 60 bp, Xenorhabdus bovienii
  Promoter location: Contig name=SeqID_16873; Position on contig =35036..35095bp; Strand=-
tagatatgtgaaaaaatgattcgaatgattcggagtaataaagaaaatatatcattaaca

SEQ ID NO: 13310 - DNA, 60 bp, Xenorhabdus bovienii
  Promoter location: Contig name=SeqID_16873; Position on contig =34918..34977bp; Strand=+
ctgttccttgttgagaccggattctaataacttaaatgcgggttctggatgatcgccgaa

SEQ ID NO: 13311 - DNA, 60 bp, Xenorhabdus bovienii
  Promoter location: Contig name=SeqID_16873; Position on contig =35224..35283bp; Strand=+
tcctaaaggcgtattttaggtagtgttgatgactcatctttctgttatatatttattttt

SEQ ID NO: 13312 - DNA, 60 bp, Xenorhabdus bovienii
  Promoter location: Contig name=SeqID_16873; Position on contig =35982..36041bp; Strand=-; Gene name=Ada
tgatgatacataaactacctccatttaatttattgttaataatttctatactagcctaaa

SEQ ID NO: 13313 - DNA, 60 bp, Xenorhabdus bovienii
  Promoter location: Contig name=SeqID_16873; Position on contig =35745..35804bp; Strand=+; Gene name=Ada
atttttgtattatattcggataatctatttatgaaataaatacaatatatgttgtgtttt

SEQ ID NO: 13314 - DNA, 60 bp, Xenorhabdus bovienii
  Promoter location: Contig name=SeqID_16873; Position on contig =36914..36973bp; Strand=-
tgtgtttaaaaacataaaaaacccgttgtagtaaacgggttttcaaaatacggggataga

SEQ ID NO: 13315 - DNA, 60 bp, Xenorhabdus bovienii
  Promoter location: Contig name=SeqID_16873; Position on contig =36595..36654bp; Strand=+
cacattttgttatatatttcgtgatctacgttacagacagtagactatattattgttgta

SEQ ID NO: 13316 - DNA, 60 bp, Xenorhabdus bovienii
  Promoter location: Contig name=SeqID_16873; Position on contig =38384..38443bp; Strand=-; Gene name=LipB
taacatttttcaaaaaaaattgaatggatttattgatctgatggctctgacatagggatt

SEQ ID NO: 13317 - DNA, 60 bp, Xenorhabdus bovienii
  Promoter location: Contig name=SeqID_16873; Position on contig =39363..39422bp; Strand=-; Gene name=TrkG
atccaatgagcaacgtctcaaaaaaggcaaacacacttttttctttataaaatagtgcaa

SEQ ID NO: 13318 - DNA, 60 bp, Xenorhabdus bovienii
  Promoter location: Contig name=SeqID_16873; Position on contig =39158..39217bp; Strand=+; Gene name=TrkG
ttgagaatgctttaatgcaataatattgttaattagacgaatatatttaaattttatatt

SEQ ID NO: 13319 - DNA, 60 bp, Xenorhabdus bovienii
  Promoter location: Contig name=SeqID_16873; Position on contig =40869..40928bp; Strand=-; Gene name=ViuB
ttcttttaagaacagagtaaaaatagagtaggttgaagacataatattatattaacaaaa

SEQ ID NO: 13320 - DNA, 60 bp, Xenorhabdus bovienii
  Promoter location: Contig name=SeqID_16873; Position on contig =40781..40840bp; Strand=+; Gene name=ViuB
ttgataattattatcaaaatgatattgatttaagatattccttgaagtatgttgactaat

SEQ ID NO: 13321 - DNA, 60 bp, Xenorhabdus bovienii
  Promoter location: Contig name=SeqID_16873; Position on contig =41822..41881bp; Strand=+
atttcaccatgaatcgcggcttttaaaatgccccgactggggcattaaatacttaatcaa

SEQ ID NO: 13322 - DNA, 60 bp, Xenorhabdus bovienii
  Promoter location: Contig name=SeqID_16873; Position on contig =43510..43569bp; Strand=-; Gene name=RlpA
caatttgttttaatgtcagcttttttgtcatttgttattatgtcgcttattatcaatccc

SEQ ID NO: 13323 - DNA, 60 bp, Xenorhabdus bovienii
  Promoter location: Contig name=SeqID_16873; Position on contig =53601..53660bp; Strand=-
cagcgatctcactttaacaagtgttgttgcccctatcccttatcagctatgctatgaggt

SEQ ID NO: 13324 - DNA, 60 bp, Xenorhabdus bovienii
  Promoter location: Contig name=SeqID_16873; Position on contig =53360..53419bp; Strand=+
gtgtagttacggacgtggcccatatgtagtcggccagaaggataaggtagcatggacaga

SEQ ID NO: 13325 - DNA, 60 bp, Xenorhabdus bovienii
  Promoter location: Contig name=SeqID_16873; Position on contig =55924..55983bp; Strand=-; Gene name=ArtI
gaggtagtcgttccctacctcatttttttagcctgttcttttgagtcaatgatttaccac

SEQ ID NO: 13326 - DNA, 60 bp, Xenorhabdus bovienii
  Promoter location: Contig name=SeqID_16873; Position on contig =57194..57253bp; Strand=-
agtcgcataattcattatttttaccatacgcttaaccaaatacactttatattattctta

SEQ ID NO: 13327 - DNA, 60 bp, Xenorhabdus bovienii
  Promoter location: Contig name=SeqID_16873; Position on contig =56968..57027bp; Strand=+
tggcgtttacatttttgtagaaacgatttcctgaatctttttgtttatatgctgtaaaaa

SEQ ID NO: 13328 - DNA, 60 bp, Xenorhabdus bovienii
  Promoter location: Contig name=SeqID_16873; Position on contig =62757..62816bp; Strand=+; Gene name=UbiH
attcgttcatctgacagccccaagttttgatatacagtttttttatcgtcgacattttat

SEQ ID NO: 13329 - DNA, 60 bp, Xenorhabdus bovienii
  Promoter location: Contig name=SeqID_16873; Position on contig =64504..64563bp; Strand=-
ctttattttcatgcctcacctcatatcaatttgacaatatatacctgtaaattaactttt

SEQ ID NO: 13330 - DNA, 60 bp, Xenorhabdus bovienii
  Promoter location: Contig name=SeqID_16873; Position on contig =64304..64363bp; Strand=+
gtatgatggaattgcacaatttattgttgagtctaatgaaaagagcctatgattcctttg

SEQ ID NO: 13331 - DNA, 60 bp, Xenorhabdus bovienii
  Promoter location: Contig name=SeqID_16873; Position on contig =66777..66836bp; Strand=-
agattattgacaacggctatctctccattgactatgcccatggactccaaaatagtggtg

SEQ ID NO: 13332 - DNA, 60 bp, Xenorhabdus bovienii
  Promoter location: Contig name=SeqID_16873; Position on contig =66710..66769bp; Strand=+
ataagtcaccatgaaatccttgacagtactgtcagagtcaaggggtttgtgatgaaaatg

SEQ ID NO: 13333 - DNA, 60 bp, Xenorhabdus bovienii
  Promoter location: Contig name=SeqID_16876; Position on contig =1625..1684bp; Strand=-; Gene name=WecG
gtgtctgttattcactatgcataatgaaacaggctttgactcgattttataattttttat

SEQ ID NO: 13334 - DNA, 60 bp, Xenorhabdus bovienii
  Promoter location: Contig name=SeqID_16876; Position on contig =3821..3880bp; Strand=-
atcctaaccctgacatatcaagagttccggcgcgttcgctttaactttaatatctttttt

SEQ ID NO: 13335 - DNA, 60 bp, Xenorhabdus bovienii
  Promoter location: Contig name=SeqID_16876; Position on contig =12548..12607bp; Strand=-
agttttattcagggaaatataaattaatgactgtttccgatggtctgtattctacataca

SEQ ID NO: 13336 - DNA, 60 bp, Xenorhabdus bovienii
  Promoter location: Contig name=SeqID_16876; Position on contig =16492..16551bp; Strand=-
tttgaaatcaatctgagtacttcaaactattgccttgtaatattagttaatatgttaaaa

SEQ ID NO: 13337 - DNA, 60 bp, Xenorhabdus bovienii
  Promoter location: Contig name=SeqID_16876; Position on contig =16501..16560bp; Strand=+
attaactaatattacaaggcaatagtttgaagtactcagattgatttcaaaataaggctg

SEQ ID NO: 13338 - DNA, 60 bp, Xenorhabdus bovienii
  Promoter location: Contig name=SeqID_16876; Position on contig =17515..17574bp; Strand=-; Gene name=SrmB
agtcggaaaacttcttttctgtcaaatgtgttttgctcatagtgtggtagaatatcagtt

SEQ ID NO: 13339 - DNA, 60 bp, Xenorhabdus bovienii
  Promoter location: Contig name=SeqID_16876; Position on contig =17313..17372bp; Strand=+; Gene name=SrmB
ccagaattcgacgagaactgcgccttttacgtttaatttttttgcatcaaaatccgcatc

SEQ ID NO: 13340 - DNA, 60 bp, Xenorhabdus bovienii
  Promoter location: Contig name=SeqID_16876; Position on contig =22556..22615bp; Strand=-; Gene name=AcuC (BS)
tttgttaatggtttattatgaaaaacgtttattgttttttctttaaatataatttgaaaa

SEQ ID NO: 13341 - DNA, 60 bp, Xenorhabdus bovienii
  Promoter location: Contig name=SeqID_16876; Position on contig =25982..26041bp; Strand=-; Gene name=LysR
cttaccgtgacaagtttaatgttgcataaaatgcaacatagtcttgttaatatatcaatt

SEQ ID NO: 13342 - DNA, 60 bp, Xenorhabdus bovienii
  Promoter location: Contig name=SeqID_16876; Position on contig =25848..25907bp; Strand=+; Gene name=LysR
acgacatttgcctaactgcgctaattgctggcgcaggttcaacgtatcaaaataattagc

SEQ ID NO: 13343 - DNA, 60 bp, Xenorhabdus bovienii
  Promoter location: Contig name=SeqID_16876; Position on contig =30426..30485bp; Strand=-; Gene name=IlvE
aagacaaaatgtaacaggcggctcgttccctgcctgttttgattgctgatactaattaga

SEQ ID NO: 13344 - DNA, 60 bp, Xenorhabdus bovienii
  Promoter location: Contig name=SeqID_16876; Position on contig =34057..34116bp; Strand=+
taaatatatttacgagcctcttcgcaaaataacaacaaaatactttttattattttttat

SEQ ID NO: 13345 - DNA, 60 bp, Xenorhabdus bovienii
  Promoter location: Contig name=SeqID_16876; Position on contig =36155..36214bp; Strand=-; Gene name=LysR
ttttcagtaattcagtgtccacatgtatctccaatagtttttgtcgttaagatttaaata

SEQ ID NO: 13346 - DNA, 60 bp, Xenorhabdus bovienii
  Promoter location: Contig name=SeqID_16876; Position on contig =36111..36170bp; Strand=+; Gene name=LysR
atggcgcggagtattaggtaggcttgacattctgtaaaacaaaatatttaaatcttaacg

SEQ ID NO: 13347 - DNA, 60 bp, Xenorhabdus bovienii
  Promoter location: Contig name=SeqID_16880; Position on contig =23..82bp; Strand=+
aaaaccattgagagatattgcatcatgaacgtccagatttcaatctttatacttgatatc

SEQ ID NO: 13348 - DNA, 60 bp, Xenorhabdus bovienii
  Promoter location: Contig name=SeqID_16880; Position on contig =2572..2631bp; Strand=+
gtcactagaaaaggtaaaaacttctttaatttttcacccattacgtgtactgtatatgca

SEQ ID NO: 13349 - DNA, 60 bp, Xenorhabdus bovienii
  Promoter location: Contig name=SeqID_16880; Position on contig =3192..3251bp; Strand=+
attatgtagcacgggggcaggaaattattacctgcccccgtgctatttaatatgtgttta

SEQ ID NO: 13350 - DNA, 60 bp, Xenorhabdus bovienii
  Promoter location: Contig name=SeqID_16880; Position on contig =4925..4984bp; Strand=+
tcgttcagcagaccccaaaagctttttttacgttggaaaaaggcttttattctattgatt

SEQ ID NO: 13351 - DNA, 60 bp, Xenorhabdus bovienii
  Promoter location: Contig name=SeqID_16880; Position on contig =9661..9720bp; Strand=+; Gene name=RfaG
gaagtaaatacaggggctatgtgatctgcaccccaaaagttggacgctatacttcaactt

SEQ ID NO: 13352 - DNA, 60 bp, Xenorhabdus bovienii
  Promoter location: Contig name=SeqID_16881; Position on contig =1826..1885bp; Strand=+
cagagatcccatccgttaatctctcttcactaatgtcacattagataatttcttcatttt

SEQ ID NO: 13353 - DNA, 60 bp, Xenorhabdus bovienii
  Promoter location: Contig name=SeqID_16881; Position on contig =3762..3821bp; Strand=-
tttgaaaacacgtatgaattcgcagtgcagtatcggcgaagtactgataaagtatcgcaa

SEQ ID NO: 13354 - DNA, 60 bp, Xenorhabdus bovienii
  Promoter location: Contig name=SeqID_16881; Position on contig =3983..4042bp; Strand=+
aataaaaatagaggaaaaagctattaaagacccaataggctgacattatctagataatgt

SEQ ID NO: 13355 - DNA, 60 bp, Xenorhabdus bovienii
  Promoter location: Contig name=SeqID_16881; Position on contig =4221..4280bp; Strand=+
tatattttaaaagcaggtttatttttattcaaaataattctgatatgtcattatttttaa

SEQ ID NO: 13356 - DNA, 60 bp, Xenorhabdus bovienii
  Promoter location: Contig name=SeqID_16881; Position on contig =4409..4468bp; Strand=+; Gene name=TnaA
cattatcatattttaaatccttttcctatctaatcaattctctctttttttatagagatt

SEQ ID NO: 13357 - DNA, 60 bp, Xenorhabdus bovienii
  Promoter location: Contig name=SeqID_16881; Position on contig =7703..7762bp; Strand=-
tcaatatacccaatagatttcaagttgcagcccacaaagcagcaacttaaaagatgaagg

SEQ ID NO: 13358 - DNA, 60 bp, Xenorhabdus bovienii
  Promoter location: Contig name=SeqID_16881; Position on contig =11390..11449bp; Strand=-
caatccgttcataaaccaaattttatcattcacgcggaaaccattgctaaattgccgcta

SEQ ID NO: 13359 - DNA, 60 bp, Xenorhabdus bovienii
  Promoter location: Contig name=SeqID_16881; Position on contig =11199..11258bp; Strand=+
tgtcttgtgtttaagtccatgatagaaaacaatctgatttctttttttatgatttctttt

SEQ ID NO: 13360 - DNA, 60 bp, Xenorhabdus bovienii
  Promoter location: Contig name=SeqID_16881; Position on contig =16745..16804bp; Strand=-
agtaacgtaactgcgggttgctaatgccatctgttccttcttcgcggtaaagtactctct

SEQ ID NO: 13361 - DNA, 60 bp, Xenorhabdus bovienii
  Promoter location: Contig name=SeqID_16881; Position on contig =16662..16721bp; Strand=+
atgacagctacgaaatacatatcgcggttatctggattccacctgttgtacaggtggttt

SEQ ID NO: 13362 - DNA, 60 bp, Xenorhabdus bovienii
  Promoter location: Contig name=SeqID_16881; Position on contig =17275..17334bp; Strand=-
tcaacgtttactaaaaatgagttgatatttaaacctatctcgataggttttattaataaa

SEQ ID NO: 13363 - DNA, 60 bp, Xenorhabdus bovienii
  Promoter location: Contig name=SeqID_16881; Position on contig =17991..18050bp; Strand=+; Gene name=FadB
agcagttaggatacttaataatttaaatttttctaaatcctgatttaaataattttaaaa

SEQ ID NO: 13364 - DNA, 60 bp, Xenorhabdus bovienii
  Promoter location: Contig name=SeqID_16881; Position on contig =21546..21605bp; Strand=-
atttcccatatttaacctttaattatagtcagtaggtagcgaaatattaaaattaataat

SEQ ID NO: 13365 - DNA, 60 bp, Xenorhabdus bovienii
  Promoter location: Contig name=SeqID_16881; Position on contig =32126..32185bp; Strand=-; Gene name=NorM
aatatcgagaatcctgccattgcatatgtgccaatataacgagtaataaaaatcgcatca

SEQ ID NO: 13366 - DNA, 60 bp, Xenorhabdus bovienii
  Promoter location: Contig name=SeqID_16881; Position on contig =31956..32015bp; Strand=+; Gene name=NorM
ataccaataccaaaatttaaactgggtttgattgataaccaagagtgtaaaaaggaattg

SEQ ID NO: 13367 - DNA, 60 bp, Xenorhabdus bovienii
  Promoter location: Contig name=SeqID_16881; Position on contig =34983..35042bp; Strand=+; Gene name=EntF
aaaaatcggtcattttaaaaataacgcttcataaatcacatatgaaattttaaatttaaa

SEQ ID NO: 13368 - DNA, 60 bp, Xenorhabdus bovienii
  Promoter location: Contig name=SeqID_16881; Position on contig =45344..45403bp; Strand=+; Gene name=GrsT
atcgaacagtggcaggtataacttgtcactgatttccttctggactgaataatcgctgag

SEQ ID NO: 13369 - DNA, 60 bp, Xenorhabdus bovienii
  Promoter location: Contig name=SeqID_16881; Position on contig =49701..49760bp; Strand=+; Gene name=WecD
gttaatatttaaaagatgatatagattttactacatgaaaaatgtgttaaagtacacgat

SEQ ID NO: 13370 - DNA, 60 bp, Xenorhabdus bovienii
  Promoter location: Contig name=SeqID_16881; Position on contig =50313..50372bp; Strand=+; Gene name=EntF
tataatttaattaatttggtatatgtttcggaaaattatttccacatataccattacaaa

SEQ ID NO: 13371 - DNA, 60 bp, Xenorhabdus bovienii
  Promoter location: Contig name=SeqID_16881; Position on contig =53085..53144bp; Strand=+
tttaaacatttattaaaaatagaaatttaacaacttcgccaaccgtttatcagcttagtg

SEQ ID NO: 13372 - DNA, 60 bp, Xenorhabdus bovienii
  Promoter location: Contig name=SeqID_16881; Position on contig =57739..57798bp; Strand=+
atggcgggcgtgcttccacgttgtaagcgtcatacccgcacacaggccatacttgtaatt

SEQ ID NO: 13373 - DNA, 60 bp, Xenorhabdus bovienii
  Promoter location: Contig name=SeqID_16881; Position on contig =61919..61978bp; Strand=+
tcaggcggaagatactaaagaaataacatttataaaaatattcatttaatgtattaaaaa

SEQ ID NO: 13374 - DNA, 60 bp, Xenorhabdus bovienii
  Promoter location: Contig name=SeqID_16881; Position on contig =62460..62519bp; Strand=-
tctcgcctacaatattcagggttgtagcttaaaaaagcatcagtctttatacttggaatt

SEQ ID NO: 13375 - DNA, 60 bp, Xenorhabdus bovienii
  Promoter location: Contig name=SeqID_16881; Position on contig =62220..62279bp; Strand=+
aaacattagatacttgcaagatgaaccgcattttcgtgtgcatgaggtaacatccgaaaa

SEQ ID NO: 13376 - DNA, 60 bp, Xenorhabdus bovienii
  Promoter location: Contig name=SeqID_16881; Position on contig =64620..64679bp; Strand=-
cgcgggcacagtgtgcaccgtgaccggggttgtattttgttgcatggtattctcctgata

SEQ ID NO: 13377 - DNA, 60 bp, Xenorhabdus bovienii
  Promoter location: Contig name=SeqID_16881; Position on contig =67703..67762bp; Strand=-
cgctgccatagcacaattgcaaaaatcccggaagacctgataacgggtatgataacgggc

SEQ ID NO: 13378 - DNA, 60 bp, Xenorhabdus bovienii
  Promoter location: Contig name=SeqID_16881; Position on contig =68367..68426bp; Strand=+
ttcggggcgctttttttttgtttttaaatggtgttaatacaattggttatggtgaaaatt

SEQ ID NO: 13379 - DNA, 60 bp, Xenorhabdus bovienii
  Promoter location: Contig name=SeqID_16881; Position on contig =73062..73121bp; Strand=-
cggaatatcggcgatataaaacaaaaacgcggggctgtcctgctcggtatagtctatttc

SEQ ID NO: 13380 - DNA, 60 bp, Xenorhabdus bovienii
  Promoter location: Contig name=SeqID_16881; Position on contig =72653..72712bp; Strand=+
atgccgaggatgcggtgttttttactgtcggtcagcaataaactctttatgctttggtga

SEQ ID NO: 13381 - DNA, 60 bp, Xenorhabdus bovienii
  Promoter location: Contig name=SeqID_16881; Position on contig =78787..78846bp; Strand=-; Gene name=Nlp
taatatttgttcaggatttatccattattgcttgtttccgtatttttattttcagcaaac

SEQ ID NO: 13382 - DNA, 60 bp, Xenorhabdus bovienii
  Promoter location: Contig name=SeqID_16881; Position on contig =79384..79443bp; Strand=-
tgattatacttacacattcgattattgaattagataactcaatcagttaaagtaaaaaag

SEQ ID NO: 13383 - DNA, 60 bp, Xenorhabdus bovienii
  Promoter location: Contig name=SeqID_16881; Position on contig =79691..79750bp; Strand=-
gccgttagcgccaacaatcacgtttaagtttttaagttcaaattcattaagctcatggat

SEQ ID NO: 13384 - DNA, 60 bp, Xenorhabdus bovienii
  Promoter location: Contig name=SeqID_16881; Position on contig =79423..79482bp; Strand=+
tcgaatgtgtaagtataatcagtaaaattaagtgattagttacccttataattcagcatc

SEQ ID NO: 13385 - DNA, 60 bp, Xenorhabdus bovienii
  Promoter location: Contig name=SeqID_16881; Position on contig =82948..83007bp; Strand=-
tgcccccctttggaagcagatattgccagtctaacggcaatgaaggttcattattcttta

SEQ ID NO: 13386 - DNA, 60 bp, Xenorhabdus bovienii
  Promoter location: Contig name=SeqID_16881; Position on contig =85245..85304bp; Strand=-
tgaaaattaagctgattcagtcagttaatgggtgactcgagtcaggttaattttcatttt

SEQ ID NO: 13387 - DNA, 60 bp, Xenorhabdus bovienii
  Promoter location: Contig name=SeqID_16881; Position on contig =84956..85015bp; Strand=+
caaggtaaaaacgctgatacaagccttcgggtaatgtactgttttgccataattgttgca

SEQ ID NO: 13388 - DNA, 60 bp, Xenorhabdus bovienii
  Promoter location: Contig name=SeqID_16881; Position on contig =85850..85909bp; Strand=+
cgtcacatgcgaaaacagctgcacaatccggtcaacatcgtcccgtttatacttgttgat

SEQ ID NO: 13389 - DNA, 60 bp, Xenorhabdus bovienii
  Promoter location: Contig name=SeqID_16881; Position on contig =87064..87123bp; Strand=+
attttccggtaatttccagttgattggtgcaccattctgccatggttaagttcctcactt

SEQ ID NO: 13390 - DNA, 60 bp, Xenorhabdus bovienii
  Promoter location: Contig name=SeqID_16881; Position on contig =89396..89455bp; Strand=-
cagaacgggtcacctcgtattgacagcctctccctgactcccccaaaatcccgttgtgtt

SEQ ID NO: 13391 - DNA, 60 bp, Xenorhabdus bovienii
  Promoter location: Contig name=SeqID_16881; Position on contig =89034..89093bp; Strand=+
agacgcgggcacgatgtccgtgaccggaggtgtattttgttgcatggtattctcctgata

SEQ ID NO: 13392 - DNA, 60 bp, Xenorhabdus bovienii
  Promoter location: Contig name=SeqID_16881; Position on contig =100224..100283bp; Strand=-
taatcgatatagcccgcctttttatcgttacgcgtaaatatttcagttaatctttaattt

SEQ ID NO: 13393 - DNA, 60 bp, Xenorhabdus bovienii
  Promoter location: Contig name=SeqID_16881; Position on contig =102746..102805bp; Strand=-
ggctcttcttccttaaataaaaggcggtgtcacatgccatcccctgccaaaatctgggaa

SEQ ID NO: 13394 - DNA, 60 bp, Xenorhabdus bovienii
  Promoter location: Contig name=SeqID_16881; Position on contig =103656..103715bp; Strand=-
ctcagttttcatctcatcacataaagcctagatggtgtcgtcataaataaattcatgtaa

SEQ ID NO: 13395 - DNA, 60 bp, Xenorhabdus bovienii; identical to SEQ ID NO: 12949
  Promoter location: Contig name=SeqID_16881; Position on contig =103429..103488bp; Strand=+

SEQ ID NO: 13396 - DNA, 60 bp, Xenorhabdus bovienii
  Promoter location: Contig name=SeqID_16881; Position on contig =107554..107613bp; Strand=-
caaaaaaatctaggtaaagctaacttcttatagggatgcggcgatgctaaactgaaagca

SEQ ID NO: 13397 - DNA, 60 bp, Xenorhabdus bovienii
  Promoter location: Contig name=SeqID_16881; Position on contig =107573..107632bp; Strand=+
ccgcatccctataagaagttagctttacctagatttttttgaattgttacaacttttttc

SEQ ID NO: 13398 - DNA, 60 bp, Xenorhabdus bovienii
  Promoter location: Contig name=SeqID_16881; Position on contig =109034..109093bp; Strand=-
gcaacctaatctgatgagatggacgtcccacatggcgtcaattgtaccaaaatgaaatag

SEQ ID NO: 13399 - DNA, 60 bp, Xenorhabdus bovienii
  Promoter location: Contig name=SeqID_16881; Position on contig =108875..108934bp; Strand=+
ttccatttgtctgacagcatccagtagccgattgcgagtcacttttttattaaagacaac

SEQ ID NO: 13400 - DNA, 60 bp, Xenorhabdus bovienii
  Promoter location: Contig name=SeqID_16881; Position on contig =109992..110051bp; Strand=+
tttcacctttaggctatccatttgccggagtttgatgccattgtttttcaaataatcaag

SEQ ID NO: 13401 - DNA, 60 bp, Xenorhabdus bovienii
  Promoter location: Contig name=SeqID_16881; Position on contig =111350..111409bp; Strand=-
tatcagccataaatatgtatctccttctcgtctttgtcatccggtgatgcaattcttatc

SEQ ID NO: 13402 - DNA, 60 bp, Xenorhabdus bovienii
  Promoter location: Contig name=SeqID_16881; Position on contig =117398..117457bp; Strand=-
ataatctgcgggtgtaaaggtttcataggcggaatcggcattaagtttaaactgatgcgt

SEQ ID NO: 13403 - DNA, 60 bp, Xenorhabdus bovienii
  Promoter location: Contig name=SeqID_16881; Position on contig =117107..117166bp; Strand=+
tactgtggttaattctttttctgatcgagaaaattatctgctcgttataaaataatttca

SEQ ID NO: 13404 - DNA, 60 bp, Xenorhabdus bovienii
  Promoter location: Contig name=SeqID_16881; Position on contig =122114..122173bp; Strand=-
catatcagtgatttgttctttcactccgggtttgcaggcttggtaggtgtaattcagttg

SEQ ID NO: 13405 - DNA, 60 bp, Xenorhabdus bovienii
  Promoter location: Contig name=SeqID_16881; Position on contig =121918..121977bp; Strand=+
gtggcagtgcctgatgtggtcatgctcccaatagttagattattgtagtaaactttccat

SEQ ID NO: 13406 - DNA, 60 bp, Xenorhabdus bovienii
  Promoter location: Contig name=SeqID_16881; Position on contig =123090..123149bp; Strand=-
ccggtacagaaatgtcccgttaataaactgaaagattaattaacacgttgaattatttta

SEQ ID NO: 13407 - DNA, 60 bp, Xenorhabdus bovienii
  Promoter location: Contig name=SeqID_16881; Position on contig =123065..123124bp; Strand=+
gtacaaaaggtcattatatgaaaaataaaataattcaacgtgttaattaatctttcagtt

SEQ ID NO: 13408 - DNA, 60 bp, Xenorhabdus bovienii
  Promoter location: Contig name=SeqID_16881; Position on contig =127146..127205bp; Strand=-; Gene name=DcuB
aagtcgctttctgccatgagtttcatcagttatagttctaactcagatatcatgctaact

SEQ ID NO: 13409 - DNA, 60 bp, Xenorhabdus bovienii
  Promoter location: Contig name=SeqID_16881; Position on contig =128752..128811bp; Strand=-
aatctttattaaattacttaataacgaaaaatatccagtatataaagtaaaatgttttga

SEQ ID NO: 13410 - DNA, 60 bp, Xenorhabdus bovienii
  Promoter location: Contig name=SeqID_16881; Position on contig =129446..129505bp; Strand=-; Gene name=AspA
attcatcatataaatgattccacctttacttttataaaattaagagcaaaaataaaaata

SEQ ID NO: 13411 - DNA, 60 bp, Xenorhabdus bovienii
  Promoter location: Contig name=SeqID_16881; Position on contig =130851..130910bp; Strand=+
atgccacggatgaattcaggcacatcattgatagtacggtcactgatataaaagttttca

SEQ ID NO: 13412 - DNA, 60 bp, Xenorhabdus bovienii
  Promoter location: Contig name=SeqID_16881; Position on contig =131227..131286bp; Strand=+
gtaaagtcaaaggcctcaagtattgaaaagcgttattatcatccccacgctatgatttac

SEQ ID NO: 13413 - DNA, 60 bp, Xenorhabdus bovienii
  Promoter location: Contig name=SeqID_16881; Position on contig =134142..134201bp; Strand=+
cccatccaaataggataaaaactttgaaggcgagcagaaaaatctgctcgcctttttact

SEQ ID NO: 13414 - DNA, 60 bp, Xenorhabdus bovienii
  Promoter location: Contig name=SeqID_16881; Position on contig =135976..136035bp; Strand=-; Gene name=Efp
acacgggcaaatgcctgccctttacctggtttaacaaattcgctttctagaatagcgcac

SEQ ID NO: 13415 - DNA, 60 bp, Xenorhabdus bovienii
  Promoter location: Contig name=SeqID_16881; Position on contig =135812..135871bp; Strand=+; Gene name=Efp
tctgcaagttgttttagccagacttctctggcagggggaatatgggttataatgtgtgcc

SEQ ID NO: 13416 - DNA, 60 bp, Xenorhabdus bovienii
  Promoter location: Contig name=SeqID_16881; Position on contig =136509..136568bp; Strand=+; Gene name=EmrE
atcttcgtttagaggctgcggtttttttattggtggtaatcaggcgctatcattgcggct

SEQ ID NO: 13417 - DNA, 60 bp, Xenorhabdus bovienii
  Promoter location: Contig name=SeqID_16881; Position on contig =138269..138328bp; Strand=-
acgctctgaggaatccccagaaaatagacaggcatagcgttgtgtgatctactgattgtt

SEQ ID NO: 13418 - DNA, 60 bp, Xenorhabdus bovienii; identical to SEQ ID NO: 13282
  Promoter location: Contig name=SeqID_16881; Position on contig =138053..138112bp; Strand=+

SEQ ID NO: 13419 - DNA, 60 bp, Xenorhabdus bovienii
  Promoter location: Contig name=SeqID_16882; Position on contig =1024..1083bp; Strand=-
aacacactcaaattgattgcttttcacacgccaatcagttcattatttatacttatccac

SEQ ID NO: 13420 - DNA, 60 bp, Xenorhabdus bovienii
  Promoter location: Contig name=SeqID_16882; Position on contig =986..1045bp; Strand=+
tcaaaaaataaccaaaatagcaatttgcttataaaaatgtggataagtataaataatgaa

SEQ ID NO: 13421 - DNA, 60 bp, Xenorhabdus bovienii; identical to SEQ ID NO: 13420
  Promoter location: Contig name=SeqID_16883; Position on contig =8256..8315bp; Strand=-

SEQ ID NO: 13422 - DNA, 60 bp, Xenorhabdus bovienii; identical to SEQ ID NO: 13419
  Promoter location: Contig name=SeqID_16883; Position on contig =8218..8277bp; Strand=+

SEQ ID NO: 13423 - DNA, 60 bp, Xenorhabdus bovienii
  Promoter location: Contig name=SeqID_16884; Position on contig =125..184bp; Strand=+
catatataccatttatatatgttatttacgtatatatagtgccatgctaatatgtgtaca

SEQ ID NO: 13424 - DNA, 60 bp, Xenorhabdus bovienii
  unsure (1)..(60): unsure at all n locations
  Promoter location: Contig name=SeqID_16885; Position on contig =1040..1099bp; Strand=-
nnnnnnnnnnnnnnnnnnnnnnnnnnnnnnnnnnnnnnnnnnnnnnntctgtcgttaaaa

SEQ ID NO: 13425 - DNA, 60 bp, Xenorhabdus bovienii
  Promoter location: Contig name=SeqID_16887; Position on contig =4381..4440bp; Strand=-
tgtagagcggatcacagggaagatttatgatggacgacaatattttttattatagttatg

SEQ ID NO: 13426 - DNA, 60 bp, Xenorhabdus bovienii
  Promoter location: Contig name=SeqID_16887; Position on contig =4179..4238bp; Strand=+
aagctgatttcgtgtcagtatttcgcgggcacgtctttgtaatattttaatatgttcgtg

SEQ ID NO: 13427 - DNA, 60 bp, Xenorhabdus bovienii
  Promoter location: Contig name=SeqID_16887; Position on contig =10264..10323bp; Strand=-
atttttagtaagttatgagtttgccttgtaaccatcatgggagggtttataatgttcttc

SEQ ID NO: 13428 - DNA, 60 bp, Xenorhabdus bovienii
  Promoter location: Contig name=SeqID_16887; Position on contig =10798..10857bp; Strand=-; Gene name=NusG
cgaataaaatgattgacgcctcgtgttgaattgatagtcgtggtatgaataatctctgga

SEQ ID NO: 13429 - DNA, 60 bp, Xenorhabdus bovienii
  Promoter location: Contig name=SeqID_16887; Position on contig =10536..10595bp; Strand=+; Gene name=NusG
ttaaacacactctgactttattgatgatcctgaagccctggttttgttatgctagacata

SEQ ID NO: 13430 - DNA, 60 bp, Xenorhabdus bovienii
  Promoter location: Contig name=SeqID_16887; Position on contig =13814..13873bp; Strand=-; Gene name=AarF
agctttaatagtgtggttgcggtattttcgaacaaaagttcgtggtttataatgaaaata

SEQ ID NO: 13431 - DNA, 60 bp, Xenorhabdus bovienii
  Promoter location: Contig name=SeqID_16887; Position on contig =17494..17553bp; Strand=+
tatatgttcctgtaacgcctgtgcctgctgcgtgtcatcatcgctgttaaagtaacgttc

SEQ ID NO: 13432 - DNA, 60 bp, Xenorhabdus bovienii
  Promoter location: Contig name=SeqID_16887; Position on contig =20066..20125bp; Strand=-
aataaggctgttaaatgcgagatgcgccactagtctttctttcgttctaaaatctgataa

SEQ ID NO: 13433 - DNA, 60 bp, Xenorhabdus bovienii
  Promoter location: Contig name=SeqID_16887; Position on contig =19978..20037bp; Strand=+
gcaatgaaggatgggatagcaatgttgtggtcatagttactcttgttatgatttaaatag

SEQ ID NO: 13434 - DNA, 60 bp, Xenorhabdus bovienii
  Promoter location: Contig name=SeqID_16887; Position on contig =21297..21356bp; Strand=-
gatgggttaaattagtcctctttatacgttgggtaaacatttttcagtaagatggtcttc

SEQ ID NO: 13435 - DNA, 60 bp, Xenorhabdus bovienii
  Promoter location: Contig name=SeqID_16887; Position on contig =21991..22050bp; Strand=-
ctcagttgatacattgtaaagaaagtttaattcactagtagcatgtttatattgctggat

SEQ ID NO: 13436 - DNA, 60 bp, Xenorhabdus bovienii
  Promoter location: Contig name=SeqID_16887; Position on contig =21706..21765bp; Strand=+
aaaaatgaattttttaccctcatttttcatgtaaactttgctttacatattctccttaac

SEQ ID NO: 13437 - DNA, 60 bp, Xenorhabdus bovienii
  Promoter location: Contig name=SeqID_16887; Position on contig =23068..23127bp; Strand=-
ctagcaaaattacttccacattctctgtgagatggctaaataaatggtaatgttcatcaa

SEQ ID NO: 13438 - DNA, 60 bp, Xenorhabdus bovienii
  Promoter location: Contig name=SeqID_16887; Position on contig =26392..26451bp; Strand=-
gacaaatacggctgtctggcggtagcatatcagtataaatgtttggatatgcttattagt

SEQ ID NO: 13439 - DNA, 60 bp, Xenorhabdus bovienii
  Promoter location: Contig name=SeqID_16887; Position on contig =26671..26730bp; Strand=+
caaatgttaatgaatattggtcacgtattcatcccgttgtttctcacgtataatgagagt

SEQ ID NO: 13440 - DNA, 60 bp, Xenorhabdus bovienii
  Promoter location: Contig name=SeqID_16887; Position on contig =27654..27713bp; Strand=+
aatcatataataactactaggctgtgtcccttaatgtaaattgatagtattatcatctaa

SEQ ID NO: 13441 - DNA, 60 bp, Xenorhabdus bovienii
  Promoter location: Contig name=SeqID_16887; Position on contig =28988..29047bp; Strand=-
ggagagcttaagcatatcgcgatatgagttatagatacctatagtagtatagtccattgt

SEQ ID NO: 13442 - DNA, 60 bp, Xenorhabdus bovienii
  Promoter location: Contig name=SeqID_16887; Position on contig =28731..28790bp; Strand=+
cacatgttattagagatgcctttgcatatcattttgaaaataatgtttactatcgtgaac

SEQ ID NO: 13443 - DNA, 60 bp, Xenorhabdus bovienii
  Promoter location: Contig name=SeqID_16887; Position on contig =35292..35351bp; Strand=-
gcccatgtttgaataacaggatacactaatccatatcctattcctgttaacatggccgca

SEQ ID NO: 13444 - DNA, 60 bp, Xenorhabdus bovienii
  Promoter location: Contig name=SeqID_16887; Position on contig =35130..35189bp; Strand=+
cttcgctgtacatgcagcgactgtagttgtatcgcgtctttttttggcacgatatttatc

SEQ ID NO: 13445 - DNA, 60 bp, Xenorhabdus bovienii
  Promoter location: Contig name=SeqID_16887; Position on contig =35950..36009bp; Strand=+
catttaaaaagtttggctaatacccgattgtaatattcgatatattttaaaatgagtgcc

SEQ ID NO: 13446 - DNA, 60 bp, Xenorhabdus bovienii
  Promoter location: Contig name=SeqID_16887; Position on contig =37736..37795bp; Strand=-
caggaataaaacagtagcaatgttattaaataaagatagattcaagatataattattaca

SEQ ID NO: 13447 - DNA, 60 bp, Xenorhabdus bovienii
  Promoter location: Contig name=SeqID_16887; Position on contig =37739..37798bp; Strand=+
aataattatatcttgaatctatctttatttaataacattgctactgttttattcctgtta

SEQ ID NO: 13448 - DNA, 60 bp, Xenorhabdus bovienii
  Promoter location: Contig name=SeqID_16887; Position on contig =40634..40693bp; Strand=-; Gene name=LysR
aagttgataatgaataatttgcgcttgtggtttatacagtacctgttgattatagaagtg

SEQ ID NO: 13449 - DNA, 60 bp, Xenorhabdus bovienii
  Promoter location: Contig name=SeqID_16887; Position on contig =40593..40652bp; Strand=+; Gene name=LysR
gtcatgttgtcacccgcaaattttagccgtctagatgtttacacttctataatcaacagg

SEQ ID NO: 13450 - DNA, 60 bp, Xenorhabdus bovienii
  Promoter location: Contig name=SeqID_16887; Position on contig =44176..44235bp; Strand=-
gtcattgattcacaatgtgattgttttttgattttctttaataactttaatatttctggt

SEQ ID NO: 13451 - DNA, 60 bp, Xenorhabdus bovienii
  Promoter location: Contig name=SeqID_16887; Position on contig =45878..45937bp; Strand=-
acaacaaattttatgattatctcttgattctcatcccttattcactggataatcattcgt

SEQ ID NO: 13452 - DNA, 60 bp, Xenorhabdus bovienii
  Promoter location: Contig name=SeqID_16887; Position on contig =45736..45795bp; Strand=+
ctaacgctatcatctctccactctgcctaacgaaaacgattacgtcgtaagatacttaaa

SEQ ID NO: 13453 - DNA, 60 bp, Xenorhabdus bovienii
  Promoter location: Contig name=SeqID_16887; Position on contig =46547..46606bp; Strand=+
taaatgaaaattattttcaataaattcaataagaaacaatattctcttatcataaaataa

SEQ ID NO: 13454 - DNA, 60 bp, Xenorhabdus bovienii
  Promoter location: Contig name=SeqID_16887; Position on contig =51162..51221bp; Strand=-
tatggtcacaatttatcgactatctcgaagctaaatattggtggtgatataaaaaagagg

SEQ ID NO: 13455 - DNA, 60 bp, Xenorhabdus bovienii
  Promoter location: Contig name=SeqID_16887; Position on contig =50938..50997bp; Strand=+
gaaaatttatggtgggtatgtagcgtaatctgcgctatgtgttcgttattttccttcgca

SEQ ID NO: 13456 - DNA, 60 bp, Xenorhabdus bovienii
  Promoter location: Contig name=SeqID_16887; Position on contig =52092..52151bp; Strand=-
cgaactccgaaaagatttttcttgaagtctagatggtgtcgtcatgaaaaaattcgtgca

SEQ ID NO: 13457 - DNA, 60 bp, Xenorhabdus bovienii
  Promoter location: Contig name=SeqID_16887; Position on contig =54093..54152bp; Strand=+
gagacagaaactttgtcttataaataatgcaaatgaatttccaatcctatgatggaagta

SEQ ID NO: 13458 - DNA, 60 bp, Xenorhabdus bovienii
  Promoter location: Contig name=SeqID_16887; Position on contig =60752..60811bp; Strand=+
tttattagtcatattacatttaactaagacaaatacaaaattatcagtatatttattttt

SEQ ID NO: 13459 - DNA, 60 bp, Xenorhabdus bovienii
  Promoter location: Contig name=SeqID_16887; Position on contig =61837..61896bp; Strand=-; Gene name=UvrA
caaagtataatataacgggtctatgtttaaacttagtcctcgcatggtaaactactttgc

SEQ ID NO: 13460 - DNA, 60 bp, Xenorhabdus bovienii
  Promoter location: Contig name=SeqID_16887; Position on contig =61843..61902bp; Strand=+; Gene name=UvrA
tagtttaccatgcgaggactaagtttaaacatagacccgttatattatactttgcgaagt

SEQ ID NO: 13461 - DNA, 60 bp, Xenorhabdus bovienii
  Promoter location: Contig name=SeqID_16887; Position on contig =65020..65079bp; Strand=-
catatgttatatcattatggcattaatgcaccgataatgtgatcagtaataatattagtt

SEQ ID NO: 13462 - DNA, 60 bp, Xenorhabdus bovienii
  Promoter location: Contig name=SeqID_16887; Position on contig =64922..64981bp; Strand=+
atttgttgaccaattttatttttccccatgcaataaagggcatttcctacaatcatttct

SEQ ID NO: 13463 - DNA, 60 bp, Xenorhabdus bovienii
  Promoter location: Contig name=SeqID_16887; Position on contig =65923..65982bp; Strand=+; Gene name=AmpC
tttatttaacgtcagctctgcttaagaaccgctatttaaaaatcacgtaaattcagactc

SEQ ID NO: 13464 - DNA, 60 bp, Xenorhabdus bovienii
  Promoter location: Contig name=SeqID_16887; Position on contig =69488..69547bp; Strand=-
gggatttttgttaccacacagtattaatattccatatattaaaggattaaaatcaggaat

SEQ ID NO: 13465 - DNA, 60 bp, Xenorhabdus bovienii
  Promoter location: Contig name=SeqID_16887; Position on contig =69241..69300bp; Strand=+
ttctgtatgaatgagatgtttaattttctgtacatcttgccaccagctatgattaatacg

SEQ ID NO: 13466 - DNA, 60 bp, Xenorhabdus bovienii
  Promoter location: Contig name=SeqID_16887; Position on contig =70828..70887bp; Strand=-; Gene name=Alr
cttatacccaatagatttctcgttgcagccgacaaagctgcaatcggaaagatgaagggt

SEQ ID NO: 13467 - DNA, 60 bp, Xenorhabdus bovienii
  Promoter location: Contig name=SeqID_16887; Position on contig =73612..73671bp; Strand=-; Gene name=Qor
cctgacgtggaaaactcgatgtgttttgccatgaatcagcctctcattattttagaaata

SEQ ID NO: 13468 - DNA, 60 bp, Xenorhabdus bovienii
  Promoter location: Contig name=SeqID_16887; Position on contig =73499..73558bp; Strand=+; Gene name=Qor
tcagtatacgccatgaaaacagccttgagtaattataaatagtctgtaatgatttcgaat

SEQ ID NO: 13469 - DNA, 60 bp, Xenorhabdus bovienii
  Promoter location: Contig name=SeqID_16887; Position on contig =75852..75911bp; Strand=-
aagtgagcaaataattgataattatcttttttaccttcttcaaatcttctactaagaacg

SEQ ID NO: 13470 - DNA, 60 bp, Xenorhabdus bovienii
  Promoter location: Contig name=SeqID_16887; Position on contig =75601..75660bp; Strand=+
cggagaagcggttgagagggaattcaacctcttttttgctcacatttttagttgtatcaa

SEQ ID NO: 13471 - DNA, 60 bp, Xenorhabdus bovienii
  Promoter location: Contig name=SeqID_16887; Position on contig =76203..76262bp; Strand=-
gtttcatatttacgtatataaaaccatataactatgcgagcctctggtaatatcttatag

SEQ ID NO: 13472 - DNA, 60 bp, Xenorhabdus bovienii
  Promoter location: Contig name=SeqID_16887; Position on contig =76664..76723bp; Strand=-
cctatagctaagaaataaaaaattccaaagataaaggcaagccaatttatatttatcaga

SEQ ID NO: 13473 - DNA, 60 bp, Xenorhabdus bovienii
  Promoter location: Contig name=SeqID_16887; Position on contig =76330..76389bp; Strand=+
aaaaactgtacataaaaacagtattgatattgattaatcttgtgctttaacattagcatc

SEQ ID NO: 13474 - DNA, 60 bp, Xenorhabdus bovienii
  Promoter location: Contig name=SeqID_16887; Position on contig =78546..78605bp; Strand=-; Gene name=DgkA
tagcggcttttacgggctggtaggttcccaattcgaatttacctgtatatactcacaggc

SEQ ID NO: 13475 - DNA, 60 bp, Xenorhabdus bovienii
  Promoter location: Contig name=SeqID_16887; Position on contig =79162..79221bp; Strand=-; Gene name=PlsB
gataagtttactttttactaagaattttagtggaaaattcaataacttataatatatttt

SEQ ID NO: 13476 - DNA, 60 bp, Xenorhabdus bovienii
  Promoter location: Contig name=SeqID_16887; Position on contig =78982..79041bp; Strand=+; Gene name=PlsB
aatcaaacctgttgattgatttgccataaaaaattttcttcaattagcataatatttgta

SEQ ID NO: 13477 - DNA, 60 bp, Xenorhabdus bovienii
  Promoter location: Contig name=SeqID_16887; Position on contig =83426..83485bp; Strand=-; Gene name=Pgi
ttttttatcgtacttaataaaattgcctcgcctccaataaacacggttattgaggtgagg

SEQ ID NO: 13478 - DNA, 60 bp, Xenorhabdus bovienii
  Promoter location: Contig name=SeqID_16887; Position on contig =87144..87203bp; Strand=-
cggctcaaggactgaacctgaccgcttgcagcggcactatttgccgttattttggttttt

SEQ ID NO: 13479 - DNA, 60 bp, Xenorhabdus bovienii
  Promoter location: Contig name=SeqID_16887; Position on contig =88172..88231bp; Strand=-
cacgtatcccgccggcaatcagcgcttttgccagtggaaccgcgtgttcaatctcactga

SEQ ID NO: 13480 - DNA, 60 bp, Xenorhabdus bovienii
  Promoter location: Contig name=SeqID_16887; Position on contig =89619..89678bp; Strand=-
agattagagattgaatgatattaattaaaaatgactggctattcatctattgtctttcaa

SEQ ID NO: 13481 - DNA, 60 bp, Xenorhabdus bovienii
  Promoter location: Contig name=SeqID_16887; Position on contig =94744..94803bp; Strand=-; Gene name=MetA
aaaaaaataaaaatgagaattagctgaagcgagccatttctcatttttttaattttctat

SEQ ID NO: 13482 - DNA, 60 bp, Xenorhabdus bovienii
  Promoter location: Contig name=SeqID_16887; Position on contig =95787..95846bp; Strand=-
taatttcaatttgagtacaataactcgacattgatcttgtcttttgatttaatttggcta

SEQ ID NO: 13483 - DNA, 60 bp, Xenorhabdus bovienii
  Promoter location: Contig name=SeqID_16887; Position on contig =95808..95867bp; Strand=+
caagatcaatgtcgagttattgtactcaaattgaaattatttcattttattctatcgaat

SEQ ID NO: 13484 - DNA, 60 bp, Xenorhabdus bovienii
  Promoter location: Contig name=SeqID_16888; Position on contig =369..428bp; Strand=-; Gene name=RuvC
tatgctggatatacgtccagctttttttatgctataagctgcagcggaatgatttatttt

SEQ ID NO: 13485 - DNA, 60 bp, Xenorhabdus bovienii
  Promoter location: Contig name=SeqID_16888; Position on contig =4109..4168bp; Strand=-
cttgccaggaaccgtgttatgcccttatctctggtcagaattttcagtataatgactgcc

SEQ ID NO: 13486 - DNA, 60 bp, Xenorhabdus bovienii
  Promoter location: Contig name=SeqID_16888; Position on contig =4170..4229bp; Strand=+
caattttttgctaactgataatattcatactatttattattaaatactatgatttatagc

SEQ ID NO: 13487 - DNA, 60 bp, Xenorhabdus bovienii
  Promoter location: Contig name=SeqID_16888; Position on contig =7546..7605bp; Strand=-
tgctgttccagtaaaaaattctgaccttgtgatttccaacatgtcattaagataagttag

SEQ ID NO: 13488 - DNA, 60 bp, Xenorhabdus bovienii
  Promoter location: Contig name=SeqID_16888; Position on contig =7283..7342bp; Strand=+
gccgcacaatgggatgcacaggaatagataaccgctgtaacgactgttgtaatgccccaa

SEQ ID NO: 13489 - DNA, 60 bp, Xenorhabdus bovienii
  Promoter location: Contig name=SeqID_16888; Position on contig =8253..8312bp; Strand=-
aggtgattcgtcgttatgccaacttcaatgagtcgcttactgagtgatattttggcaaaa

SEQ ID NO: 13490 - DNA, 60 bp, Xenorhabdus bovienii
  Promoter location: Contig name=SeqID_16888; Position on contig =8161..8220bp; Strand=+
agaaatttttgaaaaatgagacatttcttacccattaaataaaccgtaaaaattgcgttc

SEQ ID NO: 13491 - DNA, 60 bp, Xenorhabdus bovienii
  Promoter location: Contig name=SeqID_16888; Position on contig =10284..10343bp; Strand=+
ctcttcctcatctaccgtataaataatatttagctggacttactgtttatatttaattat

SEQ ID NO: 13492 - DNA, 60 bp, Xenorhabdus bovienii
  Promoter location: Contig name=SeqID_16888; Position on contig =12379..12438bp; Strand=-
ctttatatgccatttttatgatgcctgatgggatagctttacatttttatgcttaattcc

SEQ ID NO: 13493 - DNA, 60 bp, Xenorhabdus bovienii
  Promoter location: Contig name=SeqID_16888; Position on contig =12323..12382bp; Strand=+
accgctgccagtgatttcaataagttcatggtattgttctaaagttgtattcttatggaa

SEQ ID NO: 13494 - DNA, 60 bp, Xenorhabdus bovienii
  Promoter location: Contig name=SeqID_16888; Position on contig =13196..13255bp; Strand=-; Gene name=ProP
attattctgaccttaatctcatctttaaggtagagggttatagatgatatttttttatcg

SEQ ID NO: 13495 - DNA, 60 bp, Xenorhabdus bovienii
  Promoter location: Contig name=SeqID_16888; Position on contig =13126..13185bp; Strand=+; Gene name=ProP
tctcctgatatttgtcttgaaaaaattctggataatttatctcttattaaaataattgcc

SEQ ID NO: 13496 - DNA, 60 bp, Xenorhabdus bovienii
  Promoter location: Contig name=SeqID_16888; Position on contig =16923..16982bp; Strand=-
caatttgaatgttcgatagtcatttactaaagcagatgcgctttttgtaatatgcagtgg

SEQ ID NO: 13497 - DNA, 60 bp, Xenorhabdus bovienii
  Promoter location: Contig name=SeqID_16888; Position on contig =16773..16832bp; Strand=+
ttaaaggaagggtgaaaaaaaataatgttcatacaatcttattccttattgtttttttga

SEQ ID NO: 13498 - DNA, 60 bp, Xenorhabdus bovienii
  Promoter location: Contig name=SeqID_16888; Position on contig =18417..18476bp; Strand=-
actactgacagaaattgtcactcaccattgatactctgcgggctgttctactgtattaaa

SEQ ID NO: 13499 - DNA, 60 bp, Xenorhabdus bovienii
  Promoter location: Contig name=SeqID_16888; Position on contig =19303..19362bp; Strand=-; Gene name=PgsA
catttttctctaagtcctttagaggtcaatttatcagcattattaataaaataaaaaatc

SEQ ID NO: 13500 - DNA, 60 bp, Xenorhabdus bovienii
  Promoter location: Contig name=SeqID_16888; Position on contig =19254..19313bp; Strand=+; Gene name=PgsA
agttttttgatcccttgtacaagatcattgttatctgattgcccttttagattttttatt

SEQ ID NO: 13501 - DNA, 60 bp, Xenorhabdus bovienii
  Promoter location: Contig name=SeqID_16888; Position on contig =23604..23663bp; Strand=+; Gene name=SUL1
taactaacttttagacctgtaacacctttattgggtgataaaagagatactcttacatat

SEQ ID NO: 13502 - DNA, 60 bp, Xenorhabdus bovienii
  Promoter location: Contig name=SeqID_16888; Position on contig =30651..30710bp; Strand=-
cttagcaataaaatagtctgatgggtaactaatgcgccatccaagtctataatcaaggtg

SEQ ID NO: 13503 - DNA, 60 bp, Xenorhabdus bovienii
  Promoter location: Contig name=SeqID_16888; Position on contig =30452..30511bp; Strand=+
aaagtcattttaactgcgttgagttatcacgggaatcaatctcatgataatattaataac

SEQ ID NO: 13504 - DNA, 60 bp, Xenorhabdus bovienii
  Promoter location: Contig name=SeqID_16888; Position on contig =33664..33723bp; Strand=+
tattatatataaaaagcccaaagtgatatggaatatagttaacagggaatcatccttaat

SEQ ID NO: 13505 - DNA, 60 bp, Xenorhabdus bovienii
  Promoter location: Contig name=SeqID_16888; Position on contig =35929..35988bp; Strand=+
tataaaaaatcatgaggttctgtgttttttacggcgataacgctcgtcataattcttcaa

SEQ ID NO: 13506 - DNA, 60 bp, Xenorhabdus bovienii
  Promoter location: Contig name=SeqID_16888; Position on contig =37711..37770bp; Strand=-
ctgctcaaggtgaggaagacatttttccagtgcttccagctctgctttagcatctttatc

SEQ ID NO: 13507 - DNA, 60 bp, Xenorhabdus bovienii
  Promoter location: Contig name=SeqID_16888; Position on contig =37123..37182bp; Strand=+
aagccagcgcttaacaggctgtgcatggcgtggctagttattgcgtgtataatagcgcca

SEQ ID NO: 13508 - DNA, 60 bp, Xenorhabdus bovienii
  Promoter location: Contig name=SeqID_16888; Position on contig =40032..40091bp; Strand=-; Gene name=AraC
cataaacacacaaaatttttactcattattgttacttagcatatcgttagaattggaaaa

SEQ ID NO: 13509 - DNA, 60 bp, Xenorhabdus bovienii
  Promoter location: Contig name=SeqID_16888; Position on contig =40002..40061bp; Strand=+; Gene name=AraC
cctccaatttattattttcactgatataaattttccaattctaacgatatgctaagtaac

SEQ ID NO: 13510 - DNA, 60 bp, Xenorhabdus bovienii
  Promoter location: Contig name=SeqID_16888; Position on contig =41857..41916bp; Strand=+; Gene name=MdlB
cataaatcttccttgaatttttaccaaaaaaaaacaaccataacgggtctaataaattga

SEQ ID NO: 13511 - DNA, 60 bp, Xenorhabdus bovienii
  Promoter location: Contig name=SeqID_16888; Position on contig =44040..44099bp; Strand=-; Gene name=EntF
gctcccttttttatgggcatatgaaaataaaaaagtatgagaactgataaaacaaaaaat

SEQ ID NO: 13512 - DNA, 60 bp, Xenorhabdus bovienii
  Promoter location: Contig name=SeqID_16888; Position on contig =44024..44083bp; Strand=+; Gene name=EntF
tttggattctagttttattttttgttttatcagttctcatacttttttattttcatatgc

SEQ ID NO: 13513 - DNA, 60 bp, Xenorhabdus bovienii
  Promoter location: Contig name=SeqID_16888; Position on contig =70048..70107bp; Strand=-; Gene name=InsB
ccattcctgatttaaaaatcatgtgatttgccgcacgctttgttgatttactcctcaaat

SEQ ID NO: 13514 - DNA, 60 bp, Xenorhabdus bovienii
  Promoter location: Contig name=SeqID_16888; Position on contig =70852..70911bp; Strand=-
cttataaggctctctactgggtcatgctcccaatagttagattattgtagtaaactttcc

SEQ ID NO: 13515 - DNA, 60 bp, Xenorhabdus bovienii
  Promoter location: Contig name=SeqID_16888; Position on contig =70836..70895bp; Strand=+
accagtaataaaaaatggaaagtttactacaataatctaactattgggagcatgacccag

SEQ ID NO: 13516 - DNA, 60 bp, Xenorhabdus bovienii
  Promoter location: Contig name=SeqID_16888; Position on contig =71419..71478bp; Strand=-
catcttctgtctcctttgatggccacatttaaatcacccccctgacctaaacttttatgc

SEQ ID NO: 13517 - DNA, 60 bp, Xenorhabdus bovienii
  Promoter location: Contig name=SeqID_16888; Position on contig =71175..71234bp; Strand=+
aaatttgcgcatggagcggggttgatgggggaggcggagccagaggctattctgccatta

SEQ ID NO: 13518 - DNA, 60 bp, Xenorhabdus bovienii
  Promoter location: Contig name=SeqID_16888; Position on contig =72614..72673bp; Strand=+
gaaagcacaaaaagataaaaaaaggttttctatatccgccttttctctataatgctgcct

SEQ ID NO: 13519 - DNA, 60 bp, Xenorhabdus bovienii
  Promoter location: Contig name=SeqID_16888; Position on contig =73630..73689bp; Strand=+
ctctatttgcattcttcggctgtaaattttcataacctgacgaggtttaaaatcatccat

SEQ ID NO: 13520 - DNA, 60 bp, Xenorhabdus bovienii
  Promoter location: Contig name=SeqID_16888; Position on contig =75476..75535bp; Strand=-
gttttttcatcaaatccttcccaaatttctttgtgaaaattaattgtcatatttttttat

SEQ ID NO: 13521 - DNA, 60 bp, Xenorhabdus bovienii; identical to SEQ ID NO: 13282
  Promoter location: Contig name=SeqID_16888; Position on contig =75154..75213bp; Strand=+

SEQ ID NO: 13522 - DNA, 60 bp, Xenorhabdus bovienii
  Promoter location: Contig name=SeqID_16888; Position on contig =80649..80708bp; Strand=+
cctgccttcatcacatttctcacccctcgtatttatatttttgtttttattatcacaaat

SEQ ID NO: 13523 - DNA, 60 bp, Xenorhabdus bovienii
  Promoter location: Contig name=SeqID_16888; Position on contig =85942..86001bp; Strand=-
gatatcaataacacggtgtttgacctttccctgacaacgtgggtctggaaaatcagaaaa

SEQ ID NO: 13524 - DNA, 60 bp, Xenorhabdus bovienii
  Promoter location: Contig name=SeqID_16888; Position on contig =85624..85683bp; Strand=+
ggcggctttcagatgcgctaatagtttgataaataatgatgagtctttattgttgccgcc

SEQ ID NO: 13525 - DNA, 60 bp, Xenorhabdus bovienii
  Promoter location: Contig name=SeqID_16888; Position on contig =88080..88139bp; Strand=-
attaatagtcatgtattttttaataatttattgattttaaacgaatttaatttatttata

SEQ ID NO: 13526 - DNA, 60 bp, Xenorhabdus bovienii
  Promoter location: Contig name=SeqID_16888; Position on contig =88054..88113bp; Strand=+
gtgactactcatgacaggataatgcatataaataaattaaattcgtttaaaatcaataaa

SEQ ID NO: 13527 - DNA, 60 bp, Xenorhabdus bovienii
  Promoter location: Contig name=SeqID_16888; Position on contig =88893..88952bp; Strand=+
taaaaataaattaaatcttagtgttatatattaataaataacagatttatcttatttacc

SEQ ID NO: 13528 - DNA, 60 bp, Xenorhabdus bovienii
  Promoter location: Contig name=SeqID_16888; Position on contig =89776..89835bp; Strand=+
ataacataaggccatataaccaattgcactagatagtaagaaatccttatatttaattcc

SEQ ID NO: 13529 - DNA, 60 bp, Xenorhabdus bovienii
  Promoter location: Contig name=SeqID_16888; Position on contig =92478..92537bp; Strand=-
ttttttgtaacactgtaaagttatgttgattctatcgcttaacatcttaaaaaaattgaa

SEQ ID NO: 13530 - DNA, 60 bp, Xenorhabdus bovienii
  Promoter location: Contig name=SeqID_16888; Position on contig =92349..92408bp; Strand=+
aataccaccatgaccgcgaggttagtgagaaggaacaaggctattcgcatcatataaatt

SEQ ID NO: 13531 - DNA, 60 bp, Xenorhabdus bovienii
  Promoter location: Contig name=SeqID_16888; Position on contig =95226..95285bp; Strand=+
aagctgtgttttacttaaacattcttcaccctgaatacgttcaacgatatcctgaaagat

SEQ ID NO: 13532 - DNA, 60 bp, Xenorhabdus bovienii
  Promoter location: Contig name=SeqID_16888; Position on contig =96108..96167bp; Strand=-
attggtaaaaataattaaagaaaattctaattcagggatacaaacggtattctagaagga

SEQ ID NO: 13533 - DNA, 60 bp, Xenorhabdus bovienii
  Promoter location: Contig name=SeqID_16888; Position on contig =98473..98532bp; Strand=-; Gene name=Ftn
cgtaatttccgctttttcgtttgtttttgtggcaggaattacggttcttttcatttttgt

SEQ ID NO: 13534 - DNA, 60 bp, Xenorhabdus bovienii
  Promoter location: Contig name=SeqID_16888; Position on contig =99205..99264bp; Strand=-
atttttttaattagatatttagttaaataaaagtgattcttattttttatatttaatgag

SEQ ID NO: 13535 - DNA, 60 bp, Xenorhabdus bovienii
  Promoter location: Contig name=SeqID_16888; Position on contig =99135..99194bp; Strand=+
aaaaataaaataaaaatatttaatcaattgataattaagcatttatttaaaataaataat

SEQ ID NO: 13536 - DNA, 60 bp, Xenorhabdus bovienii
  Promoter location: Contig name=SeqID_16888; Position on contig =101121..101180bp; Strand=-
tttaacaaaactcacataattactttctattacatgttagtttaccccaacatttaatcc

SEQ ID NO: 13537 - DNA, 60 bp, Xenorhabdus bovienii
  Promoter location: Contig name=SeqID_16888; Position on contig =101465..101524bp; Strand=-; Gene name=TrpE
cgttgggtaattcgaaaaaataacttattaactagtggagattatcacagaatctcaccc

SEQ ID NO: 13538 - DNA, 60 bp, Xenorhabdus bovienii
  Promoter location: Contig name=SeqID_16888; Position on contig =101456..101515bp; Strand=+; Gene name=TrpE
tcaagtcaagggtgagattctgtgataatctccactagttaataagttattttttcgaat

SEQ ID NO: 13539 - DNA, 60 bp, Xenorhabdus bovienii
  Promoter location: Contig name=SeqID_16888; Position on contig =103512..103571bp; Strand=+; Gene name=SdaA
tcttagccacattcatatcaattgctattataattaaaaaaaaactgtaaactcctttat

SEQ ID NO: 13540 - DNA, 60 bp, Xenorhabdus bovienii
  Promoter location: Contig name=SeqID_16888; Position on contig =105152..105211bp; Strand=+
ttctcttttccccctaaaacatcacattttttttatacaaacattaataaaatgttaccg

SEQ ID NO: 13541 - DNA, 60 bp, Xenorhabdus bovienii
  Promoter location: Contig name=SeqID_16888; Position on contig =105336..105395bp; Strand=+
agcaattttcttaaatgcttcaaatgataatctaacgatatattttcttatgtaacaaaa

SEQ ID NO: 13542 - DNA, 60 bp, Xenorhabdus bovienii
  Promoter location: Contig name=SeqID_16888; Position on contig =108306..108365bp; Strand=+
gggaggtttttcctccccaatttctttattgtaaaaacaaatatgttataaataacccat

SEQ ID NO: 13543 - DNA, 60 bp, Xenorhabdus bovienii
  Promoter location: Contig name=SeqID_16888; Position on contig =109382..109441bp; Strand=-
gtgaaaatgcaatccagtgatcccattccataatatattggctggcataaaatcccaaaa

SEQ ID NO: 13544 - DNA, 60 bp, Xenorhabdus bovienii
  Promoter location: Contig name=SeqID_16888; Position on contig =108953..109012bp; Strand=+
cttttaatatataactaaatattttttgccttttattttaaatctggtattgtcctttcc

SEQ ID NO: 13545 - DNA, 60 bp, Xenorhabdus bovienii
  Promoter location: Contig name=SeqID_16888; Position on contig =110793..110852bp; Strand=-
agcagtcgttcggtttccaagttgtcaaatggcataatcattatttttgtaatcacaatg

SEQ ID NO: 13546 - DNA, 60 bp, Xenorhabdus bovienii
  Promoter location: Contig name=SeqID_16888; Position on contig =110657..110716bp; Strand=+
gcattgataagacataacattccgatgaatagggaaatttagaggcttactataacatgt

SEQ ID NO: 13547 - DNA, 60 bp, Xenorhabdus bovienii
  Promoter location: Contig name=SeqID_16888; Position on contig =112060..112119bp; Strand=-
atcaattctgcccacgatgaattttttgacgatgccaaaaaatactttatagtacatact

SEQ ID NO: 13548 - DNA, 60 bp, Xenorhabdus bovienii
  Promoter location: Contig name=SeqID_16888; Position on contig =115652..115711bp; Strand=-; Gene name=XseA
tcaagaaatttttttaaaaaatgctggaggcaatcgattacggcctgtataatgccgcgg

SEQ ID NO: 13549 - DNA, 60 bp, Xenorhabdus bovienii
  Promoter location: Contig name=SeqID_16888; Position on contig =115683..115742bp; Strand=+; Gene name=XseA
ctccagcattttttaaaaaaatttcttgattcgtactctgggatgattagtatcagttaa

SEQ ID NO: 13550 - DNA, 60 bp, Xenorhabdus bovienii
  Promoter location: Contig name=SeqID_16888; Position on contig =119510..119569bp; Strand=-; Gene name=PtrB
tatatttataacccaaggcgctgataatttgttatcagtgtcatgggtattttatcgcca

SEQ ID NO: 13551 - DNA, 60 bp, Xenorhabdus bovienii
  Promoter location: Contig name=SeqID_16888; Position on contig =122601..122660bp; Strand=-; Gene name=PhuW
atgacactaataaataaaaatagttttcatttatatatctaattgattatcattctctta

SEQ ID NO: 13552 - DNA, 60 bp, Xenorhabdus bovienii
  Promoter location: Contig name=SeqID_16888; Position on contig =123613..123672bp; Strand=-; Gene name=SfcA
gcataggcttaacagggtagttttatttgtaaataattctcattatctataatatgcgga

SEQ ID NO: 13553 - DNA, 60 bp, Xenorhabdus bovienii
  Promoter location: Contig name=SeqID_16888; Position on contig =126250..126309bp; Strand=-; Gene name=CitB
tttatagattaaatttcgtttttgtaagcttattttaaaagttgtttttagaatgcttct

SEQ ID NO: 13554 - DNA, 60 bp, Xenorhabdus bovienii
  Promoter location: Contig name=SeqID_16888; Position on contig =127295..127354bp; Strand=+; Gene name=ArsC
ttaccaaccaattagtttcatatataattaataacagatgttatttgtataatttattac

SEQ ID NO: 13555 - DNA, 60 bp, Xenorhabdus bovienii
  Promoter location: Contig name=SeqID_16888; Position on contig =132778..132837bp; Strand=-
tagtcagttaataacatattgaatatgattgagaatattaattttttcataatcaaataa

SEQ ID NO: 13556 - DNA, 60 bp, Xenorhabdus bovienii
  Promoter location: Contig name=SeqID_16888; Position on contig =132585..132644bp; Strand=+
accgaccaatacacatctaatacatagcagaataataacttaaaatttaatatcttaatc

SEQ ID NO: 13557 - DNA, 60 bp, Xenorhabdus bovienii
  Promoter location: Contig name=SeqID_16888; Position on contig =133585..133644bp; Strand=-
agaagagtgtttttttcatatctttcatacgaatgcatcccgtttgtaaggctttcctta

SEQ ID NO: 13558 - DNA, 60 bp, Xenorhabdus bovienii
  Promoter location: Contig name=SeqID_16888; Position on contig =134931..134990bp; Strand=-; Gene name=NlpB
acataaaggggcctaggcccctttatattttgggtgaaattttttcgtttaatttttttg

SEQ ID NO: 13559 - DNA, 60 bp, Xenorhabdus bovienii
  Promoter location: Contig name=SeqID_16888; Position on contig =137083..137142bp; Strand=-; Gene name=GcvR
aaaaatgatcaggagaaggtcaatcgtattgtgaagggaagtgcgattataatctctgtt

SEQ ID NO: 13560 - DNA, 60 bp, Xenorhabdus bovienii
  Promoter location: Contig name=SeqID_16888; Position on contig =137096..137155bp; Strand=+; Gene name=GcvR
atcgcacttcccttcacaatacgattgaccttctcctgatcattttttatgtttaatgac

SEQ ID NO: 13561 - DNA, 60 bp, Xenorhabdus bovienii
  Promoter location: Contig name=SeqID_16888; Position on contig =139468..139527bp; Strand=-
tcgtaaaaacaatgtgtcccagttagttattaaattatgaatgtgtgtatgatagcaaat

SEQ ID NO: 13562 - DNA, 60 bp, Xenorhabdus bovienii
  Promoter location: Contig name=SeqID_16888; Position on contig =142306..142365bp; Strand=-; Gene name=UraA
actaatctggatgtcaattctaattccaatcagaaaaacaacaccttgttatctactgta

SEQ ID NO: 13563 - DNA, 60 bp, Xenorhabdus bovienii
  Promoter location: Contig name=SeqID_16888; Position on contig =143970..144029bp; Strand=+
taaataagccggaattttccctttacagataaatagatacagcaatgttccaataccatt

SEQ ID NO: 13564 - DNA, 60 bp, Xenorhabdus bovienii
  Promoter location: Contig name=SeqID_16888; Position on contig =145037..145096bp; Strand=-; Gene name=PurM
gtagcccccaggcggttgcatttgaatgaataaaacagaacggcggcaattctaacagtc

SEQ ID NO: 13565 - DNA, 60 bp, Xenorhabdus bovienii
  Promoter location: Contig name=SeqID_16888; Position on contig =144802..144861bp; Strand=+; Gene name=PurM
tatcatgatctcgcatcaggccgagtttatgtttaactaatgggtgttgaacttcaacga

SEQ ID NO: 13566 - DNA, 60 bp, Xenorhabdus bovienii
  Promoter location: Contig name=SeqID_16888; Position on contig =147074..147133bp; Strand=-; Gene name=RimL
aatgttcggataattaattattaccagatacataattattgccagattaatattttgtta

SEQ ID NO: 13567 - DNA, 60 bp, Xenorhabdus bovienii
  Promoter location: Contig name=SeqID_16888; Position on contig =147047..147106bp; Strand=+; Gene name=RimL
acccagcaaatcggttatttattcatctaacaaaatattaatctggcaataattatgtat

SEQ ID NO: 13568 - DNA, 60 bp, Xenorhabdus bovienii
  Promoter location: Contig name=SeqID_16888; Position on contig =151572..151631bp; Strand=+; Gene name=MgtE
cgtcctattatccctaaaagccatttttcagattatattatcgttagataataggatcgc

SEQ ID NO: 13569 - DNA, 60 bp, Xenorhabdus bovienii
  Promoter location: Contig name=SeqID_16888; Position on contig =153475..153534bp; Strand=-; Gene name=AcrA
gatgacaacggctagtaccgcaaatcggaaaaaataagtacgacgtttattcttcatgtg

SEQ ID NO: 13570 - DNA, 60 bp, Xenorhabdus bovienii
  Promoter location: Contig name=SeqID_16888; Position on contig =153343..153402bp; Strand=+; Gene name=AcrA
gccataacttccatattttctccaccattgactatttccctttggttacactaataatat

SEQ ID NO: 13571 - DNA, 60 bp, Xenorhabdus bovienii
  Promoter location: Contig name=SeqID_16888; Position on contig =163607..163666bp; Strand=-
gcggatgaacgttttcagctttgcattgtggggagcaatattgacgacaacataaaaacg

SEQ ID NO: 13572 - DNA, 60 bp, Xenorhabdus bovienii
  Promoter location: Contig name=SeqID_16888; Position on contig =163304..163363bp; Strand=+
cacaattatattcccacaataaatttgtgccatagatggattaaacgttaaaattcttgt

SEQ ID NO: 13573 - DNA, 60 bp, Xenorhabdus bovienii
  Promoter location: Contig name=SeqID_16888; Position on contig =165103..165162bp; Strand=-; Gene name=FbaB
aactgaagaattattaatgatatttatcatgagatgatttttttatttataataaataga

SEQ ID NO: 13574 - DNA, 60 bp, Xenorhabdus bovienii
  Promoter location: Contig name=SeqID_16888; Position on contig =167420..167479bp; Strand=-
tgttgttttatagttactgttagactttagtggatgttctgagatactaaatttttattt

SEQ ID NO: 13575 - DNA, 60 bp, Xenorhabdus bovienii
  Promoter location: Contig name=SeqID_16888; Position on contig =167360..167419bp; Strand=+
gaaaagccagtatccgaataggagataccatgacttccctacgctggcattatccagatc

SEQ ID NO: 13576 - DNA, 60 bp, Xenorhabdus bovienii
  Promoter location: Contig name=SeqID_16888; Position on contig =167942..168001bp; Strand=+
agcatggtaaagccctgcataatgttgaccctgaacagcttacctaccaccatgtctatt

SEQ ID NO: 13577 - DNA, 60 bp, Xenorhabdus bovienii
  Promoter location: Contig name=SeqID_16888; Position on contig =169156..169215bp; Strand=+
ataacctattgttttaaatatataaatagccatcaaccactgatggctaaaatctcgatc

SEQ ID NO: 13578 - DNA, 60 bp, Xenorhabdus bovienii
  Promoter location: Contig name=SeqID_16888; Position on contig =170076..170135bp; Strand=+
gttcaaatagtcatagcgcatggctgactttcatctatcctcgcctatatattgcacgtg

SEQ ID NO: 13579 - DNA, 60 bp, Xenorhabdus bovienii
  Promoter location: Contig name=SeqID_16888; Position on contig =175378..175437bp; Strand=-
tattttttaaataaagttatcttattgtattgataattataaaaaaatatgataaatgat

SEQ ID NO: 13580 - DNA, 60 bp, Xenorhabdus bovienii
  Promoter location: Contig name=SeqID_16888; Position on contig =175734..175793bp; Strand=-
ttatgaatcataacaaagaaaactacttttaaaagtataactacaagaataatcaataag

SEQ ID NO: 13581 - DNA, 60 bp, Xenorhabdus bovienii
  Promoter location: Contig name=SeqID_16888; Position on contig =177003..177062bp; Strand=-
agatcacttgagggaactcagtccgatttttacgatctgatcaatggcgaaaatcacaaa

SEQ ID NO: 13582 - DNA, 60 bp, Xenorhabdus bovienii
  Promoter location: Contig name=SeqID_16888; Position on contig =178422..178481bp; Strand=-
caccatcccactttctcgaaagacgttgttttccagtgtctgcatcttatcattgccact

SEQ ID NO: 13583 - DNA, 60 bp, Xenorhabdus bovienii
  Promoter location: Contig name=SeqID_16888; Position on contig =181689..181748bp; Strand=-
tgaataatatttaataaaggataaataaaatataacttaatgacgtttaagataattata

SEQ ID NO: 13584 - DNA, 60 bp, Xenorhabdus bovienii
  Promoter location: Contig name=SeqID_16888; Position on contig =181707..181766bp; Strand=+
cattaagttatattttatttatcctttattaaatattattcaattctaatatggagccac

SEQ ID NO: 13585 - DNA, 60 bp, Xenorhabdus bovienii
  Promoter location: Contig name=SeqID_16888; Position on contig =183729..183788bp; Strand=-
aaagtgataaataagatagcttaatggggttggtttaaatgtcgcgctaaaatcagagct

SEQ ID NO: 13586 - DNA, 60 bp, Xenorhabdus bovienii
  Promoter location: Contig name=SeqID_16888; Position on contig =183541..183600bp; Strand=+
cttaagcgtagattgttctgcttgttctgccatctagtcctcttaattataatgcttaga

SEQ ID NO: 13587 - DNA, 60 bp, Xenorhabdus bovienii
  Promoter location: Contig name=SeqID_16888; Position on contig =184159..184218bp; Strand=-; Gene name=AraC
aaaaaaaacttttttagggctatgtttaataacagtgtgtctgtttttatatttattagc

SEQ ID NO: 13588 - DNA, 60 bp, Xenorhabdus bovienii
  Promoter location: Contig name=SeqID_16888; Position on contig =184211..184270bp; Strand=+; Gene name=AraC
ttttttttatgttcaattgagtcacctcacaataatttcattgtagttaactttataata

SEQ ID NO: 13589 - DNA, 60 bp, Xenorhabdus bovienii
  Promoter location: Contig name=SeqID_16888; Position on contig =185919..185978bp; Strand=-
gaaagccaccaataaagcagcaatttaaaaggtaaaggatatacattcattatgagtaat

SEQ ID NO: 13590 - DNA, 60 bp, Xenorhabdus bovienii
  Promoter location: Contig name=SeqID_16888; Position on contig =185792..185851bp; Strand=+
ataagactacaatagatgtgatgttttttactggcagaggtgcttattaaaatccaataa

SEQ ID NO: 13591 - DNA, 60 bp, Xenorhabdus bovienii
  Promoter location: Contig name=SeqID_16888; Position on contig =187560..187619bp; Strand=-
taattataaaggatattgggcacaataaattttgcaggatactgatttatggtcagctaa

SEQ ID NO: 13592 - DNA, 60 bp, Xenorhabdus bovienii
  Promoter location: Contig name=SeqID_16888; Position on contig =187707..187766bp; Strand=+
caatgggtaacttttaataatttttttacatttactttagcgtttattaagattcatact

SEQ ID NO: 13593 - DNA, 60 bp, Xenorhabdus bovienii
  Promoter location: Contig name=SeqID_16888; Position on contig =188159..188218bp; Strand=+
attaaattttaatactgtgatagttggaaaaaaccatcattgcatattaaaattttcaat

SEQ ID NO: 13594 - DNA, 60 bp, Xenorhabdus bovienii
  Promoter location: Contig name=SeqID_16888; Position on contig =189420..189479bp; Strand=+
cataatcaaggcacccagttttccaccggaattcggggcaaatcatgaataatgtactat

SEQ ID NO: 13595 - DNA, 60 bp, Xenorhabdus bovienii
  Promoter location: Contig name=SeqID_16888; Position on contig =191705..191764bp; Strand=-
aattactgatttttctttttagtattgctttggctaggaaggcctgatcacatcccttat

SEQ ID NO: 13596 - DNA, 60 bp, Xenorhabdus bovienii
  Promoter location: Contig name=SeqID_16888; Position on contig =192815..192874bp; Strand=-
taacagtaacagaaataatctattttgattatattcttttactcttttaaacgtgaaatt

SEQ ID NO: 13597 - DNA, 60 bp, Xenorhabdus bovienii; identical to SEQ ID NO: 12666
  Promoter location: Contig name=SeqID_16888; Position on contig =194127..194186bp; Strand=-

SEQ ID NO: 13598 - DNA, 60 bp, Xenorhabdus bovienii
  Promoter location: Contig name=SeqID_16888; Position on contig =194555..194614bp; Strand=-
aacgcgaatattggtggaaataaaaagaatatagccaatattgaacataaaattctgtag

SEQ ID NO: 13599 - DNA, 60 bp, Xenorhabdus bovienii
  Promoter location: Contig name=SeqID_16888; Position on contig =196971..197030bp; Strand=-
attgagtacatgtcataatttgcgtcataaagcagactgagacttacttaaaatccgacc

SEQ ID NO: 13600 - DNA, 60 bp, Xenorhabdus bovienii
  Promoter location: Contig name=SeqID_16888; Position on contig =198928..198987bp; Strand=-; Gene name=RsuA
taaggtttgttaaagatcagtaccctgcgagggcctgttaatttttttatagtatcttta

SEQ ID NO: 13601 - DNA, 60 bp, Xenorhabdus bovienii
  Promoter location: Contig name=SeqID_16888; Position on contig =198641..198700bp; Strand=+; Gene name=RsuA
gattaccgggttattcggaacatttaatttacctttggcatcaatagtaatttttttacc

SEQ ID NO: 13602 - DNA, 60 bp, Xenorhabdus bovienii
  Promoter location: Contig name=SeqID_16888; Position on contig =203365..203424bp; Strand=-; Gene name=OmpR
agtcaatttcgtcaacaggtattaaataagattatatatatcattattatgattgaatta

SEQ ID NO: 13603 - DNA, 60 bp, Xenorhabdus bovienii
  Promoter location: Contig name=SeqID_16888; Position on contig =203342..203401bp; Strand=+; Gene name=OmpR
ttggccaaaatagttactatacttaattcaatcataataatgatatatataatcttattt

SEQ ID NO: 13604 - DNA, 60 bp, Xenorhabdus bovienii
  Promoter location: Contig name=SeqID_16888; Position on contig =209087..209146bp; Strand=-
cgtgtcggtttaatcgatagcgatttaacgggtagggttctaatcagcagaatagacgac

SEQ ID NO: 13605 - DNA, 60 bp, Xenorhabdus bovienii
  Promoter location: Contig name=SeqID_16888; Position on contig =212310..212369bp; Strand=-
aacccattgtttttaaaaacatcattttgatacggcggatttcatgtttcaatctgtctc

SEQ ID NO: 13606 - DNA, 60 bp, Xenorhabdus bovienii
  Promoter location: Contig name=SeqID_16888; Position on contig =212294..212353bp; Strand=+
caatcctataaataatgagacagattgaaacatgaaatccgccgtatcaaaatgatgttt

SEQ ID NO: 13607 - DNA, 60 bp, Xenorhabdus bovienii
  Promoter location: Contig name=SeqID_16888; Position on contig =212735..212794bp; Strand=-
aacacagaaccggggtacgagtggttccatacagtattgctgccctttattatcactgaa

SEQ ID NO: 13608 - DNA, 60 bp, Xenorhabdus bovienii
  Promoter location: Contig name=SeqID_16888; Position on contig =212562..212621bp; Strand=+
gctacgccgatgcgtagccttgaaaacgccataatctaatataaagatactattaacaag

SEQ ID NO: 13609 - DNA, 60 bp, Xenorhabdus bovienii
  Promoter location: Contig name=SeqID_16888; Position on contig =218557..218616bp; Strand=+
caacaccatcatcaagagaacccgttgctacttcatgtaataatggtttccataaatggc

SEQ ID NO: 13610 - DNA, 60 bp, Xenorhabdus bovienii
  Promoter location: Contig name=SeqID_16888; Position on contig =218914..218973bp; Strand=+
ttgattaattagacatcagtcacgaaattttcgcgcttactttcaattaatctgatgtat

SEQ ID NO: 13611 - DNA, 60 bp, Xenorhabdus bovienii
  Promoter location: Contig name=SeqID_16888; Position on contig =221734..221793bp; Strand=-
tatccatatgcatatggtgggtggacgtccattggggccactgttggtaaagtaatgtga

SEQ ID NO: 13612 - DNA, 60 bp, Xenorhabdus bovienii
  Promoter location: Contig name=SeqID_16888; Position on contig =226614..226673bp; Strand=-; Gene name=FabB
ttatgaagagcctcaacatttgttgaggcttttttattcctgatttttatgatttttttt

SEQ ID NO: 13613 - DNA, 60 bp, Xenorhabdus bovienii
  unsure (1)..(60): unsure at all n locations
  Promoter location: Contig name=SeqID_16888; Position on contig =228129..228188bp; Strand=-
nnnnnnnnnnnnnnnnnnnnnnnnnnnnnnnnnnnnnnnnnnnnnnnnggcgctgattct

SEQ ID NO: 13614 - DNA, 60 bp, Xenorhabdus bovienii
  Promoter location: Contig name=SeqID_16889; Position on contig =4491..4550bp; Strand=+; Gene name=Maf (BS)
atctgcacctttccgccaaaaattcgcttattaagcggggtatagtttaaaatgtctggg

SEQ ID NO: 13615 - DNA, 60 bp, Xenorhabdus bovienii
  Promoter location: Contig name=SeqID_16889; Position on contig =6232..6291bp; Strand=-
actttatcgctttagcagttttttatcaggaaatagtgataagttgttaatctttggtct

SEQ ID NO: 13616 - DNA, 60 bp, Xenorhabdus bovienii
  Promoter location: Contig name=SeqID_16889; Position on contig =6650..6709bp; Strand=-
gttgcgttgattagcattcttttcattctaacttactcattattttttacattggtatag

SEQ ID NO: 13617 - DNA, 60 bp, Xenorhabdus bovienii
  Promoter location: Contig name=SeqID_16889; Position on contig =10607..10666bp; Strand=-
tccataaaaatcaacaactctaaatgataatgataatgataattatctaagtttattgaa

SEQ ID NO: 13618 - DNA, 60 bp, Xenorhabdus bovienii
  Promoter location: Contig name=SeqID_16889; Position on contig =10579..10638bp; Strand=+
gcctgtctcatttcattcactctctgatttcaataaacttagataattatcattatcatt

SEQ ID NO: 13619 - DNA, 60 bp, Xenorhabdus bovienii
  Promoter location: Contig name=SeqID_16889; Position on contig =11707..11766bp; Strand=-
gtcaataaattgtcgaaactgacttgtctattcgttacttgaaattgtattgtgtagtca

SEQ ID NO: 13620 - DNA, 60 bp, Xenorhabdus bovienii
  Promoter location: Contig name=SeqID_16889; Position on contig =11735..11794bp; Strand=+
aatagacaagtcagtttcgacaatttattgacattataaactttaagtatattccttaat

SEQ ID NO: 13621 - DNA, 60 bp, Xenorhabdus bovienii
  Promoter location: Contig name=SeqID_16889; Position on contig =12022..12081bp; Strand=+; Gene name=SbcB
aaaccgtgcaataaaacttttatcaacatgatcaatacacaaaaaataagataacacatt

SEQ ID NO: 13622 - DNA, 60 bp, Xenorhabdus bovienii
  Promoter location: Contig name=SeqID_16889; Position on contig =15471..15530bp; Strand=-; Gene name=PotE
aaataaaaaaagaatatcaatggcataaaaatcaccaaaaggcgtcatataataaatatc

SEQ ID NO: 13623 - DNA, 60 bp, Xenorhabdus bovienii
  Promoter location: Contig name=SeqID_16889; Position on contig =17277..17336bp; Strand=-
caaaatgcgtgcactaaaaaatagctggtgtgtaaatatacaccagttatttttttgctt

SEQ ID NO: 13624 - DNA, 60 bp, Xenorhabdus bovienii
  Promoter location: Contig name=SeqID_16889; Position on contig =17063..17122bp; Strand=+
gaaagaagagttattagaagacagtgaactgacggaggaccatgccccataatcatcgtt

SEQ ID NO: 13625 - DNA, 60 bp, Xenorhabdus bovienii
  Promoter location: Contig name=SeqID_16889; Position on contig =19672..19731bp; Strand=-; Gene name=FepC
gttttattaaaactaaagcttaataaatataacactgacagggataaataattatccctg

SEQ ID NO: 13626 - DNA, 60 bp, Xenorhabdus bovienii
  Promoter location: Contig name=SeqID_16889; Position on contig =22944..23003bp; Strand=-; Gene name=LysP
tgttaataaacatcaacaaattgatatttattaattaacttattattatttatatattac

SEQ ID NO: 13627 - DNA, 60 bp, Xenorhabdus bovienii
  Promoter location: Contig name=SeqID_16889; Position on contig =24595..24654bp; Strand=-; Gene name=LysR
ctagtatgcctacatggaactagtaatacgaaaataatcgtgtagcttataatcggcggt

SEQ ID NO: 13628 - DNA, 60 bp, Xenorhabdus bovienii
  Promoter location: Contig name=SeqID_16889; Position on contig =25610..25669bp; Strand=-
aagctttttaatcaataaaattgataatatttatatatataaccagtaaaatggattaat

SEQ ID NO: 13629 - DNA, 60 bp, Xenorhabdus bovienii
  Promoter location: Contig name=SeqID_16889; Position on contig =25593..25652bp; Strand=+
aacaaaagtcacacttaattaatccattttactggttatatatataaatattatcaattt

SEQ ID NO: 13630 - DNA, 60 bp, Xenorhabdus bovienii
  Promoter location: Contig name=SeqID_16889; Position on contig =26819..26878bp; Strand=+; Gene name=Nfo
gcattctctgtttttgacagagattttattggcaggatgaacaatgccataatagtgaaa

SEQ ID NO: 13631 - DNA, 60 bp, Xenorhabdus bovienii
  Promoter location: Contig name=SeqID_16889; Position on contig =28956..29015bp; Strand=-
atagggtgcgtgcttgctggtgcgttttcccagcaggacttcacctttatcattaataat

SEQ ID NO: 13632 - DNA, 60 bp, Xenorhabdus bovienii
  Promoter location: Contig name=SeqID_16889; Position on contig =28722..28781bp; Strand=+
ttaagatttctctgttatttataacatcaaaattgaatcgtttcagttaaaattaccact

SEQ ID NO: 13633 - DNA, 60 bp, Xenorhabdus bovienii
  Promoter location: Contig name=SeqID_16889; Position on contig =32061..32120bp; Strand=-
tttctaatcatattgtttatttaatttataaatataattattaattgtaaaattttttat

SEQ ID NO: 13634 - DNA, 60 bp, Xenorhabdus bovienii
  Promoter location: Contig name=SeqID_16889; Position on contig =32577..32636bp; Strand=-
tatcctaacttgttagaatattatgttgaaatgtggcctttataaataaaaatcataaag

SEQ ID NO: 13635 - DNA, 60 bp, Xenorhabdus bovienii
  Promoter location: Contig name=SeqID_16889; Position on contig =32679..32738bp; Strand=+; Gene name=PgpB
aaaattgagacaaatatatattatcggtactgaagtggggatttagctatttttccgata

SEQ ID NO: 13636 - DNA, 60 bp, Xenorhabdus bovienii
  Promoter location: Contig name=SeqID_16889; Position on contig =33756..33815bp; Strand=+; Gene name=Spr
ttgtatctcgctttttactcatcatttctgtaaccttccctgtgccctattattaaaata

SEQ ID NO: 13637 - DNA, 60 bp, Xenorhabdus bovienii
  Promoter location: Contig name=SeqID_16889; Position on contig =35161..35220bp; Strand=-
aagttgcttatttgcataaaaataagttgaattttttacctaaacagtataaatatatac

SEQ ID NO: 13638 - DNA, 60 bp, Xenorhabdus bovienii
  Promoter location: Contig name=SeqID_16889; Position on contig =35279..35338bp; Strand=+
aataatatttttatattacaatcagttaattaacaacaaaaccattttaatctatagtca

SEQ ID NO: 13639 - DNA, 60 bp, Xenorhabdus bovienii
  Promoter location: Contig name=SeqID_16889; Position on contig =36818..36877bp; Strand=-; Gene name=RsuA
ctatttaacaagttgttacgggagttaaagcgtgcaacaacaacgattatcctatttggg

SEQ ID NO: 13640 - DNA, 60 bp, Xenorhabdus bovienii
  Promoter location: Contig name=SeqID_16889; Position on contig =37719..37778bp; Strand=-
attcagttactaaagtaagatggctataacatgtagtttattattgttataattattgat

SEQ ID NO: 13641 - DNA, 60 bp, Xenorhabdus bovienii
  Promoter location: Contig name=SeqID_16889; Position on contig =37772..37831bp; Strand=+; Gene name=SSL2
actgaatggaaagcgctttcccgacggcaagaccacaggaaaaatgttatcctctctatc

SEQ ID NO: 13642 - DNA, 60 bp, Xenorhabdus bovienii
  Promoter location: Contig name=SeqID_16889; Position on contig =39637..39696bp; Strand=+; Gene name=RplY
aatcagcccaaaagtactttctatttgctgtcatataggtttttcgttaaaatgccgccc

SEQ ID NO: 13643 - DNA, 60 bp, Xenorhabdus bovienii
  Promoter location: Contig name=SeqID_16889; Position on contig =41298..41357bp; Strand=+
gaaaattaatttgtcataaaaaagcagaaaattgcccttctatacggtagtatatagggc

SEQ ID NO: 13644 - DNA, 60 bp, Xenorhabdus bovienii
  Promoter location: Contig name=SeqID_16889; Position on contig =43697..43756bp; Strand=-
accgtccaactttatggggtcagttcattgcggggctttttattgattattttttcctat

SEQ ID NO: 13645 - DNA, 60 bp, Xenorhabdus bovienii
  Promoter location: Contig name=SeqID_16889; Position on contig =43456..43515bp; Strand=+
cggcatgtagcgcagcttggtagcgcaccgtcatggggtgtcgggggtcgtaggttcaaa

SEQ ID NO: 13646 - DNA, 60 bp, Xenorhabdus bovienii
  Promoter location: Contig name=SeqID_16889; Position on contig =44664..44723bp; Strand=-
tgatcttggaacaggcacttagttcaattttttatccagaactcaggtaaattacctctt

SEQ ID NO: 13647 - DNA, 60 bp, Xenorhabdus bovienii
  Promoter location: Contig name=SeqID_16889; Position on contig =44419..44478bp; Strand=+
atagataacgcgatccatttattcctcctttagtgctttctgataagtatcatatatcag

SEQ ID NO: 13648 - DNA, 60 bp, Xenorhabdus bovienii
  Promoter location: Contig name=SeqID_16889; Position on contig =47879..47938bp; Strand=-
taggtcaaagaattaaagtcaaagtcaccgtctaaagacggtggttttaaacctttcata

SEQ ID NO: 13649 - DNA, 60 bp, Xenorhabdus bovienii
  Promoter location: Contig name=SeqID_16889; Position on contig =48961..49020bp; Strand=-
actcagctatttttggctgggtctttttttttgagacatgaggaaggtatcatgaaatag

SEQ ID NO: 13650 - DNA, 60 bp, Xenorhabdus bovienii
  Promoter location: Contig name=SeqID_16889; Position on contig =48626..48685bp; Strand=+
tttcccggcgaccatcgttgtgatgtcatttcatattttagcaattcaatactaggtagt

SEQ ID NO: 13651 - DNA, 60 bp, Xenorhabdus bovienii
  Promoter location: Contig name=SeqID_16889; Position on contig =64164..64223bp; Strand=-
tggttttttgtttgtaaataaataggtagtcgcttttgccatgcaggcaaaatattgttt

SEQ ID NO: 13652 - DNA, 60 bp, Xenorhabdus bovienii
  Promoter location: Contig name=SeqID_16889; Position on contig =65743..65802bp; Strand=-; Gene name=AvtA
cagtaaacctttgccctctttaatagagtagagtaatgtcacaatcggtattattttatt

SEQ ID NO: 13653 - DNA, 60 bp, Xenorhabdus bovienii
  Promoter location: Contig name=SeqID_16889; Position on contig =66212..66271bp; Strand=+; Gene name=AvtA
taaattacctgttctttcattcagccaactaaaaacacgccattatttaaaatataaagc

SEQ ID NO: 13654 - DNA, 60 bp, Xenorhabdus bovienii
  Promoter location: Contig name=SeqID_16889; Position on contig =71785..71844bp; Strand=-
taaaccccctttcagatcaataaatggttgttttgcgctactcataaaaaatgggtagtg

SEQ ID NO: 13655 - DNA, 60 bp, Xenorhabdus bovienii
  Promoter location: Contig name=SeqID_16889; Position on contig =72420..72479bp; Strand=-; Gene name=ackA
acataaaagtctgtgtaggataccgtttgctagcaataaagacaaaatatacttaatagt

SEQ ID NO: 13656 - DNA, 60 bp, Xenorhabdus bovienii
  Promoter location: Contig name=SeqID_16889; Position on contig =72511..72570bp; Strand=+; Gene name=ackA
ttttcgcaacacgttggttcagtttgttaacagattatttcattttttaacattattctt

SEQ ID NO: 13657 - DNA, 60 bp, Xenorhabdus bovienii
  Promoter location: Contig name=SeqID_16889; Position on contig =83906..83965bp; Strand=-
agtctattaattaaaaaatcacatttcatggtatatcaattcatttttattttagttatt

SEQ ID NO: 13658 - DNA, 60 bp, Xenorhabdus bovienii
  Promoter location: Contig name=SeqID_16889; Position on contig =83904..83963bp; Strand=+
taaataactaaaataaaaatgaattgatataccatgaaatgtgattttttaattaataga

SEQ ID NO: 13659 - DNA, 60 bp, Xenorhabdus bovienii
  Promoter location: Contig name=SeqID_16889; Position on contig =84749..84808bp; Strand=-
aaaattcttattttatttgatagttaaaaatatatttaatcataaattataatttttatt

SEQ ID NO: 13660 - DNA, 60 bp, Xenorhabdus bovienii
  Promoter location: Contig name=SeqID_16889; Position on contig =85056..85115bp; Strand=-
tttttgagaaaatcttaagtttatgtttgttaaagatattttttaattatattgtttgga

SEQ ID NO: 13661 - DNA, 60 bp, Xenorhabdus bovienii
  Promoter location: Contig name=SeqID_16889; Position on contig =85115..85174bp; Strand=+
aggtagaaaatgattaatcaagaattgataaattatatttttttgatgaaaatgaaggag

SEQ ID NO: 13662 - DNA, 60 bp, Xenorhabdus bovienii
  Promoter location: Contig name=SeqID_16889; Position on contig =90628..90687bp; Strand=-
actgccgcctgtttcacctcgttgaaaaggggggcaggtgcattagccatcatgatcgta

SEQ ID NO: 13663 - DNA, 60 bp, Xenorhabdus bovienii
  Promoter location: Contig name=SeqID_16889; Position on contig =90259..90318bp; Strand=+
gggtgaaaaggcgtccgtttcccccatctgctgcttgatttgcaggatataatgcgccag

SEQ ID NO: 13664 - DNA, 60 bp, Xenorhabdus bovienii
  Promoter location: Contig name=SeqID_16889; Position on contig =92901..92960bp; Strand=-; Gene name=FabG
aggggaataaaatattagtaagatcaggcgctttgctgcctgatctcatactttcgccgc

SEQ ID NO: 13665 - DNA, 60 bp, Xenorhabdus bovienii
  Promoter location: Contig name=SeqID_16889; Position on contig =108410..108469bp; Strand=-
gtttttagataaagataattgaagttgatggtagtataaaaatagctataacaggcagtg

SEQ ID NO: 13666 - DNA, 60 bp, Xenorhabdus bovienii
  Promoter location: Contig name=SeqID_16889; Position on contig =108146..108205bp; Strand=+
agacatacattcctcgtgtattgaataaaacacgcccgtaatcagcatatatttttatat

SEQ ID NO: 13667 - DNA, 60 bp, Xenorhabdus bovienii
  Promoter location: Contig name=SeqID_16889; Position on contig =110575..110634bp; Strand=-; Gene name=Gst
atggataaatatagttccagtacattaccactggtttgagttgcctgtaaaatgccataa

SEQ ID NO: 13668 - DNA, 60 bp, Xenorhabdus bovienii
  Promoter location: Contig name=SeqID_16889; Position on contig =110495..110554bp; Strand=+; Gene name=Gst
cgcgcctaattaaaaggccaaaacggataaagattgccataactgaataaaataaatcca

SEQ ID NO: 13669 - DNA, 60 bp, Xenorhabdus bovienii
  Promoter location: Contig name=SeqID_16889; Position on contig =111329..111388bp; Strand=+
gctaacagataacagcatttttcgctgttacgcaggccatcccctgctatagtcaataac

SEQ ID NO: 13670 - DNA, 60 bp, Xenorhabdus bovienii
  Promoter location: Contig name=SeqID_16889; Position on contig =115036..115095bp; Strand=-
tttcagtagagtgagaaatctgctacgcaaacgttttcgttttctgttagaatgcgcccg

SEQ ID NO: 13671 - DNA, 60 bp, Xenorhabdus bovienii
  Promoter location: Contig name=SeqID_16889; Position on contig =114936..114995bp; Strand=+
acgtatcaggctaaccagtgccgagaaaccaatgatggcaataattgtataatcaatcca

SEQ ID NO: 13672 - DNA, 60 bp, Xenorhabdus bovienii
  Promoter location: Contig name=SeqID_16889; Position on contig =118171..118230bp; Strand=-; Gene name=DedA
ttagtaagtttgaacagttttttatccactctgtaatggcattgtggtttaatggcacgt

SEQ ID NO: 13673 - DNA, 60 bp, Xenorhabdus bovienii
  Promoter location: Contig name=SeqID_16889; Position on contig =122111..122170bp; Strand=-
gtgcatagtgtatttagtgtaacaatgacccattttttgtatatagtgataatcagacaa

SEQ ID NO: 13674 - DNA, 60 bp, Xenorhabdus bovienii
  Promoter location: Contig name=SeqID_16889; Position on contig =121644..121703bp; Strand=+
atgccgacagttttatctttgagttgaaattgatcccgttccgccaataacatcagtgca

SEQ ID NO: 13675 - DNA, 60 bp, Xenorhabdus bovienii
  Promoter location: Contig name=SeqID_16889; Position on contig =125290..125349bp; Strand=-
taagaataatattttgcgagagggttcccattttatgttatcccattaacaattactcaa

SEQ ID NO: 13676 - DNA, 60 bp, Xenorhabdus bovienii
  Promoter location: Contig name=SeqID_16889; Position on contig =125644..125703bp; Strand=-
attatttttatatcggcttcatgtggaattgattttatatcaatatttattctgcttttt

SEQ ID NO: 13677 - DNA, 60 bp, Xenorhabdus bovienii
  Promoter location: Contig name=SeqID_16889; Position on contig =125642..125701bp; Strand=+
aaaaaaagcagaataaatattgatataaaatcaattccacatgaagccgatataaaaata

SEQ ID NO: 13678 - DNA, 60 bp, Xenorhabdus bovienii
  Promoter location: Contig name=SeqID_16889; Position on contig =125897..125956bp; Strand=+
ctttttattgttaatgaaaggtaaatgaaaggtttcgcatttataaataaaatgctcctg

SEQ ID NO: 13679 - DNA, 60 bp, Xenorhabdus bovienii
  Promoter location: Contig name=SeqID_16889; Position on contig =130003..130062bp; Strand=+
tgcaagataagcataaatagatgaatcgctcataaaacgctgagttttacgatcaatgag

SEQ ID NO: 13680 - DNA, 60 bp, Xenorhabdus bovienii
  Promoter location: Contig name=SeqID_16889; Position on contig =130348..130407bp; Strand=+; Gene name=DadA
tcaagtgttaacttttctcacgggtggtacaacagtatgaacaccgttaaaatctcatat

SEQ ID NO: 13681 - DNA, 60 bp, Xenorhabdus bovienii
  Promoter location: Contig name=SeqID_16889; Position on contig =133135..133194bp; Strand=-
tgataaattaattatttatttactctttttatcattagtattagtggatttgataaatgt

SEQ ID NO: 13682 - DNA, 60 bp, Xenorhabdus bovienii
  Promoter location: Contig name=SeqID_16889; Position on contig =134218..134277bp; Strand=-
agatggatattagttgaatcagtgatgatttataagaacagtaatgctaaattgttgtga

SEQ ID NO: 13683 - DNA, 60 bp, Xenorhabdus bovienii
  Promoter location: Contig name=SeqID_16889; Position on contig =136270..136329bp; Strand=+
gactgacagtaaggctggaatggtcaacaacccaccccctcctgcaatagaatcgataaa

SEQ ID NO: 13684 - DNA, 60 bp, Xenorhabdus bovienii
  Promoter location: Contig name=SeqID_16889; Position on contig =137590..137649bp; Strand=-; Gene name=HemK
caaataaaagtgccggaataagataggttttaatcattgagtgagttattgttaattaat

SEQ ID NO: 13685 - DNA, 60 bp, Xenorhabdus bovienii
  Promoter location: Contig name=SeqID_16889; Position on contig =138747..138806bp; Strand=-
gccattctatttacttttttgcgtactctttgtgtacaaactggctgtaacatagatact

SEQ ID NO: 13686 - DNA, 60 bp, Xenorhabdus bovienii
  Promoter location: Contig name=SeqID_16889; Position on contig =140294..140353bp; Strand=-; Gene name=HutH (BS)
taaataagtcgtctaaggccggtttctatccggccttatcgttgtatttatctttcatat

SEQ ID NO: 13687 - DNA, 60 bp, Xenorhabdus bovienii
  Promoter location: Contig name=SeqID_16889; Position on contig =143834..143893bp; Strand=-
gttacataaaaaaatctccctttgtttttagtatagggagattttttcacaaacaattgt

SEQ ID NO: 13688 - DNA, 60 bp, Xenorhabdus bovienii
  Promoter location: Contig name=SeqID_16889; Position on contig =143684..143743bp; Strand=+
aaaaatgtgacacagataaagtcaataatttggagggtggtgtcttttatactaaatatc

SEQ ID NO: 13689 - DNA, 60 bp, Xenorhabdus bovienii
  Promoter location: Contig name=SeqID_16889; Position on contig =146935..146994bp; Strand=-
gatattcatccgtgtccataaaatgatttgacaatcttggctggttataaaataaatgta

SEQ ID NO: 13690 - DNA, 60 bp, Xenorhabdus bovienii
  Promoter location: Contig name=SeqID_16889; Position on contig =146692..146751bp; Strand=+
ataatgtggcaatggtgagttggcacgctatccgtcggaacaatcgccaatattttttca

SEQ ID NO: 13691 - DNA, 60 bp, Xenorhabdus bovienii
  Promoter location: Contig name=SeqID_16889; Position on contig =148341..148400bp; Strand=-; Gene name=FadB
tcagatataaatcatttttagtcattttatttgtttttgttttagggcaaaatgccagtt

SEQ ID NO: 13692 - DNA, 60 bp, Xenorhabdus bovienii
  Promoter location: Contig name=SeqID_16889; Position on contig =152054..152113bp; Strand=-
taacaatgctccatcaggtctgacctcttgtgaggtgagtaaatatttttaatcaatcaa

SEQ ID NO: 13693 - DNA, 60 bp, Xenorhabdus bovienii
  Promoter location: Contig name=SeqID_16889; Position on contig =152584..152643bp; Strand=-; Gene name=FadL
tgttaacgaattgtgatggctagtttgttagcgcgatgagatcaataaataatgaaataa

SEQ ID NO: 13694 - DNA, 60 bp, Xenorhabdus bovienii
  Promoter location: Contig name=SeqID_16889; Position on contig =152617..152676bp; Strand=+; Gene name=FadL
caaactagccatcacaattcgttaacatgcgctgcctgttttttgttaagctcgtcccat

SEQ ID NO: 13695 - DNA, 60 bp, Xenorhabdus bovienii
  Promoter location: Contig name=SeqID_16889; Position on contig =155213..155272bp; Strand=-
gtacatattagtgtacttttaaagttttaatgatcttattttttctttataaaacaataa

SEQ ID NO: 13696 - DNA, 60 bp, Xenorhabdus bovienii
  Promoter location: Contig name=SeqID_16889; Position on contig =155109..155168bp; Strand=+
aaataggcaaacagaacgtcatgtcttatctcaagcaaaaaaacagttatactacgcccc

SEQ ID NO: 13697 - DNA, 60 bp, Xenorhabdus bovienii
  Promoter location: Contig name=SeqID_16889; Position on contig =156890..156949bp; Strand=-
aagcgattattagcatttatatttgcattgttggcattttgatttgctaagtttgctaga

SEQ ID NO: 13698 - DNA, 60 bp, Xenorhabdus bovienii
  Promoter location: Contig name=SeqID_16889; Position on contig =157764..157823bp; Strand=-
gaatgtccgcgccgttctgatctttagctagatggtgtcgtcataaataaattcatgtaa

SEQ ID NO: 13699 - DNA, 60 bp, Xenorhabdus bovienii
  Promoter location: Contig name=SeqID_16889; Position on contig =163499..163558bp; Strand=-
ggatggcttgaatgaaatttatgacaggcgattaattaatcaaatagtaaaaagaaaata

SEQ ID NO: 13700 - DNA, 60 bp, Xenorhabdus bovienii
  Promoter location: Contig name=SeqID_16889; Position on contig =164502..164561bp; Strand=-
tgtaaccagccttgcattatatacattgactgtcttattggtgctgctaatctgtacaca

SEQ ID NO: 13701 - DNA, 60 bp, Xenorhabdus bovienii
  Promoter location: Contig name=SeqID_16889; Position on contig =164283..164342bp; Strand=+
ttctgttgagagaaattgaatatccattatttatcttccaatgcctttataatatctgca

SEQ ID NO: 13702 - DNA, 60 bp, Xenorhabdus bovienii
  Promoter location: Contig name=SeqID_16889; Position on contig =165555..165614bp; Strand=-
atagttaaattatcacattacgttattaatgcaatcgattaactcgctataaatttgatt

SEQ ID NO: 13703 - DNA, 60 bp, Xenorhabdus bovienii
  Promoter location: Contig name=SeqID_16889; Position on contig =165336..165395bp; Strand=+
gagccatgaaatgggacgttaatagttttacttggttcattaactggtatacttaacatg

SEQ ID NO: 13704 - DNA, 60 bp, Xenorhabdus bovienii
  Promoter location: Contig name=SeqID_16889; Position on contig =166726..166785bp; Strand=-
atttatcttgagccgccacgagctttttcgtcatttttatcaccttctaatttatctcta

SEQ ID NO: 13705 - DNA, 60 bp, Xenorhabdus bovienii
  Promoter location: Contig name=SeqID_16889; Position on contig =166383..166442bp; Strand=+
tattatttgctatattcactttgtcactctctttgttagggttgacgtaatctttaattg

SEQ ID NO: 13706 - DNA, 60 bp, Xenorhabdus bovienii
  Promoter location: Contig name=SeqID_16889; Position on contig =167374..167433bp; Strand=-
caaaacgaaagaaaaaaacttttgggtttttgttttctgttttcgtttaccatctgtcat

SEQ ID NO: 13707 - DNA, 60 bp, Xenorhabdus bovienii
  Promoter location: Contig name=SeqID_16889; Position on contig =167105..167164bp; Strand=+
cttgatggtcgaaatcttgatcattgaacatctcgttagactgcactataagtattagaa

SEQ ID NO: 13708 - DNA, 60 bp, Xenorhabdus bovienii
  Promoter location: Contig name=SeqID_16889; Position on contig =167944..168003bp; Strand=-
actaacccccatcacggggcttttgtgcttattttaagcaatcaactgttatgattaccg

SEQ ID NO: 13709 - DNA, 60 bp, Xenorhabdus bovienii
  Promoter location: Contig name=SeqID_16889; Position on contig =168638..168697bp; Strand=-
atccaaactcttccgtcatacgctattgacttatacaataagagtgctattatcactcta

SEQ ID NO: 13710 - DNA, 60 bp, Xenorhabdus bovienii
  Promoter location: Contig name=SeqID_16889; Position on contig =168310..168369bp; Strand=+
tcatttaatgctctcaagactttcttttctgactcgctaaggccatctttaatacctttt

SEQ ID NO: 13711 - DNA, 60 bp, Xenorhabdus bovienii
  Promoter location: Contig name=SeqID_16889; Position on contig =171794..171853bp; Strand=-; Gene name=XerC
ggcgtcccctgcaggaatcgaacctacaactagcccttaggaggggctcgttatatccat

SEQ ID NO: 13712 - DNA, 60 bp, Xenorhabdus bovienii
  Promoter location: Contig name=SeqID_16889; Position on contig =171779..171838bp; Strand=+; Gene name=XerC
agtccccttagttaaatggatataacgagcccctcctaagggctagttgtaggttcgatt

SEQ ID NO: 13713 - DNA, 60 bp, Xenorhabdus bovienii
  Promoter location: Contig name=SeqID_16889; Position on contig =173644..173703bp; Strand=-
actaacccgctcagacaccgccttttcataaaggaaacacccccctttaacctaacccct

SEQ ID NO: 13714 - DNA, 60 bp, Xenorhabdus bovienii
  Promoter location: Contig name=SeqID_16889; Position on contig =174409..174468bp; Strand=-
gtcatattattcaataaaattaaaaattcattaagtgaattagatattacaatctgacta

SEQ ID NO: 13715 - DNA, 60 bp, Xenorhabdus bovienii
  Promoter location: Contig name=SeqID_16889; Position on contig =174994..175053bp; Strand=-
catacatcaggtgttttgttaaataaattgaaaaaaagtgcttgatacaaaatatcacct

SEQ ID NO: 13716 - DNA, 60 bp, Xenorhabdus bovienii
  Promoter location: Contig name=SeqID_16889; Position on contig =175491..175550bp; Strand=-
ttaagtctattttctggaaggatcatgaaagaatatcctatgaagtttaaaatattatag

SEQ ID NO: 13717 - DNA, 60 bp, Xenorhabdus bovienii
  Promoter location: Contig name=SeqID_16889; Position on contig =175218..175277bp; Strand=+
gagtataattaaattttttcaaggattcatctgaatttatttctttataaaatattttgc

SEQ ID NO: 13718 - DNA, 60 bp, Xenorhabdus bovienii
  Promoter location: Contig name=SeqID_16889; Position on contig =175808..175867bp; Strand=+; Gene name=PrpB
agaaatttaatttaaaattgtttttttattgatccacatattgactgtataaaaaaccag

SEQ ID NO: 13719 - DNA, 60 bp, Xenorhabdus bovienii
  Promoter location: Contig name=SeqID_16889; Position on contig =176972..177031bp; Strand=+
gataaaaataaaataaattcctcttgaaaattcacacaacttagaaacataatctgtttt

SEQ ID NO: 13720 - DNA, 60 bp, Xenorhabdus bovienii
  Promoter location: Contig name=SeqID_16889; Position on contig =177494..177553bp; Strand=+
ctaattcatttttccattacctgtcataacttataatgacaaataaaatagatcatttaa

SEQ ID NO: 13721 - DNA, 60 bp, Xenorhabdus bovienii
  unsure (1)..(60): unsure at all n locations
  Promoter location: Contig name=SeqID_16890; Position on contig =53..112bp; Strand=+
cagggatcancatcngtacgttcaatacaagccgatacccgcccagtcatgatgagttta

SEQ ID NO: 13722 - DNA, 60 bp, Xenorhabdus bovienii; identical to SEQ ID NO: 12261
  unsure (1)..(60): unsure at all n locations
  Promoter location: Contig name=SeqID_16891; Position on contig =889..948bp; Strand=-

SEQ ID NO: 13723 - DNA, 60 bp, Xenorhabdus bovienii
  Promoter location: Contig name=SeqID_16892; Position on contig =269..328bp; Strand=+
gttacacctgattcgccgttttgttttccgacatgcactttgttttttttaatggcatga

SEQ ID NO: 13724 - DNA, 60 bp, Xenorhabdus bovienii
  Promoter location: Contig name=SeqID_16892; Position on contig =1189..1248bp; Strand=+
gtgatttattattttttcaaataaaaacaatatgataattatttttttatgataggatca

SEQ ID NO: 13725 - DNA, 60 bp, Xenorhabdus bovienii
  Promoter location: Contig name=SeqID_16892; Position on contig =7607..7666bp; Strand=-
aagcagtagcttatttttatttggtcaagtaattgtatttgccatgccataattttctct

SEQ ID NO: 13726 - DNA, 60 bp, Xenorhabdus bovienii
  Promoter location: Contig name=SeqID_16892; Position on contig =10089..10148bp; Strand=-
cattaagggacacagcctaatactacagccgtaatccatcatgtgccatgatagggctct

SEQ ID NO: 13727 - DNA, 60 bp, Xenorhabdus bovienii
  Promoter location: Contig name=SeqID_16892; Position on contig =10120..10179bp; Strand=+
gctgtagtattaggctgtgtcccttaatgtaaattgatagtgttctcatctaaactgttt

SEQ ID NO: 13728 - DNA, 60 bp, Xenorhabdus bovienii
  Promoter location: Contig name=SeqID_16892; Position on contig =12246..12305bp; Strand=+
ttctggctctgttttaatgccgccttatcgtcacgggcaggcacttgtaagaacgcctgt

SEQ ID NO: 13729 - DNA, 60 bp, Xenorhabdus bovienii
  Promoter location: Contig name=SeqID_16892; Position on contig =13169..13228bp; Strand=+
ttcttttagttttttaagttaatcaatgaaattatctgcacttttgttatagtcggtaat

SEQ ID NO: 13730 - DNA, 60 bp, Xenorhabdus bovienii
  Promoter location: Contig name=SeqID_16892; Position on contig =14745..14804bp; Strand=-
tggttgtaggtataagtttaaggtacttgcatttaatttcaattttttattattatatat

SEQ ID NO: 13731 - DNA, 60 bp, Xenorhabdus bovienii
  Promoter location: Contig name=SeqID_16892; Position on contig =15217..15276bp; Strand=-
cgctaatgtgaaaagtaagcgagcgtgtgtttcagcccacttgaagttaagataaaaccg

SEQ ID NO: 13732 - DNA, 60 bp, Xenorhabdus bovienii
  Promoter location: Contig name=SeqID_16892; Position on contig =15593..15652bp; Strand=+
aggctcatgcctgcttaacagcgcagtgaatctgacactgcatttcatagattaaaaaag

SEQ ID NO: 13733 - DNA, 60 bp, Xenorhabdus bovienii
  Promoter location: Contig name=SeqID_16892; Position on contig =17378..17437bp; Strand=-; Gene name=Nlp
tatcaaaatatcgactaggccagatttctgaagggtgtattcctaggtaatctgcaataa

SEQ ID NO: 13734 - DNA, 60 bp, Xenorhabdus bovienii
  Promoter location: Contig name=SeqID_16892; Position on contig =16965..17024bp; Strand=+; Gene name=Nlp
tgattggggttagtgattcagttattgagtcagataaaccaatcagttaaagtaaccgct

SEQ ID NO: 13735 - DNA, 60 bp, Xenorhabdus bovienii
  Promoter location: Contig name=SeqID_16892; Position on contig =17658..17717bp; Strand=-; Gene name=Fis
cttagatcatgttgttataaaagcactttttcttttaggggaagtgcttttttttgtttc

SEQ ID NO: 13736 - DNA, 60 bp, Xenorhabdus bovienii
  Promoter location: Contig name=SeqID_16892; Position on contig =19109..19168bp; Strand=-; Gene name=PrmA
ttgatgttatttaaaagtaattgactaatttttaaaaaatcaactggaaaaattctgtta

SEQ ID NO: 13737 - DNA, 60 bp, Xenorhabdus bovienii
  Promoter location: Contig name=SeqID_16892; Position on contig =21727..21786bp; Strand=-
ttgccatactggttcgaattggcctgcctgctactgccagccctgtttatcatcctctgt

SEQ ID NO: 13738 - DNA, 60 bp, Xenorhabdus bovienii
  Promoter location: Contig name=SeqID_16892; Position on contig =21336..21395bp; Strand=+
cagcatgtcattcagggtgacagcgttgtagcgacgggcgaggatggcaaattttttccc

SEQ ID NO: 13739 - DNA, 60 bp, Xenorhabdus bovienii
  Promoter location: Contig name=SeqID_16892; Position on contig =24683..24742bp; Strand=-; Gene name=Qor
tacaaataatgataacagaaaaagatgacaaaccgttaacatcgagttatcttggtcgat

SEQ ID NO: 13740 - DNA, 60 bp, Xenorhabdus bovienii
  Promoter location: Contig name=SeqID_16892; Position on contig =25930..25989bp; Strand=-
atcaataatgttattttccttattgttaccctgtgcatttgatcttttacactgtcatct

SEQ ID NO: 13741 - DNA, 60 bp, Xenorhabdus bovienii
  Promoter location: Contig name=SeqID_16892; Position on contig =26334..26393bp; Strand=+; Gene name=MreB
agtaaaagtagttagtgatgcgccttgtcgctgcttcatgtggttggtagagtagacgga

SEQ ID NO: 13742 - DNA, 60 bp, Xenorhabdus bovienii
  Promoter location: Contig name=SeqID_16892; Position on contig =38414..38473bp; Strand=-
taaataaacgcaaaaatataaaatatatttaatgatatttatttttaaaataaaagatta

SEQ ID NO: 13743 - DNA, 60 bp, Xenorhabdus bovienii
  Promoter location: Contig name=SeqID_16892; Position on contig =39394..39453bp; Strand=-; Gene name=TldD
gagagcgtgggagaccgcatcttccaattgcttgcgctgttccgcgatatattgattagt

SEQ ID NO: 13744 - DNA, 60 bp, Xenorhabdus bovienii
  Promoter location: Contig name=SeqID_16892; Position on contig =39134..39193bp; Strand=+; Gene name=TldD
tcttcctcttctgcaggataattgtcaagccaatcttcaggctgctttaccataatcgtt

SEQ ID NO: 13745 - DNA, 60 bp, Xenorhabdus bovienii
  Promoter location: Contig name=SeqID_16892; Position on contig =41266..41325bp; Strand=-
aaaacagttcgtgatcatgatctctttattttcacgtcagaacagcctaatatcaatttt

SEQ ID NO: 13746 - DNA, 60 bp, Xenorhabdus bovienii
  Promoter location: Contig name=SeqID_16892; Position on contig =42740..42799bp; Strand=-; Gene name=FruB
tataaatttagcttataatattgcttatttacaaatagtattcctattacaatcaaagtt

SEQ ID NO: 13747 - DNA, 60 bp, Xenorhabdus bovienii
  Promoter location: Contig name=SeqID_16892; Position on contig =44823..44882bp; Strand=-
actcatcactgttctacttacatacccaatagatttcagatgaaaggtataaacagtgca

SEQ ID NO: 13748 - DNA, 60 bp, Xenorhabdus bovienii
  Promoter location: Contig name=SeqID_16892; Position on contig =49170..49229bp; Strand=-; Gene name=GutQ
acagagaaagatgaagggttagagtatgtataaagcacaggcaatggtataagcagctgt

SEQ ID NO: 13749 - DNA, 60 bp, Xenorhabdus bovienii
  Promoter location: Contig name=SeqID_16892; Position on contig =51300..51359bp; Strand=-
tgcgttagcaaagttatgacaaattttactttttaccgcttgaccgtcagaatatataag

SEQ ID NO: 13750 - DNA, 60 bp, Xenorhabdus bovienii
  Promoter location: Contig name=SeqID_16892; Position on contig =51185..51244bp; Strand=+
ccggtaatgagcagggcaatagtcagaaacatggggtgttccttaaataaaatttattcc

SEQ ID NO: 13751 - DNA, 60 bp, Xenorhabdus bovienii
  Promoter location: Contig name=SeqID_16892; Position on contig =54567..54626bp; Strand=+; Gene name=BolA
ttttcccataatcatcgcccttgtaagtcaccctcttacaagggcgtttttcttggttta

SEQ ID NO: 13752 - DNA, 60 bp, Xenorhabdus bovienii
  Promoter location: Contig name=SeqID_16892; Position on contig =57466..57525bp; Strand=-; Gene name=DegQ
gtattactgacagacacagcataagctgtgtctgttcgcttctatgctatgcttctttca

SEQ ID NO: 13753 - DNA, 60 bp, Xenorhabdus bovienii
  Promoter location: Contig name=SeqID_16892; Position on contig =59142..59201bp; Strand=-
ttgataccacggctcattggctttcttgacattaaagagttttgttttttaattttaatt

SEQ ID NO: 13754 - DNA, 60 bp, Xenorhabdus bovienii
  Promoter location: Contig name=SeqID_16892; Position on contig =58925..58984bp; Strand=+
tttcttttcattgaatacgttctcttaatacctaagccagaaagggaaatcgtacttaaa

SEQ ID NO: 13755 - DNA, 60 bp, Xenorhabdus bovienii
  Promoter location: Contig name=SeqID_16892; Position on contig =59844..59903bp; Strand=-
tcattgtactggtaaaaatcgcgctaatcttttctgtttgagttcgttatatttgttcca

SEQ ID NO: 13756 - DNA, 60 bp, Xenorhabdus bovienii
  Promoter location: Contig name=SeqID_16892; Position on contig =59702..59761bp; Strand=+
accgctaattaagtcagagtggaatattgattattaattaatttatacaccacttgatgt

SEQ ID NO: 13757 - DNA, 60 bp, Xenorhabdus bovienii
  Promoter location: Contig name=SeqID_16892; Position on contig =61458..61517bp; Strand=-; Gene name=RplM
ttcggcgttaacaataatgatgtaatcaccagtatcaacgtgcggagtatattccgcttt

SEQ ID NO: 13758 - DNA, 60 bp, Xenorhabdus bovienii
  Promoter location: Contig name=SeqID_16892; Position on contig =61117..61176bp; Strand=+; Gene name=RplM
gcaggataattattgaattgggggtcgattttttatgatgacttctctataatcttgcga

SEQ ID NO: 13759 - DNA, 60 bp, Xenorhabdus bovienii
  Promoter location: Contig name=SeqID_16892; Position on contig =62757..62816bp; Strand=-; Gene name=Gst
tatacaggcatgagtggtggatgtggaaaacgctcatccagatattccataatgatgcga

SEQ ID NO: 13760 - DNA, 60 bp, Xenorhabdus bovienii
  Promoter location: Contig name=SeqID_16892; Position on contig =62327..62386bp; Strand=+; Gene name=Gst
catcattaattctcaatgtacttccccacaaaatgtgcaaaatctggtagactagtgata

SEQ ID NO: 13761 - DNA, 60 bp, Xenorhabdus bovienii
  Promoter location: Contig name=SeqID_16892; Position on contig =64484..64543bp; Strand=-; Gene name=GltD
ttagaaacgagttcacttttatctcttctttactcccatattagttgtatttttttgctt

SEQ ID NO: 13762 - DNA, 60 bp, Xenorhabdus bovienii
  Promoter location: Contig name=SeqID_16892; Position on contig =70546..70605bp; Strand=-
taaagcaagtggtgtttagctgagggcgcaaatcagacgcctgtagcaataatatatacc

SEQ ID NO: 13763 - DNA, 60 bp, Xenorhabdus bovienii
  Promoter location: Contig name=SeqID_16892; Position on contig =70434..70493bp; Strand=+
atatgcgcaattaatccaaagccacagttatctttttcctgcaatttatcatacaacatg

SEQ ID NO: 13764 - DNA, 60 bp, Xenorhabdus bovienii
  Promoter location: Contig name=SeqID_16892; Position on contig =70971..71030bp; Strand=+; Gene name=BaeS
ttgactgagaataaataattgattgctttttgttctaaaataatttttaaaataaatatc

SEQ ID NO: 13765 - DNA, 60 bp, Xenorhabdus bovienii
  Promoter location: Contig name=SeqID_16892; Position on contig =73505..73564bp; Strand=+; Gene name=ElbB
gcgcgaatactgcgccaacaccagggaaacttgtctacccgcttatctaaaatttatttt

SEQ ID NO: 13766 - DNA, 60 bp, Xenorhabdus bovienii
  Promoter location: Contig name=SeqID_16892; Position on contig =76838..76897bp; Strand=-; Gene name=LppC
attgcattatgacgcgccccaacgtcactggcttgttagccaatcaatataatattttcg

SEQ ID NO: 13767 - DNA, 60 bp, Xenorhabdus bovienii
  Promoter location: Contig name=SeqID_16892; Position on contig =78985..79044bp; Strand=-
accttgctctaatttcgcaagtatttgatctgctttctgctgttcattatgatcatgaag

SEQ ID NO: 13768 - DNA, 60 bp, Xenorhabdus bovienii
  Promoter location: Contig name=SeqID_16892; Position on contig =78680..78739bp; Strand=+
gctgtgcagactaaaccagttttgaaacgcacaaaaattgagggaagcatactgtatcca

SEQ ID NO: 13769 - DNA, 60 bp, Xenorhabdus bovienii
  Promoter location: Contig name=SeqID_16892; Position on contig =80990..81049bp; Strand=-; Gene name=LysR
ctttttctcaatcagtaattttgaatatagtaaccagattaactggctaacatttcaacg

SEQ ID NO: 13770 - DNA, 60 bp, Xenorhabdus bovienii
  Promoter location: Contig name=SeqID_16892; Position on contig =80971..81030bp; Strand=+; Gene name=LysR
ttgatcttaattatctggacgttgaaatgttagccagttaatctggttactatattcaaa

SEQ ID NO: 13771 - DNA, 60 bp, Xenorhabdus bovienii
  Promoter location: Contig name=SeqID_16892; Position on contig =82568..82627bp; Strand=-
ttttacgtatgttaagtaattccttcaaaaaaactgcaataaattgttaatattccttac

SEQ ID NO: 13772 - DNA, 60 bp, Xenorhabdus bovienii; identical to SEQ ID NO: 12949
  Promoter location: Contig name=SeqID_16892; Position on contig =83166..83225bp; Strand=-

SEQ ID NO: 13773 - DNA, 60 bp, Xenorhabdus bovienii
  Promoter location: Contig name=SeqID_16892; Position on contig =82939..82998bp; Strand=+
gaaataattagtatttttaaggatgcattagatggtgtcgtcataaataaattcatgtaa

SEQ ID NO: 13774 - DNA, 60 bp, Xenorhabdus bovienii
  Promoter location: Contig name=SeqID_16892; Position on contig =84672..84731bp; Strand=-
ccagatagagaaactatccaaatttcactggcgaggttaaaaggtgttaaaaataaacgc

SEQ ID NO: 13775 - DNA, 60 bp, Xenorhabdus bovienii
  Promoter location: Contig name=SeqID_16892; Position on contig =85122..85181bp; Strand=-; Gene name=AdhC
acaggcaccataagtaagaaccacatgatcgcccacttttaatgtcttaacctgagggcc

SEQ ID NO: 13776 - DNA, 60 bp, Xenorhabdus bovienii
  Promoter location: Contig name=SeqID_16892; Position on contig =87320..87379bp; Strand=-
tatcaggaagagcaggatgatttttgacatccgtactttaaactctttataaaagcgact

SEQ ID NO: 13777 - DNA, 60 bp, Xenorhabdus bovienii
  Promoter location: Contig name=SeqID_16892; Position on contig =88241..88300bp; Strand=-
attttcaaagtacccaacagaaatgcaccagaaatgcaccataaaagtaagatgtaatcc

SEQ ID NO: 13778 - DNA, 60 bp, Xenorhabdus bovienii
  Promoter location: Contig name=SeqID_16892; Position on contig =88040..88099bp; Strand=+
acgccaactaatatcaacaggctatcgcccggtaaaaaagccgcaggcaatatcccattt

SEQ ID NO: 13779 - DNA, 60 bp, Xenorhabdus bovienii
  Promoter location: Contig name=SeqID_16892; Position on contig =88648..88707bp; Strand=-
gtgaagcataataaaaaaacagtaattactctttttattcaataaattatattgaatcat

SEQ ID NO: 13780 - DNA, 60 bp, Xenorhabdus bovienii
  Promoter location: Contig name=SeqID_16892; Position on contig =88472..88531bp; Strand=+
attaattattgggtgaagttttcccaaaacagcatgatttaactatttatcatgtggact

SEQ ID NO: 13781 - DNA, 60 bp, Xenorhabdus bovienii
  Promoter location: Contig name=SeqID_16892; Position on contig =92382..92441bp; Strand=-; Gene name=RimL
taaattccagaatttgaagaacggtttccactggcacatcatttcttgatacttgtcaca

SEQ ID NO: 13782 - DNA, 60 bp, Xenorhabdus bovienii
  Promoter location: Contig name=SeqID_16892; Position on contig =92243..92302bp; Strand=+; Gene name=RimL
ggtaattgctcattgcattctccaacaaatatttggtgacttaaaagtattattgttttc

SEQ ID NO: 13783 - DNA, 60 bp, Xenorhabdus bovienii
  Promoter location: Contig name=SeqID_16892; Position on contig =93934..93993bp; Strand=-; Gene name=WecD
aattttacttaaatatattaacaattacatcttatttataaaaaatataaaataaataat

SEQ ID NO: 13784 - DNA, 60 bp, Xenorhabdus bovienii
  Promoter location: Contig name=SeqID_16892; Position on contig =94615..94674bp; Strand=-
cgcactctgcggcgttttttttacacatgggttcctattactttctgttaaatcgattgt

SEQ ID NO: 13785 - DNA, 60 bp, Xenorhabdus bovienii
  Promoter location: Contig name=SeqID_16892; Position on contig =94339..94398bp; Strand=+
acaaatccttcgatgatatgttggtcatttacagccttatagatgattaaattgggtaag

SEQ ID NO: 13786 - DNA, 60 bp, Xenorhabdus bovienii
  Promoter location: Contig name=SeqID_16892; Position on contig =96824..96883bp; Strand=-
accaagatatatcccaatccctggcatatatcgttaccgccattcagcaaaatcttgatg

SEQ ID NO: 13787 - DNA, 60 bp, Xenorhabdus bovienii
  Promoter location: Contig name=SeqID_16892; Position on contig =96641..96700bp; Strand=+
tggcataactcgtatcgatgctgaaacttgccatcgataaaggaattaaactcattaagt

SEQ ID NO: 13788 - DNA, 60 bp, Xenorhabdus bovienii
  Promoter location: Contig name=SeqID_16892; Position on contig =111801..111860bp; Strand=-
cccctgaatttaaccctcatgatcgataggctttaactctatttcattagagtttcactg

SEQ ID NO: 13789 - DNA, 60 bp, Xenorhabdus bovienii
  Promoter location: Contig name=SeqID_16892; Position on contig =112266..112325bp; Strand=-
gcgcgaaacgcatacattaacaagttttatgcacttatctaaccagagaaaatccatgaa

SEQ ID NO: 13790 - DNA, 60 bp, Xenorhabdus bovienii
  Promoter location: Contig name=SeqID_16892; Position on contig =111822..111881bp; Strand=+
gagttaaagcctatcgatcatgagggttaaattcaggggataggctgtaaaataagtgtt

SEQ ID NO: 13791 - DNA, 60 bp, Xenorhabdus bovienii
  Promoter location: Contig name=SeqID_16892; Position on contig =112341..112400bp; Strand=+
aattattaccatactgccacacctactgtttttttcataaaaatgattatgtttaactcg

SEQ ID NO: 13792 - DNA, 60 bp, Xenorhabdus bovienii
  Promoter location: Contig name=SeqID_16892; Position on contig =114602..114661bp; Strand=-
atcaataatgtgcagtcattcacagtgacgacgggtacagtaggtcgcatgatgagcatg

SEQ ID NO: 13793 - DNA, 60 bp, Xenorhabdus bovienii
  Promoter location: Contig name=SeqID_16892; Position on contig =114210..114269bp; Strand=+
aagaggaagggaatttatcatcgaatgtctcctatcaattcggatgtcatactgagatgg

SEQ ID NO: 13794 - DNA, 60 bp, Xenorhabdus bovienii
  Promoter location: Contig name=SeqID_16892; Position on contig =121819..121878bp; Strand=-
cgtcttcataaagtaaaagcttcaaatatcaacatttgcgacatagataacataattagt

SEQ ID NO: 13795 - DNA, 60 bp, Xenorhabdus bovienii
  Promoter location: Contig name=SeqID_16892; Position on contig =124414..124473bp; Strand=-
gattattagttaatttactagagcacgaaatgtatgccgcttaagggtacactcaggcac

SEQ ID NO: 13796 - DNA, 60 bp, Xenorhabdus bovienii
  Promoter location: Contig name=SeqID_16892; Position on contig =124802..124861bp; Strand=-
aatcctgctggatctgttttgtaaacgttctcagattaatataacggtatagttccgtta

SEQ ID NO: 13797 - DNA, 60 bp, Xenorhabdus bovienii
  Promoter location: Contig name=SeqID_16892; Position on contig =124420..124479bp; Strand=+
gagtgtacccttaagcggcatacatttcgtgctctagtaaattaactaataatcactata

SEQ ID NO: 13798 - DNA, 60 bp, Xenorhabdus bovienii; identical to SEQ ID NO: 13581
  Promoter location: Contig name=SeqID_16892; Position on contig =125949..126008bp; Strand=+

SEQ ID NO: 13799 - DNA, 60 bp, Xenorhabdus bovienii
  Promoter location: Contig name=SeqID_16892; Position on contig =126999..127058bp; Strand=+
gccttcatggaaatcacttcattacaacagcaaaaacctgggagggtaaaaatgggtgta

SEQ ID NO: 13800 - DNA, 60 bp, Xenorhabdus bovienii
  Promoter location: Contig name=SeqID_16892; Position on contig =128319..128378bp; Strand=-
ggtgttattttggctgaaaaacccatatctataacacccggtatgtttattatttcatta

SEQ ID NO: 13801 - DNA, 60 bp, Xenorhabdus bovienii
  Promoter location: Contig name=SeqID_16892; Position on contig =128145..128204bp; Strand=+
aaattattttttaaaacatacatttggagggttggtttttaaaccaataaaataaaaatg

SEQ ID NO: 13802 - DNA, 60 bp, Xenorhabdus bovienii
  Promoter location: Contig name=SeqID_16892; Position on contig =129710..129769bp; Strand=+
cgatttacatcgccatttctatacttgtatgctgttctcaacagaatcataattctttct

SEQ ID NO: 13803 - DNA, 60 bp, Xenorhabdus bovienii
  Promoter location: Contig name=SeqID_16892; Position on contig =131934..131993bp; Strand=+
ccctgctccttttctaaaacactagctttgtattgaacatcgaggcgaacaatagacggt

SEQ ID NO: 13804 - DNA, 60 bp, Xenorhabdus bovienii; identical to SEQ ID NO: 12949
  Promoter location: Contig name=SeqID_16892; Position on contig =132877..132936bp; Strand=-

SEQ ID NO: 13805 - DNA, 60 bp, Xenorhabdus bovienii
  Promoter location: Contig name=SeqID_16892; Position on contig =132577..132636bp; Strand=+
attaacgtcctcgcagcaactatttaaaacaccaatacaacggtttttattatttttaat

SEQ ID NO: 13806 - DNA, 60 bp, Xenorhabdus bovienii
  Promoter location: Contig name=SeqID_16892; Position on contig =137467..137526bp; Strand=-
taagcgtttatactgattcgcttattgagtccgataaaccaatcagttaaagtagccccg

SEQ ID NO: 13807 - DNA, 60 bp, Xenorhabdus bovienii
  Promoter location: Contig name=SeqID_16892; Position on contig =138242..138301bp; Strand=-
acatggtaaaatagtaatatttttttattaccacgtcaacgcatttgtaatattttttta

SEQ ID NO: 13808 - DNA, 60 bp, Xenorhabdus bovienii
  Promoter location: Contig name=SeqID_16892; Position on contig =137686..137745bp; Strand=+
ccacccagccctccggcgttttgctgcatgactgtctttcatcctggtatgctgtttaat

SEQ ID NO: 13809 - DNA, 60 bp, Xenorhabdus bovienii
  Promoter location: Contig name=SeqID_16892; Position on contig =138239..138298bp; Strand=+
taataaaaaaatattacaaatgcgttgacgtggtaataaaaaaatattactattttacca

SEQ ID NO: 13810 - DNA, 60 bp, Xenorhabdus bovienii
  Promoter location: Contig name=SeqID_16892; Position on contig =139165..139224bp; Strand=+
acaccgcacccgcctgcacgttttggatcaaaaaattatttcagttttaaaattcgacaa

SEQ ID NO: 13811 - DNA, 60 bp, Xenorhabdus bovienii
  Promoter location: Contig name=SeqID_16892; Position on contig =140366..140425bp; Strand=-
aaatcagtgcattaagccactttttaacaagtggcttttttgttttctatagtcagtgtc

SEQ ID NO: 13812 - DNA, 60 bp, Xenorhabdus bovienii
  Promoter location: Contig name=SeqID_16892; Position on contig =140771..140830bp; Strand=-
aaaatagccgctgacaaatgatgtttgttcatattaattcacagaaatatttttatagaa

SEQ ID NO: 13813 - DNA, 60 bp, Xenorhabdus bovienii
  Promoter location: Contig name=SeqID_16892; Position on contig =140672..140731bp; Strand=+
taaattattctgattacttatcgtactttgtcgtactctaacagagttagattggcactt

SEQ ID NO: 13814 - DNA, 60 bp, Xenorhabdus bovienii
  Promoter location: Contig name=SeqID_16892; Position on contig =143649..143708bp; Strand=-
atatggcaattggtgattattgcaatatagcctgatgaaataggttctaaaccaaaattt

SEQ ID NO: 13815 - DNA, 60 bp, Xenorhabdus bovienii
  Promoter location: Contig name=SeqID_16892; Position on contig =143376..143435bp; Strand=+
cgacgatatcttccggcagatggtcattgacctcagcataggtcagatagccttgctcct

SEQ ID NO: 13816 - DNA, 60 bp, Xenorhabdus bovienii
  Promoter location: Contig name=SeqID_16892; Position on contig =145511..145570bp; Strand=-; Gene name=RpsU
aaactactgcagttaaaggccgtgctttccccaaaggaagcgcggcttattctcgttcat

SEQ ID NO: 13817 - DNA, 60 bp, Xenorhabdus bovienii
  Promoter location: Contig name=SeqID_16892; Position on contig =146041..146100bp; Strand=-
atcacaactgtctccatttacatgctgactattttttctgtttagtctataatcagcacc

SEQ ID NO: 13818 - DNA, 60 bp, Xenorhabdus bovienii
  Promoter location: Contig name=SeqID_16892; Position on contig =148620..148679bp; Strand=-
gatttattcaaaacaacctcttttattaataagaaacaatattttttaataatataaaaa

SEQ ID NO: 13819 - DNA, 60 bp, Xenorhabdus bovienii
  Promoter location: Contig name=SeqID_16892; Position on contig =148560..148619bp; Strand=+
ttttatttaatataaaaataataaatgtaatcatatccactaattaagtataattaaatg

SEQ ID NO: 13820 - DNA, 60 bp, Xenorhabdus bovienii
  Promoter location: Contig name=SeqID_16892; Position on contig =149637..149696bp; Strand=-; Gene name=FolB
gcacgtttgttgtcccatcccatttcgatatcgaacaccagtttctgtttaattgtctgt

SEQ ID NO: 13821 - DNA, 60 bp, Xenorhabdus bovienii
  Promoter location: Contig name=SeqID_16892; Position on contig =149465..149524bp; Strand=+; Gene name=FolB
taagatatctccaatgaataagggtcgttttcttaactctaacaatggataatacgcaca

SEQ ID NO: 13822 - DNA, 60 bp, Xenorhabdus bovienii
  Promoter location: Contig name=SeqID_16892; Position on contig =151911..151970bp; Strand=-
agagttctcattctggtttactgattgcacctgcaaacttaactctttactatccgttta

SEQ ID NO: 13823 - DNA, 60 bp, Xenorhabdus bovienii
  Promoter location: Contig name=SeqID_16892; Position on contig =152008..152067bp; Strand=+
ttgcgaagtgagcataatcattgttgagataaccccctattgtggtttattttttctctt

SEQ ID NO: 13824 - DNA, 60 bp, Xenorhabdus bovienii
  Promoter location: Contig name=SeqID_16892; Position on contig =156022..156081bp; Strand=+; Gene name=RfaE
actgagcttttcctgctggatcttgctggcattcagtaaggttatggtaatatccgcaac

SEQ ID NO: 13825 - DNA, 60 bp, Xenorhabdus bovienii
  Promoter location: Contig name=SeqID_16892; Position on contig =158473..158532bp; Strand=-; Gene name=RibB
gcagcgaaaatcatgtcaccttcattttcacgattttcgtcatccagtaccatcactccg

SEQ ID NO: 13826 - DNA, 60 bp, Xenorhabdus bovienii
  Promoter location: Contig name=SeqID_16892; Position on contig =158314..158373bp; Strand=+; Gene name=RibB
gccgtatttttttgcagcattaactcctcaaaattgccctgattctggtaacccataaat

SEQ ID NO: 13827 - DNA, 60 bp, Xenorhabdus bovienii
  Promoter location: Contig name=SeqID_16892; Position on contig =159239..159298bp; Strand=+
gtaatcttgccataatatttttgtcattattgacaatcgacgtaatctagaatgtttaat

SEQ ID NO: 13828 - DNA, 60 bp, Xenorhabdus bovienii
  Promoter location: Contig name=SeqID_16892; Position on contig =162091..162150bp; Strand=-; Gene name=TolC
ttaatgctctaccgttcctgattaaaaaacgttatattaaaaacgctatactataaagaa

SEQ ID NO: 13829 - DNA, 60 bp, Xenorhabdus bovienii
  Promoter location: Contig name=SeqID_16892; Position on contig =163679..163738bp; Strand=-; Gene name=MutT
ctcataaagtctcctaattatttttttaattgcctattattaaaatgtatttttccacat

SEQ ID NO: 13830 - DNA, 60 bp, Xenorhabdus bovienii
  Promoter location: Contig name=SeqID_16892; Position on contig =163651..163710bp; Strand=+; Gene name=MutT
tatcatcaaagcgaatttatttagatcaatgtggaaaaatacattttaataataggcaat

SEQ ID NO: 13831 - DNA, 60 bp, Xenorhabdus bovienii
  Promoter location: Contig name=SeqID_16892; Position on contig =164389..164448bp; Strand=+; Gene name=Icc
aacgggaagtgtgtcccagtcagcagatcttttttgtaaagaaacgctagaataattctt

SEQ ID NO: 13832 - DNA, 60 bp, Xenorhabdus bovienii
  Promoter location: Contig name=SeqID_16892; Position on contig =170194..170253bp; Strand=+; Gene name=PlsC
ggcagtaacaaaacgatttttgttacacaacaatcacaatagcaggccagatttattctg

SEQ ID NO: 13833 - DNA, 60 bp, Xenorhabdus bovienii
  Promoter location: Contig name=SeqID_16892; Position on contig =171190..171249bp; Strand=+; Gene name=SufI
ttgggtaattcatcccaataattatttgaattgtgaagtgcttgcgttcatataagcaat

SEQ ID NO: 13834 - DNA, 60 bp, Xenorhabdus bovienii
  Promoter location: Contig name=SeqID_16892; Position on contig =172870..172929bp; Strand=+; Gene name=FolA
gttctgaataaattgctaatcttatcgactgagagtagccctttccgtatagtgtccaaa

SEQ ID NO: 13835 - DNA, 60 bp, Xenorhabdus bovienii
  Promoter location: Contig name=SeqID_16892; Position on contig =177620..177679bp; Strand=+
gggatagtgatctgcatctgttttgccatttgcaaaatgatgtcatccataatcaaacgc

SEQ ID NO: 13836 - DNA, 60 bp, Xenorhabdus bovienii
  Promoter location: Contig name=SeqID_16893; Position on contig =2339..2398bp; Strand=+
tgtgttaggtgtttagttctaatatttgatggattaggatttatctctaaaatagccttt

SEQ ID NO: 13837 - DNA, 60 bp, Xenorhabdus bovienii
  Promoter location: Contig name=SeqID_16893; Position on contig =3300..3359bp; Strand=-
aaattaacagccggacataaataacatttaagcatttttatgagtgtaatactcataaaa

SEQ ID NO: 13838 - DNA, 60 bp, Xenorhabdus bovienii
  Promoter location: Contig name=SeqID_16893; Position on contig =3159..3218bp; Strand=+
cgctgtttttctgtctgttttgacaaaacatattcctccaaaagatcggatataaaaaat

SEQ ID NO: 13839 - DNA, 60 bp, Xenorhabdus bovienii
  Promoter location: Contig name=SeqID_16893; Position on contig =7630..7689bp; Strand=-
aggctgagaatttctgctgatacatcactgttgcacgaattttttagatagactaatcta

SEQ ID NO: 13840 - DNA, 60 bp, Xenorhabdus bovienii
  Promoter location: Contig name=SeqID_16893; Position on contig =7733..7792bp; Strand=+
gtgtacattttcatagcggcaaagctgtcggttctgtcgcattaacgtaatatcaggtaa

SEQ ID NO: 13841 - DNA, 60 bp, Xenorhabdus bovienii
  Promoter location: Contig name=SeqID_16893; Position on contig =9359..9418bp; Strand=-; Gene name=SunT (BS)
tatcacgatagaaaattcattgaagacatgagacttgtttcagcttaaaattaatttcgt

SEQ ID NO: 13842 - DNA, 60 bp, Xenorhabdus bovienii
  Promoter location: Contig name=SeqID_16893; Position on contig =15224..15283bp; Strand=-
caaataatttatcgactgcgtgaataaaaatatatctatttactttttaaaatcaacata

SEQ ID NO: 13843 - DNA, 60 bp, Xenorhabdus bovienii
  Promoter location: Contig name=SeqID_16893; Position on contig =14638..14697bp; Strand=+
aattcgggaataaaccagcggatattaaattggttacttttttgttttatttttatccag

SEQ ID NO: 13844 - DNA, 60 bp, Xenorhabdus bovienii
  Promoter location: Contig name=SeqID_16893; Position on contig =15203..15262bp; Strand=+
aaacagacatttttatttttatatgttgattttaaaaagtaaatagatatatttttattc

SEQ ID NO: 13845 - DNA, 60 bp, Xenorhabdus bovienii
  Promoter location: Contig name=SeqID_16893; Position on contig =15437..15496bp; Strand=+
taaataaaaccataacgacatagggttttaatcatttaatttaatataattgtaacatta

SEQ ID NO: 13846 - DNA, 60 bp, Xenorhabdus bovienii
  Promoter location: Contig name=SeqID_16893; Position on contig =31083..31142bp; Strand=-
tttggctaatgaaaataaaagattcttcctataagcctattgcagagcattatgtgaatc

SEQ ID NO: 13847 - DNA, 60 bp, Xenorhabdus bovienii
  Promoter location: Contig name=SeqID_16893; Position on contig =32346..32405bp; Strand=-
aattttatataaaaataaatatctcactagaatatatcaaacattgatatcatttcataa

SEQ ID NO: 13848 - DNA, 60 bp, Xenorhabdus bovienii
  Promoter location: Contig name=SeqID_16893; Position on contig =33497..33556bp; Strand=-
tttattataaatcagtaacaatatatttaaaaacataaatttaatcttaatataacaata

SEQ ID NO: 13849 - DNA, 60 bp, Xenorhabdus bovienii
  Promoter location: Contig name=SeqID_16893; Position on contig =33579..33638bp; Strand=+
tgcaataataataaaaaacaatatcatgatatgaataatatgataattatcatataaaaa

SEQ ID NO: 13850 - DNA, 60 bp, Xenorhabdus bovienii
  Promoter location: Contig name=SeqID_16893; Position on contig =33807..33866bp; Strand=+
tctataaaaatataaagtgattattttatttgttactgttttttaattaaactaaataat

SEQ ID NO: 13851 - DNA, 60 bp, Xenorhabdus bovienii
  Promoter location: Contig name=SeqID_16893; Position on contig =35149..35208bp; Strand=-; Gene name=SeqA
ctatccagtactgttcttaatgaaaaaattattctgagattataagatataatacagcaa

SEQ ID NO: 13852 - DNA, 60 bp, Xenorhabdus bovienii
  Promoter location: Contig name=SeqID_16893; Position on contig =35118..35177bp; Strand=+; Gene name=SeqA
tttaagttattgaaagtttaattgttttgttttgctgtattatatcttataatctcagaa

SEQ ID NO: 13853 - DNA, 60 bp, Xenorhabdus bovienii
  Promoter location: Contig name=SeqID_16893; Position on contig =37803..37862bp; Strand=-
aaacaaatatccagtttattcttactgacatctattccgacataatacataataaccctc

SEQ ID NO: 13854 - DNA, 60 bp, Xenorhabdus bovienii
  Promoter location: Contig name=SeqID_16893; Position on contig =39288..39347bp; Strand=-
gagttatttctgtcacaatatcgtgataataaatgtaatgactattttataatgaaacta

SEQ ID NO: 13855 - DNA, 60 bp, Xenorhabdus bovienii
  Promoter location: Contig name=SeqID_16893; Position on contig =39372..39431bp; Strand=+; Gene name=GlgX
tacaacccaaggaggatgcctaatcgtttgaggcagcatttaatatctaatctcattttt

SEQ ID NO: 13856 - DNA, 60 bp, Xenorhabdus bovienii
  Promoter location: Contig name=SeqID_16893; Position on contig =50487..50546bp; Strand=-
tattcaaccccttttttagcctatatatcactctttttttctattgatgtaatttaatta

SEQ ID NO: 13857 - DNA, 60 bp, Xenorhabdus bovienii
  Promoter location: Contig name=SeqID_16893; Position on contig =50438..50497bp; Strand=+
ttttttgttttcaatgtgttggttttgtttctgtttaggtattaatttgtaattaaatta

SEQ ID NO: 13858 - DNA, 60 bp, Xenorhabdus bovienii
  Promoter location: Contig name=SeqID_16893; Position on contig =51127..51186bp; Strand=-
aacccgctgaatatggggacggccttccacctgtaaaccattgggggcataatcctgaaa

SEQ ID NO: 13859 - DNA, 60 bp, Xenorhabdus bovienii
  Promoter location: Contig name=SeqID_16893; Position on contig =50885..50944bp; Strand=+
cttattttttcccctgatagagtattttgacaccttgcctgtttatgctgacgaggtgtt

SEQ ID NO: 13860 - DNA, 60 bp, Xenorhabdus bovienii
  Promoter location: Contig name=SeqID_16893; Position on contig =53096..53155bp; Strand=-; Gene name=AraC
agccacgccatattaatatcctttaactttatgtccgaatacataaataaactgccttta

SEQ ID NO: 13861 - DNA, 60 bp, Xenorhabdus bovienii
  Promoter location: Contig name=SeqID_16893; Position on contig =52996..53055bp; Strand=+; Gene name=AraC
agcgagccaaagcgatggtctagtgtgcatgatattttcttctgatgaattatttatagc

SEQ ID NO: 13862 - DNA, 60 bp, Xenorhabdus bovienii
  Promoter location: Contig name=SeqID_16893; Position on contig =55347..55406bp; Strand=-
attctctccggtagcacaatgccatcggcacagtataaattgcgcctatcatggttgtta

SEQ ID NO: 13863 - DNA, 60 bp, Xenorhabdus bovienii
  Promoter location: Contig name=SeqID_16893; Position on contig =55291..55350bp; Strand=+
aacgtagcttttttatcagccatttacatctccttagcgcttatttttataacccctaac

SEQ ID NO: 13864 - DNA, 60 bp, Xenorhabdus bovienii
  Promoter location: Contig name=SeqID_16893; Position on contig =55624..55683bp; Strand=+
atatgtaagataaatgtttaatccttgtcaaataagataatggtttttatgataaatgtt

SEQ ID NO: 13865 - DNA, 60 bp, Xenorhabdus bovienii
  Promoter location: Contig name=SeqID_16893; Position on contig =59492..59551bp; Strand=-; Gene name=SucA
cagccagtccttcattgcgccgttctgcattgtgatcccttaagctttaaaagctttagt

SEQ ID NO: 13866 - DNA, 60 bp, Xenorhabdus bovienii
  Promoter location: Contig name=SeqID_16893; Position on contig =63716..63775bp; Strand=-; Gene name=SucC
gctggtaaaccataccgtgcaaaaagttgttttgcctgatactcgtgtaaattcatgatg

SEQ ID NO: 13867 - DNA, 60 bp, Xenorhabdus bovienii
  Promoter location: Contig name=SeqID_16893; Position on contig =63572..63631bp; Strand=+; Gene name=SucC
tggagggtgttaaattctgcccagtctgaagtaaagcaatgttgatgtaaaaaatgtata

SEQ ID NO: 13868 - DNA, 60 bp, Xenorhabdus bovienii
  Promoter location: Contig name=SeqID_16893; Position on contig =66498..66557bp; Strand=-; Gene name=CydA
gtcatatctttgtagatctgtttgccagaaaggacatataccgtttccatgatcgcaagc

SEQ ID NO: 13869 - DNA, 60 bp, Xenorhabdus bovienii
  Promoter location: Contig name=SeqID_16893; Position on contig =66100..66159bp; Strand=+; Gene name=CydA
tcaatttattactatggtatgtattcgctgagtttgcttaaattgatctaaaataattag

SEQ ID NO: 13870 - DNA, 60 bp, Xenorhabdus bovienii
  Promoter location: Contig name=SeqID_16893; Position on contig =69458..69517bp; Strand=-
gagaagaatgaaaaatgcaggtaatggatgaaaaaaaagccgccagataatctgtttagg

SEQ ID NO: 13871 - DNA, 60 bp, Xenorhabdus bovienii
  Promoter location: Contig name=SeqID_16893; Position on contig =69585..69644bp; Strand=+; Gene name=FcbC
tttgatttctttactgacaagtcattccaaagcgcgattgtcttgagtatagtggcagcg

SEQ ID NO: 13872 - DNA, 60 bp, Xenorhabdus bovienii
  Promoter location: Contig name=SeqID_16893; Position on contig =72391..72450bp; Strand=+; Gene name=TolB
tttgctagttaaaaatacgaataatttatatatacaaacaaaattattagattttattta

SEQ ID NO: 13873 - DNA, 60 bp, Xenorhabdus bovienii
  Promoter location: Contig name=SeqID_16894; Position on contig =8110..8169bp; Strand=-
cgcagtaaaatgattgccccaaacttcggtaggatggcgttcttctttaaaatcgctgta

SEQ ID NO: 13874 - DNA, 60 bp, Xenorhabdus bovienii
  Promoter location: Contig name=SeqID_16894; Position on contig =7775..7834bp; Strand=+
accaaaaaaaatcgctgcacattatagctaataccagcaacatgtcataaagttgctcac

SEQ ID NO: 13875 - DNA, 60 bp, Xenorhabdus bovienii
  Promoter location: Contig name=SeqID_16894; Position on contig =14021..14080bp; Strand=-
gaagagtataccgtgattattttgttattaaagccacataaccgcatatatttttccgga

SEQ ID NO: 13876 - DNA, 60 bp, Xenorhabdus bovienii
  Promoter location: Contig name=SeqID_16894; Position on contig =13726..13785bp; Strand=+
gttgtgtcatagggaacctttttcattacttttaatcggcatattgataacatctgtata

SEQ ID NO: 13877 - DNA, 60 bp, Xenorhabdus bovienii
  Promoter location: Contig name=SeqID_16894; Position on contig =15425..15484bp; Strand=+; Gene name=AsnS
ccccattcaaactcacaatttctgcttgtttcctgagatatggcaagtaagatagaagat

SEQ ID NO: 13878 - DNA, 60 bp, Xenorhabdus bovienii
  Promoter location: Contig name=SeqID_16894; Position on contig =17084..17143bp; Strand=+; Gene name=OmpC
tacaaattgttaccaattattcgattttgtagcattttgagggtagataaaattcattac

SEQ ID NO: 13879 - DNA, 60 bp, Xenorhabdus bovienii
  Promoter location: Contig name=SeqID_16894; Position on contig =18978..19037bp; Strand=-; Gene name=TyrB
tgtcggattactgatccagacacgttttgcattggtctgtttagcaataaaatcagcagc

SEQ ID NO: 13880 - DNA, 60 bp, Xenorhabdus bovienii
  Promoter location: Contig name=SeqID_16894; Position on contig =18478..18537bp; Strand=+; Gene name=TyrB
tttttacgttttactttactgttttttatgacctttttttcactccgtaaactacttcac

SEQ ID NO: 13881 - DNA, 60 bp, Xenorhabdus bovienii
  Promoter location: Contig name=SeqID_16894; Position on contig =21364..21423bp; Strand=-
atgatttttttctctgctattgaaaaatttatcatgattcagatggataaaattttgtaa

SEQ ID NO: 13882 - DNA, 60 bp, Xenorhabdus bovienii
  Promoter location: Contig name=SeqID_16894; Position on contig =23439..23498bp; Strand=-; Gene name=AphA
acttaaggtgcctttttcttttttagtgctaacataagctaatttattataataaaaact

SEQ ID NO: 13883 - DNA, 60 bp, Xenorhabdus bovienii
  Promoter location: Contig name=SeqID_16894; Position on contig =25301..25360bp; Strand=-
aaatcaccaacttgacacctcagtatagattatataaccttacatttcataattgttaaa

SEQ ID NO: 13884 - DNA, 60 bp, Xenorhabdus bovienii
  Promoter location: Contig name=SeqID_16894; Position on contig =25602..25661bp; Strand=+
ataaataagaggttagttaaaaataatttacaatcataatttatttttaaaataaatata

SEQ ID NO: 13885 - DNA, 60 bp, Xenorhabdus bovienii
  Promoter location: Contig name=SeqID_16894; Position on contig =26887..26946bp; Strand=+
ttctttgcatatcagtaatgcataaacaatcttatttttgtcatggatataaaaaccata

SEQ ID NO: 13886 - DNA, 60 bp, Xenorhabdus bovienii
  Promoter location: Contig name=SeqID_16894; Position on contig =37005..37064bp; Strand=+
atctgatatcagttgcttagtcatttcattcccatccataaagtgtgaaaaattgcactt

SEQ ID NO: 13887 - DNA, 60 bp, Xenorhabdus bovienii
  Promoter location: Contig name=SeqID_16894; Position on contig =43488..43547bp; Strand=-; Gene name=WbbJ
taagtaataaataatattattattgacttgattcgtttctaattaattttaattcaataa

SEQ ID NO: 13888 - DNA, 60 bp, Xenorhabdus bovienii
  Promoter location: Contig name=SeqID_16894; Position on contig =44576..44635bp; Strand=-; Gene name=GrpB
aatcatggggaataaatattataaatctctatcataatataatctggtaaaattcagcat

SEQ ID NO: 13889 - DNA, 60 bp, Xenorhabdus bovienii
  Promoter location: Contig name=SeqID_16894; Position on contig =52784..52843bp; Strand=-
aaaagtagtgaattcaatgagtactgtgccaaaataacagtagccagcattattactcaa

SEQ ID NO: 13890 - DNA, 60 bp, Xenorhabdus bovienii
  Promoter location: Contig name=SeqID_16894; Position on contig =52550..52609bp; Strand=+
aattcagccaattggcaagccatgtttccttcaccgcctcccgcatccaaaatgcgcaga

SEQ ID NO: 13891 - DNA, 60 bp, Xenorhabdus bovienii
  Promoter location: Contig name=SeqID_16894; Position on contig =54758..54817bp; Strand=-
caacattcaacaaaataacagagttaacggtgatacattgcttgtggtattctgaaccgc

SEQ ID NO: 13892 - DNA, 60 bp, Xenorhabdus bovienii
  Promoter location: Contig name=SeqID_16894; Position on contig =62325..62384bp; Strand=-
gttttcgcatgttgtactcttgcaacagcgcaccaagaagatgtatatagaatcctggta

SEQ ID NO: 13893 - DNA, 60 bp, Xenorhabdus bovienii
  Promoter location: Contig name=SeqID_16894; Position on contig =61989..62048bp; Strand=+
cgtcgatttcatcgccaacttggatttccagctcgccctgagcatttttgaattgttcta

SEQ ID NO: 13894 - DNA, 60 bp, Xenorhabdus bovienii
  Promoter location: Contig name=SeqID_16894; Position on contig =63167..63226bp; Strand=-; Gene name=AroA
tcgtcaggtaatcatgatgtgcttattccactcatctgcggagtgcgtataataagagat

SEQ ID NO: 13895 - DNA, 60 bp, Xenorhabdus bovienii
  Promoter location: Contig name=SeqID_16894; Position on contig =65852..65911bp; Strand=-
gtttttttatatccatattattaataacgcagtctatcaaccagttatacaataggttgc

SEQ ID NO: 13896 - DNA, 60 bp, Xenorhabdus bovienii
  Promoter location: Contig name=SeqID_16894; Position on contig =66523..66582bp; Strand=-
cgataaattagtggcagattgtctctgtctataatatcacctataggaaaaatcctaatt

SEQ ID NO: 13897 - DNA, 60 bp, Xenorhabdus bovienii
  Promoter location: Contig name=SeqID_16894; Position on contig =66379..66438bp; Strand=+
aatcggcttcgtctcctgcatgctttctcgggttgttaattttttgttcaaatacccata

SEQ ID NO: 13898 - DNA, 60 bp, Xenorhabdus bovienii
  Promoter location: Contig name=SeqID_16894; Position on contig =70046..70105bp; Strand=-
aggatataaaaaagcagaaagacgcctttaatgcgtctttctgtatttaagttcaacatc

SEQ ID NO: 13899 - DNA, 60 bp, Xenorhabdus bovienii
  Promoter location: Contig name=SeqID_16894; Position on contig =69738..69797bp; Strand=+
agaattatctaaatatataaagtaacaaaaaataaaattcactttcgtatgattttattt

SEQ ID NO: 13900 - DNA, 60 bp, Xenorhabdus bovienii
  Promoter location: Contig name=SeqID_16894; Position on contig =71200..71259bp; Strand=+
ttttttagtctttttcatgatttaaccttttgtaaaaaaagccattttattatgtaaact

SEQ ID NO: 13901 - DNA, 60 bp, Xenorhabdus bovienii
  Promoter location: Contig name=SeqID_16894; Position on contig =73144..73203bp; Strand=+; Gene name=FocA
gtttatttattataaaaagtaaaattcaggttaaattaagtttatttaaaaataacaaat

SEQ ID NO: 13902 - DNA, 60 bp, Xenorhabdus bovienii
  Promoter location: Contig name=SeqID_16894; Position on contig =76673..76732bp; Strand=+; Gene name=PflA
gtcattattttctattgaaataaaatgacatacactaaaggccccttcacaattggggcc

SEQ ID NO: 13903 - DNA, 60 bp, Xenorhabdus bovienii
  Promoter location: Contig name=SeqID_16894; Position on contig =77931..77990bp; Strand=+
tctaaaaatacacaatatttcatatttaagtataaaaatttcatttcatacttaaataaa

SEQ ID NO: 13904 - DNA, 60 bp, Xenorhabdus bovienii
  Promoter location: Contig name=SeqID_16894; Position on contig =79132..79191bp; Strand=+
aaaaaaataaaccaataacaaggaataataatgaaagataactatcttaattttaactca

SEQ ID NO: 13905 - DNA, 60 bp, Xenorhabdus bovienii
  Promoter location: Contig name=SeqID_16894; Position on contig =81461..81520bp; Strand=-
gtgtcggcttggtcaatccgagctgatttcaccacttttttctcaataacaattttttca

SEQ ID NO: 13906 - DNA, 60 bp, Xenorhabdus bovienii
  Promoter location: Contig name=SeqID_16894; Position on contig =87077..87136bp; Strand=-
cttttgtctaaaatgtacagatgcaaaacaggaaaaacttaggtacactcctgtttatgc

SEQ ID NO: 13907 - DNA, 60 bp, Xenorhabdus bovienii
  Promoter location: Contig name=SeqID_16894; Position on contig =87306..87365bp; Strand=+
aactaagtgacattcttggatttcttcaagtttctgtacagcagtattaaactgctcaaa

SEQ ID NO: 13908 - DNA, 60 bp, Xenorhabdus bovienii
  Promoter location: Contig name=SeqID_16894; Position on contig =88499..88558bp; Strand=-; Gene name=TrxB
agacggaatggtcttttttcgaaatcgactttctgaatatggtcagaaataatttctgtt

SEQ ID NO: 13909 - DNA, 60 bp, Xenorhabdus bovienii
  Promoter location: Contig name=SeqID_16894; Position on contig =88113..88172bp; Strand=+; Gene name=TrxB
gtaacctctccttacattcccattacatcatagttactatctatcggtaaaatcgttaat

SEQ ID NO: 13910 - DNA, 60 bp, Xenorhabdus bovienii
  Promoter location: Contig name=SeqID_16894; Position on contig =89474..89533bp; Strand=-; Gene name=MdlB
gggggattttatccatgattagtgcttgaaggattgacgccagaagccaagcttgagaga

SEQ ID NO: 13911 - DNA, 60 bp, Xenorhabdus bovienii
  Promoter location: Contig name=SeqID_16894; Position on contig =89280..89339bp; Strand=+; Gene name=MdlB
aaggtttggccgctggcaaacagtatcaccagcctttttgatacattgtatcatcacctg

SEQ ID NO: 13912 - DNA, 60 bp, Xenorhabdus bovienii
  Promoter location: Contig name=SeqID_16894; Position on contig =93846..93905bp; Strand=-; Gene name=InfA
tatggggttagctcaactgtaaccttgtctccagtcaggatgcgaatatagtttttacgc

SEQ ID NO: 13913 - DNA, 60 bp, Xenorhabdus bovienii
  Promoter location: Contig name=SeqID_16894; Position on contig =93613..93672bp; Strand=+; Gene name=InfA
atatccattatgaggaaaatgatggtttaaaatacgacattcctttacataatgagggtt

SEQ ID NO: 13914 - DNA, 60 bp, Xenorhabdus bovienii
  Promoter location: Contig name=SeqID_16894; Position on contig =96721..96780bp; Strand=-
ttcatgaagtgataaaatatatagcagtagaatgaattagttcatactaaaatccagcag

SEQ ID NO: 13915 - DNA, 60 bp, Xenorhabdus bovienii
  Promoter location: Contig name=SeqID_16894; Position on contig =96633..96692bp; Strand=+
cgtttgctctgttttatcttcaattaattcttcaattttcaaactgttataaaactcact

SEQ ID NO: 13916 - DNA, 60 bp, Xenorhabdus bovienii
  Promoter location: Contig name=SeqID_16894; Position on contig =97606..97665bp; Strand=-
aaccagtcataaagactaataaaatcatgacaacaatatttttacactaaaataataaat

SEQ ID NO: 13917 - DNA, 60 bp, Xenorhabdus bovienii
  Promoter location: Contig name=SeqID_16894; Position on contig =97553..97612bp; Strand=+
attccttagacagtgcgaaacgcgttgaatttcagtatgtttccctttattctatttatt

SEQ ID NO: 13918 - DNA, 60 bp, Xenorhabdus bovienii
  Promoter location: Contig name=SeqID_16894; Position on contig =98660..98719bp; Strand=+
aaacttatttggtatgaaaatcaatccatttagccaaaaatagaacataaaataatctaa

SEQ ID NO: 13919 - DNA, 60 bp, Xenorhabdus bovienii
  Promoter location: Contig name=SeqID_16894; Position on contig =99589..99648bp; Strand=+; Gene name=ArtI
taaatctgtcatacaaatagtcagttagaacataaaacaagcatcagtaacatttatcaa

SEQ ID NO: 13920 - DNA, 60 bp, Xenorhabdus bovienii
  Promoter location: Contig name=SeqID_16894; Position on contig =104141..104200bp; Strand=-; Gene name=GrxC
acttgggcgaccaaaaatgacagtatacatacaaactccttagtggtaataatcgtgaac

SEQ ID NO: 13921 - DNA, 60 bp, Xenorhabdus bovienii
  Promoter location: Contig name=SeqID_16894; Position on contig =104065..104124bp; Strand=+; Gene name=GrxC
attagaacaaaaggcaattcctgcttttttttgccaacgcttacaggcatagtaacccca

SEQ ID NO: 13922 - DNA, 60 bp, Xenorhabdus bovienii
  Promoter location: Contig name=SeqID_16894; Position on contig =105183..105242bp; Strand=-; Gene name=PgpB
ggtaaagactgctgtaccgtggttactgggaaaagaggctgtaggggaatgatagagaaa

SEQ ID NO: 13923 - DNA, 60 bp, Xenorhabdus bovienii
  Promoter location: Contig name=SeqID_16894; Position on contig =104812..104871bp; Strand=+; Gene name=PgpB
cgtattataaaattactatttttaacaatgacttgataaagcatgtttatcatatttgcg

SEQ ID NO: 13924 - DNA, 60 bp, Xenorhabdus bovienii
  Promoter location: Contig name=SeqID_16894; Position on contig =106193..106252bp; Strand=+; Gene name=SdaC
acatttcactgaaaataactatattttccctatcaaaagactagggttaaattttttgat

SEQ ID NO: 13925 - DNA, 60 bp, Xenorhabdus bovienii
  Promoter location: Contig name=SeqID_16894; Position on contig =109161..109220bp; Strand=-
aagaaaatctttacgttattgggttggagtcttgtctcataacatcctatattaatagag

SEQ ID NO: 13926 - DNA, 60 bp, Xenorhabdus bovienii
  Promoter location: Contig name=SeqID_16894; Position on contig =108947..109006bp; Strand=+
gattatgggatgccagaatttttccactggcgtaatccatcaatatataggatttcgcat

SEQ ID NO: 13927 - DNA, 60 bp, Xenorhabdus bovienii
  Promoter location: Contig name=SeqID_16894; Position on contig =111500..111559bp; Strand=-; Gene name=HisG
ggggtaagacgtggcgatacgggaattttgcaggcattccactccggtatagtcgtagtc

SEQ ID NO: 13928 - DNA, 60 bp, Xenorhabdus bovienii
  Promoter location: Contig name=SeqID_16894; Position on contig =111084..111143bp; Strand=+; Gene name=HisG
ctcggaagattttccgggggttttttattgccaatttacgcgatttatatattgaatatt

SEQ ID NO: 13929 - DNA, 60 bp, Xenorhabdus bovienii
  Promoter location: Contig name=SeqID_16894; Position on contig =119828..119887bp; Strand=-
gtaggaatattattcatataataatcgccatatgaacttattgacattatagtacactat

SEQ ID NO: 13930 - DNA, 60 bp, Xenorhabdus bovienii
  Promoter location: Contig name=SeqID_16894; Position on contig =119492..119551bp; Strand=+
aatctcgtttaacacgcggtcagtgacaatcaaagcctgcctgtagccataatttttcat

SEQ ID NO: 13931 - DNA, 60 bp, Xenorhabdus bovienii
  Promoter location: Contig name=SeqID_16894; Position on contig =119695..119754bp; Strand=+
acttatctacctcagcaattttgatcgatatcaataatcgcctttgtaaaatttaaaaat

SEQ ID NO: 13932 - DNA, 60 bp, Xenorhabdus bovienii
  Promoter location: Contig name=SeqID_16894; Position on contig =121574..121633bp; Strand=-
tgtaattttgttgtatatgacatttgtgatcgacattgtttgattgacataatgttgagt

SEQ ID NO: 13933 - DNA, 60 bp, Xenorhabdus bovienii
  Promoter location: Contig name=SeqID_16894; Position on contig =121415..121474bp; Strand=+
tttatcgctggagcggttgaaaatggatacagagtaaccacggctttcaatattcaacgc

SEQ ID NO: 13934 - DNA, 60 bp, Xenorhabdus bovienii
  Promoter location: Contig name=SeqID_16894; Position on contig =123991..124050bp; Strand=-
cgatgtttttcattaatcagtttggattgattgacgtttgggatgggtaagctgccaccg

SEQ ID NO: 13935 - DNA, 60 bp, Xenorhabdus bovienii
  Promoter location: Contig name=SeqID_16894; Position on contig =132693..132752bp; Strand=-
cctataatccgccaaacatagcgttactgaatgctatgtccccactttattttttctttt

SEQ ID NO: 13936 - DNA, 60 bp, Xenorhabdus bovienii
  Promoter location: Contig name=SeqID_16894; Position on contig =134344..134403bp; Strand=-
ccaataatttgttcgcgacttgagacatagttaggatctgacttccgtatattgaaaagg

SEQ ID NO: 13937 - DNA, 60 bp, Xenorhabdus bovienii
  Promoter location: Contig name=SeqID_16894; Position on contig =133951..134010bp; Strand=+
gtcgtttcttccttcagttttgcaaaagcacgcttccagacgaacggcatcattaattca

SEQ ID NO: 13938 - DNA, 60 bp, Xenorhabdus bovienii
  Promoter location: Contig name=SeqID_16894; Position on contig =136462..136521bp; Strand=+
agagtccgctttttaatgtgacgtatggcacatttacagagttagtcgtatgataaaacc

SEQ ID NO: 13939 - DNA, 60 bp, Xenorhabdus bovienii
  Promoter location: Contig name=SeqID_16894; Position on contig =137716..137775bp; Strand=+; Gene name=Cdd
aaacggtgaaaaattcataaaaatagtaaaaatttgatataagttactaaaataatgtat

SEQ ID NO: 13940 - DNA, 60 bp, Xenorhabdus bovienii
  Promoter location: Contig name=SeqID_16894; Position on contig =138920..138979bp; Strand=-; Gene name=SfcA
taagaagataaaaaaaataagtacagtaaatgttacttaattatgtttatcatgagcaaa

SEQ ID NO: 13941 - DNA, 60 bp, Xenorhabdus bovienii
  Promoter location: Contig name=SeqID_16894; Position on contig =138898..138957bp; Strand=+; Gene name=SfcA
attctgtaagttatctctcatttttgctcatgataaacataattaagtaacatttactgt

SEQ ID NO: 13942 - DNA, 60 bp, Xenorhabdus bovienii
  Promoter location: Contig name=SeqID_16894; Position on contig =143587..143646bp; Strand=-
agatagttgtacacagatacaatgtaagtacataccacgcgagtggatatcatgtcagca

SEQ ID NO: 13943 - DNA, 60 bp, Xenorhabdus bovienii
  Promoter location: Contig name=SeqID_16894; Position on contig =143479..143538bp; Strand=+
tctccaagaataatactttccgttacttgacggggaatcgagacgcatattttacgcaga

SEQ ID NO: 13944 - DNA, 60 bp, Xenorhabdus bovienii
  Promoter location: Contig name=SeqID_16894; Position on contig =144875..144934bp; Strand=-; Gene name=MoeA
aagacgtgtattatatttatgatttgttataactgaataatgttaattaaaacaattaat

SEQ ID NO: 13945 - DNA, 60 bp, Xenorhabdus bovienii
  Promoter location: Contig name=SeqID_16894; Position on contig =144857..144916bp; Strand=+; Gene name=MoeA
tgattaaaaaataatgggattaattgttttaattaacattattcagttataacaaatcat

SEQ ID NO: 13946 - DNA, 60 bp, Xenorhabdus bovienii
  Promoter location: Contig name=SeqID_16894; Position on contig =147275..147334bp; Strand=+
atttccctggtcttgtattataaaatcttaatagataacatagtattataaatcaccatc

SEQ ID NO: 13947 - DNA, 60 bp, Xenorhabdus bovienii
  Promoter location: Contig name=SeqID_16894; Position on contig =151855..151914bp; Strand=-
aatttcatgacgatactatatagtctattccataagaaaattttatttatcttttttatg

SEQ ID NO: 13948 - DNA, 60 bp, Xenorhabdus bovienii
  Promoter location: Contig name=SeqID_16894; Position on contig =151622..151681bp; Strand=+
caatcagaccataacgattgccgttgccgaatttggcagaaatgttttcaaatagtggct

SEQ ID NO: 13949 - DNA, 60 bp, Xenorhabdus bovienii
  Promoter location: Contig name=SeqID_16894; Position on contig =152817..152876bp; Strand=-; Gene name=WecE
agagtatcccaataggaggtattttatatcataatcagcctattttttacatttagggtt

SEQ ID NO: 13950 - DNA, 60 bp, Xenorhabdus bovienii
  Promoter location: Contig name=SeqID_16894; Position on contig =152822..152881bp; Strand=+; Gene name=WecE
taaatgtaaaaaataggctgattatgatataaaatacctcctattgggatactctattag

SEQ ID NO: 13951 - DNA, 60 bp, Xenorhabdus bovienii
  Promoter location: Contig name=SeqID_16894; Position on contig =156812..156871bp; Strand=-
atgcggaaaaaagcccctccatcagccctaccaaatacatagccgttatcatcaacctcg

SEQ ID NO: 13952 - DNA, 60 bp, Xenorhabdus bovienii
  Promoter location: Contig name=SeqID_16894; Position on contig =156640..156699bp; Strand=+
cgtatcgtgcatcaattcgagggcttctttttgggcatctgtcagagtaattttcatggg

SEQ ID NO: 13953 - DNA, 60 bp, Xenorhabdus bovienii
  Promoter location: Contig name=SeqID_16894; Position on contig =157888..157947bp; Strand=+
tgcaattcatcctccttcagttcttttttagcttgttctaacctgtctaaaatgaatttt

SEQ ID NO: 13954 - DNA, 60 bp, Xenorhabdus bovienii
  Promoter location: Contig name=SeqID_16894; Position on contig =158730..158789bp; Strand=+
tatacctacaggaagtaatcctcccatttttcatggaggttaaaagtagaatttaagcaa

SEQ ID NO: 13955 - DNA, 60 bp, Xenorhabdus bovienii
  Promoter location: Contig name=SeqID_16894; Position on contig =160275..160334bp; Strand=-
gcaggtcgcgccacggaatgcctgttctcatacgataaagaatgccttcaaatgtttggc

SEQ ID NO: 13956 - DNA, 60 bp, Xenorhabdus bovienii
  Promoter location: Contig name=SeqID_16894; Position on contig =160097..160156bp; Strand=+
ggctgttgacgttttgtgaagggaatttgaacagcatgatgattgggtataatcgttttc

SEQ ID NO: 13957 - DNA, 60 bp, Xenorhabdus bovienii
  Promoter location: Contig name=SeqID_16894; Position on contig =160682..160741bp; Strand=-
caccggaaccgacttttgttcttcgataacacttctcaaacgctgactatcatatccctt

SEQ ID NO: 13958 - DNA, 60 bp, Xenorhabdus bovienii
  Promoter location: Contig name=SeqID_16894; Position on contig =161209..161268bp; Strand=+
tattcagtaaccacgccgaaatctgctcattttcggcagacaaacggcataatgtcccaa

SEQ ID NO: 13959 - DNA, 60 bp, Xenorhabdus bovienii
  Promoter location: Contig name=SeqID_16894; Position on contig =163490..163549bp; Strand=+
tacatatccatgcccagtgatgccagtaaatcgaatggtgataacagtaatattgtggcg

SEQ ID NO: 13960 - DNA, 60 bp, Xenorhabdus bovienii
  Promoter location: Contig name=SeqID_16894; Position on contig =164183..164242bp; Strand=-
agcaaaatacaccgccgtttaattgtttgataccacgaaattatggttatatttttgatt

SEQ ID NO: 13961 - DNA, 60 bp, Xenorhabdus bovienii
  Promoter location: Contig name=SeqID_16894; Position on contig =163871..163930bp; Strand=+
aataaaaatatttttttagcaagggtttgaaaaacattaatgttaaaaatgacaacagta

SEQ ID NO: 13962 - DNA, 60 bp, Xenorhabdus bovienii
  Promoter location: Contig name=SeqID_16894; Position on contig =166106..166165bp; Strand=+; Gene name=PhnA
acaatgtcaaagattagactaacctttaaaaaaatcatttttctctctataatctctttt

SEQ ID NO: 13963 - DNA, 60 bp, Xenorhabdus bovienii
  Promoter location: Contig name=SeqID_16894; Position on contig =166790..166849bp; Strand=+
gtactatcagccttcttttttaatacattaactcactaacgattatttatattttctgaa

SEQ ID NO: 13964 - DNA, 60 bp, Xenorhabdus bovienii
  Promoter location: Contig name=SeqID_16894; Position on contig =168745..168804bp; Strand=-
ttcacaaaagaaagtaagttaatcaatgaaattatctgcacttttgttatagtcggtaat

SEQ ID NO: 13965 - DNA, 60 bp, Xenorhabdus bovienii
  Promoter location: Contig name=SeqID_16894; Position on contig =169335..169394bp; Strand=-
atcaatatattgaagattattataaatttctttagaaaatgatgatttataattaacgcc

SEQ ID NO: 13966 - DNA, 60 bp, Xenorhabdus bovienii
  Promoter location: Contig name=SeqID_16894; Position on contig =169144..169203bp; Strand=+
ataataaattacattatattaacatgcaaaacacctatttcagcatgtaaattatttgaa

SEQ ID NO: 13967 - DNA, 60 bp, Xenorhabdus bovienii
  Promoter location: Contig name=SeqID_16894; Position on contig =171250..171309bp; Strand=-
gatttctttttaaatggaatttttgaaatatataggcaaccatttgctatattcatatca

SEQ ID NO: 13968 - DNA, 60 bp, Xenorhabdus bovienii
  Promoter location: Contig name=SeqID_16894; Position on contig =171110..171169bp; Strand=+
acagaaaaaaaacatattctctttaaggataaaattaattttaaattgagtggtggtggt

SEQ ID NO: 13969 - DNA, 60 bp, Xenorhabdus bovienii
  Promoter location: Contig name=SeqID_16895; Position on contig =855..914bp; Strand=+
gttgtctcatttttattaactatatgaattttaattattttagtttttaaattgagacaa

SEQ ID NO: 13970 - DNA, 60 bp, Xenorhabdus bovienii
  Promoter location: Contig name=SeqID_16895; Position on contig =2045..2104bp; Strand=+
aataacttccttttatctgagttaagttgtcagtattacccttattttaatatgaggaat

SEQ ID NO: 13971 - DNA, 60 bp, Xenorhabdus bovienii
  Promoter location: Contig name=SeqID_16895; Position on contig =2913..2972bp; Strand=+
aactttggcgtagagggttcgcgcggatgcctgaagagcattaggactcggttcgattcc

SEQ ID NO: 13972 - DNA, 60 bp, Xenorhabdus bovienii
  Promoter location: Contig name=SeqID_16895; Position on contig =3312..3371bp; Strand=+
cgtctatatctgggcgctcgatattgattattacctaattatgccgctgcaatcactctc

SEQ ID NO: 13973 - DNA, 60 bp, Xenorhabdus bovienii
  Promoter location: Contig name=SeqID_16895; Position on contig =6756..6815bp; Strand=+
aaagctgcttaactacaaaaaataaatgcaaccacctccgggtggttttttattccctta

SEQ ID NO: 13974 - DNA, 60 bp, Xenorhabdus bovienii
  Promoter location: Contig name=SeqID_16895; Position on contig =8093..8152bp; Strand=+
cgataatcggatattgcccatgtttagggcacttgcaaggacttttatataaatcagacc

SEQ ID NO: 13975 - DNA, 60 bp, Xenorhabdus bovienii
  Promoter location: Contig name=SeqID_16895; Position on contig =31555..31614bp; Strand=-
ttccgtgccatcctaatcagaagttctctccagtattgatgaacctttttatttatgttc

SEQ ID NO: 13976 - DNA, 60 bp, Xenorhabdus bovienii
  Promoter location: Contig name=SeqID_16895; Position on contig =31429..31488bp; Strand=+
ttgctgcgctaatgtagtatcttttaattctgatatatcaggctttttatcttgcatact

SEQ ID NO: 13977 - DNA, 60 bp, Xenorhabdus bovienii
  Promoter location: Contig name=SeqID_16895; Position on contig =32187..32246bp; Strand=-
gttgtctcagttgtctctgttgcctcaatcaacttaactaattgttttataatgattaat

SEQ ID NO: 13978 - DNA, 60 bp, Xenorhabdus bovienii
  Promoter location: Contig name=SeqID_16895; Position on contig =32844..32903bp; Strand=-
tcttttgggcacacctcttattgagttgtgcaaattttgcgagtaactatcatttacgct

SEQ ID NO: 13979 - DNA, 60 bp, Xenorhabdus bovienii
  Promoter location: Contig name=SeqID_16895; Position on contig =34273..34332bp; Strand=+
tcacataaaaaaaagcacatcagattgaatcacaatgtgcttttgttgattatttattca

SEQ ID NO: 13980 - DNA, 60 bp, Xenorhabdus bovienii
  Promoter location: Contig name=SeqID_16895; Position on contig =37496..37555bp; Strand=+
taggtcccaaaaatcattattcttttctggcctgtattggatttatttataattatccat

SEQ ID NO: 13981 - DNA, 60 bp, Xenorhabdus bovienii
  Promoter location: Contig name=SeqID_16895; Position on contig =39110..39169bp; Strand=-
atagcaatgatataaaaacattgcagcaactcagtgagcgaattgaggaaattgcggaaa

SEQ ID NO: 13982 - DNA, 60 bp, Xenorhabdus bovienii
  Promoter location: Contig name=SeqID_16895; Position on contig =39688..39747bp; Strand=-
attttcgcagttggccaccgttccctgacctgttcggctacagtcggtaaattcccttca

SEQ ID NO: 13983 - DNA, 60 bp, Xenorhabdus bovienii
  Promoter location: Contig name=SeqID_16895; Position on contig =41750..41809bp; Strand=+
gttgtctcatttttattaactgtatgaattgtaattattttagtttttaaattgagacaa

SEQ ID NO: 13984 - DNA, 60 bp, Xenorhabdus bovienii; identical to SEQ ID NO: 13280
  Promoter location: Contig name=SeqID_16895; Position on contig =44669..44728bp; Strand=-

SEQ ID NO: 13985 - DNA, 60 bp, Xenorhabdus bovienii
  Promoter location: Contig name=SeqID_16895; Position on contig =44851..44910bp; Strand=+
atctgtttgaaccctgcattttgaaaacctgcatccgtaacaataattactctagcttta

SEQ ID NO: 13986 - DNA, 60 bp, Xenorhabdus bovienii
  Promoter location: Contig name=SeqID_16895; Position on contig =45388..45447bp; Strand=-
tagggctgaggaatccccagaaaatagacaggcatagcgttgtgtgatctactgattgtt

SEQ ID NO: 13987 - DNA, 60 bp, Xenorhabdus bovienii; identical to SEQ ID NO: 13282
  Promoter location: Contig name=SeqID_16895; Position on contig =45172..45231bp; Strand=+

SEQ ID NO: 13988 - DNA, 60 bp, Xenorhabdus bovienii
  Promoter location: Contig name=SeqID_16895; Position on contig =46442..46501bp; Strand=-; Gene name=WecD
ttttccgcaatatattctagatggtgtcgtcatgagaaatttcgtgcaataataatgccc

SEQ ID NO: 13989 - DNA, 60 bp, Xenorhabdus bovienii
  Promoter location: Contig name=SeqID_16895; Position on contig =46380..46439bp; Strand=+; Gene name=WecD
aatatcgtggcggcggtgtgcaggtgtactcatggttaatcaactcttatgatggaatgg

SEQ ID NO: 13990 - DNA, 60 bp, Xenorhabdus bovienii
  Promoter location: Contig name=SeqID_16895; Position on contig =47462..47521bp; Strand=-
ttggtggaacctctcggaatcgaaccgagtcctaatgctcttcaggcatccgcgcgaacc

SEQ ID NO: 13991 - DNA, 60 bp, Xenorhabdus bovienii
  Promoter location: Contig name=SeqID_16895; Position on contig =47076..47135bp; Strand=+
tggattttaattcccccgaattcgagggaatctagcagtctactttttattttcgccttt

SEQ ID NO: 13992 - DNA, 60 bp, Xenorhabdus bovienii
  Promoter location: Contig name=SeqID_16895; Position on contig =47459..47518bp; Strand=+
gagggttcgcgcggatgcctgaagagcattaggactcggttcgattccgagaggttccac

SEQ ID NO: 13993 - DNA, 60 bp, Xenorhabdus bovienii
  Promoter location: Contig name=SeqID_16895; Position on contig =50061..50120bp; Strand=-
tcactcagtgttaacattacctagttcaaaccaaatagcttcttatataaattagttttg

SEQ ID NO: 13994 - DNA, 60 bp, Xenorhabdus bovienii
  Promoter location: Contig name=SeqID_16895; Position on contig =49954..50013bp; Strand=+
ccatcagtgttttcataaatatgtatagcatattctatgccttgaattaaaattggacta

SEQ ID NO: 13995 - DNA, 60 bp, Xenorhabdus bovienii
  Promoter location: Contig name=SeqID_16895; Position on contig =51895..51954bp; Strand=+; Gene name=Hcp
aaatgctacataaagacgcagggcaggttatcaataaagccatcggttaacacgggtggc

SEQ ID NO: 13996 - DNA, 60 bp, Xenorhabdus bovienii
  Promoter location: Contig name=SeqID_16895; Position on contig =54504..54563bp; Strand=-
gcgcttttcatcttcggctttggtgagcagtgaacgcatttggtcggtaaaggttgcttt

SEQ ID NO: 13997 - DNA, 60 bp, Xenorhabdus bovienii
  Promoter location: Contig name=SeqID_16895; Position on contig =54342..54401bp; Strand=+
aaaatgaaatcttttgtaaatgtttcgtcttcatgttttcccttgtttagcctctgaatt

SEQ ID NO: 13998 - DNA, 60 bp, Xenorhabdus bovienii
  Promoter location: Contig name=SeqID_16895; Position on contig =56576..56635bp; Strand=-
agccttaagaccactaaaaatacctttagtgtgcgcccgtgtgtagccaagatcattatc

SEQ ID NO: 13999 - DNA, 60 bp, Xenorhabdus bovienii
  Promoter location: Contig name=SeqID_16895; Position on contig =56203..56262bp; Strand=+
cttggccgtgagggatgcctgattccagtacgcccttcaacgtattttttaatttctcca

SEQ ID NO: 14000 - DNA, 60 bp, Xenorhabdus bovienii
  Promoter location: Contig name=SeqID_16895; Position on contig =57649..57708bp; Strand=-; Gene name=GrsT
aaatcagcagtttattgtgaactttaaacactttaccaccctgtattttttaatactgaa

SEQ ID NO: 14001 - DNA, 60 bp, Xenorhabdus bovienii
  Promoter location: Contig name=SeqID_16895; Position on contig =58503..58562bp; Strand=-
ttgtgatagaaaaatctccttcatgttttattaaacttaatactgtttctaatcctgaga

SEQ ID NO: 14002 - DNA, 60 bp, Xenorhabdus bovienii
  unsure (1)..(60): unsure at all n locations
  Promoter location: Contig name=SeqID_16895; Position on contig =59776..59835bp; Strand=-
aagccacaaataaggtttatcccttgtgtaaaattncccggcccatccatagtttcaata

SEQ ID NO: 14003 - DNA, 60 bp, Xenorhabdus bovienii
  Promoter location: Contig name=SeqID_16895; Position on contig =63080..63139bp; Strand=-; Gene name=Ada
agaactttctactacccttttattttactccatcgacctaatatcgttagattaaatacc

SEQ ID NO: 14004 - DNA, 60 bp, Xenorhabdus bovienii
  Promoter location: Contig name=SeqID_16895; Position on contig =62871..62930bp; Strand=+; Gene name=Ada
tttggctctcatttattaatcctttttgttaaatgtaacaatattgttataaatccgaaa

SEQ ID NO: 14005 - DNA, 60 bp, Xenorhabdus bovienii
  Promoter location: Contig name=SeqID_16895; Position on contig =64326..64385bp; Strand=+; Gene name=LdcC
ataacaggtgttcagtaaaaatatattaaataaataactgtcatcttaataatgaaaaat

SEQ ID NO: 14006 - DNA, 60 bp, Xenorhabdus bovienii
  Promoter location: Contig name=SeqID_16895; Position on contig =68874..68933bp; Strand=-; Gene name=RbsK
ccccggattagaatcttcatagattaattctgcgaatgcatagctggtaacatccatatt

SEQ ID NO: 14007 - DNA, 60 bp, Xenorhabdus bovienii
  Promoter location: Contig name=SeqID_16895; Position on contig =68447..68506bp; Strand=+; Gene name=RbsK
aacttaaataaattattactggttcgactaataagaattaaattccttactattgtaaat

SEQ ID NO: 14008 - DNA, 60 bp, Xenorhabdus bovienii
  Promoter location: Contig name=SeqID_16895; Position on contig =70727..70786bp; Strand=+; Gene name=NupC
tatccaacgttacaataaaataagtgccagcctgaaagaaaacagggtaatatcccttgg

SEQ ID NO: 14009 - DNA, 60 bp, Xenorhabdus bovienii
  Promoter location: Contig name=SeqID_16895; Position on contig =72100..72159bp; Strand=+; Gene name=UspA
cgctatcggcgctaacatgttgaggtgttagataactcacagtaagttatgctggatccc

SEQ ID NO: 14010 - DNA, 60 bp, Xenorhabdus bovienii
  Promoter location: Contig name=SeqID_16895; Position on contig =73564..73623bp; Strand=-; Gene name=EndA
gtgtgtattaatatttattgttaaacccatccattatttggcttagttaatattaatatt

SEQ ID NO: 14011 - DNA, 60 bp, Xenorhabdus bovienii
  Promoter location: Contig name=SeqID_16895; Position on contig =73479..73538bp; Strand=+; Gene name=EndA
caaataattagagttcaatagtttaataaacgtgatattttggcatttaacatgggaata

SEQ ID NO: 14012 - DNA, 60 bp, Xenorhabdus bovienii
  Promoter location: Contig name=SeqID_16895; Position on contig =79830..79889bp; Strand=-; Gene name=ARO8
ctgacctttggtaaaactgttataggtaataaatagatgattgtcactattataccctaa

SEQ ID NO: 14013 - DNA, 60 bp, Xenorhabdus bovienii
  Promoter location: Contig name=SeqID_16895; Position on contig =79789..79848bp; Strand=+; Gene name=ARO8
gcgatgaagttagaaggtgcggataagtaaaacacaggaatttagggtataatagtgaca

SEQ ID NO: 14014 - DNA, 60 bp, Xenorhabdus bovienii
  Promoter location: Contig name=SeqID_16895; Position on contig =81685..81744bp; Strand=-
tccaacaattcagcatgcccgcgaatatcgccagaaaaatggaagggtgtcatttttttc

SEQ ID NO: 14015 - DNA, 60 bp, Xenorhabdus bovienii
  Promoter location: Contig name=SeqID_16895; Position on contig =81319..81378bp; Strand=+
aatcacatttcaattatctctatgttgtcgtaggcagaattatttgcgaatgttggagtt

SEQ ID NO: 14016 - DNA, 60 bp, Xenorhabdus bovienii
  Promoter location: Contig name=SeqID_16895; Position on contig =82310..82369bp; Strand=-
gcacaaataagtaatgaagtatggaatttttatatcaatggtggcgggatgattacgttc

SEQ ID NO: 14017 - DNA, 60 bp, Xenorhabdus bovienii
  Promoter location: Contig name=SeqID_16895; Position on contig =83887..83946bp; Strand=-
actcacatttcttaactctgctttatcaaaagcaattaatttatcgtcaaaatgaatata

SEQ ID NO: 14018 - DNA, 60 bp, Xenorhabdus bovienii
  Promoter location: Contig name=SeqID_16895; Position on contig =86323..86382bp; Strand=-; Gene name=VgrG
gtaaaccacaacagcctcttctttatcacctttaagattgaacggtatcttgtgcctcga

SEQ ID NO: 14019 - DNA, 60 bp, Xenorhabdus bovienii
  Promoter location: Contig name=SeqID_16895; Position on contig =88547..88606bp; Strand=+
atcacttttggggaatggggctggaattgtttttatatgaggaatgttattatccacttt

SEQ ID NO: 14020 - DNA, 60 bp, Xenorhabdus bovienii
  Promoter location: Contig name=SeqID_16895; Position on contig =91848..91907bp; Strand=-
atgtgatgacatggtagcgattaatttaattgtgaaacataaccctgaattttctttgct

SEQ ID NO: 14021 - DNA, 60 bp, Xenorhabdus bovienii
  Promoter location: Contig name=SeqID_16895; Position on contig =91968..92027bp; Strand=+
cccacccaacggaaattaaaccttgcttcttaccctttaacgataaataaattatgtgtg

SEQ ID NO: 14022 - DNA, 60 bp, Xenorhabdus bovienii
  Promoter location: Contig name=SeqID_16895; Position on contig =93591..93650bp; Strand=+
atacctcattatcgctcaagctgattcatttaatgcgacagaacccgtaatctttatcgc

SEQ ID NO: 14023 - DNA, 60 bp, Xenorhabdus bovienii
  Promoter location: Contig name=SeqID_16895; Position on contig =94868..94927bp; Strand=-; Gene name=OmpW
gttacctgctttaatcttttaggtatccaataatcccccggacaaggtacaattgagtat

SEQ ID NO: 14024 - DNA, 60 bp, Xenorhabdus bovienii
  Promoter location: Contig name=SeqID_16895; Position on contig =94987..95046bp; Strand=+; Gene name=OmpW
aatgatagatctattaatgttatgttaattaattggaatagaagtgatattttttatcaa

SEQ ID NO: 14025 - DNA, 60 bp, Xenorhabdus bovienii
  Promoter location: Contig name=SeqID_16895; Position on contig =97432..97491bp; Strand=-; Gene name=OsmY
tgcgcgcacatctactcaggctcttgcgatgtgtgcatgtcgtagcgtaaactcggtgcg

SEQ ID NO: 14026 - DNA, 60 bp, Xenorhabdus bovienii
  Promoter location: Contig name=SeqID_16895; Position on contig =98009..98068bp; Strand=-
tccgggaataaatatttcccctatcatttgtaggttttcccgttttcaataatactttct

SEQ ID NO: 14027 - DNA, 60 bp, Xenorhabdus bovienii
  Promoter location: Contig name=SeqID_16895; Position on contig =97750..97809bp; Strand=+
atttttggcctcaagtaatgctgattttactttggctgtaatgacggtatcgtcaatgta

SEQ ID NO: 14028 - DNA, 60 bp, Xenorhabdus bovienii
  Promoter location: Contig name=SeqID_16895; Position on contig =104560..104619bp; Strand=+
tccagtaataacgtggctgggcgattaccacaaagctgattgaaaagtagagttggatct

SEQ ID NO: 14029 - DNA, 60 bp, Xenorhabdus bovienii
  Promoter location: Contig name=SeqID_16895; Position on contig =105115..105174bp; Strand=+
attttttttgttttttattagatgcattgagaaattacatcaattggtattatttatttt

SEQ ID NO: 14030 - DNA, 60 bp, Xenorhabdus bovienii
  Promoter location: Contig name=SeqID_16895; Position on contig =105810..105869bp; Strand=+
atgattgccatcttgaaatgattgctacatgtaacggagtaaattgtttaaataaaaata

SEQ ID NO: 14031 - DNA, 60 bp, Xenorhabdus bovienii
  Promoter location: Contig name=SeqID_16895; Position on contig =106199..106258bp; Strand=+
agaacaaaattctggggttattccaataaaatatggtgattataaaaataaaaagaaatt

SEQ ID NO: 14032 - DNA, 60 bp, Xenorhabdus bovienii
  Promoter location: Contig name=SeqID_16895; Position on contig =107192..107251bp; Strand=+
attgtgtagaaccagtaaattcgcaccttcaactactccctctgtgttatcatccccgct

SEQ ID NO: 14033 - DNA, 60 bp, Xenorhabdus bovienii
  Promoter location: Contig name=SeqID_16895; Position on contig =111335..111394bp; Strand=-
acgggggcattaagttttgttctgatgacagacttcatgtgtccgcctaaaatagcagat

SEQ ID NO: 14034 - DNA, 60 bp, Xenorhabdus bovienii
  Promoter location: Contig name=SeqID_16895; Position on contig =111174..111233bp; Strand=+
taagttagcgccgcttcacgaccaatgccgtctccggcaccggtgactaaaatgattttc

SEQ ID NO: 14035 - DNA, 60 bp, Xenorhabdus bovienii
  Promoter location: Contig name=SeqID_16895; Position on contig =111839..111898bp; Strand=-; Gene name=SppA
aatctcttcacggagagaatcaacttcatgggcatccatactgcctttaaaatccagaac

SEQ ID NO: 14036 - DNA, 60 bp, Xenorhabdus bovienii
  Promoter location: Contig name=SeqID_16895; Position on contig =111437..111496bp; Strand=+; Gene name=SppA
agataggatgcaagtaaactgttagagcacagcctccggtttttagttagaatgaagaat

SEQ ID NO: 14037 - DNA, 60 bp, Xenorhabdus bovienii
  Promoter location: Contig name=SeqID_16895; Position on contig =113149..113208bp; Strand=-
gttgcgatatataaaataaattctctttttatattgcgatagatttgcaagatatcaact

SEQ ID NO: 14038 - DNA, 60 bp, Xenorhabdus bovienii
  Promoter location: Contig name=SeqID_16895; Position on contig =112725..112784bp; Strand=+
ttcggataatatatgtgctaaatgtttaaacatattaaacacagcggtacttttcgtggt

SEQ ID NO: 14039 - DNA, 60 bp, Xenorhabdus bovienii
  Promoter location: Contig name=SeqID_16895; Position on contig =113127..113186bp; Strand=+; Gene name=TopA
agcaaagtacaagataaaaattagttgatatcttgcaaatctatcgcaatataaaaagag

SEQ ID NO: 14040 - DNA, 60 bp, Xenorhabdus bovienii
  Promoter location: Contig name=SeqID_16895; Position on contig =116024..116083bp; Strand=+; Gene name=LysR
atcgttatcatccccaattatttgttatataaatatacagcaggtgatatagtagttata

SEQ ID NO: 14041 - DNA, 60 bp, Xenorhabdus bovienii
  Promoter location: Contig name=SeqID_16895; Position on contig =118479..118538bp; Strand=-; Gene name=AcnA
ttatggtcagctacaccattaaacataacatactagcgaacatttgttattcagttacca

SEQ ID NO: 14042 - DNA, 60 bp, Xenorhabdus bovienii
  Promoter location: Contig name=SeqID_16895; Position on contig =118465..118524bp; Strand=+; Gene name=AcnA
gttagcaaaatgtgtggtaactgaataacaaatgttcgctagtatgttatgtttaatggt

SEQ ID NO: 14043 - DNA, 60 bp, Xenorhabdus bovienii
  Promoter location: Contig name=SeqID_16895; Position on contig =122059..122118bp; Strand=-
acattctcttcatccgttcatctgatgattttatatacggacaggtgtattatttctgtt

SEQ ID NO: 14044 - DNA, 60 bp, Xenorhabdus bovienii
  Promoter location: Contig name=SeqID_16895; Position on contig =122082..122141bp; Strand=+
tatataaaatcatcagatgaacggatgaagagaatgttaacatgctaaactataaacaga

SEQ ID NO: 14045 - DNA, 60 bp, Xenorhabdus bovienii
  Promoter location: Contig name=SeqID_16895; Position on contig =123869..123928bp; Strand=+; Gene name=PyrF
ggctatatctgcgtgttttcattaatacatgtttcattacggacatgtttacttttcatt

SEQ ID NO: 14046 - DNA, 60 bp, Xenorhabdus bovienii
  Promoter location: Contig name=SeqID_16895; Position on contig =125159..125218bp; Strand=-
cagtttggctatatccgctcccgttggagtattgaaactttcatatttaaaatcaataaa

SEQ ID NO: 14047 - DNA, 60 bp, Xenorhabdus bovienii
  Promoter location: Contig name=SeqID_16895; Position on contig =126411..126470bp; Strand=+
cgtacatctgcggatctatttgcttcaattatatacatgatatctattattatttatttg

SEQ ID NO: 14048 - DNA, 60 bp, Xenorhabdus bovienii
  Promoter location: Contig name=SeqID_16895; Position on contig =127999..128058bp; Strand=-
tatattttgtgtagtcatggtaggttcctagatggtgtcgtcataaataaattcatgtaa

SEQ ID NO: 14049 - DNA, 60 bp, Xenorhabdus bovienii; identical to SEQ ID NO: 12949
  Promoter location: Contig name=SeqID_16895; Position on contig =127772..127831bp; Strand=+

SEQ ID NO: 14050 - DNA, 60 bp, Xenorhabdus bovienii
  Promoter location: Contig name=SeqID_16895; Position on contig =134727..134786bp; Strand=+
caagcagcggattgtcttgaaacataataatctggggaatatggagttattatcgataat

SEQ ID NO: 14051 - DNA, 60 bp, Xenorhabdus bovienii
  Promoter location: Contig name=SeqID_16895; Position on contig =142244..142303bp; Strand=-; Gene name=MviM
aatatcaccacctttcaccaattagcaaataatcaaagttcctgtgttactatctttttc

SEQ ID NO: 14052 - DNA, 60 bp, Xenorhabdus bovienii
  Promoter location: Contig name=SeqID_16895; Position on contig =142175..142234bp; Strand=+; Gene name=MviM
ttaatacggtaataatcattggattgatacataaagaatcttcactccatgatgagcgtt

SEQ ID NO: 14053 - DNA, 60 bp, Xenorhabdus bovienii
  Promoter location: Contig name=SeqID_16895; Position on contig =145475..145534bp; Strand=-
actccgatagtactttcattttcttgccagtcaatgtgttgactggcttttttgtatata

SEQ ID NO: 14054 - DNA, 60 bp, Xenorhabdus bovienii
  Promoter location: Contig name=SeqID_16895; Position on contig =147193..147252bp; Strand=-; Gene name=ManA
ggttgttaatgactcttttattgaaaattgattaaaaattttttagttaaactatacaat

SEQ ID NO: 14055 - DNA, 60 bp, Xenorhabdus bovienii
  Promoter location: Contig name=SeqID_16895; Position on contig =148500..148559bp; Strand=-; Gene name=FumC
ccataaatttattatccataatgcgacctgatcgtgtttattgtattgttgtcatataaa

SEQ ID NO: 14056 - DNA, 60 bp, Xenorhabdus bovienii
  Promoter location: Contig name=SeqID_16895; Position on contig =148432..148491bp; Strand=+; Gene name=FumC
tcataatgttggatctggttggtcattttcagcatggcaagactccctataataaaaaaa

SEQ ID NO: 14057 - DNA, 60 bp, Xenorhabdus bovienii
  Promoter location: Contig name=SeqID_16895; Position on contig =151090..151149bp; Strand=-
attgggcttttttttgttttttgttgaggatctgctccttttgttgttatactaataagt

SEQ ID NO: 14058 - DNA, 60 bp, Xenorhabdus bovienii
  Promoter location: Contig name=SeqID_16895; Position on contig =151189..151248bp; Strand=+
ctgttgtgataaaaatcaaaaaaggaattactgattatctaacaagtttcaataagtatt

SEQ ID NO: 14059 - DNA, 60 bp, Xenorhabdus bovienii
  Promoter location: Contig name=SeqID_16895; Position on contig =153372..153431bp; Strand=-; Gene name=LysR
gatgattaatatattagacaaaatattcatgagttcctattcttgatcaaaatcaagtcg

SEQ ID NO: 14060 - DNA, 60 bp, Xenorhabdus bovienii
  Promoter location: Contig name=SeqID_16895; Position on contig =153392..153451bp; Strand=+; Gene name=LysR
ataggaactcatgaatattttgtctaatatattaatcatcatgaatgatatgtttaaaat

SEQ ID NO: 14061 - DNA, 60 bp, Xenorhabdus bovienii
  Promoter location: Contig name=SeqID_16895; Position on contig =154422..154481bp; Strand=+; Gene name=NagC
cgatcacatttctactgtaaacggatatcttctaatttaaacaaggacataatcgttact

SEQ ID NO: 14062 - DNA, 60 bp, Xenorhabdus bovienii
  Promoter location: Contig name=SeqID_16895; Position on contig =155748..155807bp; Strand=+; Gene name=BioD
caggcaaaacattgcgctaacgcaatccctatctcaaacacatctcctaaactttaagct

SEQ ID NO: 14063 - DNA, 60 bp, Xenorhabdus bovienii
  Promoter location: Contig name=SeqID_16895; Position on contig =157008..157067bp; Strand=-
ttaacaaacgtgaagaaaaacagtttgataagtatgaggtggacgttgataatcgagatg

SEQ ID NO: 14064 - DNA, 60 bp, Xenorhabdus bovienii
  Promoter location: Contig name=SeqID_16895; Position on contig =156532..156591bp; Strand=+
ttagaaaaggggagctaaacgtgctccccagtttaattttaataagttctcatttttgag

SEQ ID NO: 14065 - DNA, 60 bp, Xenorhabdus bovienii
  Promoter location: Contig name=SeqID_16895; Position on contig =158275..158334bp; Strand=-
ctatagttgcagagtttcaggatttttgtcattgttaatctgacacttatattaatgagt

SEQ ID NO: 14066 - DNA, 60 bp, Xenorhabdus bovienii
  Promoter location: Contig name=SeqID_16895; Position on contig =158129..158188bp; Strand=+
cccctgtaacaaaaacaatcatagtcgtcctcttagttaccaattgttatcattaatttc

SEQ ID NO: 14067 - DNA, 60 bp, Xenorhabdus bovienii
  Promoter location: Contig name=SeqID_16895; Position on contig =158769..158828bp; Strand=+
gaattatacaaaactgatggaatatttagtagcaacgaataaaaaatgaaaatgagtata

SEQ ID NO: 14068 - DNA, 60 bp, Xenorhabdus bovienii
  Promoter location: Contig name=SeqID_16895; Position on contig =159871..159930bp; Strand=+; Gene name=GrpB
agatgtccgcctctaagcaaagttgaaatgtccacaaacatcctttatatatttaggatg

SEQ ID NO: 14069 - DNA, 60 bp, Xenorhabdus bovienii
  Promoter location: Contig name=SeqID_16895; Position on contig =160754..160813bp; Strand=-
cagggcagaacatagttaattgactgaaaaggttcatctcatgaagttatgatctatttt

SEQ ID NO: 14070 - DNA, 60 bp, Xenorhabdus bovienii
  Promoter location: Contig name=SeqID_16895; Position on contig =161810..161869bp; Strand=-; Gene name=LysR
agtaaaactgcctaattgtgctgtcgccacaaaggcaacaattccgctaaaatgatcgtt

SEQ ID NO: 14071 - DNA, 60 bp, Xenorhabdus bovienii
  Promoter location: Contig name=SeqID_16895; Position on contig =161513..161572bp; Strand=+; Gene name=LysR
cgggtaagtgatgcgcaaccgttgcaacatcatataacccaacagagtaaaagaaatcag

SEQ ID NO: 14072 - DNA, 60 bp, Xenorhabdus bovienii
  Promoter location: Contig name=SeqID_16895; Position on contig =164011..164070bp; Strand=-
tacaaacagtagacaaaaataggcttctcttttgaaatcaattttgtcatcatctgcgaa

SEQ ID NO: 14073 - DNA, 60 bp, Xenorhabdus bovienii
  Promoter location: Contig name=SeqID_16895; Position on contig =164502..164561bp; Strand=+; Gene name=DapA
tttgtgtcgttggctcacgtagatttcaaaatagatatcatttcctttataaacctaacc

SEQ ID NO: 14074 - DNA, 60 bp, Xenorhabdus bovienii
  Promoter location: Contig name=SeqID_16895; Position on contig =166535..166594bp; Strand=-; Gene name=BioA
tcatggattccttgactgagcggtgtttttcaccgctcatatttttctatacttagaata

SEQ ID NO: 14075 - DNA, 60 bp, Xenorhabdus bovienii
  Promoter location: Contig name=SeqID_16895; Position on contig =168007..168066bp; Strand=-
cggtcttattcagtaaaatttggctttacgtaagtaaacccataactaatgattcgataa

SEQ ID NO: 14076 - DNA, 60 bp, Xenorhabdus bovienii
  Promoter location: Contig name=SeqID_16895; Position on contig =168348..168407bp; Strand=-
atgcatgtcatgaccatgtgccggtgatgcgtaatgatgattattgctattttgcatgcc

SEQ ID NO: 14077 - DNA, 60 bp, Xenorhabdus bovienii
  Promoter location: Contig name=SeqID_16895; Position on contig =168636..168695bp; Strand=+; Gene name=CirA
aaataattcatttattttccttgctatacgctgtttgtaaggcaagtcaatattttttca

SEQ ID NO: 14078 - DNA, 60 bp, Xenorhabdus bovienii
  Promoter location: Contig name=SeqID_16895; Position on contig =171538..171597bp; Strand=-; Gene name=RhaT
ggcgctagtgcggtaagcaaaatattactgagtattctcgtttcctgcataatgatttcc

SEQ ID NO: 14079 - DNA, 60 bp, Xenorhabdus bovienii
  Promoter location: Contig name=SeqID_16895; Position on contig =171431..171490bp; Strand=+; Gene name=RhaT
tattcatttatttcaacaaaaagatacttgataaaaatcgtttaggctattattttaatt

SEQ ID NO: 14080 - DNA, 60 bp, Xenorhabdus bovienii
  Promoter location: Contig name=SeqID_16895; Position on contig =174797..174856bp; Strand=-; Gene name=HipB
ttagtaatagtataaatggttaaattgtaacaggacgatatggaaactaaaatcagctta

SEQ ID NO: 14081 - DNA, 60 bp, Xenorhabdus bovienii
  Promoter location: Contig name=SeqID_16895; Position on contig =174781..174840bp; Strand=+; Gene name=HipB
ctctcggtatctgaaataagctgattttagtttccatatcgtcctgttacaatttaacca

SEQ ID NO: 14082 - DNA, 60 bp, Xenorhabdus bovienii
  Promoter location: Contig name=SeqID_16895; Position on contig =176599..176658bp; Strand=-; Gene name=AprE (BS)
atagcataataattaaatccgaaatgcaagaaatctattaacttttttataacagtttcg

SEQ ID NO: 14083 - DNA, 60 bp, Xenorhabdus bovienii
  Promoter location: Contig name=SeqID_16895; Position on contig =176560..176619bp; Strand=+; Gene name=AprE (BS)
taaataaaattcaaaagtgtgactatgttatttttgtaacgaaactgttataaaaaagtt

SEQ ID NO: 14084 - DNA, 60 bp, Xenorhabdus bovienii
  Promoter location: Contig name=SeqID_16895; Position on contig =185335..185394bp; Strand=-; Gene name=LysR
tttcaaatctagtagtaatactctcttaacaaaatagcaacaagtattaaaaaaatgata

SEQ ID NO: 14085 - DNA, 60 bp, Xenorhabdus bovienii
  Promoter location: Contig name=SeqID_16895; Position on contig =185288..185347bp; Strand=+; Gene name=LysR
tactgcgctttagtgccatttcataacctcatgattatcggtatttttatcattttttta

SEQ ID NO: 14086 - DNA, 60 bp, Xenorhabdus bovienii
  Promoter location: Contig name=SeqID_16895; Position on contig =186709..186768bp; Strand=+; Gene name=AraJ
caattagatttttgtgtgtgcatttgacaatgttttgcatttttacttaaccttatatct

SEQ ID NO: 14087 - DNA, 60 bp, Xenorhabdus bovienii
  Promoter location: Contig name=SeqID_16895; Position on contig =190362..190421bp; Strand=-
tttattaacttatgattaatattttaaaaagtatgttttatatcgattaaaatagattaa

SEQ ID NO: 14088 - DNA, 60 bp, Xenorhabdus bovienii
  Promoter location: Contig name=SeqID_16895; Position on contig =190984..191043bp; Strand=-; Gene name=Crp
aatttgcgtaaaatttttaccattcaatataacatatcaatcaaacttaaattgaattaa

SEQ ID NO: 14089 - DNA, 60 bp, Xenorhabdus bovienii
  Promoter location: Contig name=SeqID_16895; Position on contig =191048..191107bp; Strand=+; Gene name=Crp
gttaaccccaaaaaaattcttttttttctcaagatgcctttttgcgtgatgatttataca

SEQ ID NO: 14090 - DNA, 60 bp, Xenorhabdus bovienii
  Promoter location: Contig name=SeqID_16895; Position on contig =191966..192025bp; Strand=+; Gene name=UspA
taagccggatcgctatattttgctgatctggctttcttttaccctgttatagttggtcat

SEQ ID NO: 14091 - DNA, 60 bp, Xenorhabdus bovienii
  Promoter location: Contig name=SeqID_16895; Position on contig =202303..202362bp; Strand=-
cgtctctgctcaaatagctagtctgttatcacataatgatcatctattaacattaacggc

SEQ ID NO: 14092 - DNA, 60 bp, Xenorhabdus bovienii
  Promoter location: Contig name=SeqID_16895; Position on contig =202575..202634bp; Strand=+
gctggcgaaatatctatatccgctacagcctgaaccacacgggcagctatactacgaaga

SEQ ID NO: 14093 - DNA, 60 bp, Xenorhabdus bovienii
  Promoter location: Contig name=SeqID_16895; Position on contig =215377..215436bp; Strand=+; Gene name=CaiA
ttaattaataatagggagtactgtattttgtacttattccggaacgttatttttgatatt

SEQ ID NO: 14094 - DNA, 60 bp, Xenorhabdus bovienii
  Promoter location: Contig name=SeqID_16895; Position on contig =220546..220605bp; Strand=-
tagtgactattttattttttattgataggttttattgatagcagtaataaaatcaacttt

SEQ ID NO: 14095 - DNA, 60 bp, Xenorhabdus bovienii
  Promoter location: Contig name=SeqID_16895; Position on contig =220545..220604bp; Strand=+
taaagttgattttattactgctatcaataaaacctatcaataaaaaataaaatagtcact

SEQ ID NO: 14096 - DNA, 60 bp, Xenorhabdus bovienii
  Promoter location: Contig name=SeqID_16895; Position on contig =221827..221886bp; Strand=+
gcacaaatgatggtttgtgcttttttatcatgaccagaacacgttttttaaataattcgt

SEQ ID NO: 14097 - DNA, 60 bp, Xenorhabdus bovienii
  Promoter location: Contig name=SeqID_16895; Position on contig =223624..223683bp; Strand=+
gagttttttttgttgtgtttttgcggtgttaatgggatttgtttttttaaacttataagt

SEQ ID NO: 14098 - DNA, 60 bp, Xenorhabdus bovienii
  Promoter location: Contig name=SeqID_16895; Position on contig =224727..224786bp; Strand=+
gcctagttattattaacagagagttaactttaattggatggaaaatttatcatttagttg

SEQ ID NO: 14099 - DNA, 60 bp, Xenorhabdus bovienii
  Promoter location: Contig name=SeqID_16895; Position on contig =225826..225885bp; Strand=+; Gene name=FimC
tggcagggatgcccaaataatacaatatagccaatgaataataattaatttaatctattc

SEQ ID NO: 14100 - DNA, 60 bp, Xenorhabdus bovienii
  Promoter location: Contig name=SeqID_16895; Position on contig =230561..230620bp; Strand=-
ataagaacttttgtctgtaaatagatatatcaatgagtgattgtaggtaaattaactaaa

SEQ ID NO: 14101 - DNA, 60 bp, Xenorhabdus bovienii
  Promoter location: Contig name=SeqID_16895; Position on contig =230331..230390bp; Strand=+
tccgaaaggctgcaattttacctcgttgcccagaggacgataacagttaaacgaataatt

SEQ ID NO: 14102 - DNA, 60 bp, Xenorhabdus bovienii
  Promoter location: Contig name=SeqID_16895; Position on contig =230638..230697bp; Strand=+; Gene name=EntF
gttcatttttatccagacatcaggttaatcaaagtcaatagttcttttattttcaggtag

SEQ ID NO: 14103 - DNA, 60 bp, Xenorhabdus bovienii
  Promoter location: Contig name=SeqID_16895; Position on contig =246376..246435bp; Strand=-; Gene name=AcpD
atgttacacttctaatattttaattaataaaaaatcaataagaatctatcctattaactt

SEQ ID NO: 14104 - DNA, 60 bp, Xenorhabdus bovienii
  Promoter location: Contig name=SeqID_16895; Position on contig =246367..246426bp; Strand=+; Gene name=AcpD
tatttcagtaagttaataggatagattcttattgattttttattaattaaaatattagaa

SEQ ID NO: 14105 - DNA, 60 bp, Xenorhabdus bovienii
  Promoter location: Contig name=SeqID_16895; Position on contig =250750..250809bp; Strand=-; Gene name=LdhA
aagtctttggttgagcatttctaaatgtttacggtcatattgttttgtactataaacaac

SEQ ID NO: 14106 - DNA, 60 bp, Xenorhabdus bovienii
  Promoter location: Contig name=SeqID_16895; Position on contig =250467..250526bp; Strand=+; Gene name=LdhA
tcattacatccttatctcttatttttaatctaagcacaacatcctgttatgatagtttca

SEQ ID NO: 14107 - DNA, 60 bp, Xenorhabdus bovienii
  Promoter location: Contig name=SeqID_16895; Position on contig =252618..252677bp; Strand=-
tcaataattaaccccaattgttcaagtgaacattgttctatttctgccacaattcagcca

SEQ ID NO: 14108 - DNA, 60 bp, Xenorhabdus bovienii
  Promoter location: Contig name=SeqID_16895; Position on contig =253042..253101bp; Strand=-
cacaccggattgccatgaatatcggattttcctctcgtttttcttgcttttatcagccaa

SEQ ID NO: 14109 - DNA, 60 bp, Xenorhabdus bovienii
  Promoter location: Contig name=SeqID_16895; Position on contig =252752..252811bp; Strand=+
cagacgaatatcgacggttctttgcttgaaaaaggggtcgcgattgatttgattttttcc

SEQ ID NO: 14110 - DNA, 60 bp, Xenorhabdus bovienii
  Promoter location: Contig name=SeqID_16895; Position on contig =254132..254191bp; Strand=-
attatatatacccaattattttaattatttacaatatttaatttttatataatgttatag

SEQ ID NO: 14111 - DNA, 60 bp, Xenorhabdus bovienii
  Promoter location: Contig name=SeqID_16895; Position on contig =257023..257082bp; Strand=-; Gene name=MinC
gttccccagaatctgggatgcgttattcttaaatataataagcatgttatagttactgaa

SEQ ID NO: 14112 - DNA, 60 bp, Xenorhabdus bovienii
  Promoter location: Contig name=SeqID_16895; Position on contig =256996..257055bp; Strand=+; Gene name=MinC
aattaacactgcgacttgcttgaataattcagtaactataacatgcttattatatttaag

SEQ ID NO: 14113 - DNA, 60 bp, Xenorhabdus bovienii
  Promoter location: Contig name=SeqID_16895; Position on contig =259781..259840bp; Strand=-
caaatccatgcctttggtaaagcggaattactccgcaataaaaccgataaaattgacgcc

SEQ ID NO: 14114 - DNA, 60 bp, Xenorhabdus bovienii
  Promoter location: Contig name=SeqID_16895; Position on contig =259551..259610bp; Strand=+
ttttttagtttcaattcggtgtctttgagttcttgctttagcagggtgattatctttgca

SEQ ID NO: 14115 - DNA, 60 bp, Xenorhabdus bovienii; identical to SEQ ID NO: 13523
  Promoter location: Contig name=SeqID_16895; Position on contig =260939..260998bp; Strand=+

SEQ ID NO: 14116 - DNA, 60 bp, Xenorhabdus bovienii
  Promoter location: Contig name=SeqID_16895; Position on contig =261942..262001bp; Strand=-
attaattcactcatttttttaccttatatgtattgaaaagacagcgatagaatagcggct

SEQ ID NO: 14117 - DNA, 60 bp, Xenorhabdus bovienii
  Promoter location: Contig name=SeqID_16895; Position on contig =261901..261960bp; Strand=+
cgttgttcctacaatccggatcgattttaccccaaaagctgagccgctattctatcgctg

SEQ ID NO: 14118 - DNA, 60 bp, Xenorhabdus bovienii
  Promoter location: Contig name=SeqID_16895; Position on contig =268046..268105bp; Strand=-
catgtcatcaataatcagtcttcgcaaaaccaagatgggtaactgtttaaagtaacgata

SEQ ID NO: 14119 - DNA, 60 bp, Xenorhabdus bovienii
  Promoter location: Contig name=SeqID_16895; Position on contig =269505..269564bp; Strand=-
ttcatgaaatatccttgttaaatcccctgattttttcattcaagtttaaaaatgttgccg

SEQ ID NO: 14120 - DNA, 60 bp, Xenorhabdus bovienii
  Promoter location: Contig name=SeqID_16895; Position on contig =269361..269420bp; Strand=+
ctggcccggctccggtgcccaattgtgccagaagcccatcacaatcttattttcactatt

SEQ ID NO: 14121 - DNA, 60 bp, Xenorhabdus bovienii
  Promoter location: Contig name=SeqID_16895; Position on contig =270074..270133bp; Strand=-
atcatataacaaacaaatatccagtttattcttactgacatctattccgacataatacat

SEQ ID NO: 14122 - DNA, 60 bp, Xenorhabdus bovienii
  Promoter location: Contig name=SeqID_16895; Position on contig =271325..271384bp; Strand=-
tttgacaaaaataaatgatcacctgatttatataaatattcagtatgtattatatattgc

SEQ ID NO: 14123 - DNA, 60 bp, Xenorhabdus bovienii
  Promoter location: Contig name=SeqID_16895; Position on contig =272215..272274bp; Strand=-
aaaccattaggctatggatactgataaccctgacaggcaaatgagtttatattacattct

SEQ ID NO: 14124 - DNA, 60 bp, Xenorhabdus bovienii
  Promoter location: Contig name=SeqID_16895; Position on contig =280202..280261bp; Strand=-
attgatttatatttgtaattattgcttaaatcgcaattgatgttggttatcattttgata

SEQ ID NO: 14125 - DNA, 60 bp, Xenorhabdus bovienii
  Promoter location: Contig name=SeqID_16895; Position on contig =280170..280229bp; Strand=+
atctaaagatatgtaactatgttgataattattatcaaaatgataaccaacatcaattgc

SEQ ID NO: 14126 - DNA, 60 bp, Xenorhabdus bovienii
  Promoter location: Contig name=SeqID_16895; Position on contig =281681..281740bp; Strand=-; Gene name=SUL1
tatatttatatttatatttatatttatataagtataggttgtttatgtaatatttatttt

SEQ ID NO: 14127 - DNA, 60 bp, Xenorhabdus bovienii
  Promoter location: Contig name=SeqID_16895; Position on contig =284092..284151bp; Strand=-
actgagaggccacgggtagggttgagagtttttatttaacaccgcattataatgcgctcc

SEQ ID NO: 14128 - DNA, 60 bp, Xenorhabdus bovienii
  Promoter location: Contig name=SeqID_16895; Position on contig =283950..284009bp; Strand=+
gggtaacgcaaccgcagcaactgagaggcctgaccgtatatcatgactaaaatactcttt

SEQ ID NO: 14129 - DNA, 60 bp, Xenorhabdus bovienii
  Promoter location: Contig name=SeqID_16895; Position on contig =286281..286340bp; Strand=-
atacagatgtttttgaatcatgattgaatatgatagtcatttgcatttaaactagtagct

SEQ ID NO: 14130 - DNA, 60 bp, Xenorhabdus bovienii
  Promoter location: Contig name=SeqID_16895; Position on contig =286826..286885bp; Strand=-; Gene name=Cls
cagttcagtactgaataaaaggttgtcatacgtggcaatcaatcctgtttatttaagtat

SEQ ID NO: 14131 - DNA, 60 bp, Xenorhabdus bovienii
  Promoter location: Contig name=SeqID_16895; Position on contig =286618..286677bp; Strand=+; Gene name=Cls
ggtttaacacaacgctgtattgaatctaagtcattagttaatagatatataattgattca

SEQ ID NO: 14132 - DNA, 60 bp, Xenorhabdus bovienii
  Promoter location: Contig name=SeqID_16895; Position on contig =288384..288443bp; Strand=+
tggggctgtgattagtagtaagggtattcaatcactacagatcatgttttaatttctctt

SEQ ID NO: 14133 - DNA, 60 bp, Xenorhabdus bovienii
  Promoter location: Contig name=SeqID_16895; Position on contig =294519..294578bp; Strand=-; Gene name=OppA
cttttggatacggaaaacaaccattccaaaaagtgactatggcttttaaaaatcggatga

SEQ ID NO: 14134 - DNA, 60 bp, Xenorhabdus bovienii
  Promoter location: Contig name=SeqID_16895; Position on contig =297543..297602bp; Strand=-; Gene name=EutG
aacgtaacgaaaaaatattttttttacggtattttcttaagtgttgttaaaagttttgtt

SEQ ID NO: 14135 - DNA, 60 bp, Xenorhabdus bovienii
  Promoter location: Contig name=SeqID_16895; Position on contig =297836..297895bp; Strand=+; Gene name=EutG
taaatatcaggcaaggtgcataattaatatatcaactcattaatttagataattttttaa

SEQ ID NO: 14136 - DNA, 60 bp, Xenorhabdus bovienii
  Promoter location: Contig name=SeqID_16895; Position on contig =301939..301998bp; Strand=+; Gene name=Hns
ctgagaaagtaaattcactattgcagaaaataaaatagcattctattattatccgtacat

SEQ ID NO: 14137 - DNA, 60 bp, Xenorhabdus bovienii
  Promoter location: Contig name=SeqID_16895; Position on contig =306105..306164bp; Strand=-; Gene name=CheY
aatgtaattaaacgccagcgcactgtaaatctagttgatttagctggtatactcgggcgc

SEQ ID NO: 14138 - DNA, 60 bp, Xenorhabdus bovienii
  Promoter location: Contig name=SeqID_16895; Position on contig =307386..307445bp; Strand=-
cagcaatgtacgaaaagtgagtcgctgccacaagggcatatttttgtcaaaataactccg

SEQ ID NO: 14139 - DNA, 60 bp, Xenorhabdus bovienii
  Promoter location: Contig name=SeqID_16895; Position on contig =307312..307371bp; Strand=+
aataggtcattactatttgtactcttacatatctttgcagtatcggtcatattaacagca

SEQ ID NO: 14140 - DNA, 60 bp, Xenorhabdus bovienii
  Promoter location: Contig name=SeqID_16895; Position on contig =310301..310360bp; Strand=-; Gene name=XthA
aagtttgatttagcggttacctgatgagaaggccatttcaaggaaattattttagccaca

SEQ ID NO: 14141 - DNA, 60 bp, Xenorhabdus bovienii
  Promoter location: Contig name=SeqID_16895; Position on contig =315343..315402bp; Strand=+; Gene name=SppA
taatttcctcctgaataagataatttgtcacggctcaacattctctgtttaatcgttact

SEQ ID NO: 14142 - DNA, 60 bp, Xenorhabdus bovienii
  Promoter location: Contig name=SeqID_16895; Position on contig =317449..317508bp; Strand=+; Gene name=AnsB
ttaaagcctgatccttacatcaggctttttttattccatatactccctataatccggctg

SEQ ID NO: 14143 - DNA, 60 bp, Xenorhabdus bovienii
  Promoter location: Contig name=SeqID_16897; Position on contig =948..1007bp; Strand=-; Gene name=Abc
attgagcgcgctccttgttgaaataccttatttatctgagtcagtcttatcatttttttc

SEQ ID NO: 14144 - DNA, 60 bp, Xenorhabdus bovienii
  Promoter location: Contig name=SeqID_16897; Position on contig =835..894bp; Strand=+; Gene name=Abc
aaccagcatttaatttattcgcagttgacttagacgtctagacgccttaacatccacatt

SEQ ID NO: 14145 - DNA, 60 bp, Xenorhabdus bovienii
  Promoter location: Contig name=SeqID_16897; Position on contig =2669..2728bp; Strand=+; Gene name=NlpA
taagggcttatacctaaaagcctcatgagtagtacgcagtagcctggtaagacaggttct

SEQ ID NO: 14146 - DNA, 60 bp, Xenorhabdus bovienii
  Promoter location: Contig name=SeqID_16897; Position on contig =3573..3632bp; Strand=+
ctttcatcttcagtcaatcaagattaaaatcatcgggcgggtattattatccgcccattt

SEQ ID NO: 14147 - DNA, 60 bp, Xenorhabdus bovienii
  Promoter location: Contig name=SeqID_16897; Position on contig =4869..4928bp; Strand=+; Gene name=ProS
actcgctggtagactagcggtttatctttattttctgggttgggtggcacaatcttgtcg

SEQ ID NO: 14148 - DNA, 60 bp, Xenorhabdus bovienii
  Promoter location: Contig name=SeqID_16897; Position on contig =7583..7642bp; Strand=-
aagtagattaaatctaagtcttatcattacgcaacgaaattacatcatattatttgattt

SEQ ID NO: 14149 - DNA, 60 bp, Xenorhabdus bovienii
  Promoter location: Contig name=SeqID_16897; Position on contig =11714..11773bp; Strand=-; Gene name=AccA
tattatcattctgacaacattgggatgaaataggctgttttatcagctagactcgaaaaa

SEQ ID NO: 14150 - DNA, 60 bp, Xenorhabdus bovienii
  Promoter location: Contig name=SeqID_16897; Position on contig =19446..19505bp; Strand=-; Gene name=LpxD
cctgataactctgcatttggagttaacgcaggccgtgtcgttaatactatgattcttata

SEQ ID NO: 14151 - DNA, 60 bp, Xenorhabdus bovienii
  Promoter location: Contig name=SeqID_16897; Position on contig =21112..21171bp; Strand=-
aatcgtttttggcggaaaatcgccttattattagataaggtgattgttaattttccaaca

SEQ ID NO: 14152 - DNA, 60 bp, Xenorhabdus bovienii
  Promoter location: Contig name=SeqID_16897; Position on contig =26771..26830bp; Strand=-
gaatcttgctaataagtatatatttgtttgcgttttggcaaatggtatagttcgcgggta

SEQ ID NO: 14153 - DNA, 60 bp, Xenorhabdus bovienii
  Promoter location: Contig name=SeqID_16897; Position on contig =26538..26597bp; Strand=+
gtctgggtaacgttagcaatgagttacagtcactggaagatatcactcaaaatgatcctt

SEQ ID NO: 14154 - DNA, 60 bp, Xenorhabdus bovienii
  Promoter location: Contig name=SeqID_16897; Position on contig =28061..28120bp; Strand=-; Gene name=Frr
gcatcacatttctttctcaagcgatggacataccgatcgggacggctcaaactattgaca

SEQ ID NO: 14155 - DNA, 60 bp, Xenorhabdus bovienii
  Promoter location: Contig name=SeqID_16897; Position on contig =29625..29684bp; Strand=-; Gene name=Tsf
ttttatttcatgatgaatttttacatctgggctgcatagcatggatgtgtaattgtaata

SEQ ID NO: 14156 - DNA, 60 bp, Xenorhabdus bovienii
  Promoter location: Contig name=SeqID_16897; Position on contig =30601..30660bp; Strand=-; Gene name=RpsB
tgtcacggccccctttacatatctgatatagaactatccacgcggaatattatcttcccg

SEQ ID NO: 14157 - DNA, 60 bp, Xenorhabdus bovienii
  Promoter location: Contig name=SeqID_16897; Position on contig =31593..31652bp; Strand=-
ggcattctgcataattgtttctgccagattcggtttttcagcgatgctaaattaactcat

SEQ ID NO: 14158 - DNA, 60 bp, Xenorhabdus bovienii
  Promoter location: Contig name=SeqID_16897; Position on contig =32661..32720bp; Strand=+; Gene name=GlnD
agaaatcacgtagataagacggcgttgataatcgaagcccttgtacataaactgtcccca

SEQ ID NO: 14159 - DNA, 60 bp, Xenorhabdus bovienii
  Promoter location: Contig name=SeqID_16897; Position on contig =38476..38535bp; Strand=-
tgtttcattttatcctgccgcaagttttccgatgaaatcatatcagtgatactcttactg

SEQ ID NO: 14160 - DNA, 60 bp, Xenorhabdus bovienii
  Promoter location: Contig name=SeqID_16897; Position on contig =39545..39604bp; Strand=-
gggtgagtgaacgtagccaacaaagcggcaacttgtaagacgacaggtataaacctaaaa

SEQ ID NO: 14161 - DNA, 60 bp, Xenorhabdus bovienii
  Promoter location: Contig name=SeqID_16897; Position on contig =41760..41819bp; Strand=-
caatccgctcatcgcattattttttggatcattttatgaatggcaactattatttatagt

SEQ ID NO: 14162 - DNA, 60 bp, Xenorhabdus bovienii
  Promoter location: Contig name=SeqID_16897; Position on contig =41696..41755bp; Strand=+
cccatgtcattatagttactattcataacagttaccgccataataattacaatataatat

SEQ ID NO: 14163 - DNA, 60 bp, Xenorhabdus bovienii
  Promoter location: Contig name=SeqID_16897; Position on contig =42412..42471bp; Strand=-; Gene name=GlcD
gatgagttcatattttttataaccttaataatgaaattattagtttggattctttttcgg

SEQ ID NO: 14164 - DNA, 60 bp, Xenorhabdus bovienii
  Promoter location: Contig name=SeqID_16897; Position on contig =42337..42396bp; Strand=+; Gene name=GlcD
atcgagtaacatcgaacctctttcacaaaaaatatattacaccccgttagaaaaaaattc

SEQ ID NO: 14165 - DNA, 60 bp, Xenorhabdus bovienii
  Promoter location: Contig name=SeqID_16897; Position on contig =45027..45086bp; Strand=+
taaaaatacgaaccattgaaattccttgatacactacaacctatctcagttgcaattatt

SEQ ID NO: 14166 - DNA, 60 bp, Xenorhabdus bovienii
  Promoter location: Contig name=SeqID_16897; Position on contig =52878..52937bp; Strand=-
ttatgacattcagtggcacgcattcagtgacaaagtaaatgcagtgacaaaataaaacaa

SEQ ID NO: 14167 - DNA, 60 bp, Xenorhabdus bovienii
  Promoter location: Contig name=SeqID_16897; Position on contig =52826..52885bp; Strand=+
ttcatcattaactgaagcaaaaacgatttatttacccagtaattcgttatttttgtttta

SEQ ID NO: 14168 - DNA, 60 bp, Xenorhabdus bovienii
  Promoter location: Contig name=SeqID_16897; Position on contig =55029..55088bp; Strand=-
tttattaaaaaataatactgtttttttgttatcaaaaaaattaattttaaaattaataat

SEQ ID NO: 14169 - DNA, 60 bp, Xenorhabdus bovienii
  Promoter location: Contig name=SeqID_16897; Position on contig =57995..58054bp; Strand=-; Gene name=CsdB
aattgctggcgaaatttttctgagtcaaaggatttcataaacggtgttaatttcaacgtt

SEQ ID NO: 14170 - DNA, 60 bp, Xenorhabdus bovienii
  Promoter location: Contig name=SeqID_16897; Position on contig =61851..61910bp; Strand=-
agcactatttgttgtattttttgttcatttatgggtttatggaacggtaatctatttttt

SEQ ID NO: 14171 - DNA, 60 bp, Xenorhabdus bovienii
  Promoter location: Contig name=SeqID_16897; Position on contig =61633..61692bp; Strand=+
atttggaatattaacaagctggagatcttcgctgatgcggccatctttatactgctgccc

SEQ ID NO: 14172 - DNA, 60 bp, Xenorhabdus bovienii
  Promoter location: Contig name=SeqID_16897; Position on contig =63919..63978bp; Strand=-; Gene name=ArgB
tttcatgaaacctcctaatgaatttttattcacaatttttgtatttttattcttttttgt

SEQ ID NO: 14173 - DNA, 60 bp, Xenorhabdus bovienii
  Promoter location: Contig name=SeqID_16897; Position on contig =63815..63874bp; Strand=+; Gene name=ArgB
gcgagtggctgtcatcaaaaaaagcgttttatgctctctcaatttattaatatcaatata

SEQ ID NO: 14174 - DNA, 60 bp, Xenorhabdus bovienii
  Promoter location: Contig name=SeqID_16897; Position on contig =79175..79234bp; Strand=-
aatattaaaaaatagcgacttgccatttctgcgcaccgctccgcaaataaaatgtaaacg

SEQ ID NO: 14175 - DNA, 60 bp, Xenorhabdus bovienii
  Promoter location: Contig name=SeqID_16897; Position on contig =78915..78974bp; Strand=+
aaacgcaggcggttttgatattgcccccaatgatataacccccaggatagactcattgaa

SEQ ID NO: 14176 - DNA, 60 bp, Xenorhabdus bovienii
  Promoter location: Contig name=SeqID_16897; Position on contig =81022..81081bp; Strand=-; Gene name=PtsP
tactgtctgtgatattatttgcgattatttgtcttaagacgtacagataatattcattca

SEQ ID NO: 14177 - DNA, 60 bp, Xenorhabdus bovienii
  Promoter location: Contig name=SeqID_16897; Position on contig =84309..84368bp; Strand=-; Gene name=TbpA
ttaatggcaggtcccggcccccattcagaagcaaatgaatcataagtgtaaattgtcagt

SEQ ID NO: 14178 - DNA, 60 bp, Xenorhabdus bovienii
  Promoter location: Contig name=SeqID_16897; Position on contig =84100..84159bp; Strand=+; Gene name=TbpA
tgatccggctagtaccgacgtaggaatttgagacgctaatcattgatataaaagtatttt

SEQ ID NO: 14179 - DNA, 60 bp, Xenorhabdus bovienii
  Promoter location: Contig name=SeqID_16897; Position on contig =87533..87592bp; Strand=+
agccatgcccctgcctgaagtgccattgattcagatacagcaatttttattatcttatgc

SEQ ID NO: 14180 - DNA, 60 bp, Xenorhabdus bovienii
  Promoter location: Contig name=SeqID_16897; Position on contig =89058..89117bp; Strand=+
taattatttttcaatatgaatcgcatttttttaactggaaataatggtatactccaataa

SEQ ID NO: 14181 - DNA, 60 bp, Xenorhabdus bovienii
  Promoter location: Contig name=SeqID_16897; Position on contig =91591..91650bp; Strand=+; Gene name=Bax
aactttatgaatggtgaataatggtagccagatattgattgttctgctaatattcgtatg

SEQ ID NO: 14182 - DNA, 60 bp, Xenorhabdus bovienii
  Promoter location: Contig name=SeqID_16897; Position on contig =92705..92764bp; Strand=+; Gene name=DltB (BS)
attatttttttataacttctctgcctgctacctattgtaaacacaagtaaattccatact

SEQ ID NO: 14183 - DNA, 60 bp, Xenorhabdus bovienii
  Promoter location: Contig name=SeqID_16897; Position on contig =98954..99013bp; Strand=-; Gene name=PurR
tcttcaattgcgataagcttcacattttcttttttttccgatcctgattaattgctcgcg

SEQ ID NO: 14184 - DNA, 60 bp, Xenorhabdus bovienii
  Promoter location: Contig name=SeqID_16897; Position on contig =100080..100139bp; Strand=-; Gene name=PurR
ccagcattttttgctaaaaatcgtattgttatggtgtgtaaatgtgttaaaaccgcgttt

SEQ ID NO: 14185 - DNA, 60 bp, Xenorhabdus bovienii
  Promoter location: Contig name=SeqID_16897; Position on contig =104764..104823bp; Strand=-
aacactctaatttcatccatctgttttataacaatttttttgacctccaaaattctacca

SEQ ID NO: 14186 - DNA, 60 bp, Xenorhabdus bovienii
  Promoter location: Contig name=SeqID_16897; Position on contig =106362..106421bp; Strand=+
aattcactattaattatagtctatagtcggatgatttatagcacttgtatcatagtaatt

SEQ ID NO: 14187 - DNA, 60 bp, Xenorhabdus bovienii
  Promoter location: Contig name=SeqID_16897; Position on contig =107685..107744bp; Strand=+; Gene name=AraJ
gtaaaagagttcatctaatacatttttccttgcttcaagattcagtatagaattcgtttt

SEQ ID NO: 14188 - DNA, 60 bp, Xenorhabdus bovienii
  Promoter location: Contig name=SeqID_16897; Position on contig =110396..110455bp; Strand=-
gaacactctaatttcatccatctgttttataacaatttttttacctccaaaattctacca

SEQ ID NO: 14189 - DNA, 60 bp, Xenorhabdus bovienii
  Promoter location: Contig name=SeqID_16897; Position on contig =112300..112359bp; Strand=-
acccaacgagagagcgtgggatgatcaacggtaaccccgcactcagccataatttctttc

SEQ ID NO: 14190 - DNA, 60 bp, Xenorhabdus bovienii
  Promoter location: Contig name=SeqID_16897; Position on contig =111889..111948bp; Strand=+
tgggatcaatctatgaggtaaaagttcaataacgagggggggcgggttaaaatatttgtg

SEQ ID NO: 14191 - DNA, 60 bp, Xenorhabdus bovienii
  Promoter location: Contig name=SeqID_16897; Position on contig =113765..113824bp; Strand=-
cgatcattccattataatgggtcttgtgtgtatctttaaaaatgctatatacttatgcta

SEQ ID NO: 14192 - DNA, 60 bp, Xenorhabdus bovienii
  Promoter location: Contig name=SeqID_16897; Position on contig =114147..114206bp; Strand=-; Gene name=GloA
cgtattggcagagaacatataatagtgattgattactgacaagattgtattatttttttt

SEQ ID NO: 14193 - DNA, 60 bp, Xenorhabdus bovienii
  Promoter location: Contig name=SeqID_16897; Position on contig =114665..114724bp; Strand=+; Gene name=GloA
cttttcacatttatcccttcatatagttctaaatgtgagcgtcattccataatctaattg

SEQ ID NO: 14194 - DNA, 60 bp, Xenorhabdus bovienii
  Promoter location: Contig name=SeqID_16897; Position on contig =123095..123154bp; Strand=-
tcgcgcttcatcaccccaaattggcagaatgcgagattctgattttgtagaatgagataa

SEQ ID NO: 14195 - DNA, 60 bp, Xenorhabdus bovienii
  Promoter location: Contig name=SeqID_16897; Position on contig =122866..122925bp; Strand=+
agttactcatttcccagcattattcgttaacgggcttaacataagctatgataatctact

SEQ ID NO: 14196 - DNA, 60 bp, Xenorhabdus bovienii
  Promoter location: Contig name=SeqID_16897; Position on contig =126765..126824bp; Strand=+
aatctggcatagtttcaacaacctttctatttcgggaagttttgtcttccaattctaaaa

SEQ ID NO: 14197 - DNA, 60 bp, Xenorhabdus bovienii
  Promoter location: Contig name=SeqID_16897; Position on contig =128348..128407bp; Strand=-; Gene name=LysR
tgagccgatctagcaatccacatattctgtgaacctcatagggtgcgtataatttaactc

SEQ ID NO: 14198 - DNA, 60 bp, Xenorhabdus bovienii
  Promoter location: Contig name=SeqID_16897; Position on contig =128270..128329bp; Strand=+; Gene name=LysR
gtttcacccgtgtgacttgtggttgatctcacttaactgccctcctgtaaaattctttat

SEQ ID NO: 14199 - DNA, 60 bp, Xenorhabdus bovienii
  Promoter location: Contig name=SeqID_16897; Position on contig =138387..138446bp; Strand=-
aaatatattttataaattgttaaatgtaggataattcgccacaattgtaaatttatatta

SEQ ID NO: 14200 - DNA, 60 bp, Xenorhabdus bovienii
  Promoter location: Contig name=SeqID_16897; Position on contig =139234..139293bp; Strand=-
cctactctctctttaaatatataaattcacattctattgctaaatgtaaaaatatatagt

SEQ ID NO: 14201 - DNA, 60 bp, Xenorhabdus bovienii
  Promoter location: Contig name=SeqID_16897; Position on contig =139627..139686bp; Strand=-; Gene name=ET17
atataatgataagtaaatgattaatttaaaatattaataatccagtattaaatatatata

SEQ ID NO: 14202 - DNA, 60 bp, Xenorhabdus bovienii
  Promoter location: Contig name=SeqID_16897; Position on contig =139810..139869bp; Strand=+; Gene name=ET17
gtaatttaattagttaacaaaaggataaatcaacgtcatgacattgatgtttttctctat

SEQ ID NO: 14203 - DNA, 60 bp, Xenorhabdus bovienii
  Promoter location: Contig name=SeqID_16897; Position on contig =142432..142491bp; Strand=-
aaaatgatgaaattttactgagtatttataaaaaatatcaaattaattatggtattaagg

SEQ ID NO: 14204 - DNA, 60 bp, Xenorhabdus bovienii
  Promoter location: Contig name=SeqID_16897; Position on contig =142720..142779bp; Strand=+
caattagttcagaatactgattattaagttagattatattaacaaaataaaataattcat

SEQ ID NO: 14205 - DNA, 60 bp, Xenorhabdus bovienii
  Promoter location: Contig name=SeqID_16897; Position on contig =145140..145199bp; Strand=-
cagaaaggactatcttcgatttcattagtggacgcggtaagtcagtgtattgtattaccg

SEQ ID NO: 14206 - DNA, 60 bp, Xenorhabdus bovienii
  Promoter location: Contig name=SeqID_16897; Position on contig =144878..144937bp; Strand=+
ttcccccatgattattaactttgaattgaataagacatgactactgttgcactaactgca

SEQ ID NO: 14207 - DNA, 60 bp, Xenorhabdus bovienii
  Promoter location: Contig name=SeqID_16897; Position on contig =146663..146722bp; Strand=-
aagcaatcgtttatctgaagcattttattgccctctttaataattaataaaatataactc

SEQ ID NO: 14208 - DNA, 60 bp, Xenorhabdus bovienii
  Promoter location: Contig name=SeqID_16897; Position on contig =146598..146657bp; Strand=+
aaacatcttcaaaaataagtaattaatatagctccccatttaattcataacattaattaa

SEQ ID NO: 14209 - DNA, 60 bp, Xenorhabdus bovienii
  Promoter location: Contig name=SeqID_16897; Position on contig =148600..148659bp; Strand=-
tttttatctgatatcagaaaggcctttacaatctcagaattcatggataaagtaccgccg

SEQ ID NO: 14210 - DNA, 60 bp, Xenorhabdus bovienii
  Promoter location: Contig name=SeqID_16897; Position on contig =149032..149091bp; Strand=-
tctagatgatataaatgatagtgattgtcaatcttggcaagaatgggaaaaattacgtga

SEQ ID NO: 14211 - DNA, 60 bp, Xenorhabdus bovienii
  Promoter location: Contig name=SeqID_16897; Position on contig =152346..152405bp; Strand=-
ggatcggagaaataaggccagaggttgtgatactcgatcacttggcatagaattaaaacg

SEQ ID NO: 14212 - DNA, 60 bp, Xenorhabdus bovienii
  Promoter location: Contig name=SeqID_16897; Position on contig =152374..152433bp; Strand=+
tatcacaacctctggccttatttctccgatcccgtcctcaaaacagatataacttgcacc

SEQ ID NO: 14213 - DNA, 60 bp, Xenorhabdus bovienii
  Promoter location: Contig name=SeqID_16897; Position on contig =154654..154713bp; Strand=-; Gene name=PotC
aggttggtcacgcctttacttcatttgcaacatcgctttttaccctgaaaaatcagaatt

SEQ ID NO: 14214 - DNA, 60 bp, Xenorhabdus bovienii
  Promoter location: Contig name=SeqID_16897; Position on contig =157631..157690bp; Strand=-
gcgcgatgttatcatttatgaaatgataacaaaaaatgacatattgttattgtttcggct

SEQ ID NO: 14215 - DNA, 60 bp, Xenorhabdus bovienii
  Promoter location: Contig name=SeqID_16897; Position on contig =157597..157656bp; Strand=+
gcgcgcataataaacgcagtaagctgaaattgaaagccgaaacaataacaatatgtcatt

SEQ ID NO: 14216 - DNA, 60 bp, Xenorhabdus bovienii
  Promoter location: Contig name=SeqID_16897; Position on contig =158085..158144bp; Strand=+; Gene name=PtsN
gagaatgaataaagattatttttacttattcgacaataaaaataacgtaaattaactcat

SEQ ID NO: 14217 - DNA, 60 bp, Xenorhabdus bovienii
  Promoter location: Contig name=SeqID_16897; Position on contig =163291..163350bp; Strand=-; Gene name=WecD
tgttatatttcggtacttaacgtttcatgtattactccgcgcctccagatgatttttcag

SEQ ID NO: 14218 - DNA, 60 bp, Xenorhabdus bovienii
  Promoter location: Contig name=SeqID_16897; Position on contig =164227..164286bp; Strand=-
tgataactgtattgtatttttgtatgccattatggcatacaatttggtataaattgattt

SEQ ID NO: 14219 - DNA, 60 bp, Xenorhabdus bovienii
  Promoter location: Contig name=SeqID_16897; Position on contig =164121..164180bp; Strand=+
gatgttcgcgcaaccaaacgggtttctttacgctcagaataagtgcccataatttcacct

SEQ ID NO: 14220 - DNA, 60 bp, Xenorhabdus bovienii
  Promoter location: Contig name=SeqID_16897; Position on contig =165418..165477bp; Strand=-; Gene name=LysR
ataaccatttcagctcaatgttattcagcataatgctaccctattaatataatgattatt

SEQ ID NO: 14221 - DNA, 60 bp, Xenorhabdus bovienii
  Promoter location: Contig name=SeqID_16897; Position on contig =168273..168332bp; Strand=-
catgaagtggatgaaaaacttgcttaacctgaattttctgtccgtggcattatgcagcaa

SEQ ID NO: 14222 - DNA, 60 bp, Xenorhabdus bovienii
  Promoter location: Contig name=SeqID_16897; Position on contig =168232..168291bp; Strand=+
tcatcgtcagtcactaaagcgatatcagtgataccgtacacttgctgcataatgccacgg

SEQ ID NO: 14223 - DNA, 60 bp, Xenorhabdus bovienii
  Promoter location: Contig name=SeqID_16897; Position on contig =171026..171085bp; Strand=-
ttgtttataatgcaattttttgattttattgactctataaaattatttaatatggttttt

SEQ ID NO: 14224 - DNA, 60 bp, Xenorhabdus bovienii
  Promoter location: Contig name=SeqID_16897; Position on contig =171011..171070bp; Strand=+
tctaagagaaaaattaaaaaccatattaaataattttatagagtcaataaaatcaaaaaa

SEQ ID NO: 14225 - DNA, 60 bp, Xenorhabdus bovienii
  Promoter location: Contig name=SeqID_16897; Position on contig =173560..173619bp; Strand=+; Gene name=Pnp
ataattatttcactaacccaaacaaccacattttcattgagcgctattaatatgaatgat

SEQ ID NO: 14226 - DNA, 60 bp, Xenorhabdus bovienii
  Promoter location: Contig name=SeqID_16897; Position on contig =174893..174952bp; Strand=+
atcagccacaacgtatgacactcgtagtgatcggcaagctcccgcggtaatatacaagct

SEQ ID NO: 14227 - DNA, 60 bp, Xenorhabdus bovienii
  Promoter location: Contig name=SeqID_16897; Position on contig =175676..175735bp; Strand=+
gtcacaatgatgaaataacatcggttgaatacaaaaaaacagtgggaagagtctatgaag

SEQ ID NO: 14228 - DNA, 60 bp, Xenorhabdus bovienii
  Promoter location: Contig name=SeqID_16897; Position on contig =176600..176659bp; Strand=-
acttgataaacccaaactgctgagacattgccccgaagttcatgggtaatctttttcatc

SEQ ID NO: 14229 - DNA, 60 bp, Xenorhabdus bovienii
  Promoter location: Contig name=SeqID_16897; Position on contig =178607..178666bp; Strand=-; Gene name=InsB
aatccgttttacctatcgataatgtgttaataaggctcgtttttggttattttttgattt

SEQ ID NO: 14230 - DNA, 60 bp, Xenorhabdus bovienii
  Promoter location: Contig name=SeqID_16897; Position on contig =179622..179681bp; Strand=-
gtatcaatacggtgatgcggacattaaaaaactctcgccaaaacaagtaacatcgcgaca

SEQ ID NO: 14231 - DNA, 60 bp, Xenorhabdus bovienii
  Promoter location: Contig name=SeqID_16897; Position on contig =179971..180030bp; Strand=+
tatttaaaaaataatcattcatacatatttaatcaatgtgatcaaggtaacatttattta

SEQ ID NO: 14232 - DNA, 60 bp, Xenorhabdus bovienii
  Promoter location: Contig name=SeqID_16897; Position on contig =183556..183615bp; Strand=-; Gene name=XerC
tgtttaatatacgatattaattacgattttacagcgttcttgtcaattatactaggatgt

SEQ ID NO: 14233 - DNA, 60 bp, Xenorhabdus bovienii
  Promoter location: Contig name=SeqID_16897; Position on contig =184882..184941bp; Strand=+
atagattgcaatggacgtaagttgagtgaaaacgcgagtaagggattgcagaatggggat

SEQ ID NO: 14234 - DNA, 60 bp, Xenorhabdus bovienii
  Promoter location: Contig name=SeqID_16897; Position on contig =185324..185383bp; Strand=+; Gene name=AmpC
acaatcatgtctattatcggctatatttttataggtatccttgtgggtatcattattggc

SEQ ID NO: 14235 - DNA, 60 bp, Xenorhabdus bovienii
  Promoter location: Contig name=SeqID_16897; Position on contig =189179..189238bp; Strand=-; Gene name=PepB
ctccatgcgttctcctgaatcttaaagacaaagacggatacaatcgctaaaatatcacgt

SEQ ID NO: 14236 - DNA, 60 bp, Xenorhabdus bovienii
  Promoter location: Contig name=SeqID_16897; Position on contig =189003..189062bp; Strand=+; Gene name=PepB
cgtcgtatatctaccatttatatgcatcagtttggcttccccattgctaaaatgatacca

SEQ ID NO: 14237 - DNA, 60 bp, Xenorhabdus bovienii
  Promoter location: Contig name=SeqID_16897; Position on contig =190918..190977bp; Strand=-; Gene name=HolC
gtggctgtaattcatcagaagacgatgattgttcctgtgagagcttttccaataaataga

SEQ ID NO: 14238 - DNA, 60 bp, Xenorhabdus bovienii
  Promoter location: Contig name=SeqID_16897; Position on contig =190815..190874bp; Strand=+; Gene name=HolC
ggaattaagggtattgcggctgcaatacccttttgtatcgcttttcccatcatttttctg

SEQ ID NO: 14239 - DNA, 60 bp, Xenorhabdus bovienii
  Promoter location: Contig name=SeqID_16897; Position on contig =194562..194621bp; Strand=+; Gene name=ArtI
taacattatcttctatgcaatgcctttgtcattgacgttatattgggaataattccaaaa

SEQ ID NO: 14240 - DNA, 60 bp, Xenorhabdus bovienii
  Promoter location: Contig name=SeqID_16897; Position on contig =196335..196394bp; Strand=+; Gene name=ArtM
tctgtagctaaacccgctattctgatcagataggctctgatatgttgtataaatatgtct

SEQ ID NO: 14241 - DNA, 60 bp, Xenorhabdus bovienii
  Promoter location: Contig name=SeqID_16897; Position on contig =198780..198839bp; Strand=+; Gene name=WecD
taatagattcagcaagtttatcctgtttacttatttgttttttcaattaatatcaagctg

SEQ ID NO: 14242 - DNA, 60 bp, Xenorhabdus bovienii
  Promoter location: Contig name=SeqID_16897; Position on contig =200164..200223bp; Strand=-
aaaatggattcatactgtattttctccattagagtgatattgaatttatattcaatatat

SEQ ID NO: 14243 - DNA, 60 bp, Xenorhabdus bovienii
  Promoter location: Contig name=SeqID_16897; Position on contig =199831..199890bp; Strand=+
ggctttttccaaaagatcgaagttttccgccgaaaaatggtgctcaataatataaagcgc

SEQ ID NO: 14244 - DNA, 60 bp, Xenorhabdus bovienii
  Promoter location: Contig name=SeqID_16897; Position on contig =200118..200177bp; Strand=+; Gene name=ArgF
atgacaaatacacatcacaggggttgtaattgaattttttatcgatatatattgaatata

SEQ ID NO: 14245 - DNA, 60 bp, Xenorhabdus bovienii
  Promoter location: Contig name=SeqID_16897; Position on contig =202563..202622bp; Strand=-; Gene name=TauD
acatttgtttgttgatatatttatctaacataacatattgttattaatataataatttta

SEQ ID NO: 14246 - DNA, 60 bp, Xenorhabdus bovienii
  Promoter location: Contig name=SeqID_16897; Position on contig =203220..203279bp; Strand=-
attaatctattgtttatttagcctttttattttttaatttaaaggttgataattttattg

SEQ ID NO: 14247 - DNA, 60 bp, Xenorhabdus bovienii
  Promoter location: Contig name=SeqID_16897; Position on contig =203236..203295bp; Strand=+
ctttaaattaaaaaataaaaaggctaaataaacaatagattaatttataaaattgaataa

SEQ ID NO: 14248 - DNA, 60 bp, Xenorhabdus bovienii
  Promoter location: Contig name=SeqID_16897; Position on contig =204738..204797bp; Strand=-
ttggcggttggctattttgattactggtagctctatgcacttttagctataatagctatt

SEQ ID NO: 14249 - DNA, 60 bp, Xenorhabdus bovienii
  Promoter location: Contig name=SeqID_16897; Position on contig =204679..204738bp; Strand=+
ttcttagctagttgtgcgggaataatttccatacatcacctaccgtctaaaatggctcga

SEQ ID NO: 14250 - DNA, 60 bp, Xenorhabdus bovienii
  Promoter location: Contig name=SeqID_16897; Position on contig =205658..205717bp; Strand=-; Gene name=KptA
gatgaaacaccccataaattaagtcttgtaaatgctttttttaatgatattttggaaaaa

SEQ ID NO: 14251 - DNA, 60 bp, Xenorhabdus bovienii
  Promoter location: Contig name=SeqID_16897; Position on contig =208971..209030bp; Strand=-; Gene name=PspF
ttcatgctcttccctgtgattcgattatctaattttataaacaacgatataaaaagataa

SEQ ID NO: 14252 - DNA, 60 bp, Xenorhabdus bovienii
  Promoter location: Contig name=SeqID_16897; Position on contig =208924..208983bp; Strand=+; Gene name=PspF
ttttattttcacttgtttttggtgattgtttttacagtcagtttttcttatctttttata

SEQ ID NO: 14253 - DNA, 60 bp, Xenorhabdus bovienii
  Promoter location: Contig name=SeqID_16897; Position on contig =211985..212044bp; Strand=-
tttaatatctgtttttatgattgaattcattattgaccctttggttttttaattaaaaat

SEQ ID NO: 14254 - DNA, 60 bp, Xenorhabdus bovienii
  Promoter location: Contig name=SeqID_16897; Position on contig =211860..211919bp; Strand=+
ttggtaggtaataaataaatatactgaaggaaattataaataaaaattaacattaaataa

SEQ ID NO: 14255 - DNA, 60 bp, Xenorhabdus bovienii
  Promoter location: Contig name=SeqID_16897; Position on contig =216999..217058bp; Strand=+; Gene name=CaiC
atatatctgccataaattatatagtttcacaaataatcataatgtagtaaattattttat

SEQ ID NO: 14256 - DNA, 60 bp, Xenorhabdus bovienii
  Promoter location: Contig name=SeqID_16897; Position on contig =222525..222584bp; Strand=+
tgattgatctgttgaataatatgtttcctggattattccttccaggaaacactataatca

SEQ ID NO: 14257 - DNA, 60 bp, Xenorhabdus bovienii
  Promoter location: Contig name=SeqID_16897; Position on contig =223125..223184bp; Strand=+
ttatttatcgaaaccattccatttatatttaattacatcaagttattataatataaatta

SEQ ID NO: 14258 - DNA, 60 bp, Xenorhabdus bovienii
  Promoter location: Contig name=SeqID_16897; Position on contig =224428..224487bp; Strand=-
ggcaaaaaaaagcccctcatttgaggggctttttcaatgatcggttttgcaatggaaaaa

SEQ ID NO: 14259 - DNA, 60 bp, Xenorhabdus bovienii
  Promoter location: Contig name=SeqID_16897; Position on contig =227314..227373bp; Strand=-
gtaaccggttaaatatcttgttgataatgcccgattttgacccgcggttaaatcggttat

SEQ ID NO: 14260 - DNA, 60 bp, Xenorhabdus bovienii
  Promoter location: Contig name=SeqID_16897; Position on contig =227027..227086bp; Strand=+
aaaccataatgcctgctgtaattgatactaggctgtgtcccttaatgtaaattgatagta

SEQ ID NO: 14261 - DNA, 60 bp, Xenorhabdus bovienii
  Promoter location: Contig name=SeqID_16897; Position on contig =227978..228037bp; Strand=+; Gene name=ArsR
agcacgactactaaccacttaaatatcttgattaaatctaatctgattacatttatacgt

SEQ ID NO: 14262 - DNA, 60 bp, Xenorhabdus bovienii
  Promoter location: Contig name=SeqID_16897; Position on contig =231273..231332bp; Strand=-
aatagcaatagatcggtttttccgttgcctaagaacggaataagtatcacaatggatcat

SEQ ID NO: 14263 - DNA, 60 bp, Xenorhabdus bovienii
  Promoter location: Contig name=SeqID_16897; Position on contig =231069..231128bp; Strand=+
gataaggttctatttttgatttgaatttcataaaaatctctattttttaacctagtggtc

SEQ ID NO: 14264 - DNA, 60 bp, Xenorhabdus bovienii
  Promoter location: Contig name=SeqID_16897; Position on contig =233843..233902bp; Strand=-; Gene name=PyrI
gttttttcatgcggaaaataaaaattgatgagacgtggttttgttgctaatctgtaaagg

SEQ ID NO: 14265 - DNA, 60 bp, Xenorhabdus bovienii
  Promoter location: Contig name=SeqID_16897; Position on contig =233945..234004bp; Strand=+; Gene name=PyrI
tgtattttttacttatattattgagacaagtaagtagggcttttaattaatattttttta

SEQ ID NO: 14266 - DNA, 60 bp, Xenorhabdus bovienii
  Promoter location: Contig name=SeqID_16897; Position on contig =234673..234732bp; Strand=+; Gene name=TdcF
aagggtataagctgccctgtaccagttgaagcaggactggaggtcactataatggttggc

SEQ ID NO: 14267 - DNA, 60 bp, Xenorhabdus bovienii
  Promoter location: Contig name=SeqID_16897; Position on contig =235742..235801bp; Strand=-
attatataaatatcagaacacgtggctggctgaatatccagttgtgttctgatatgaata

SEQ ID NO: 14268 - DNA, 60 bp, Xenorhabdus bovienii
  Promoter location: Contig name=SeqID_16897; Position on contig =236278..236337bp; Strand=+
tgataattcagattatcactaaataatgaatgaattttatatggcaataaaatcatgcaa

SEQ ID NO: 14269 - DNA, 60 bp, Xenorhabdus bovienii
  Promoter location: Contig name=SeqID_16897; Position on contig =238723..238782bp; Strand=-
tcggtgtttaacatgatcccaatattaatttctgctttaacatctggtatatcaatggca

SEQ ID NO: 14270 - DNA, 60 bp, Xenorhabdus bovienii
  Promoter location: Contig name=SeqID_16897; Position on contig =238464..238523bp; Strand=+
cttgtaagtataataacggtggctataagaacaatttcattcaaatttatatttgttaaa

SEQ ID NO: 14271 - DNA, 60 bp, Xenorhabdus bovienii
  Promoter location: Contig name=SeqID_16897; Position on contig =241101..241160bp; Strand=-
ataagtttttatccattatgaatatttattgcactaaatggaagcctgatactgattact

SEQ ID NO: 14272 - DNA, 60 bp, Xenorhabdus bovienii
  Promoter location: Contig name=SeqID_16897; Position on contig =248950..249009bp; Strand=-
aacgggaaacataaaaatatttttgttgtgccgacattctgcttgagcagaatgtattaa

SEQ ID NO: 14273 - DNA, 60 bp, Xenorhabdus bovienii
  Promoter location: Contig name=SeqID_16897; Position on contig =249455..249514bp; Strand=-
tatagttataaattaatcactcaattggctcggtatcccggataggataaaataaaaaca

SEQ ID NO: 14274 - DNA, 60 bp, Xenorhabdus bovienii
  Promoter location: Contig name=SeqID_16897; Position on contig =249458..249517bp; Strand=+
ttttattttatcctatccgggataccgagccaattgagtgattaatttataactatatgt

SEQ ID NO: 14275 - DNA, 60 bp, Xenorhabdus bovienii
  Promoter location: Contig name=SeqID_16897; Position on contig =252906..252965bp; Strand=+
ttgacgggcttaaattcaacctttgataatggagatctaaatttatttataaaaattaat

SEQ ID NO: 14276 - DNA, 60 bp, Xenorhabdus bovienii
  Promoter location: Contig name=SeqID_16897; Position on contig =257803..257862bp; Strand=-; Gene name=NrfG
cagatttttaagtccacatcttgataggtgggggcttgtttgttcgtttaataacataat

SEQ ID NO: 14277 - DNA, 60 bp, Xenorhabdus bovienii
  Promoter location: Contig name=SeqID_16897; Position on contig =258812..258871bp; Strand=-; Gene name=Pnp
gtaaaaagggcgccgtttagtcaattttgggcaggacgcctgaaatatacaatgtgggtg

SEQ ID NO: 14278 - DNA, 60 bp, Xenorhabdus bovienii
  Promoter location: Contig name=SeqID_16897; Position on contig =261183..261242bp; Strand=-
aggaagcgaagcgggaagcggaacgttaaaaacttaagttctgtttctgaaattttaacc

SEQ ID NO: 14279 - DNA, 60 bp, Xenorhabdus bovienii
  Promoter location: Contig name=SeqID_16897; Position on contig =260795..260854bp; Strand=+
gccttcacggcgaaagaaacttcctggaatacgaccagcagcgtaggtacgctcctgata

SEQ ID NO: 14280 - DNA, 60 bp, Xenorhabdus bovienii
  Promoter location: Contig name=SeqID_16897; Position on contig =261579..261638bp; Strand=-; Gene name=TruB
tagaatagcgcgtctatatatgagttgctgaattagagattggcactcatgatttttaat

SEQ ID NO: 14281 - DNA, 60 bp, Xenorhabdus bovienii
  Promoter location: Contig name=SeqID_16897; Position on contig =267995..268054bp; Strand=-
ccccgagtatcggggttttttgttatttgacagcagaactactgggctaatatagccctt

SEQ ID NO: 14282 - DNA, 60 bp, Xenorhabdus bovienii
  Promoter location: Contig name=SeqID_16897; Position on contig =267978..268037bp; Strand=+
cccccaagacataaaaaaagggctatattagcccagtagttctgctgtcaaataacaaaa

SEQ ID NO: 14283 - DNA, 60 bp, Xenorhabdus bovienii
  Promoter location: Contig name=SeqID_16897; Position on contig =268939..268998bp; Strand=-; Gene name=CpsG
aacgccagtatttgaaattaaccttgcttgtctgaaacgctttggttagtattcacaccc

SEQ ID NO: 14284 - DNA, 60 bp, Xenorhabdus bovienii
  Promoter location: Contig name=SeqID_16897; Position on contig =274053..274112bp; Strand=-
tgttaagagtcatcgtttttttgcttatgttgggattgaaaacggcctattctaccgcca

SEQ ID NO: 14285 - DNA, 60 bp, Xenorhabdus bovienii
  Promoter location: Contig name=SeqID_16897; Position on contig =273948..274007bp; Strand=+
gcgttttttattggccattgttctttccaactatacgaatagagagctatatttttgcac

SEQ ID NO: 14286 - DNA, 60 bp, Xenorhabdus bovienii
  Promoter location: Contig name=SeqID_16897; Position on contig =275137..275196bp; Strand=-
gttagaataatagattagcaggcaaaataggtatgtgaacttcagggtatactgtagttt

SEQ ID NO: 14287 - DNA, 60 bp, Xenorhabdus bovienii
  Promoter location: Contig name=SeqID_16897; Position on contig =274888..274947bp; Strand=+
gcattttctttcaaatcaccatgcgcacgcgcatcagcgattgcggtaataattttaggg

SEQ ID NO: 14288 - DNA, 60 bp, Xenorhabdus bovienii
  Promoter location: Contig name=SeqID_16897; Position on contig =278770..278829bp; Strand=-; Gene name=IspA
ttctcatctgttctaattctgcacttgtcttcgaatcggtttttgcgtagaattcgcgcc

SEQ ID NO: 14289 - DNA, 60 bp, Xenorhabdus bovienii
  Promoter location: Contig name=SeqID_16897; Position on contig =278858..278917bp; Strand=+; Gene name=IspA
tttgaacggtttttcaagtacaatcgatacatcgtgatatctgttgatatgctaatttaa

SEQ ID NO: 14290 - DNA, 60 bp, Xenorhabdus bovienii
  Promoter location: Contig name=SeqID_16897; Position on contig =280889..280948bp; Strand=-; Gene name=Nlp
atcatttttttaatcctttcctattaaatttgaagccacattagtggtataactaaagcg

SEQ ID NO: 14291 - DNA, 60 bp, Xenorhabdus bovienii
  Promoter location: Contig name=SeqID_16897; Position on contig =280707..280766bp; Strand=+; Gene name=Nlp
aactcacctacaccggtcaactccattgccgtataccactcttttttcataatgtttctc

SEQ ID NO: 14292 - DNA, 60 bp, Xenorhabdus bovienii
  Promoter location: Contig name=SeqID_16897; Position on contig =282703..282762bp; Strand=+; Gene name=ArgR
tattttagttttttcttctcttccttgaataaaaattcactctttcgcataataatagct

SEQ ID NO: 14293 - DNA, 60 bp, Xenorhabdus bovienii
  Promoter location: Contig name=SeqID_16897; Position on contig =284795..284854bp; Strand=-; Gene name=Fbp
tggggtgattgataggctattgcatttctaatctcagcattgatggttagaatagtgaca

SEQ ID NO: 14294 - DNA, 60 bp, Xenorhabdus bovienii
  Promoter location: Contig name=SeqID_16897; Position on contig =286091..286150bp; Strand=+; Gene name=Ppa
attatctatattgttcccttaagttctatacatactctttctctatttatatttgttcac

SEQ ID NO: 14295 - DNA, 60 bp, Xenorhabdus bovienii
  Promoter location: Contig name=SeqID_16897; Position on contig =292852..292911bp; Strand=-; Gene name=MsrA
caaactttaccagaattaatttattgcagcatttttatatcgttggattttatccccaga

SEQ ID NO: 14296 - DNA, 60 bp, Xenorhabdus bovienii
  Promoter location: Contig name=SeqID_16897; Position on contig =292855..292914bp; Strand=+; Gene name=MsrA
ggggataaaatccaacgatataaaaatgctgcaataaattaattctggtaaagtttgaaa

SEQ ID NO: 14297 - DNA, 60 bp, Xenorhabdus bovienii
  Promoter location: Contig name=SeqID_16897; Position on contig =293622..293681bp; Strand=+
gttagctcagtgttataatcattgggctaaatttatatatcttacggtaaaatgccgtaa

SEQ ID NO: 14298 - DNA, 60 bp, Xenorhabdus bovienii
  Promoter location: Contig name=SeqID_16897; Position on contig =295626..295685bp; Strand=-
catagcgcttgttaactggtctgtcctcataaaaataaacaaattgataacatttgaaac

SEQ ID NO: 14299 - DNA, 60 bp, Xenorhabdus bovienii
  Promoter location: Contig name=SeqID_16897; Position on contig =295572..295631bp; Strand=+
ataatgaaactatagagtattatgttgctttaacatgggattaccttatattttgtttca

SEQ ID NO: 14300 - DNA, 60 bp, Xenorhabdus bovienii
  Promoter location: Contig name=SeqID_16898; Position on contig =6700..6759bp; Strand=-; Gene name=FhlA
tcataacatcccagcggtcccatttatattaataaaaatattttatataaattttaatta

SEQ ID NO: 14301 - DNA, 60 bp, Xenorhabdus bovienii
  Promoter location: Contig name=SeqID_16898; Position on contig =6709..6768bp; Strand=+; Gene name=FhlA
tttatataaaatatttttattaatataaatgggaccgctgggatgttatgattttccgta

SEQ ID NO: 14302 - DNA, 60 bp, Xenorhabdus bovienii
  Promoter location: Contig name=SeqID_16898; Position on contig =8986..9045bp; Strand=+; Gene name=CspC
gggattacctgtgtatatgtacagtaactgacggtggtgtaaaaaaataaaattaaagct

SEQ ID NO: 14303 - DNA, 60 bp, Xenorhabdus bovienii
  Promoter location: Contig name=SeqID_16898; Position on contig =10668..10727bp; Strand=-
ttcgaaataatatccaaagtattaaatttttcaatacttttagtatttatcattttaata

SEQ ID NO: 14304 - DNA, 60 bp, Xenorhabdus bovienii
  Promoter location: Contig name=SeqID_16898; Position on contig =10584..10643bp; Strand=+
acaaatatgcgcttcaaacgtttggcatctgcaagttgttctgttgttagtttctttttc

SEQ ID NO: 14305 - DNA, 60 bp, Xenorhabdus bovienii
  Promoter location: Contig name=SeqID_16898; Position on contig =10986..11045bp; Strand=+
tgaacggacttaattatctcattgattttattctgatgttttttgtgtatattgttcagg

SEQ ID NO: 14306 - DNA, 60 bp, Xenorhabdus bovienii
  Promoter location: Contig name=SeqID_16898; Position on contig =11539..11598bp; Strand=+
atgtaactatgttcatttgccacttttatatcctctcaattttatttgaatatcttcttg

SEQ ID NO: 14307 - DNA, 60 bp, Xenorhabdus bovienii
  Promoter location: Contig name=SeqID_16898; Position on contig =12261..12320bp; Strand=+
catagattaaattttagcgcctaaaaatctaggcgctaaaatagaatgggaagggataga

SEQ ID NO: 14308 - DNA, 60 bp, Xenorhabdus bovienii
  Promoter location: Contig name=SeqID_16898; Position on contig =14169..14228bp; Strand=+
ttaaaacttaagattttaaaattagccaattaattcaagaatattcttataatgtacaaa

SEQ ID NO: 14309 - DNA, 60 bp, Xenorhabdus bovienii
  Promoter location: Contig name=SeqID_16898; Position on contig =14553..14612bp; Strand=+; Gene name=LysR
atgggcgagtgctttatcaacatgccaaggaaataagtagccgaattcaagatgcattat

SEQ ID NO: 14310 - DNA, 60 bp, Xenorhabdus bovienii
  Promoter location: Contig name=SeqID_16898; Position on contig =15417..15476bp; Strand=+; Gene name=LldP
atgatgtttaatcatatccgtatgacatgataatttcgccgaaaatttatattattcctt

SEQ ID NO: 14311 - DNA, 60 bp, Xenorhabdus bovienii
  Promoter location: Contig name=SeqID_16898; Position on contig =19913..19972bp; Strand=-
aaaataaaaaacaagcaagaaactcctttgattttcatatattcccctaatgtaactata

SEQ ID NO: 14312 - DNA, 60 bp, Xenorhabdus bovienii
  Promoter location: Contig name=SeqID_16898; Position on contig =19788..19847bp; Strand=+
aaaaatcggactcagcatgttgaagttacttttgtttgtaaagggttattttttccgaac

SEQ ID NO: 14313 - DNA, 60 bp, Xenorhabdus bovienii
  Promoter location: Contig name=SeqID_16898; Position on contig =22062..22121bp; Strand=-; Gene name=HtrB
ttttattttaacttgtaaaatatctccatcacaaagatgggtttctgggaagaattattc

SEQ ID NO: 14314 - DNA, 60 bp, Xenorhabdus bovienii
  Promoter location: Contig name=SeqID_16898; Position on contig =23957..24016bp; Strand=-
tgtccaacagatgtaaaacagcatttgaatataatgcgcaggaatatcataatcatggcc

SEQ ID NO: 14315 - DNA, 60 bp, Xenorhabdus bovienii
  Promoter location: Contig name=SeqID_16898; Position on contig =24058..24117bp; Strand=+
cagaatagcaacgttaaaaatcactactcgctaaaggccattttcgttatgatatccggc

SEQ ID NO: 14316 - DNA, 60 bp, Xenorhabdus bovienii
  Promoter location: Contig name=SeqID_16898; Position on contig =25956..26015bp; Strand=-
tcatacagtcattctcatccgcctaattcttaattattaagccatttttttatttaaata

SEQ ID NO: 14317 - DNA, 60 bp, Xenorhabdus bovienii
  Promoter location: Contig name=SeqID_16898; Position on contig =26539..26598bp; Strand=-; Gene name=PyrC
ttattttcgcacgtttacacttacctaaataagtcgttggtatcccttacaataatccca

SEQ ID NO: 14318 - DNA, 60 bp, Xenorhabdus bovienii
  Promoter location: Contig name=SeqID_16899; Position on contig =632..691bp; Strand=-
tagcaaataatatttaaaatattaatttttcaaaattcatagaattttatcattcaataa

SEQ ID NO: 14319 - DNA, 60 bp, Xenorhabdus bovienii
  Promoter location: Contig name=SeqID_16900; Position on contig =399..458bp; Strand=+
tgcttcttcttccatcatgctgatatttgactatattattgatatttattattaaattat

SEQ ID NO: 14320 - DNA, 60 bp, Xenorhabdus bovienii
  Promoter location: Contig name=SeqID_16900; Position on contig =1557..1616bp; Strand=-
gttgatttacccgtcttttgttcgtattgatattctggctgagtgcgtaaattggccgca

SEQ ID NO: 14321 - DNA, 60 bp, Xenorhabdus bovienii
  Promoter location: Contig name=SeqID_16900; Position on contig =1193..1252bp; Strand=+
tttatagatagtgtgctaatgtttctggaaagcgctttgtcttactgtaaactgtaaaaa

SEQ ID NO: 14322 - DNA, 60 bp, Xenorhabdus bovienii
  Promoter location: Contig name=SeqID_16900; Position on contig =3259..3318bp; Strand=-; Gene name=RpiA
aagctatcaacttcattacagtcaaaaatgggaatgcccagactttttaatttttcagtc

SEQ ID NO: 14323 - DNA, 60 bp, Xenorhabdus bovienii
  Promoter location: Contig name=SeqID_16900; Position on contig =2994..3053bp; Strand=+; Gene name=RpiA
cacagcactatgccatattttttcgccgggtgaggcaaaatattgtttatactggtggcc

SEQ ID NO: 14324 - DNA, 60 bp, Xenorhabdus bovienii
  Promoter location: Contig name=SeqID_16900; Position on contig =3763..3822bp; Strand=+; Gene name=SerA
ggcagaataatctgcccttaaaatatttccatgtttttttaaaaaattaaaatttagtga

SEQ ID NO: 14325 - DNA, 60 bp, Xenorhabdus bovienii
  Promoter location: Contig name=SeqID_16900; Position on contig =5845..5904bp; Strand=+
gattgctgctctggggatagattttgacgtaactgtcgaatttgttttcttatggatttt

SEQ ID NO: 14326 - DNA, 60 bp, Xenorhabdus bovienii
  Promoter location: Contig name=SeqID_16900; Position on contig =7073..7132bp; Strand=-
agattaaaaacaaaatcactatcatcaagtgattcaaaagtcgtttcgtataattccctg

SEQ ID NO: 14327 - DNA, 60 bp, Xenorhabdus bovienii
  Promoter location: Contig name=SeqID_16900; Position on contig =6681..6740bp; Strand=+
ttattactgtgccgataccttgattctggcataaaagcagattttggtattaaaacaagg

SEQ ID NO: 14328 - DNA, 60 bp, Xenorhabdus bovienii
  Promoter location: Contig name=SeqID_16900; Position on contig =16475..16534bp; Strand=+; Gene name=ProP
atgaaattttatttcttctatagttagaaaaacacttcaatcctaaacataattgtttgt

SEQ ID NO: 14329 - DNA, 60 bp, Xenorhabdus bovienii
  Promoter location: Contig name=SeqID_16900; Position on contig =20387..20446bp; Strand=-
ctccagtaaacgaacgaaaagccgcttatcatcatcattcaatgagtcatattcatattc

SEQ ID NO: 14330 - DNA, 60 bp, Xenorhabdus bovienii
  Promoter location: Contig name=SeqID_16900; Position on contig =20158..20217bp; Strand=+
tccagaatcgttgataattccctttgactgtgaaattttgcaaccgtgatcatttctgaa

SEQ ID NO: 14331 - DNA, 60 bp, Xenorhabdus bovienii
  Promoter location: Contig name=SeqID_16900; Position on contig =21792..21851bp; Strand=-; Gene name=XerC
ccgttcagccaaaaataattgtagttcaatagattccacagaaagtaaatcatgaccacc

SEQ ID NO: 14332 - DNA, 60 bp, Xenorhabdus bovienii
  Promoter location: Contig name=SeqID_16900; Position on contig =21518..21577bp; Strand=+; Gene name=XerC
ttcgaatatcaggggccgcattgtaacagaagaattgttttttcaggcataatagccgct

SEQ ID NO: 14333 - DNA, 60 bp, Xenorhabdus bovienii
  Promoter location: Contig name=SeqID_16900; Position on contig =25541..25600bp; Strand=+; Gene name=PrfB
tggaagaaaaactcggtcaacttgaattccgccgcatgttctcaggtcaatatgacagcg

SEQ ID NO: 14334 - DNA, 60 bp, Xenorhabdus bovienii
  Promoter location: Contig name=SeqID_16900; Position on contig =29073..29132bp; Strand=+
gcattgaaaccttcgcaaccgcagatcacggcacaaatcgaaatggttaaaatatcgatg

SEQ ID NO: 14335 - DNA, 60 bp, Xenorhabdus bovienii
  Promoter location: Contig name=SeqID_16900; Position on contig =29615..29674bp; Strand=-
gaatcttttatttataattttttagatgttttgatcaattaagagcatatgatgattttt

SEQ ID NO: 14336 - DNA, 60 bp, Xenorhabdus bovienii
  Promoter location: Contig name=SeqID_16900; Position on contig =29906..29965bp; Strand=-
atgctaaaaataattaattgaaaatttttagattttacttactccattttaatcggggtg

SEQ ID NO: 14337 - DNA, 60 bp, Xenorhabdus bovienii
  Promoter location: Contig name=SeqID_16900; Position on contig =29612..29671bp; Strand=+
tcaaaaaatcatcatatgctcttaattgatcaaaacatctaaaaaattataaataaaaga

SEQ ID NO: 14338 - DNA, 60 bp, Xenorhabdus bovienii
  Promoter location: Contig name=SeqID_16900; Position on contig =29969..30028bp; Strand=+
catatatgttattccttagaatgatattaacatacctatggatagtttattttttttcat

SEQ ID NO: 14339 - DNA, 60 bp, Xenorhabdus bovienii
  Promoter location: Contig name=SeqID_16900; Position on contig =31321..31380bp; Strand=+; Gene name=FhaC
gggggttagaatgtataatttaaacacatgagtttaaattgacattgtaatattttttgc

SEQ ID NO: 14340 - DNA, 60 bp, Xenorhabdus bovienii
  Promoter location: Contig name=SeqID_16900; Position on contig =37450..37509bp; Strand=+; Gene name=DnaK
ataaatttgtgccactgtacttatttaatcgtatatctatgctttggtattataattaag

SEQ ID NO: 14341 - DNA, 60 bp, Xenorhabdus bovienii
  Promoter location: Contig name=SeqID_16900; Position on contig =39926..39985bp; Strand=-
agaaccctttcacctttttcatggttttgcattatgcaattatctgatatattcaaataa

SEQ ID NO: 14342 - DNA, 60 bp, Xenorhabdus bovienii
  Promoter location: Contig name=SeqID_16900; Position on contig =39877..39936bp; Strand=+
attgtgcattttattccacctatattcaagcaatcaatataatgatttattatttgaata

SEQ ID NO: 14343 - DNA, 60 bp, Xenorhabdus bovienii
  Promoter location: Contig name=SeqID_16900; Position on contig =40257..40316bp; Strand=+
gtttttcttatattactcttaagttgatggtaagcctcggtacggttatgccatctccta

SEQ ID NO: 14344 - DNA, 60 bp, Xenorhabdus bovienii
  Promoter location: Contig name=SeqID_16900; Position on contig =100516..100575bp; Strand=-
tcaaaaataaatgaattctaactcttttataagtgagattaaaaaaataaagtatctgtt

SEQ ID NO: 14345 - DNA, 60 bp, Xenorhabdus bovienii
  Promoter location: Contig name=SeqID_16900; Position on contig =100803..100862bp; Strand=-
caaataacaaataacaaataataatcttattatagaaatcagccaagtaaaatattgata

SEQ ID NO: 14346 - DNA, 60 bp, Xenorhabdus bovienii
  Promoter location: Contig name=SeqID_16900; Position on contig =101199..101258bp; Strand=-; Gene name=SmtA
aaaccagcatcttcttcccaccacattttttcttcattactttgggttacaataatatca

SEQ ID NO: 14347 - DNA, 60 bp, Xenorhabdus bovienii
  Promoter location: Contig name=SeqID_16900; Position on contig =100849..100908bp; Strand=+; Gene name=SmtA
ttatttgttatttgttatttgttatttgttatttgttatttgttatataacatttgttat

SEQ ID NO: 14348 - DNA, 60 bp, Xenorhabdus bovienii
  Promoter location: Contig name=SeqID_16900; Position on contig =102228..102287bp; Strand=+
ttttattcttgcttggtcgcagagtggacaaaaaatattcggtctgggtagattcggtta

SEQ ID NO: 14349 - DNA, 60 bp, Xenorhabdus bovienii
  Promoter location: Contig name=SeqID_16900; Position on contig =102726..102785bp; Strand=-; Gene name=EntF
taattatattatatatacattatttaaacataccattaacaacatgttatttttatgaaa

SEQ ID NO: 14350 - DNA, 60 bp, Xenorhabdus bovienii
  Promoter location: Contig name=SeqID_16900; Position on contig =102707..102766bp; Strand=+; Gene name=EntF
tatatttgttttcttaaattttcataaaaataacatgttgttaatggtatgtttaaataa

SEQ ID NO: 14351 - DNA, 60 bp, Xenorhabdus bovienii
  Promoter location: Contig name=SeqID_16900; Position on contig =121963..122022bp; Strand=-
cttatccaagaaattacatcatattttacgtacaagctcctaaagattaatttttaagca

SEQ ID NO: 14352 - DNA, 60 bp, Xenorhabdus bovienii
  Promoter location: Contig name=SeqID_16900; Position on contig =121546..121605bp; Strand=+
gattttgttcagacgtttagtgtattggctggatgccggtgcagttttattctgtgcatc

SEQ ID NO: 14353 - DNA, 60 bp, Xenorhabdus bovienii
  Promoter location: Contig name=SeqID_16900; Position on contig =123300..123359bp; Strand=-
ttgtaaccaataacctcacttgtaaaaccacaaccagcttattaatgtattttaaaatag

SEQ ID NO: 14354 - DNA, 60 bp, Xenorhabdus bovienii
  Promoter location: Contig name=SeqID_16900; Position on contig =122996..123055bp; Strand=+
gaaaagaatacttttaatcatctgttctaaagaagccccactaatcgtaagattggtaat

SEQ ID NO: 14355 - DNA, 60 bp, Xenorhabdus bovienii
  Promoter location: Contig name=SeqID_16900; Position on contig =125201..125260bp; Strand=-
agttactattacatgttcaattatttttacaacaataagttaacaattattatgacatac

SEQ ID NO: 14356 - DNA, 60 bp, Xenorhabdus bovienii
  Promoter location: Contig name=SeqID_16900; Position on contig =124823..124882bp; Strand=+
ccagtatgttttcagctaacagaatcgctaatccaatcacaaagctaaataataaaaata

SEQ ID NO: 14357 - DNA, 60 bp, Xenorhabdus bovienii
  Promoter location: Contig name=SeqID_16900; Position on contig =125275..125334bp; Strand=+
aatttccactgacgaaactggattctgatttaacagtcagtgataagtatcatattcact

SEQ ID NO: 14358 - DNA, 60 bp, Xenorhabdus bovienii
  Promoter location: Contig name=SeqID_16900; Position on contig =125574..125633bp; Strand=+
tttttatttaaccattttattaaatatttctttagataattattctgtaaaattagaatg

SEQ ID NO: 14359 - DNA, 60 bp, Xenorhabdus bovienii
  Promoter location: Contig name=SeqID_16900; Position on contig =126030..126089bp; Strand=+
tttaatcatcgcaataaacttttgtcaattaatatttgtttgcatattaaaataaaatat

SEQ ID NO: 14360 - DNA, 60 bp, Xenorhabdus bovienii
  Promoter location: Contig name=SeqID_16900; Position on contig =126489..126548bp; Strand=+
atttaacaccgttagtttttttgactgttactctaattattttgatttatattatggcta

SEQ ID NO: 14361 - DNA, 60 bp, Xenorhabdus bovienii
  Promoter location: Contig name=SeqID_16900; Position on contig =127769..127828bp; Strand=-
gtaaattaagaatttattatttttttgcacaaaaaaatatcaacgtgtattatgtgtaaa

SEQ ID NO: 14362 - DNA, 60 bp, Xenorhabdus bovienii
  Promoter location: Contig name=SeqID_16900; Position on contig =127511..127570bp; Strand=+
gaacatagatatcgcggcagataataaacaaaaaataataaacttgtcaaaataaaaata

SEQ ID NO: 14363 - DNA, 60 bp, Xenorhabdus bovienii
  Promoter location: Contig name=SeqID_16900; Position on contig =128069..128128bp; Strand=-; Gene name=HsdM
gcaaccgaccagataaaagcagccgtttgagaaaaattagtgtcagacatgattgatacc

SEQ ID NO: 14364 - DNA, 60 bp, Xenorhabdus bovienii
  Promoter location: Contig name=SeqID_16900; Position on contig =127989..128048bp; Strand=+; Gene name=HsdM
gataccctgaatgcgctataagttaaagcacgatatgtctgatgaggtataatcaagtca

SEQ ID NO: 14365 - DNA, 60 bp, Xenorhabdus bovienii
  Promoter location: Contig name=SeqID_16900; Position on contig =135480..135539bp; Strand=-
gaagatatctgcttccaaaagtgtgcagatgtaccgcaatgcttacactccctttcaggc

SEQ ID NO: 14366 - DNA, 60 bp, Xenorhabdus bovienii
  Promoter location: Contig name=SeqID_16900; Position on contig =135125..135184bp; Strand=+
gtttttccaaaataatcgttctgactcattcggcgttaacccattgttatactaatgggg

SEQ ID NO: 14367 - DNA, 60 bp, Xenorhabdus bovienii
  Promoter location: Contig name=SeqID_16900; Position on contig =137304..137363bp; Strand=+; Gene name=Soj (BS)
cattttattaacagccctaaattttaacttatttattaatcatttgataatattcaataa

SEQ ID NO: 14368 - DNA, 60 bp, Xenorhabdus bovienii
  Promoter location: Contig name=SeqID_16900; Position on contig =144533..144592bp; Strand=-
aatcacctgcggcatgccgataatgtccgggtattgacgacgaccgataagatcttcttt

SEQ ID NO: 14369 - DNA, 60 bp, Xenorhabdus bovienii
  Promoter location: Contig name=SeqID_16900; Position on contig =144271..144330bp; Strand=+
aagacgataaaaataatcttttctacgatcccgaaaagggatcgttttttccttttttca

SEQ ID NO: 14370 - DNA, 60 bp, Xenorhabdus bovienii
  Promoter location: Contig name=SeqID_16900; Position on contig =147238..147297bp; Strand=+
ctgcccacctttggaagcagatattgtcagtccagtggcagtgaaggtttttttattctt

SEQ ID NO: 14371 - DNA, 60 bp, Xenorhabdus bovienii
  Promoter location: Contig name=SeqID_16900; Position on contig =150849..150908bp; Strand=-; Gene name=Nlp
attttgccgatagcttttttactttaacgaattacgttatctaattcaataatcgaacga

SEQ ID NO: 14372 - DNA, 60 bp, Xenorhabdus bovienii
  Promoter location: Contig name=SeqID_16900; Position on contig =150906..150965bp; Strand=+; Gene name=Nlp
aatccgatagtcaaggaatctcacccttgctaagagtaacccactggtaggaattttctg

SEQ ID NO: 14373 - DNA, 60 bp, Xenorhabdus bovienii
  Promoter location: Contig name=SeqID_16900; Position on contig =156876..156935bp; Strand=-
ctctttatgctttgatgaaaattagctaaatagtccggctaatttatttaattaacgatt

SEQ ID NO: 14374 - DNA, 60 bp, Xenorhabdus bovienii
  Promoter location: Contig name=SeqID_16900; Position on contig =157197..157256bp; Strand=-
tgatcaataccggttttgatggtattgagatcggttttgattcgggtgtaatcaaagtga

SEQ ID NO: 14375 - DNA, 60 bp, Xenorhabdus bovienii
  Promoter location: Contig name=SeqID_16900; Position on contig =156865..156924bp; Strand=+
cttcatggttaaatcgttaattaaataaattagccggactatttagctaattttcatcaa

SEQ ID NO: 14376 - DNA, 60 bp, Xenorhabdus bovienii
  Promoter location: Contig name=SeqID_16900; Position on contig =158229..158288bp; Strand=-
atcaccgatgcccattcggcgttttttctcttccagcttcagccagagataattttccgg

SEQ ID NO: 14377 - DNA, 60 bp, Xenorhabdus bovienii
  Promoter location: Contig name=SeqID_16900; Position on contig =157922..157981bp; Strand=+
gtggtgctgttggttgcggtgatttggctgctggcgaaatcggccggcattattttttaa

SEQ ID NO: 14378 - DNA, 60 bp, Xenorhabdus bovienii
  Promoter location: Contig name=SeqID_16900; Position on contig =165622..165681bp; Strand=-
tttaattctttttctcattgtaaaaattacataattataaacaaggagataattaatgaa

SEQ ID NO: 14379 - DNA, 60 bp, Xenorhabdus bovienii
  Promoter location: Contig name=SeqID_16900; Position on contig =165596..165655bp; Strand=+
tgacttcctgatacatttctaaactattcattaattatctccttgtttataattatgtaa

SEQ ID NO: 14380 - DNA, 60 bp, Xenorhabdus bovienii
  Promoter location: Contig name=SeqID_16900; Position on contig =169097..169156bp; Strand=+
aaaccattctgatagttgttctaaccttcaaattttcaataattaagtaaattatcaggt

SEQ ID NO: 14381 - DNA, 60 bp, Xenorhabdus bovienii
  Promoter location: Contig name=SeqID_16900; Position on contig =177315..177374bp; Strand=-
taacagagtgctgattttatataaactttacgcataacatgccgattaattattcatcgg

SEQ ID NO: 14382 - DNA, 60 bp, Xenorhabdus bovienii
  Promoter location: Contig name=SeqID_16900; Position on contig =178226..178285bp; Strand=-
gcgtgttgacgttttgtgaaggtaatctgaacagcatgatgatttggtataatcaatttc

SEQ ID NO: 14383 - DNA, 60 bp, Xenorhabdus bovienii
  Promoter location: Contig name=SeqID_16900; Position on contig =178732..178791bp; Strand=-
caccgccgggtatttgcgcacaccggattgccaggcatggacaacagcacgataagcgtt

SEQ ID NO: 14384 - DNA, 60 bp, Xenorhabdus bovienii
  Promoter location: Contig name=SeqID_16900; Position on contig =178244..178303bp; Strand=+
tcatcatgctgttcagattaccttcacaaaacgtcaacacgccctagtatgtttaatgaa

SEQ ID NO: 14385 - DNA, 60 bp, Xenorhabdus bovienii
  Promoter location: Contig name=SeqID_16900; Position on contig =183384..183443bp; Strand=-
aaaaataatatattaattcaataatatatttgcattaaataggatttcataatgctgcta

SEQ ID NO: 14386 - DNA, 60 bp, Xenorhabdus bovienii
  Promoter location: Contig name=SeqID_16900; Position on contig =183415..183474bp; Strand=+
atatattattgaattaatatattatttttcttaattcagggcggttttatattccttttc

SEQ ID NO: 14387 - DNA, 60 bp, Xenorhabdus bovienii
  Promoter location: Contig name=SeqID_16900; Position on contig =184578..184637bp; Strand=-
gctgtacagagatcaggacgtttatcgtcagtgttcaaaacgcaggttaatgtttttcgg

SEQ ID NO: 14388 - DNA, 60 bp, Xenorhabdus bovienii
  Promoter location: Contig name=SeqID_16900; Position on contig =184542..184601bp; Strand=+
atcacgcaatacgggcagagcattctttgcctcgttccgaaaaacattaacctgcgtttt

SEQ ID NO: 14389 - DNA, 60 bp, Xenorhabdus bovienii
  Promoter location: Contig name=SeqID_16900; Position on contig =184857..184916bp; Strand=+
gtcatatctgattttcaacccactgcctgatagcaggctgatgcagtaaaaattaaggag

SEQ ID NO: 14390 - DNA, 60 bp, Xenorhabdus bovienii
  Promoter location: Contig name=SeqID_16900; Position on contig =194694..194753bp; Strand=-; Gene name=XerC
tattcttgagatgatgtcgtatttattcctgttttatttcctctagtgtatacttcctat

SEQ ID NO: 14391 - DNA, 60 bp, Xenorhabdus bovienii
  Promoter location: Contig name=SeqID_16900; Position on contig =195483..195542bp; Strand=-
ttcctatttgaatagttatgtgtttactcattccctcaatttttagctaaacttttaagg

SEQ ID NO: 14392 - DNA, 60 bp, Xenorhabdus bovienii
  Promoter location: Contig name=SeqID_16900; Position on contig =196308..196367bp; Strand=-
caacggcgtcaaaccaaactcgttagctaaatcgctaaccgttagttcatgatattgtcg

SEQ ID NO: 14393 - DNA, 60 bp, Xenorhabdus bovienii
  Promoter location: Contig name=SeqID_16900; Position on contig =199102..199161bp; Strand=-; Gene name=XerC
acaaatattttaacccgcccccccctcgttattgaacttttacctcatagattgatccca

SEQ ID NO: 14394 - DNA, 60 bp, Xenorhabdus bovienii
  Promoter location: Contig name=SeqID_16900; Position on contig =199820..199879bp; Strand=-
aagttagataaaaagcactgacaaatatctacccatcttcaaaagactacaatcatgatg

SEQ ID NO: 14395 - DNA, 60 bp, Xenorhabdus bovienii
  Promoter location: Contig name=SeqID_16900; Position on contig =201985..202044bp; Strand=-
tgggaaatcacacaagactgattaattaaaaaaataacttcatgtggtatcttaaggtga

SEQ ID NO: 14396 - DNA, 60 bp, Xenorhabdus bovienii
  Promoter location: Contig name=SeqID_16900; Position on contig =201963..202022bp; Strand=+
aggtttaattccctgtttataatcaccttaagataccacatgaagttatttttttaatta

SEQ ID NO: 14397 - DNA, 60 bp, Xenorhabdus bovienii
  Promoter location: Contig name=SeqID_16900; Position on contig =206379..206438bp; Strand=-
tttagcttttctctttgaccaaatttagctaatgaatcaatatgtgttaagttttgtatc

SEQ ID NO: 14398 - DNA, 60 bp, Xenorhabdus bovienii
  Promoter location: Contig name=SeqID_16900; Position on contig =206130..206189bp; Strand=+
tttgttgctttcatatttctttgcaagtgtctcgaatgtgcacttactaccatctagccc

SEQ ID NO: 14399 - DNA, 60 bp, Xenorhabdus bovienii
  Promoter location: Contig name=SeqID_16900; Position on contig =206858..206917bp; Strand=-
aaataggctggctaggattcaccttgaaagatatccctttcataaccgatactgccccat

SEQ ID NO: 14400 - DNA, 60 bp, Xenorhabdus bovienii
  Promoter location: Contig name=SeqID_16900; Position on contig =206606..206665bp; Strand=+
atattgtgagatctctgacttcgactgacagatcatttttagctatttaaattgaacgct

SEQ ID NO: 14401 - DNA, 60 bp, Xenorhabdus bovienii
  Promoter location: Contig name=SeqID_16900; Position on contig =208401..208460bp; Strand=-
cggggacacagtgtgcaccgtggccgggattgtattttgttgcatggtattctcctgata

SEQ ID NO: 14402 - DNA, 60 bp, Xenorhabdus bovienii
  Promoter location: Contig name=SeqID_16900; Position on contig =207930..207989bp; Strand=+
aactcttttaattagtcattagattttctaggtgaccccatccagtttaacttttttaac

SEQ ID NO: 14403 - DNA, 60 bp, Xenorhabdus bovienii
  Promoter location: Contig name=SeqID_16900; Position on contig =211316..211375bp; Strand=+
ccttcgtttaacgcagtatccatttatttttacctcaaccgaaaggggaaactattccct

SEQ ID NO: 14404 - DNA, 60 bp, Xenorhabdus bovienii
  Promoter location: Contig name=SeqID_16900; Position on contig =213374..213433bp; Strand=-
ttccttagtgtgtaatattgtgtcccggtacagaaatgtcccgttaataaactgaaagat

SEQ ID NO: 14405 - DNA, 60 bp, Xenorhabdus bovienii
  Promoter location: Contig name=SeqID_16900; Position on contig =213325..213384bp; Strand=+
gtacaaaaggtcattatatgaaaaatgaaataattcaacgtgttaattaatctttcagtt

SEQ ID NO: 14406 - DNA, 60 bp, Xenorhabdus bovienii
  Promoter location: Contig name=SeqID_16902; Position on contig =972..1031bp; Strand=+
cttccgtctggttcctcgccgtccacactgctgtgcctccgtacgggtagtattcttcca

SEQ ID NO: 14407 - DNA, 60 bp, Xenorhabdus bovienii
  Promoter location: Contig name=SeqID_16902; Position on contig =3763..3822bp; Strand=-
acacaacaaataaaaatcacccaattactgaggtagatgcataatattattatgcattaa

SEQ ID NO: 14408 - DNA, 60 bp, Xenorhabdus bovienii
  Promoter location: Contig name=SeqID_16902; Position on contig =5190..5249bp; Strand=+
tagaataattgtctttatagatgatcattgtttcgtgaacaggattgcaacatagtgtaa

SEQ ID NO: 14409 - DNA, 60 bp, Xenorhabdus bovienii
  unsure (1)..(60): unsure at all n locations
  Promoter location: Contig name=SeqID_16903; Position on contig =26..85bp; Strand=+
ctttaaactggataaaaagtaccatgataaataacgtantttcaccgnaatatatgaaaa

SEQ ID NO: 14410 - DNA, 60 bp, Xenorhabdus bovienii
  unsure (1)..(60): unsure at all n locations
  Promoter location: Contig name=SeqID_16904; Position on contig =2..61bp; Strand=+
nnnnnnnnnnnnnnnnnnnnnnnnattgatgaatttcaggaacttggtttttccgtaaag

SEQ ID NO: 14411 - DNA, 60 bp, Xenorhabdus bovienii
  Promoter location: Contig name=SeqID_16904; Position on contig =2345..2404bp; Strand=-; Gene name=FecB
tgtgtttcaccagaaagatgttttactgtgacgaaatcaccagattgtactatcacggaa

SEQ ID NO: 14412 - DNA, 60 bp, Xenorhabdus bovienii
  Promoter location: Contig name=SeqID_16904; Position on contig =2146..2205bp; Strand=+; Gene name=FecB
taaaaataagaatcaatatgaaattgattcttatttgattgacatcgtagtgttgccacc

SEQ ID NO: 14413 - DNA, 60 bp, Xenorhabdus bovienii
  Promoter location: Contig name=SeqID_16904; Position on contig =7303..7362bp; Strand=-
atgcagatcagaagcattatgctttacactaagagccaccaatttttccatattcatttt

SEQ ID NO: 14414 - DNA, 60 bp, Xenorhabdus bovienii
  Promoter location: Contig name=SeqID_16904; Position on contig =7150..7209bp; Strand=+
tttgcgatagcgtccgcaggtttggttttactgactgcaagcaatgtaatttcttgtgga

SEQ ID NO: 14415 - DNA, 60 bp, Xenorhabdus bovienii
  Promoter location: Contig name=SeqID_16904; Position on contig =9335..9394bp; Strand=-; Gene name=RimK
catttaccatttataatgttggctcacatactgtgagccaaatcacgctaacattgccaa

SEQ ID NO: 14416 - DNA, 60 bp, Xenorhabdus bovienii
  Promoter location: Contig name=SeqID_16904; Position on contig =11629..11688bp; Strand=-; Gene name=PppA
cgccatatcctattccctctttctttaaggtatatcgacagactctatttaataaccata

SEQ ID NO: 14417 - DNA, 60 bp, Xenorhabdus bovienii
  Promoter location: Contig name=SeqID_16904; Position on contig =11286..11345bp; Strand=+; Gene name=PppA
tttttattgctaaccaattgagtgataaattaatattcctcgtgttctgatttcggtcag

SEQ ID NO: 14418 - DNA, 60 bp, Xenorhabdus bovienii
  Promoter location: Contig name=SeqID_16904; Position on contig =13858..13917bp; Strand=-
caaataattgcagattttgcggtttttaaatcgaaatatgcaacttattatacgtgccat

SEQ ID NO: 14419 - DNA, 60 bp, Xenorhabdus bovienii
  Promoter location: Contig name=SeqID_16904; Position on contig =13591..13650bp; Strand=+
tccggtttgctggatcattttgaccagcgcttgggcgtcactctttttaaattgcgcgtc

SEQ ID NO: 14420 - DNA, 60 bp, Xenorhabdus bovienii
  Promoter location: Contig name=SeqID_16904; Position on contig =16097..16156bp; Strand=-; Gene name=LysA
gggtattggaacaggctttctgtgcaaaccgaatgatatcgaatcgttttaatttattga

SEQ ID NO: 14421 - DNA, 60 bp, Xenorhabdus bovienii
  Promoter location: Contig name=SeqID_16904; Position on contig =15830..15889bp; Strand=+; Gene name=LysA
atgcgctatctacataacatgattagtttgaaaaacaatcaaaacgatatcataaataaa

SEQ ID NO: 14422 - DNA, 60 bp, Xenorhabdus bovienii
  Promoter location: Contig name=SeqID_16904; Position on contig =19820..19879bp; Strand=-
cattgtaattaagatgtaaatatattgataaatacgttttcctcatctaaaaagaagaac

SEQ ID NO: 14423 - DNA, 60 bp, Xenorhabdus bovienii
  Promoter location: Contig name=SeqID_16904; Position on contig =19733..19792bp; Strand=+
actaaaaacaaaataatgctgagagcggtcatagtaaaaactcctgttaatctcaggtga

SEQ ID NO: 14424 - DNA, 60 bp, Xenorhabdus bovienii
  Promoter location: Contig name=SeqID_16904; Position on contig =22180..22239bp; Strand=-
gcatttattggccgctccaccatttcacagatgccaaacatcgctgctatatttgtattc

SEQ ID NO: 14425 - DNA, 60 bp, Xenorhabdus bovienii
  Promoter location: Contig name=SeqID_16904; Position on contig =22069..22128bp; Strand=+
acagaaatagtgaaagataaaacgccgtttttttcataacagagccgtataaaaggataa

SEQ ID NO: 14426 - DNA, 60 bp, Xenorhabdus bovienii
  Promoter location: Contig name=SeqID_16904; Position on contig =22730..22789bp; Strand=-; Gene name=NqrA
cgttcaccacgcccgatggtaataattttcccgctagcgggactcgtaaaaataacccct

SEQ ID NO: 14427 - DNA, 60 bp, Xenorhabdus bovienii
  Promoter location: Contig name=SeqID_16904; Position on contig =22384..22443bp; Strand=+; Gene name=NqrA
aaaattaagagaaaattgtaacgattatcggagtgaataacttgagatatatgcagctca

SEQ ID NO: 14428 - DNA, 60 bp, Xenorhabdus bovienii
  Promoter location: Contig name=SeqID_16904; Position on contig =30390..30449bp; Strand=-; Gene name=CirA
acttgaaagatgaagagtataacccccttaatttttgagaggattatgtctacaatacta

SEQ ID NO: 14429 - DNA, 60 bp, Xenorhabdus bovienii
  Promoter location: Contig name=SeqID_16904; Position on contig =32904..32963bp; Strand=-
atctatcacagtgcatttcatctccataacacttctcaaaacatgcttataaaaataatt

SEQ ID NO: 14430 - DNA, 60 bp, Xenorhabdus bovienii
  Promoter location: Contig name=SeqID_16904; Position on contig =32734..32793bp; Strand=+
actaatgtacctgagaatgtacttcttaaaatttttcgaatgatggccataattgggcgt

SEQ ID NO: 14431 - DNA, 60 bp, Xenorhabdus bovienii
  Promoter location: Contig name=SeqID_16904; Position on contig =38413..38472bp; Strand=-
tcataggcagttcctgaaattaataaaaataaaaagacaaaaaagaataaaacaattaac

SEQ ID NO: 14432 - DNA, 60 bp, Xenorhabdus bovienii
  Promoter location: Contig name=SeqID_16904; Position on contig =38056..38115bp; Strand=+
gagttggtgcaataagtaacgcatggtggattccaataacccattcttatccttgaaata

SEQ ID NO: 14433 - DNA, 60 bp, Xenorhabdus bovienii
  Promoter location: Contig name=SeqID_16904; Position on contig =40691..40750bp; Strand=+; Gene name=AraJ
attcaattgatttattgattaatggtgttgtactttaatcggtaatttatagtcatctcg

SEQ ID NO: 14434 - DNA, 60 bp, Xenorhabdus bovienii
  Promoter location: Contig name=SeqID_16904; Position on contig =42332..42391bp; Strand=-; Gene name=DinP
tggcgaatatgctgagaaacttctttgtaggatgccattcgccccggtatgactttcaat

SEQ ID NO: 14435 - DNA, 60 bp, Xenorhabdus bovienii
  Promoter location: Contig name=SeqID_16904; Position on contig =42048..42107bp; Strand=+; Gene name=DinP
aaaaaacaagtagcgctcaatgacatgaggctgtatatttatacagttattttggtgtga

SEQ ID NO: 14436 - DNA, 60 bp, Xenorhabdus bovienii
  Promoter location: Contig name=SeqID_16904; Position on contig =44957..45016bp; Strand=-
ggcatgcatttgcaacatatcccacgttacaacatatttttcgctcatatgatttgatcc

SEQ ID NO: 14437 - DNA, 60 bp, Xenorhabdus bovienii
  Promoter location: Contig name=SeqID_16904; Position on contig =47187..47246bp; Strand=+; Gene name=ProB
tttttttaattttgcgttatgtcggttggcataacgctcctctcctgttaaaactgagca

SEQ ID NO: 14438 - DNA, 60 bp, Xenorhabdus bovienii
  Promoter location: Contig name=SeqID_16904; Position on contig =49730..49789bp; Strand=+; Gene name=AroK
cacactttatcgtaagtgtggctgtttgcttgatgaaaagtattttttatattggtgtaa

SEQ ID NO: 14439 - DNA, 60 bp, Xenorhabdus bovienii
  Promoter location: Contig name=SeqID_16904; Position on contig =54391..54450bp; Strand=+; Gene name=RecA
gatgctgtatgattatacagtataattaattccagcactttggtatcagaaacggtttat

SEQ ID NO: 14440 - DNA, 60 bp, Xenorhabdus bovienii
  Promoter location: Contig name=SeqID_16904; Position on contig =55749..55808bp; Strand=-; Gene name=AlaS
acgaataaattaaaatagggttaagatagaatgtcttccataagaagtaaaatcccatat

SEQ ID NO: 14441 - DNA, 60 bp, Xenorhabdus bovienii
  Promoter location: Contig name=SeqID_16904; Position on contig =55734..55793bp; Strand=+; Gene name=AlaS
aaagcggatgaatttatatgggattttacttcttatggaagacattctatcttaacccta

SEQ ID NO: 14442 - DNA, 60 bp, Xenorhabdus bovienii
  Promoter location: Contig name=SeqID_16904; Position on contig =58651..58710bp; Strand=-
ctattatccatcaaacaccgtgaaaacgtaaagcaatgatatctacttaaagtataagca

SEQ ID NO: 14443 - DNA, 60 bp, Xenorhabdus bovienii
  Promoter location: Contig name=SeqID_16904; Position on contig =59054..59113bp; Strand=-
ctcatgaacgatgctttttcaacagatagaaaataaaaagacgtgagagaataaaaaata

SEQ ID NO: 14444 - DNA, 60 bp, Xenorhabdus bovienii
  Promoter location: Contig name=SeqID_16904; Position on contig =58771..58830bp; Strand=+
actcgtcgagttggtgaaacgctcatgataggcgatgaggtaacagtcacagtactggga

SEQ ID NO: 14445 - DNA, 60 bp, Xenorhabdus bovienii
  Promoter location: Contig name=SeqID_16905; Position on contig =600..659bp; Strand=+; Gene name=GshA
atccatagctcagctggatagagtactcggctacgaaccgagcggtcggaggttcgaatc

SEQ ID NO: 14446 - DNA, 60 bp, Xenorhabdus bovienii
  Promoter location: Contig name=SeqID_16905; Position on contig =2434..2493bp; Strand=+; Gene name=LuxS
aaaatggccaccagtggtggccgaaataaaatctattagagaatagggatgataacaatt

SEQ ID NO: 14447 - DNA, 60 bp, Xenorhabdus bovienii
  Promoter location: Contig name=SeqID_16905; Position on contig =4088..4147bp; Strand=-
taattactatgatacaagtgcaatttttcagaagggcggtcagttgctatagtaggcatc

SEQ ID NO: 14448 - DNA, 60 bp, Xenorhabdus bovienii
  unsure (1)..(60): unsure at all n locations
  Promoter location: Contig name=SeqID_16905; Position on contig =7453..7512bp; Strand=-
nnnnnnnnnnnnnnnnnnnngatttttcatgtcagcagcggccaaaatctcacgttgtta

SEQ ID NO: 14449 - DNA, 60 bp, Xenorhabdus bovienii
  Promoter location: Contig name=SeqID_16906; Position on contig =2032..2091bp; Strand=-
tggcggtgcggacgggactcgaacccgcgacccccggcgtgacaggccggtattctaacc

SEQ ID NO: 14450 - DNA, 60 bp, Xenorhabdus bovienii
  Promoter location: Contig name=SeqID_16906; Position on contig =2016..2075bp; Strand=+
gtgcggtagttcagttggttagaataccggcctgtcacgccgggggtcgcgggttcgagt

SEQ ID NO: 14451 - DNA, 60 bp, Xenorhabdus bovienii
  Promoter location: Contig name=SeqID_16906; Position on contig =3550..3609bp; Strand=-
tgcccatgtggtaatgagttgtcttcaagtaatcgtttagaggtgggtaaaactagctct

SEQ ID NO: 14452 - DNA, 60 bp, Xenorhabdus bovienii
  Promoter location: Contig name=SeqID_16906; Position on contig =3214..3273bp; Strand=+
atattatcatattgttttttttaatagttttaatcgccaataattatatattccataaaa

SEQ ID NO: 14453 - DNA, 60 bp, Xenorhabdus bovienii
  Promoter location: Contig name=SeqID_16906; Position on contig =5872..5931bp; Strand=-
ttattgggtaaatcataaaaaaactctggttttactaaactgccgggtattattacagat

SEQ ID NO: 14454 - DNA, 60 bp, Xenorhabdus bovienii
  Promoter location: Contig name=SeqID_16906; Position on contig =7075..7134bp; Strand=-; Gene name=CysJ
tctcataactaaaatgcctaactttatttacagatttcatatatcgataaagtcgttaag

SEQ ID NO: 14455 - DNA, 60 bp, Xenorhabdus bovienii
  Promoter location: Contig name=SeqID_16906; Position on contig =7105..7164bp; Strand=+; Gene name=CysJ
taaataaagttaggcattttagttatgagatattgcaaacctttctttaaaatctcatct

SEQ ID NO: 14456 - DNA, 60 bp, Xenorhabdus bovienii
  Promoter location: Contig name=SeqID_16906; Position on contig =11644..11703bp; Strand=+; Gene name=CysG
gaactaataattcctttttgtcatttcataaccggatctcagcctcatatattcattctc

SEQ ID NO: 14457 - DNA, 60 bp, Xenorhabdus bovienii
  Promoter location: Contig name=SeqID_16906; Position on contig =16225..16284bp; Strand=+
actgagccgttaagaaacacattattgcgagtagaataatgtgtttctacactcatctca

SEQ ID NO: 14458 - DNA, 60 bp, Xenorhabdus bovienii
  Promoter location: Contig name=SeqID_16906; Position on contig =18999..19058bp; Strand=+; Gene name=XerC
tgcatcaatgattcattgcatctcataatgtctcattaattgttataatagcaggataga

SEQ ID NO: 14459 - DNA, 60 bp, Xenorhabdus bovienii
  Promoter location: Contig name=SeqID_16906; Position on contig =20781..20840bp; Strand=-
ttcgagaacgggaagagtgtcggttgactgcttatcgtcaaccgttttacaaattaaagc

SEQ ID NO: 14460 - DNA, 60 bp, Xenorhabdus bovienii
  Promoter location: Contig name=SeqID_16906; Position on contig =27702..27761bp; Strand=-
ggattggattaaatgtagcgataggttgccaaatgacgatggatattatttagtgtacga

SEQ ID NO: 14461 - DNA, 60 bp, Xenorhabdus bovienii
  Promoter location: Contig name=SeqID_16906; Position on contig =28314..28373bp; Strand=-
gactaactccagctcatttccgagtgggctgtggtgagtagaactgatatattcatggat

SEQ ID NO: 14462 - DNA, 60 bp, Xenorhabdus bovienii
  Promoter location: Contig name=SeqID_16906; Position on contig =29165..29224bp; Strand=+
tttatcccaccaaccggcttcaacattttgctggtgaatttgtttttgtaattcagtgag

SEQ ID NO: 14463 - DNA, 60 bp, Xenorhabdus bovienii
  Promoter location: Contig name=SeqID_16906; Position on contig =30809..30868bp; Strand=-
gagaaatccatatgagtaactccatgtgtataaaatcaacataatgttaatcttaagaat

SEQ ID NO: 14464 - DNA, 60 bp, Xenorhabdus bovienii
  Promoter location: Contig name=SeqID_16906; Position on contig =30710..30769bp; Strand=+
aataatttttagtctgtctttcaaagtcatatgtatcccccaaagcgtaagataaacatc

SEQ ID NO: 14465 - DNA, 60 bp, Xenorhabdus bovienii
  Promoter location: Contig name=SeqID_16906; Position on contig =31076..31135bp; Strand=+
taacaatctactgctctccttgaaaacgggagaattattaacctgattatagtcaggcta

SEQ ID NO: 14466 - DNA, 60 bp, Xenorhabdus bovienii
  Promoter location: Contig name=SeqID_16906; Position on contig =31540..31599bp; Strand=+
gttcccgaacaccatttcaacgaggttaattatacatgaaaacgaaatttaatcacagcg

SEQ ID NO: 14467 - DNA, 60 bp, Xenorhabdus bovienii
  Promoter location: Contig name=SeqID_16906; Position on contig =37866..37925bp; Strand=+
aggcctcgcactcgcggggctttttcacatctgcaatcctaactaattgaaatccatccg

SEQ ID NO: 14468 - DNA, 60 bp, Xenorhabdus bovienii; identical to SEQ ID NO: 12522
  Promoter location: Contig name=SeqID_16906; Position on contig =40070..40129bp; Strand=-

SEQ ID NO: 14469 - DNA, 60 bp, Xenorhabdus bovienii
  Promoter location: Contig name=SeqID_16906; Position on contig =40031..40090bp; Strand=+
gcgatgtaagcattttgtctcatcatgtcaacccaacaacaagcgaataatatttaataa

SEQ ID NO: 14470 - DNA, 60 bp, Xenorhabdus bovienii
  Promoter location: Contig name=SeqID_16906; Position on contig =51482..51541bp; Strand=-
acggccaataagtttattggtttctactgggcaatttgccatgtgaataacctctattaa

SEQ ID NO: 14471 - DNA, 60 bp, Xenorhabdus bovienii
  Promoter location: Contig name=SeqID_16906; Position on contig =51401..51460bp; Strand=+
caagagaaccgatatatcatccggttactattccgctgtacatcataatcaggtcgcata

SEQ ID NO: 14472 - DNA, 60 bp, Xenorhabdus bovienii
  Promoter location: Contig name=SeqID_16906; Position on contig =53008..53067bp; Strand=+
gatgactttaattatctaaatttttgtatatacagatttaataatcatgtaatgcatttt

SEQ ID NO: 14473 - DNA, 60 bp, Xenorhabdus bovienii
  Promoter location: Contig name=SeqID_16906; Position on contig =66127..66186bp; Strand=-
cccggtgcggtgacaccatcatcattactgagcaatatccgcagcattattatatctcat

SEQ ID NO: 14474 - DNA, 60 bp, Xenorhabdus bovienii
  Promoter location: Contig name=SeqID_16906; Position on contig =65870..65929bp; Strand=+
tagcgggtagttgggtggattggtgtgggatgtgaggctggtaaactggcgggtggggtg

SEQ ID NO: 14475 - DNA, 60 bp, Xenorhabdus bovienii
  Promoter location: Contig name=SeqID_16906; Position on contig =67588..67647bp; Strand=+; Gene name=NlpD
tattttgccttaaatcttttgtaattcgaaatttctttataaatcattatgcttaaaact

SEQ ID NO: 14476 - DNA, 60 bp, Xenorhabdus bovienii
  Promoter location: Contig name=SeqID_16906; Position on contig =72808..72867bp; Strand=-
gattaaatataagaatattactcatgatgaatttttaggagtaaaaataaaatcgagtcg

SEQ ID NO: 14477 - DNA, 60 bp, Xenorhabdus bovienii
  Promoter location: Contig name=SeqID_16906; Position on contig =72483..72542bp; Strand=+
tctaaatcctttgctggtgattctttcatattgatcgcattcaattttactattcctgtt

SEQ ID NO: 14478 - DNA, 60 bp, Xenorhabdus bovienii
  Promoter location: Contig name=SeqID_16906; Position on contig =73902..73961bp; Strand=+
attcagcttgatatccggtcatgtattaaatagttagatcttggtgttaaaaataatgtt

SEQ ID NO: 14479 - DNA, 60 bp, Xenorhabdus bovienii
  Promoter location: Contig name=SeqID_16906; Position on contig =74984..75043bp; Strand=-
gaagtcggtaatcaggcatgataatttcctcttaaatcgactcggattaaaataatacct

SEQ ID NO: 14480 - DNA, 60 bp, Xenorhabdus bovienii
  Promoter location: Contig name=SeqID_16906; Position on contig =75272..75331bp; Strand=+
agcgggggggttggttggaaactagttgttggtctaatgtttttcactatgattagattt

SEQ ID NO: 14481 - DNA, 60 bp, Xenorhabdus bovienii
  Promoter location: Contig name=SeqID_16906; Position on contig =75906..75965bp; Strand=-
tatggaaaaataaaaattaattcttgctaaataaatcattacgtggctattatagtcaat

SEQ ID NO: 14482 - DNA, 60 bp, Xenorhabdus bovienii
  Promoter location: Contig name=SeqID_16906; Position on contig =75886..75945bp; Strand=+
aaggtctgtgttccaaaccgattgactataatagccacgtaatgatttatttagcaagaa

SEQ ID NO: 14483 - DNA, 60 bp, Xenorhabdus bovienii
  Promoter location: Contig name=SeqID_16906; Position on contig =76866..76925bp; Strand=+
gctggatagattgtctttaaaattgacataccatcaatcttttagtttactatttgtgat

SEQ ID NO: 14484 - DNA, 60 bp, Xenorhabdus bovienii
  Promoter location: Contig name=SeqID_16906; Position on contig =79818..79877bp; Strand=-
tattatcaattgattaagtatattttctatatatacccatcgtcattgaagatgcttgat

SEQ ID NO: 14485 - DNA, 60 bp, Xenorhabdus bovienii
  Promoter location: Contig name=SeqID_16906; Position on contig =80756..80815bp; Strand=-
ttctctttttcaaagagaatttattgacagaaaaacagttaacttaacaaaataacaata

SEQ ID NO: 14486 - DNA, 60 bp, Xenorhabdus bovienii
  Promoter location: Contig name=SeqID_16906; Position on contig =80817..80876bp; Strand=+
ttattcctttgtgaaaaatatcatttttttcgcattgaagactgtagtaaaatcgagcta

SEQ ID NO: 14487 - DNA, 60 bp, Xenorhabdus bovienii
  Promoter location: Contig name=SeqID_16906; Position on contig =82724..82783bp; Strand=+; Gene name=CstA
ttcaaccgctggctcagatcctcctgatatcgtgggtgaaagtttcatatcatagtgcag

SEQ ID NO: 14488 - DNA, 60 bp, Xenorhabdus bovienii
  Promoter location: Contig name=SeqID_16906; Position on contig =85541..85600bp; Strand=-
ctgggttgccctatccccaattaattcatggtcaatgggcacttcaccaaactcattttc

SEQ ID NO: 14489 - DNA, 60 bp, Xenorhabdus bovienii
  Promoter location: Contig name=SeqID_16906; Position on contig =85129..85188bp; Strand=+
cctttgtattatgtggggtatttttctttggagaacagtatgtttggtaatcttggcaag

SEQ ID NO: 14490 - DNA, 60 bp, Xenorhabdus bovienii
  Promoter location: Contig name=SeqID_16906; Position on contig =87360..87419bp; Strand=-
agctgcaaattttttttatttactgttttccaattagattaatctggtattttgctaatc

SEQ ID NO: 14491 - DNA, 60 bp, Xenorhabdus bovienii
  Promoter location: Contig name=SeqID_16906; Position on contig =88007..88066bp; Strand=+
ttcatcattataattatttcttgaattatgtactgtcgaatatcatttttttgacgctaa

SEQ ID NO: 14492 - DNA, 60 bp, Xenorhabdus bovienii
  Promoter location: Contig name=SeqID_16906; Position on contig =89743..89802bp; Strand=-
tttgaattgttaatatcacaaataatcataataccttatagtgaagatataataacttta

SEQ ID NO: 14493 - DNA, 60 bp, Xenorhabdus bovienii
  Promoter location: Contig name=SeqID_16906; Position on contig =90265..90324bp; Strand=+; Gene name=FabH
ttataaataaatttatttttttgatttatgagatttttaattaaatgtaatttcacagat

SEQ ID NO: 14494 - DNA, 60 bp, Xenorhabdus bovienii
  Promoter location: Contig name=SeqID_16906; Position on contig =91643..91702bp; Strand=+; Gene name=CsgG
taacaatatctattatttttccgttttattttagcggtatccgcctgtataagtaatctg

SEQ ID NO: 14495 - DNA, 60 bp, Xenorhabdus bovienii
  Promoter location: Contig name=SeqID_16906; Position on contig =94938..94997bp; Strand=-
tctgtaccaatcgcgtaacccgcctaccaaatgaccaataaaccttgtagaattacctac

SEQ ID NO: 14496 - DNA, 60 bp, Xenorhabdus bovienii
  Promoter location: Contig name=SeqID_16906; Position on contig =94700..94759bp; Strand=+
taatgcagagatcgaaaacaagattgcctccccccatggcagccaggtaagccgaagaaa

SEQ ID NO: 14497 - DNA, 60 bp, Xenorhabdus bovienii
  Promoter location: Contig name=SeqID_16906; Position on contig =96790..96849bp; Strand=-
tcattaattaaagatgatatgtcatcgaagagcatattaatctcctttatcatgactaaa

SEQ ID NO: 14498 - DNA, 60 bp, Xenorhabdus bovienii
  Promoter location: Contig name=SeqID_16906; Position on contig =96374..96433bp; Strand=+
atatttttctggttcactgaggcctttataagatatttctaacttgttaatatccccatc

SEQ ID NO: 14499 - DNA, 60 bp, Xenorhabdus bovienii
  Promoter location: Contig name=SeqID_16906; Position on contig =98800..98859bp; Strand=+; Gene name=PncA
ttattaatatggcaataacttgattaatggaataacttaagaaagttattttttctatat

SEQ ID NO: 14500 - DNA, 60 bp, Xenorhabdus bovienii
  Promoter location: Contig name=SeqID_16906; Position on contig =99934..99993bp; Strand=-
gcaattttcctaaagttaagaaaataaagtttggctaacaaagatattaatatgttagtt

SEQ ID NO: 14501 - DNA, 60 bp, Xenorhabdus bovienii
  Promoter location: Contig name=SeqID_16906; Position on contig =99727..99786bp; Strand=+
acgcctgatctcacgatctgggatttggctatagccacaatcatatttcaaataaatgta

SEQ ID NO: 14502 - DNA, 60 bp, Xenorhabdus bovienii
  Promoter location: Contig name=SeqID_16906; Position on contig =100678..100737bp; Strand=-
attagaaaagtgtgcttcattttgataactatcaggaatggagttaataagatttgccct

SEQ ID NO: 14503 - DNA, 60 bp, Xenorhabdus bovienii
  Promoter location: Contig name=SeqID_16906; Position on contig =100318..100377bp; Strand=+
aaatgacatttatcacatttttattgaatgatttttgttcatagtggaattattaaattt

SEQ ID NO: 14504 - DNA, 60 bp, Xenorhabdus bovienii
  Promoter location: Contig name=SeqID_16906; Position on contig =104326..104385bp; Strand=-; Gene name=Hpt
cacatcgcgggtagagttcatctcattgccatagctggacgcagtcataaaatccacttc

SEQ ID NO: 14505 - DNA, 60 bp, Xenorhabdus bovienii
  Promoter location: Contig name=SeqID_16906; Position on contig =104058..104117bp; Strand=+; Gene name=Hpt
acggtatatcaatcggtgtatcacttttcgtaaaaagacacatgattttattttaatttt

SEQ ID NO: 14506 - DNA, 60 bp, Xenorhabdus bovienii
  Promoter location: Contig name=SeqID_16906; Position on contig =105438..105497bp; Strand=-; Gene name=CcmA
taaaaaacattattcaattaattattaaattctcaattaatgttgtatatgattctatct

SEQ ID NO: 14507 - DNA, 60 bp, Xenorhabdus bovienii
  Promoter location: Contig name=SeqID_16906; Position on contig =105394..105453bp; Strand=+; Gene name=CcmA
cttcaatttttctcatcataactaatagcctggcaacgtttttgagatagaatcatatac

SEQ ID NO: 14508 - DNA, 60 bp, Xenorhabdus bovienii
  Promoter location: Contig name=SeqID_16906; Position on contig =107842..107901bp; Strand=-
tcaaatgcatacaaaaatatcgccttagatatatagaaataatattttaaaattgcattt

SEQ ID NO: 14509 - DNA, 60 bp, Xenorhabdus bovienii
  Promoter location: Contig name=SeqID_16906; Position on contig =108029..108088bp; Strand=+
attttatttataatccaagcaattcattaatagtgaacttgtttgttatatttatttctc

SEQ ID NO: 14510 - DNA, 60 bp, Xenorhabdus bovienii
  Promoter location: Contig name=SeqID_16906; Position on contig =110106..110165bp; Strand=-; Gene name=FolK
atagcaggatttatcgttgtaacatagccgttttatgaaggaaaagttattcaatatctc

SEQ ID NO: 14511 - DNA, 60 bp, Xenorhabdus bovienii
  Promoter location: Contig name=SeqID_16906; Position on contig =112247..112306bp; Strand=-; Gene name=GlnS
gtgtttctattggctctgcaagcattctcaaagaatgcccagtaagttatgattagcggc

SEQ ID NO: 14512 - DNA, 60 bp, Xenorhabdus bovienii
  Promoter location: Contig name=SeqID_16906; Position on contig =113782..113841bp; Strand=-
ttgcaaaactaatggcaggaacaattgccaacctcgcagtcatctgctatttatagcggc

SEQ ID NO: 14513 - DNA, 60 bp, Xenorhabdus bovienii
  Promoter location: Contig name=SeqID_16906; Position on contig =113506..113565bp; Strand=+
gatcagggaagttcgctgcctcatcttgcatatgagatacagtacggtctacttcatccc

SEQ ID NO: 14514 - DNA, 60 bp, Xenorhabdus bovienii
  Promoter location: Contig name=SeqID_16906; Position on contig =114678..114737bp; Strand=-; Gene name=HrpA
aataacaaaggatcaccctaaccattaactttcaatgggcgtcattgtagcattggctac

SEQ ID NO: 14515 - DNA, 60 bp, Xenorhabdus bovienii
  Promoter location: Contig name=SeqID_16906; Position on contig =114642..114701bp; Strand=+; Gene name=HrpA
gctaatggtcggaaagatcaatgaactgaaattaaagtagccaatgctacaatgacgccc

SEQ ID NO: 14516 - DNA, 60 bp, Xenorhabdus bovienii
  Promoter location: Contig name=SeqID_16906; Position on contig =120082..120141bp; Strand=-
tccaataagcgatcattttttatttcacccatatcattactgtatttatacataacaatt

SEQ ID NO: 14517 - DNA, 60 bp, Xenorhabdus bovienii
  Promoter location: Contig name=SeqID_16906; Position on contig =119831..119890bp; Strand=+
tgaaaataatttttttaagtaaatataatttacttttgaatgtaatttattatgagtata

SEQ ID NO: 14518 - DNA, 60 bp, Xenorhabdus bovienii
  Promoter location: Contig name=SeqID_16906; Position on contig =129821..129880bp; Strand=-; Gene name=IscA
cacgcttctccatgtcaggatgatttggcttccccatcaggctgctttaaaatggcctcc

SEQ ID NO: 14519 - DNA, 60 bp, Xenorhabdus bovienii
  Promoter location: Contig name=SeqID_16906; Position on contig =129877..129936bp; Strand=+; Gene name=IscA
cgtgttgccttggtgtagcaaaacttgaacgaatcagttaggtatcggataatcgcggct

SEQ ID NO: 14520 - DNA, 60 bp, Xenorhabdus bovienii
  Promoter location: Contig name=SeqID_16906; Position on contig =132030..132089bp; Strand=-; Gene name=Dgt
gtaaacagtgattcaatgttacactgccgcatcgaataagagtgccttttcatagacact

SEQ ID NO: 14521 - DNA, 60 bp, Xenorhabdus bovienii
  Promoter location: Contig name=SeqID_16906; Position on contig =131958..132017bp; Strand=+; Gene name=Dgt
tgttacttcttgttccattgcgcctattacacctactttcattgtgtcatactcatggtt

SEQ ID NO: 14522 - DNA, 60 bp, Xenorhabdus bovienii
  Promoter location: Contig name=SeqID_16906; Position on contig =136078..136137bp; Strand=-; Gene name=TrmA
cggtaacggaaataatgcctcggtttacggagcggcggtttggggagtaaaattgcacca

SEQ ID NO: 14523 - DNA, 60 bp, Xenorhabdus bovienii
  Promoter location: Contig name=SeqID_16906; Position on contig =142367..142426bp; Strand=+; Gene name=Eno
gggcgattgattggttttaattgtaatttattgaattttaatgaatttaatttcaatcga

SEQ ID NO: 14524 - DNA, 60 bp, Xenorhabdus bovienii
  Promoter location: Contig name=SeqID_16906; Position on contig =144189..144248bp; Strand=-; Gene name=CitT
ggttttttcgccatacggcaaaaacttaagcaaagcgacaagcaagataatatccagcgc

SEQ ID NO: 14525 - DNA, 60 bp, Xenorhabdus bovienii
  Promoter location: Contig name=SeqID_16906; Position on contig =143968..144027bp; Strand=+; Gene name=CitT
atcccaaaatcatacacgttgtattttcttccttgttaatactccttattatttcacatg

SEQ ID NO: 14526 - DNA, 60 bp, Xenorhabdus bovienii
  Promoter location: Contig name=SeqID_16906; Position on contig =147077..147136bp; Strand=-
acagaaaaataagagttaatcccataaaacattcgggatagatgtcctagcataggaaaa

SEQ ID NO: 14527 - DNA, 60 bp, Xenorhabdus bovienii
  Promoter location: Contig name=SeqID_16906; Position on contig =146792..146851bp; Strand=+
aggtcagcgattttcagtagcagagattgtttttcggctgctgattttttactccatgca

SEQ ID NO: 14528 - DNA, 60 bp, Xenorhabdus bovienii
  Promoter location: Contig name=SeqID_16906; Position on contig =148943..149002bp; Strand=+
tataaaggttttttcttggaagtgttatccataaaggatcctgtggttaatataattatt

SEQ ID NO: 14529 - DNA, 60 bp, Xenorhabdus bovienii
  Promoter location: Contig name=SeqID_16906; Position on contig =150340..150399bp; Strand=-
aaaacacattatttccctatataaatcactcatggacttatcgatagttttcatattacg

SEQ ID NO: 14530 - DNA, 60 bp, Xenorhabdus bovienii
  Promoter location: Contig name=SeqID_16906; Position on contig =150639..150698bp; Strand=+
atagaggctgaaataatttatagtaaatttttttatatggaaattattttaattaatcaa

SEQ ID NO: 14531 - DNA, 60 bp, Xenorhabdus bovienii
  Promoter location: Contig name=SeqID_16906; Position on contig =151097..151156bp; Strand=+
taaaaatagctgatgcagttatttttctcttttcttgatactacatttatacttacaaat

SEQ ID NO: 14532 - DNA, 60 bp, Xenorhabdus bovienii
  Promoter location: Contig name=SeqID_16906; Position on contig =153536..153595bp; Strand=-
tccttgacaagagtgccttaaaatggccgtctagatggtaaaacatctacccttaaacca

SEQ ID NO: 14533 - DNA, 60 bp, Xenorhabdus bovienii
  Promoter location: Contig name=SeqID_16906; Position on contig =154003..154062bp; Strand=-
catgcccttaaattatagaaacgtttagagggaactaaacaattatttacggtgtgacaa

SEQ ID NO: 14534 - DNA, 60 bp, Xenorhabdus bovienii
  Promoter location: Contig name=SeqID_16906; Position on contig =157178..157237bp; Strand=+
aatccagtaaaaccacgaccagatattgcagctgcgaaaaactccgctaggatgtttgca

SEQ ID NO: 14535 - DNA, 60 bp, Xenorhabdus bovienii
  Promoter location: Contig name=SeqID_16906; Position on contig =159813..159872bp; Strand=-; Gene name=LeuC
tcatagtttggctcatctcacattgcctccgaaagattaaaaaatagtaaaaaaatagaa

SEQ ID NO: 14536 - DNA, 60 bp, Xenorhabdus bovienii
  Promoter location: Contig name=SeqID_16906; Position on contig =159777..159836bp; Strand=+; Gene name=LeuC
tttccctgctataagcgttagtaatgtcgttaagacttctatttttttactattttttaa

SEQ ID NO: 14537 - DNA, 60 bp, Xenorhabdus bovienii
  Promoter location: Contig name=SeqID_16906; Position on contig =162619..162678bp; Strand=-
tctttgctcacaaacagaagggactctgacgttttttcaaatcttgccaatatcgcaaat

SEQ ID NO: 14538 - DNA, 60 bp, Xenorhabdus bovienii
  Promoter location: Contig name=SeqID_16906; Position on contig =162925..162984bp; Strand=-
atgcctgacttctataattagatttgatttagctacttggttaatcttatcatccagttt

SEQ ID NO: 14539 - DNA, 60 bp, Xenorhabdus bovienii
  Promoter location: Contig name=SeqID_16906; Position on contig =162811..162870bp; Strand=+
atcaaaggaatggataattgatagtagcaagcatccatgaaataaatattatttaatata

SEQ ID NO: 14540 - DNA, 60 bp, Xenorhabdus bovienii
  Promoter location: Contig name=SeqID_16906; Position on contig =163840..163899bp; Strand=+; Gene name=GalE
aattttgccatactttagcgcttgttcactaacttactgactctttttatactctttctt

SEQ ID NO: 14541 - DNA, 60 bp, Xenorhabdus bovienii
  Promoter location: Contig name=SeqID_16906; Position on contig =165094..165153bp; Strand=+; Gene name=SmtA
acagatactgtgaatttctgcattattacctatttctttaccgactgttgttatccatcg

SEQ ID NO: 14542 - DNA, 60 bp, Xenorhabdus bovienii
  Promoter location: Contig name=SeqID_16906; Position on contig =166552..166611bp; Strand=-
atacaaattgatatcagccagattaacttgattttttttctaaccactgcaatacctatt

SEQ ID NO: 14543 - DNA, 60 bp, Xenorhabdus bovienii
  Promoter location: Contig name=SeqID_16906; Position on contig =167698..167757bp; Strand=-; Gene name=CysK
tttaaaagaacaaataaaaactatatataacaaaatgtgattaattctatattaatagat

SEQ ID NO: 14544 - DNA, 60 bp, Xenorhabdus bovienii
  Promoter location: Contig name=SeqID_16906; Position on contig =167707..167766bp; Strand=+; Gene name=CysK
tatagaattaatcacattttgttatatatagtttttatttgttcttttaaattcattgcc

SEQ ID NO: 14545 - DNA, 60 bp, Xenorhabdus bovienii
  Promoter location: Contig name=SeqID_16906; Position on contig =170437..170496bp; Strand=+; Gene name=Def
atttttgtgctgctcttttttagcgattgtcttattgccttctgctgtaaattatcccta

SEQ ID NO: 14546 - DNA, 60 bp, Xenorhabdus bovienii
  Promoter location: Contig name=SeqID_16906; Position on contig =171134..171193bp; Strand=+
atattattccttcactcaatattttaattttatatatcagagttatttaaattattaatg

SEQ ID NO: 14547 - DNA, 60 bp, Xenorhabdus bovienii
  Promoter location: Contig name=SeqID_16906; Position on contig =172593..172652bp; Strand=-
tatttttaatacggtgaacaccaattaaaaaatcttgcatatcatgctattatcaaggca

SEQ ID NO: 14548 - DNA, 60 bp, Xenorhabdus bovienii
  Promoter location: Contig name=SeqID_16906; Position on contig =172884..172943bp; Strand=+
tatgatgactgatatcgcttgtgaaaaagagaataaaatgcattaagataatgaaaaata

SEQ ID NO: 14549 - DNA, 60 bp, Xenorhabdus bovienii
  Promoter location: Contig name=SeqID_16906; Position on contig =173192..173251bp; Strand=+
tttttttaacaaaggtattttatagtaggatgaaatgatggcacctcatcctactcgata

SEQ ID NO: 14550 - DNA, 60 bp, Xenorhabdus bovienii
  Promoter location: Contig name=SeqID_16906; Position on contig =176102..176161bp; Strand=-
gaaaaaaaccgcgccgagcgcggtttttttataccggctcggcgctcaagaatcaaacac

SEQ ID NO: 14551 - DNA, 60 bp, Xenorhabdus bovienii
  Promoter location: Contig name=SeqID_16906; Position on contig =176891..176950bp; Strand=-
ccaattaataagatcaatcaccccaatttgttagaaattaaattgagatccttccttgta

SEQ ID NO: 14552 - DNA, 60 bp, Xenorhabdus bovienii
  Promoter location: Contig name=SeqID_16906; Position on contig =177151..177210bp; Strand=-; Gene name=LysR
attactgacagccggttgtgacattcccagtgcctgagccgcacgtgtaatgttctgcat

SEQ ID NO: 14553 - DNA, 60 bp, Xenorhabdus bovienii
  Promoter location: Contig name=SeqID_16906; Position on contig =176773..176832bp; Strand=+; Gene name=LysR
taagtgactaatgtaattcgagttatttctattcatacataaagtattaatattcatgct

SEQ ID NO: 14554 - DNA, 60 bp, Xenorhabdus bovienii
  Promoter location: Contig name=SeqID_16906; Position on contig =178019..178078bp; Strand=+; Gene name=FAA1
tttgtttcatcaggtgtcattttgtctgacgtcatggtaacaagcattattattgcaaat

SEQ ID NO: 14555 - DNA, 60 bp, Xenorhabdus bovienii
  Promoter location: Contig name=SeqID_16906; Position on contig =180202..180261bp; Strand=+; Gene name=IlvB
gttaattaatctagtgttattgaatgagctaacactagattgactttatataaataaaaa

SEQ ID NO: 14556 - DNA, 60 bp, Xenorhabdus bovienii
  Promoter location: Contig name=SeqID_16906; Position on contig =182569..182628bp; Strand=+; Gene name=PurR
aatcgcaatctgcgggttaatatacagatacttaacgagccctactgtaaagtagggctt

SEQ ID NO: 14557 - DNA, 60 bp, Xenorhabdus bovienii
  Promoter location: Contig name=SeqID_16906; Position on contig =184035..184094bp; Strand=-
ggagagtatattcttagaaaaaaaatttaggttaaataattaccacttaaattaatttat

SEQ ID NO: 14558 - DNA, 60 bp, Xenorhabdus bovienii
  Promoter location: Contig name=SeqID_16906; Position on contig =184277..184336bp; Strand=-
ttaaccagtgttgctccacgaaacatactcaggttaccccttgatggtaaaaatctccac

SEQ ID NO: 14559 - DNA, 60 bp, Xenorhabdus bovienii
  Promoter location: Contig name=SeqID_16908; Position on contig =1711..1770bp; Strand=-
ataattattagatattttaggtagttcaagatggctgaatatcacgttaagctattttaa

SEQ ID NO: 14560 - DNA, 60 bp, Xenorhabdus bovienii
  Promoter location: Contig name=SeqID_16908; Position on contig =1304..1363bp; Strand=+
aataatttccagaccgttttcatccttgctggtaataattgcaaggttagcatcggtttc

SEQ ID NO: 14561 - DNA, 60 bp, Xenorhabdus bovienii
  Promoter location: Contig name=SeqID_16908; Position on contig =1581..1640bp; Strand=+
agaattcaatacgttaagaacaaactcttgcttcactccgcaagatgtgtactcgattaa

SEQ ID NO: 14562 - DNA, 60 bp, Xenorhabdus bovienii
  Promoter location: Contig name=SeqID_16908; Position on contig =3057..3116bp; Strand=-; Gene name=ZnuA
tgaattttttatctgcataggcttgctggctgaatagagtgagcgtgaataatgcgataa

SEQ ID NO: 14563 - DNA, 60 bp, Xenorhabdus bovienii
  Promoter location: Contig name=SeqID_16908; Position on contig =2916..2975bp; Strand=+; Gene name=ZnuA
atcattaattttgtgtaatatcgccttgactttaaataaatgatattgataatcattatc

SEQ ID NO: 14564 - DNA, 60 bp, Xenorhabdus bovienii
  Promoter location: Contig name=SeqID_16908; Position on contig =6842..6901bp; Strand=-
gttttaaaaacaggcaacatttctttcaagttggatttgataaaaatatgctgttcgccg

SEQ ID NO: 14565 - DNA, 60 bp, Xenorhabdus bovienii
  Promoter location: Contig name=SeqID_16908; Position on contig =6646..6705bp; Strand=+
gctatttaaatcactttttaacctgttcaattgttgcatctgtctgtaatatgagcatag

SEQ ID NO: 14566 - DNA, 60 bp, Xenorhabdus bovienii
  Promoter location: Contig name=SeqID_16908; Position on contig =7870..7929bp; Strand=-
aaaataaaaataacagctgcggaagcatttatcttctcttcgcagcttattaagatattc

SEQ ID NO: 14567 - DNA, 60 bp, Xenorhabdus bovienii
  Promoter location: Contig name=SeqID_16908; Position on contig =7751..7810bp; Strand=+
atgcttaattaatttttacctaatagataagataaaaaagaaaaatttattatattagga

SEQ ID NO: 14568 - DNA, 60 bp, Xenorhabdus bovienii
  Promoter location: Contig name=SeqID_16908; Position on contig =8631..8690bp; Strand=-
aatgacatcttatatctctccttgatggtgctaacgattaaagatttataattgtagcaa

SEQ ID NO: 14569 - DNA, 60 bp, Xenorhabdus bovienii
  Promoter location: Contig name=SeqID_16908; Position on contig =8699..8758bp; Strand=+
ctatagaagccgccatttgtgatataactagccctattatataaattcataataaaaaca

SEQ ID NO: 14570 - DNA, 60 bp, Xenorhabdus bovienii
  Promoter location: Contig name=SeqID_16908; Position on contig =9803..9862bp; Strand=-
ctaaataacatgaaggcggtggttactgctccgccagtgaacatcaataaaataggttca

SEQ ID NO: 14571 - DNA, 60 bp, Xenorhabdus bovienii
  Promoter location: Contig name=SeqID_16908; Position on contig =9663..9722bp; Strand=+
gattaatgaaatcaataggttaggttaaagaggggaattgtcccctttaaactctaagtt

SEQ ID NO: 14572 - DNA, 60 bp, Xenorhabdus bovienii
  Promoter location: Contig name=SeqID_16908; Position on contig =13608..13667bp; Strand=-
agtcttaacaggtcgctacggcggcctttttttatgggtgaaatatgtctaatcaattaa

SEQ ID NO: 14573 - DNA, 60 bp, Xenorhabdus bovienii; identical to SEQ ID NO: 13282
  Promoter location: Contig name=SeqID_16908; Position on contig =14496..14555bp; Strand=-

SEQ ID NO: 14574 - DNA, 60 bp, Xenorhabdus bovienii; identical to SEQ ID NO: 13986
  Promoter location: Contig name=SeqID_16908; Position on contig =14280..14339bp; Strand=+

SEQ ID NO: 14575 - DNA, 60 bp, Xenorhabdus bovienii
  Promoter location: Contig name=SeqID_16908; Position on contig =15786..15845bp; Strand=-
gtaaatatgatgccaaattacgttttgcgagtgttatctcgtaatattaaaatcatttaa

SEQ ID NO: 14576 - DNA, 60 bp, Xenorhabdus bovienii
  Promoter location: Contig name=SeqID_16908; Position on contig =16458..16517bp; Strand=-
tgctaaattaggaaagatgttaccggagtaatgattttcatatcaatatataatttattc

SEQ ID NO: 14577 - DNA, 60 bp, Xenorhabdus bovienii
  Promoter location: Contig name=SeqID_16908; Position on contig =16127..16186bp; Strand=+
ttaattaaattattttgttttattttgttttattttgttttattttgttttattttgttt

SEQ ID NO: 14578 - DNA, 60 bp, Xenorhabdus bovienii
  Promoter location: Contig name=SeqID_16908; Position on contig =17443..17502bp; Strand=+
tacaggcatgttttttgtgtattttttatttaagtgataatgctatttaaaataatgtat

SEQ ID NO: 14579 - DNA, 60 bp, Xenorhabdus bovienii
  Promoter location: Contig name=SeqID_16908; Position on contig =19587..19646bp; Strand=-
accatttaaaaaggcgagggctttttaattaaagtccttggtaaaatatctaattatttt

SEQ ID NO: 14580 - DNA, 60 bp, Xenorhabdus bovienii
  Promoter location: Contig name=SeqID_16908; Position on contig =20933..20992bp; Strand=+
taagaattcaaaatagtagatcacttgagggaactcagtccgatttttacgatctgatca

SEQ ID NO: 14581 - DNA, 60 bp, Xenorhabdus bovienii
  Promoter location: Contig name=SeqID_16908; Position on contig =25652..25711bp; Strand=+
acataaatgttcccaaaatgtatttatacagaaaatgaagtattagataatatattttta

SEQ ID NO: 14582 - DNA, 60 bp, Xenorhabdus bovienii
  Promoter location: Contig name=SeqID_16908; Position on contig =27491..27550bp; Strand=+
attctcttgcagcaaggcgttcttatccgcttctgaaaaataaaagatataatctgcgcc

SEQ ID NO: 14583 - DNA, 60 bp, Xenorhabdus bovienii
  Promoter location: Contig name=SeqID_16908; Position on contig =69443..69502bp; Strand=-
gaatgataatatatcgtaagttaataatttttatttaaataatattttatgttatataaa

SEQ ID NO: 14584 - DNA, 60 bp, Xenorhabdus bovienii
  Promoter location: Contig name=SeqID_16908; Position on contig =69864..69923bp; Strand=-
aacggatattattatattcagggttattattttcttgatcataacctgataattctccct

SEQ ID NO: 14585 - DNA, 60 bp, Xenorhabdus bovienii
  Promoter location: Contig name=SeqID_16908; Position on contig =69758..69817bp; Strand=+
ccttatgcaccttaaaatacatctcgattccgtagatatgccaatgccataataatacca

SEQ ID NO: 14586 - DNA, 60 bp, Xenorhabdus bovienii
  Promoter location: Contig name=SeqID_16908; Position on contig =71592..71651bp; Strand=+; Gene name=XerC
gcaattccactcacctggaggatttggtcaaatttggaagtccctaataaaaaggtcagg

SEQ ID NO: 14587 - DNA, 60 bp, Xenorhabdus bovienii
  Promoter location: Contig name=SeqID_16908; Position on contig =72262..72321bp; Strand=-
ctatgttacggtggcagcgtggaaaaattgccatgtcagcccaaggctaatatggcactt

SEQ ID NO: 14588 - DNA, 60 bp, Xenorhabdus bovienii
  Promoter location: Contig name=SeqID_16908; Position on contig =72281..72340bp; Strand=+
ggctgacatggcaatttttccacgctgccaccgtaacatagccctttcaaactaaagcgc

SEQ ID NO: 14589 - DNA, 60 bp, Xenorhabdus bovienii
  Promoter location: Contig name=SeqID_16908; Position on contig =77276..77335bp; Strand=+; Gene name=FliJ
caatatagcttattgctaatacaactttgctattaatgtaattcagtaacgcttatgtct

SEQ ID NO: 14590 - DNA, 60 bp, Xenorhabdus bovienii
  Promoter location: Contig name=SeqID_16908; Position on contig =79546..79605bp; Strand=-; Gene name=FliL
tgtaaaacacggtcaatatggtcttcgttgtcgatcaaattgacggtaaaattctccagc

SEQ ID NO: 14591 - DNA, 60 bp, Xenorhabdus bovienii; identical to SEQ ID NO: 13523
  Promoter location: Contig name=SeqID_16908; Position on contig =87062..87121bp; Strand=-

SEQ ID NO: 14592 - DNA, 60 bp, Xenorhabdus bovienii
  Promoter location: Contig name=SeqID_16908; Position on contig =86721..86780bp; Strand=+
tttcagcccagcaagataacgtttagctttttccggtagggtattttcataatcctgctc

SEQ ID NO: 14593 - DNA, 60 bp, Xenorhabdus bovienii
  Promoter location: Contig name=SeqID_16908; Position on contig =88669..88728bp; Strand=-
tgattaacttatttcgattttttaatgataattgtttttattaattataaatttattggc

SEQ ID NO: 14594 - DNA, 60 bp, Xenorhabdus bovienii
  Promoter location: Contig name=SeqID_16908; Position on contig =88632..88691bp; Strand=+
aatgtaatcgagtgactattcgagcatcgatttatccgccaataaatttataattaataa

SEQ ID NO: 14595 - DNA, 60 bp, Xenorhabdus bovienii
  Promoter location: Contig name=SeqID_16908; Position on contig =91053..91112bp; Strand=+
aaattaattaaaaacattatttatttaatatcgatatttttataaattatattttattta

SEQ ID NO: 14596 - DNA, 60 bp, Xenorhabdus bovienii
  Promoter location: Contig name=SeqID_16908; Position on contig =92116..92175bp; Strand=-
gtgtcaaaataacgatcactctggttttctgcaatttcgaccccaaatataatagctaac

SEQ ID NO: 14597 - DNA, 60 bp, Xenorhabdus bovienii
  Promoter location: Contig name=SeqID_16908; Position on contig =92894..92953bp; Strand=-
ttataatattttatcttgtgatcaagatcttatctttgataggaaagtagaataatgcat

SEQ ID NO: 14598 - DNA, 60 bp, Xenorhabdus bovienii
  Promoter location: Contig name=SeqID_16908; Position on contig =92668..92727bp; Strand=+
gactacatcacagactgtattgattccttcttccccgattgcccattcataatcaattgt

SEQ ID NO: 14599 - DNA, 60 bp, Xenorhabdus bovienii
  Promoter location: Contig name=SeqID_16908; Position on contig =95522..95581bp; Strand=+
gcccagtgcggcatgtttagtttgtgcagagctatgttgctggttgataaactcactata

SEQ ID NO: 14600 - DNA, 60 bp, Xenorhabdus bovienii
  Promoter location: Contig name=SeqID_16908; Position on contig =98807..98866bp; Strand=-; Gene name=FlgE
agatttcccgttgcagccagcaaagccgcaacggaaaagataaaaggtataatcattaat

SEQ ID NO: 14601 - DNA, 60 bp, Xenorhabdus bovienii
  Promoter location: Contig name=SeqID_16908; Position on contig =102240..102299bp; Strand=+
ggtgggatcttggttcttaagttgagcaaccaataaattcaagaagttatctttgatatc

SEQ ID NO: 14602 - DNA, 60 bp, Xenorhabdus bovienii
  Promoter location: Contig name=SeqID_16908; Position on contig =103279..103338bp; Strand=-; Gene name=FlgA
atcagctttttcttctgagtttattctgttagctgcttagagcttaatacaatgggcttt

SEQ ID NO: 14603 - DNA, 60 bp, Xenorhabdus bovienii
  Promoter location: Contig name=SeqID_16908; Position on contig =103380..103439bp; Strand=+; Gene name=FlgA
acgaataatcaaccgcgttacactattcacatccaacaggtactgaatattttttgaaat

SEQ ID NO: 14604 - DNA, 60 bp, Xenorhabdus bovienii
  Promoter location: Contig name=SeqID_16908; Position on contig =104802..104861bp; Strand=-
aacagtttggctgatttgatcccataataccgccagtatttcatggctagaatagggtgc

SEQ ID NO: 14605 - DNA, 60 bp, Xenorhabdus bovienii
  Promoter location: Contig name=SeqID_16908; Position on contig =104507..104566bp; Strand=+
gtaaaattgctgatgctctgttcagagaagcccttgaaaacatggaatatgataaataag

SEQ ID NO: 14606 - DNA, 60 bp, Xenorhabdus bovienii
  Promoter location: Contig name=SeqID_16908; Position on contig =109517..109576bp; Strand=-; Gene name=FimA
tttttttattgcttttgtgatatctccaccgcattcggtgggggtgtctctcatttttag

SEQ ID NO: 14607 - DNA, 60 bp, Xenorhabdus bovienii
  Promoter location: Contig name=SeqID_16908; Position on contig =111117..111176bp; Strand=-
tatcctccccttaaaatagattcattaacgaactcagcgatgtcttttaacagatttact

SEQ ID NO: 14608 - DNA, 60 bp, Xenorhabdus bovienii
  Promoter location: Contig name=SeqID_16908; Position on contig =111326..111385bp; Strand=+
ctcggttaagttttttcatcagttttttactgcaaatgcggcttcggtaaagtttttatc

SEQ ID NO: 14609 - DNA, 60 bp, Xenorhabdus bovienii
  Promoter location: Contig name=SeqID_16908; Position on contig =112407..112466bp; Strand=-
tgctttatgtggaagatcaggtcatgacatcaatttattgaaccctgtatagtctgtcta

SEQ ID NO: 14610 - DNA, 60 bp, Xenorhabdus bovienii
  Promoter location: Contig name=SeqID_16908; Position on contig =113228..113287bp; Strand=-; Gene name=FlhA
atatataaaaattgaatttatatttaaataaatataagtatttatttttttaaaattatt

SEQ ID NO: 14611 - DNA, 60 bp, Xenorhabdus bovienii
  Promoter location: Contig name=SeqID_16908; Position on contig =116906..116965bp; Strand=-
atgtcaacaggataatgcagacgtttgaaagatttccgtattaaagacatgctcagctca

SEQ ID NO: 14612 - DNA, 60 bp, Xenorhabdus bovienii
  Promoter location: Contig name=SeqID_16908; Position on contig =116672..116731bp; Strand=+
agcgttcgttattgcatgcagaaaaattgcttttgggaaagagcaaataaaattgtgtta

SEQ ID NO: 14613 - DNA, 60 bp, Xenorhabdus bovienii
  Promoter location: Contig name=SeqID_16908; Position on contig =122505..122564bp; Strand=-
gattattttaaggttttttatactattgaatgtctttgtgaaaaaggtataaataaattt

SEQ ID NO: 14614 - DNA, 60 bp, Xenorhabdus bovienii
  Promoter location: Contig name=SeqID_16908; Position on contig =124754..124813bp; Strand=-
tgaaataacagattttttcgaatttaaatcattaaaattatttatgttataatgttgatt

SEQ ID NO: 14615 - DNA, 60 bp, Xenorhabdus bovienii
  Promoter location: Contig name=SeqID_16908; Position on contig =128155..128214bp; Strand=-; Gene name=PinR
gactcttgccactgataatccttcaatacccaaaaaaaccatttattatgcaaataatac

SEQ ID NO: 14616 - DNA, 60 bp, Xenorhabdus bovienii
  Promoter location: Contig name=SeqID_16908; Position on contig =128090..128149bp; Strand=+; Gene name=PinR
atctgatttcgccaatttttatcttgcaatcaagaaaattaatggttttttatataaaaa

SEQ ID NO: 14617 - DNA, 60 bp, Xenorhabdus bovienii
  Promoter location: Contig name=SeqID_16908; Position on contig =129039..129098bp; Strand=+
accccatttttttcctcttggttgtaatgcataaaggcaaaggcagttatgttattcatg

SEQ ID NO: 14618 - DNA, 60 bp, Xenorhabdus bovienii
  Promoter location: Contig name=SeqID_16908; Position on contig =130110..130169bp; Strand=-
actgagtaaacccgttcaaccttccctgttatgcaggcggggaaggttaagaccgcattt

SEQ ID NO: 14619 - DNA, 60 bp, Xenorhabdus bovienii
  Promoter location: Contig name=SeqID_16908; Position on contig =138296..138355bp; Strand=-
ttgtctatttgttaatttataatcattcactacgttttcttgggattataatccatgagg

SEQ ID NO: 14620 - DNA, 60 bp, Xenorhabdus bovienii
  Promoter location: Contig name=SeqID_16908; Position on contig =138452..138511bp; Strand=+
gatccttaattataaataattacctcaaaatcacactattttcatgttatatttttatta

SEQ ID NO: 14621 - DNA, 60 bp, Xenorhabdus bovienii
  Promoter location: Contig name=SeqID_16908; Position on contig =139027..139086bp; Strand=-
tataaaaagacatattatttgcttgaaaaatagacatctttttttgttaaagccgtttta

SEQ ID NO: 14622 - DNA, 60 bp, Xenorhabdus bovienii
  Promoter location: Contig name=SeqID_16908; Position on contig =139478..139537bp; Strand=-; Gene name=DesA
cgcaaaggcgaagacaatcttgctgatgaatagggctggacgtttgacaaaatattcacg

SEQ ID NO: 14623 - DNA, 60 bp, Xenorhabdus bovienii
  Promoter location: Contig name=SeqID_16908; Position on contig =141457..141516bp; Strand=-
ggctgttgacgttttgtgaggggaatttgaacagcatgatgattgggtataatcgttttc

SEQ ID NO: 14624 - DNA, 60 bp, Xenorhabdus bovienii; identical to SEQ ID NO: 13955
  Promoter location: Contig name=SeqID_16908; Position on contig =141279..141338bp; Strand=+

SEQ ID NO: 14625 - DNA, 60 bp, Xenorhabdus bovienii
  Promoter location: Contig name=SeqID_16908; Position on contig =142250..142309bp; Strand=+
taatgcgggatgatgtttggattttactgtggtgagagcaccagatatatcattggcagg

SEQ ID NO: 14626 - DNA, 60 bp, Xenorhabdus bovienii
  Promoter location: Contig name=SeqID_16908; Position on contig =143269..143328bp; Strand=-
atttgttgctgccccggcactgtgttgatgcgctcgaacaatactgccatcaataaatag

SEQ ID NO: 14627 - DNA, 60 bp, Xenorhabdus bovienii; identical to SEQ ID NO: 14382
  Promoter location: Contig name=SeqID_16908; Position on contig =142918..142977bp; Strand=+

SEQ ID NO: 14628 - DNA, 60 bp, Xenorhabdus bovienii
  Promoter location: Contig name=SeqID_16908; Position on contig =150474..150533bp; Strand=-
ggctgtcgtgattgttgccactcattatagtcagtcgagcaaaacggcagccttaattgt

SEQ ID NO: 14629 - DNA, 60 bp, Xenorhabdus bovienii
  Promoter location: Contig name=SeqID_16908; Position on contig =150249..150308bp; Strand=+
ggcttctgtatcgttctttaaaccattaaagaacagtcccccggagataaattgcagagc

SEQ ID NO: 14630 - DNA, 60 bp, Xenorhabdus bovienii
  Promoter location: Contig name=SeqID_16908; Position on contig =155182..155241bp; Strand=-
aaatgggaaacttaaaagcaggttacaggtttttatgtgcagacctgtaatctgctctgt

SEQ ID NO: 14631 - DNA, 60 bp, Xenorhabdus bovienii
  Promoter location: Contig name=SeqID_16908; Position on contig =156202..156261bp; Strand=-
tcatgctactggtaattttgtcgtgagtgattctttgatcacttaattaatttttcatat

SEQ ID NO: 14632 - DNA, 60 bp, Xenorhabdus bovienii
  Promoter location: Contig name=SeqID_16908; Position on contig =156303..156362bp; Strand=+
ccagagcagtaactgtcctttgtattactcttgggatcgcccaatttctaaaatatttcg

SEQ ID NO: 14633 - DNA, 60 bp, Xenorhabdus bovienii
  Promoter location: Contig name=SeqID_16908; Position on contig =156793..156852bp; Strand=-
aaccaaaaatgatcagattagtagctttttaataactagtattcacatataattaataaa

SEQ ID NO: 14634 - DNA, 60 bp, Xenorhabdus bovienii
  Promoter location: Contig name=SeqID_16908; Position on contig =157117..157176bp; Strand=-
gtataaggtagtcaatgaggagaaataacaaccagtgaggatttagttaaatttatgcca

SEQ ID NO: 14635 - DNA, 60 bp, Xenorhabdus bovienii
  Promoter location: Contig name=SeqID_16908; Position on contig =156890..156949bp; Strand=+
ttcaagccactttacgcataaatatcacacagatcacaaaaataagataaaatacagtat

SEQ ID NO: 14636 - DNA, 60 bp, Xenorhabdus bovienii
  Promoter location: Contig name=SeqID_16908; Position on contig =157710..157769bp; Strand=-; Gene name=MgtA
tttacattcatcacgttggtggatagttgtaaataattctcattaattaacatcttattc

SEQ ID NO: 14637 - DNA, 60 bp, Xenorhabdus bovienii
  Promoter location: Contig name=SeqID_16908; Position on contig =158070..158129bp; Strand=-
attgggttagggacgacattttctatcttagatatcacaatattcgctatgatttgatat

SEQ ID NO: 14638 - DNA, 60 bp, Xenorhabdus bovienii
  Promoter location: Contig name=SeqID_16908; Position on contig =158013..158072bp; Strand=+
ccatgaactagcctattggaatgaagtttgatgttctgcacagctcactataaatatata

SEQ ID NO: 14639 - DNA, 60 bp, Xenorhabdus bovienii
  Promoter location: Contig name=SeqID_16908; Position on contig =162660..162719bp; Strand=-; Gene name=CspC
gtgaaatcgtctaccggttaagcctttacttatcaattttacctgtttatactccaaacc

SEQ ID NO: 14640 - DNA, 60 bp, Xenorhabdus bovienii
  Promoter location: Contig name=SeqID_16908; Position on contig =163401..163460bp; Strand=-
atcaaataaaattataactgtacctatttattatgtcattctgttctaatattgagcgta

SEQ ID NO: 14641 - DNA, 60 bp, Xenorhabdus bovienii
  Promoter location: Contig name=SeqID_16908; Position on contig =163816..163875bp; Strand=-
atatcgaaaagcagaacggctgccatggcgacaaaaagtactgtaaataaaatcagtgac

SEQ ID NO: 14642 - DNA, 60 bp, Xenorhabdus bovienii
  Promoter location: Contig name=SeqID_16908; Position on contig =163398..163457bp; Strand=+
gtatacgctcaatattagaacagaatgacataataaataggtacagttataattttattt

SEQ ID NO: 14643 - DNA, 60 bp, Xenorhabdus bovienii
  unsure (1)..(60): unsure at all n locations
  Promoter location: Contig name=SeqID_16908; Position on contig =164748..164807bp; Strand=-
nnnnnnnnnnnnnnnnnnnnnnnnnnnnnnnnnnnnggaggaattgctttgttcctgaga

SEQ ID NO: 14644 - DNA, 60 bp, Xenorhabdus bovienii
  Promoter location: Contig name=SeqID_16909; Position on contig =1019..1078bp; Strand=-
ttagcgaggatgacgattttacaatgaaggcacaatgtatgaaacgcaataatcagtgtg

SEQ ID NO: 14645 - DNA, 60 bp, Xenorhabdus bovienii
  Promoter location: Contig name=SeqID_16909; Position on contig =1320..1379bp; Strand=-
gccattttgattgcggaatttcttgatgagcaaacaacattggccgatatccattgtatt

SEQ ID NO: 14646 - DNA, 60 bp, Xenorhabdus bovienii
  Promoter location: Contig name=SeqID_16909; Position on contig =1771..1830bp; Strand=-
gggttagaaaaaagattacacagtgccttgccgtcagggtactgtgttttgttgtgcggt

SEQ ID NO: 14647 - DNA, 60 bp, Xenorhabdus bovienii
  Promoter location: Contig name=SeqID_16909; Position on contig =2876..2935bp; Strand=-
tttgaatcacacgagttggtagacttgcagcctaaactaagcaggaattaaatgagggat

SEQ ID NO: 14648 - DNA, 60 bp, Xenorhabdus bovienii
  Promoter location: Contig name=SeqID_16909; Position on contig =3545..3604bp; Strand=-; Gene name=LysR
cccaacaaaagagaggatttttataaccgaatgaaaaagtgtatattttgcacctttttt

SEQ ID NO: 14649 - DNA, 60 bp, Xenorhabdus bovienii
  Promoter location: Contig name=SeqID_16909; Position on contig =3515..3574bp; Strand=+; Gene name=LysR
attctgcacttcttatttatattaaaacacaaaaaaggtgcaaaatatacactttttcat

SEQ ID NO: 14650 - DNA, 60 bp, Xenorhabdus bovienii
  Promoter location: Contig name=SeqID_16909; Position on contig =6824..6883bp; Strand=-
caagaccataacactctataaacctcgaaaaagtcaattttatagagtattctacaaatc

SEQ ID NO: 14651 - DNA, 60 bp, Xenorhabdus bovienii
  Promoter location: Contig name=SeqID_16909; Position on contig =7519..7578bp; Strand=-
gctgatcggataaccaatagctctactcgctcagattccctgataagtatgattgttcgc

SEQ ID NO: 14652 - DNA, 60 bp, Xenorhabdus bovienii
  Promoter location: Contig name=SeqID_16909; Position on contig =7443..7502bp; Strand=+
atcatagggctgacatctcgaatggcggcttttactgtatatacgggcataatttccctt

SEQ ID NO: 14653 - DNA, 60 bp, Xenorhabdus bovienii
  Promoter location: Contig name=SeqID_16909; Position on contig =8823..8882bp; Strand=+
gtattaaatttgtacataaaaatactcaagccggactcatgtccggttatcctctttgtt

SEQ ID NO: 14654 - DNA, 60 bp, Xenorhabdus bovienii
  Promoter location: Contig name=SeqID_16909; Position on contig =9191..9250bp; Strand=+
tttaattagttattaattatctgcatttttaagaacgaataggtagataagatgggtaat

SEQ ID NO: 14655 - DNA, 60 bp, Xenorhabdus bovienii
  Promoter location: Contig name=SeqID_16909; Position on contig =12067..12126bp; Strand=+
ccacctaaccagccgtgacggttctgttgcaataagcaaagccttggtaatatctcactt

SEQ ID NO: 14656 - DNA, 60 bp, Xenorhabdus bovienii
  Promoter location: Contig name=SeqID_16909; Position on contig =13531..13590bp; Strand=+; Gene name=VgrG
ccttattcacacaatcacattgccaataactaaaaagaaatatccggtataattttattg

SEQ ID NO: 14657 - DNA, 60 bp, Xenorhabdus bovienii
  Promoter location: Contig name=SeqID_16909; Position on contig =20828..20887bp; Strand=+
gctgattttttttcactgcaaggtcatgctcaggctgtactgggtaataaattgattaat

SEQ ID NO: 14658 - DNA, 60 bp, Xenorhabdus bovienii
  Promoter location: Contig name=SeqID_16909; Position on contig =27300..27359bp; Strand=+
atacccatccaacttcacgttgccgcttacaaactcatgtgagtgtttatacctctgcgc

SEQ ID NO: 14659 - DNA, 60 bp, Xenorhabdus bovienii
  Promoter location: Contig name=SeqID_16909; Position on contig =28604..28663bp; Strand=+
gcggggaggtatcacgcatcttgaaaggcgactgctatatatccgattaaattagctaat

SEQ ID NO: 14660 - DNA, 60 bp, Xenorhabdus bovienii
  Promoter location: Contig name=SeqID_16909; Position on contig =30822..30881bp; Strand=+
actgttactacataaattaaaaccattgttcttcattcaacattatttattgttcattgt

SEQ ID NO: 14661 - DNA, 60 bp, Xenorhabdus bovienii
  unsure (1)..(60): unsure at all n locations
  Promoter location: Contig name=SeqID_16910; Position on contig =2..61bp; Strand=+
nnnnnnnnnnnnnnnnnnnnnnnnnnnnnnnnnnnttatgaaaaaacttgggtaacaagt

SEQ ID NO: 14662 - DNA, 60 bp, Xenorhabdus bovienii
  Promoter location: Contig name=SeqID_16910; Position on contig =2160..2219bp; Strand=+; Gene name=Soj (BS)
ttagaataaatcctacaaaacctagttgccaatatgacagataagtgtaatatatattat

SEQ ID NO: 14663 - DNA, 60 bp, Xenorhabdus bovienii
  Promoter location: Contig name=SeqID_16910; Position on contig =5620..5679bp; Strand=-
ctccaactacattctttcactttattcccatccctaattattaatgctatatttaataag

SEQ ID NO: 14664 - DNA, 60 bp, Xenorhabdus bovienii
  Promoter location: Contig name=SeqID_16910; Position on contig =5743..5802bp; Strand=+
cgcagatcaattaataaaaatatttgatcgctcccatcactgttttttatatttattaga

SEQ ID NO: 14665 - DNA, 60 bp, Xenorhabdus bovienii
  Promoter location: Contig name=SeqID_16910; Position on contig =6612..6671bp; Strand=-
taatgagttatatgtttataaaatttattaattacgaggttgctatgtattatataaatg

SEQ ID NO: 14666 - DNA, 60 bp, Xenorhabdus bovienii
  Promoter location: Contig name=SeqID_16910; Position on contig =7312..7371bp; Strand=-; Gene name=Smf
aatgcaagcccgccatattttaaatgcgggccgctacacctacatatgtaaaattattag

SEQ ID NO: 14667 - DNA, 60 bp, Xenorhabdus bovienii
  Promoter location: Contig name=SeqID_16910; Position on contig =8073..8132bp; Strand=-; Gene name=CynS
tgccccacagatttttatgctctccattatatcaagaagaacattcgtatttttttctat

SEQ ID NO: 14668 - DNA, 60 bp, Xenorhabdus bovienii
  Promoter location: Contig name=SeqID_16910; Position on contig =9503..9562bp; Strand=-; Gene name=LysR
atacctgatataacggaaattcatgacaatcatccataagattttcagataatacccatc

SEQ ID NO: 14669 - DNA, 60 bp, Xenorhabdus bovienii
  Promoter location: Contig name=SeqID_16910; Position on contig =9453..9512bp; Strand=+; Gene name=LysR
atgcggtgaagattactccccatattccataaggtaaaagtctcgtttatgatgggtatt

SEQ ID NO: 14670 - DNA, 60 bp, Xenorhabdus bovienii; identical to SEQ ID NO: 14650
  Promoter location: Contig name=SeqID_16910; Position on contig =12544..12603bp; Strand=-

SEQ ID NO: 14671 - DNA, 60 bp, Xenorhabdus bovienii; identical to SEQ ID NO: 14651
  Promoter location: Contig name=SeqID_16910; Position on contig =13239..13298bp; Strand=-

SEQ ID NO: 14672 - DNA, 60 bp, Xenorhabdus bovienii
  Promoter location: Contig name=SeqID_16910; Position on contig =14120..14179bp; Strand=-
cgcgagagtgaagccgattatattttgtcccttaaaggcaatcagggaaaaaccttttcg

SEQ ID NO: 14673 - DNA, 60 bp, Xenorhabdus bovienii
  Promoter location: Contig name=SeqID_16910; Position on contig =14458..14517bp; Strand=+
ataaataactggaataaattatttacaatgaaatcatatatagagtgctaaaatttttta

SEQ ID NO: 14674 - DNA, 60 bp, Xenorhabdus bovienii
  Promoter location: Contig name=SeqID_16910; Position on contig =16133..16192bp; Strand=-
aaagtttggtgcccattttcttatttctaacgttttttttcctgtcgcaatattttcacc

SEQ ID NO: 14675 - DNA, 60 bp, Xenorhabdus bovienii
  Promoter location: Contig name=SeqID_16910; Position on contig =15989..16048bp; Strand=+
cagatttgcatgtcaaggctaagtagaaatgtcctgatttatgcatgtattataaataat

SEQ ID NO: 14676 - DNA, 60 bp, Xenorhabdus bovienii
  Promoter location: Contig name=SeqID_16910; Position on contig =16454..16513bp; Strand=+
ttataaaccagccagaacactgaattgcactttcatacctcattatgatgaaaataaaaa

SEQ ID NO: 14677 - DNA, 60 bp, Xenorhabdus bovienii
  Promoter location: Contig name=SeqID_16910; Position on contig =25070..25129bp; Strand=-
gggcgcgatcttgatctgatacgaatgaaaaatcaagcatcttcaattacgatgggtata

SEQ ID NO: 14678 - DNA, 60 bp, Xenorhabdus bovienii
  Promoter location: Contig name=SeqID_16910; Position on contig =24847..24906bp; Strand=+
acccaaagcatcaatgacttttttcttcggattaatttttccgccgataccataaataat

SEQ ID NO: 14679 - DNA, 60 bp, Xenorhabdus bovienii
  Promoter location: Contig name=SeqID_16910; Position on contig =27002..27061bp; Strand=-
taatacgttgtaatatatttggatttttgttagagaaaagtcaggtgaattatttacacc

SEQ ID NO: 14680 - DNA, 60 bp, Xenorhabdus bovienii
  Promoter location: Contig name=SeqID_16910; Position on contig =27720..27779bp; Strand=-
tacgatgggtatagatgagtttttatatcagtcagcattgaaaactataaaattatttaa

SEQ ID NO: 14681 - DNA, 60 bp, Xenorhabdus bovienii
  Promoter location: Contig name=SeqID_16910; Position on contig =27684..27743bp; Strand=+
tattaccctccttatgatataaaagaattgggataattaaataattttatagttttcaat

SEQ ID NO: 14682 - DNA, 60 bp, Xenorhabdus bovienii
  Promoter location: Contig name=SeqID_16910; Position on contig =29168..29227bp; Strand=-
gacggcattggtataccaatggcattcggttaaggaaataattatgttataaacataaag

SEQ ID NO: 14683 - DNA, 60 bp, Xenorhabdus bovienii
  Promoter location: Contig name=SeqID_16910; Position on contig =30485..30544bp; Strand=-
ctctgttaatgcgacagaacccattttcctttggcgagaaagatgcctactatagcaact

SEQ ID NO: 14684 - DNA, 60 bp, Xenorhabdus bovienii
  Promoter location: Contig name=SeqID_16910; Position on contig =31293..31352bp; Strand=-
gtcttctgagtagattaggattaataaacatggttctggtcatcaggtaagcttccctgt

SEQ ID NO: 14685 - DNA, 60 bp, Xenorhabdus bovienii
  Promoter location: Contig name=SeqID_16911; Position on contig =335..394bp; Strand=-; Gene name=LonB (BS)
tcagtatcatctgatcggagttgttcagcgtacaagtgtacgctatcctctggccttaca

SEQ ID NO: 14686 - DNA, 60 bp, Xenorhabdus bovienii
  Promoter location: Contig name=SeqID_16911; Position on contig =799..858bp; Strand=-
ttggaccaatttatggcgaagttgatggcgacagcgcctcactgctgaattatgtgcgtt

SEQ ID NO: 14687 - DNA, 60 bp, Xenorhabdus bovienii; identical to SEQ ID NO: 12261
  unsure (1)..(60): unsure at all n locations
  Promoter location: Contig name=SeqID_16912; Position on contig =1509..1568bp; Strand=-

SEQ ID NO: 14688 - DNA, 60 bp, Xenorhabdus bovienii
  Promoter location: Contig name=SeqID_16914; Position on contig =1596..1655bp; Strand=-
ttttgtgccatgagtcacagtgtacttgtaagtttttaagttcgttgtagactttactca

SEQ ID NO: 14689 - DNA, 60 bp, Xenorhabdus bovienii
  Promoter location: Contig name=SeqID_16914; Position on contig =2430..2489bp; Strand=-
gcgaagcgctttgaaaaaaaataggcttgcttttaagcaagtaacgatatactgtataaa

SEQ ID NO: 14690 - DNA, 60 bp, Xenorhabdus bovienii
  Promoter location: Contig name=SeqID_16914; Position on contig =2199..2258bp; Strand=+
agatcagttcactgaccattccttttaccatttgtgaatcatattgggatgattcgacaa

SEQ ID NO: 14691 - DNA, 60 bp, Xenorhabdus bovienii
  Promoter location: Contig name=SeqID_16914; Position on contig =2557..2616bp; Strand=+; Gene name=TfoX
tttaattacttgttcttgttatctatattgctaataaaaacatgagaaaaatattagtta

SEQ ID NO: 14692 - DNA, 60 bp, Xenorhabdus bovienii
  Promoter location: Contig name=SeqID_16914; Position on contig =3619..3678bp; Strand=+
tgtttaatttattaatcttcatgtggagaaaatattttttataaggttttaataaataaa

SEQ ID NO: 14693 - DNA, 60 bp, Xenorhabdus bovienii
  Promoter location: Contig name=SeqID_16914; Position on contig =3889..3948bp; Strand=+
aactcctttttagatgataaaggagtgctagaagctaaatacagagttattcaaaaatcc

SEQ ID NO: 14694 - DNA, 60 bp, Xenorhabdus bovienii
  Promoter location: Contig name=SeqID_16914; Position on contig =5543..5602bp; Strand=-; Gene name=ProP
cctgaataaatagccgtcgctgaagcaagtccaccgaatatcattgccatactagccaga

SEQ ID NO: 14695 - DNA, 60 bp, Xenorhabdus bovienii
  Promoter location: Contig name=SeqID_16914; Position on contig =5246..5305bp; Strand=+; Gene name=ProP
caacattgaagaacaccccttaatatgggagtaacaacttaacaatgtggaatatgtgct

SEQ ID NO: 14696 - DNA, 60 bp, Xenorhabdus bovienii
  Promoter location: Contig name=SeqID_16914; Position on contig =35675..35734bp; Strand=-; Gene name=UvrD
tccttcatacaactcaaattccagttccccccaaataatccctcgcttacactgaatact

SEQ ID NO: 14697 - DNA, 60 bp, Xenorhabdus bovienii
  Promoter location: Contig name=SeqID_16914; Position on contig =35369..35428bp; Strand=+; Gene name=UvrD
taaccaagggacgagggtcgttcctgtcagtgcaataaatatacggatataatagaggac

SEQ ID NO: 14698 - DNA, 60 bp, Xenorhabdus bovienii
  Promoter location: Contig name=SeqID_16914; Position on contig =38549..38608bp; Strand=-
ggcacgtcaaacctacttttagtattgtattttatatatgcaacagctaacctgaaatta

SEQ ID NO: 14699 - DNA, 60 bp, Xenorhabdus bovienii
  Promoter location: Contig name=SeqID_16914; Position on contig =38300..38359bp; Strand=+
gctatatcattttcctgtggctgttctaaagaatattcagcatcaatatctacaataaca

SEQ ID NO: 14700 - DNA, 60 bp, Xenorhabdus bovienii
  Promoter location: Contig name=SeqID_16914; Position on contig =38528..38587bp; Strand=+; Gene name=AcyP
tggcatgtgactgccaccccataatttcaggttagctgttgcatatataaaatacaatac

SEQ ID NO: 14701 - DNA, 60 bp, Xenorhabdus bovienii
  Promoter location: Contig name=SeqID_16914; Position on contig =39479..39538bp; Strand=-; Gene name=XerC
ggcggaggaggagagattcgaactctcggatggtttcccatcggcggttttcaagaccgc

SEQ ID NO: 14702 - DNA, 60 bp, Xenorhabdus bovienii
  Promoter location: Contig name=SeqID_16914; Position on contig =39454..39513bp; Strand=+; Gene name=XerC
aggggtggccgagcggctgaaggcagcggtcttgaaaaccgccgatgggaaaccatccga

SEQ ID NO: 14703 - DNA, 60 bp, Xenorhabdus bovienii
  Promoter location: Contig name=SeqID_16914; Position on contig =40973..41032bp; Strand=-
atccgtagaggtgtacgggttttcggggatcaacctaggcatagctttattctttaacgt

SEQ ID NO: 14704 - DNA, 60 bp, Xenorhabdus bovienii
  Promoter location: Contig name=SeqID_16914; Position on contig =40913..40972bp; Strand=+
aagaaacgtgcttaactggataaatagacagcgataattgtctttagtagactattgaag

SEQ ID NO: 14705 - DNA, 60 bp, Xenorhabdus bovienii
  Promoter location: Contig name=SeqID_16914; Position on contig =42194..42253bp; Strand=-; Gene name=AlpA
ataaggttttctttcgatgctgtgattgttgacatttagccccctgttaacttgccctta

SEQ ID NO: 14706 - DNA, 60 bp, Xenorhabdus bovienii
  Promoter location: Contig name=SeqID_16914; Position on contig =42507..42566bp; Strand=-
aatttagggtgagtttgaccgttgccaatcaaggcagtaattttttccatgatgttattc

SEQ ID NO: 14707 - DNA, 60 bp, Xenorhabdus bovienii
  Promoter location: Contig name=SeqID_16914; Position on contig =44229..44288bp; Strand=-
aggacttcaacagtaagactccttaacctcccagcatccctatagttaataattcccatc

SEQ ID NO: 14708 - DNA, 60 bp, Xenorhabdus bovienii
  Promoter location: Contig name=SeqID_16914; Position on contig =48882..48941bp; Strand=+
gacaacatgagacaacaaacaagggttttgagacaacatcaaacgggtaaaagttttctt

SEQ ID NO: 14709 - DNA, 60 bp, Xenorhabdus bovienii; identical to SEQ ID NO: 13985
  Promoter location: Contig name=SeqID_16914; Position on contig =50274..50333bp; Strand=+

SEQ ID NO: 14710 - DNA, 60 bp, Xenorhabdus bovienii
  Promoter location: Contig name=SeqID_16914; Position on contig =50967..51026bp; Strand=-
taaccattaataaaattaacacgcattaaaatagggttacgcatcataaaatctgtctat

SEQ ID NO: 14711 - DNA, 60 bp, Xenorhabdus bovienii; identical to SEQ ID NO: 13282
  Promoter location: Contig name=SeqID_16914; Position on contig =50595..50654bp; Strand=+

SEQ ID NO: 14712 - DNA, 60 bp, Xenorhabdus bovienii
  Promoter location: Contig name=SeqID_16914; Position on contig =51008..51067bp; Strand=+
ttaattttattaatggttattcagttgatataaaagaccaccctaagtaatattaactgg

SEQ ID NO: 14713 - DNA, 60 bp, Xenorhabdus bovienii
  Promoter location: Contig name=SeqID_16914; Position on contig =51639..51698bp; Strand=+
gctttctacccgtcgtaaatccaactacctaagaatcctaggtagttcaaaatcccgcga

SEQ ID NO: 14714 - DNA, 60 bp, Xenorhabdus bovienii; identical to SEQ ID NO: 13990
  Promoter location: Contig name=SeqID_16914; Position on contig =52285..52344bp; Strand=-

SEQ ID NO: 14715 - DNA, 60 bp, Xenorhabdus bovienii
  Promoter location: Contig name=SeqID_16914; Position on contig =52562..52621bp; Strand=-
taggaggtcgttatgggaattcccatatcggattagtttcaattagttaggatgccgacc

SEQ ID NO: 14716 - DNA, 60 bp, Xenorhabdus bovienii
  Promoter location: Contig name=SeqID_16914; Position on contig =52573..52632bp; Strand=+
taactaattgaaactaatccgatatgggaattcccataacgacctcctattaactcaatc

SEQ ID NO: 14717 - DNA, 60 bp, Xenorhabdus bovienii
  Promoter location: Contig name=SeqID_16914; Position on contig =54208..54267bp; Strand=+
agaagaagatattttttcataatcattctccacatcttttactacgttattatcacaaaa

SEQ ID NO: 14718 - DNA, 60 bp, Xenorhabdus bovienii
  Promoter location: Contig name=SeqID_16914; Position on contig =55146..55205bp; Strand=+
aagtctttttttatccccgcgaaaaatgaaatttaaatcgggagtctttttatccctctg

SEQ ID NO: 14719 - DNA, 60 bp, Xenorhabdus bovienii
  Promoter location: Contig name=SeqID_16914; Position on contig =61452..61511bp; Strand=-; Gene name=RsuA
ccgctctcgctaatgtatttgttaagacgaatggatgggttggtcagcatgatttctcca

SEQ ID NO: 14720 - DNA, 60 bp, Xenorhabdus bovienii
  Promoter location: Contig name=SeqID_16914; Position on contig =62596..62655bp; Strand=-; Gene name=SuhB
caccgacaacaggttcaccgttttcaatataagcgattaatgtattaaataatggcacac

SEQ ID NO: 14721 - DNA, 60 bp, Xenorhabdus bovienii
  Promoter location: Contig name=SeqID_16914; Position on contig =62405..62464bp; Strand=+; Gene name=SuhB
taaagatttaaacataaatcgccatgagtttgctagacagtacaaaaaactaagtttaca

SEQ ID NO: 14722 - DNA, 60 bp, Xenorhabdus bovienii
  Promoter location: Contig name=SeqID_16914; Position on contig =62818..62877bp; Strand=-
gcacaatgtttatctatccggatttgacggggtggtaagacaccccatatcatcgttttt

SEQ ID NO: 14723 - DNA, 60 bp, Xenorhabdus bovienii
  Promoter location: Contig name=SeqID_16914; Position on contig =64080..64139bp; Strand=-
aacctgattattcaataggtgttggtgaatggttactcaaatcctgctagaattcgcggc

SEQ ID NO: 14724 - DNA, 60 bp, Xenorhabdus bovienii
  Promoter location: Contig name=SeqID_16914; Position on contig =63992..64051bp; Strand=+
gaacattcagtctctggcacatactttccatttaattaacctgttggtgttatttgttgt

SEQ ID NO: 14725 - DNA, 60 bp, Xenorhabdus bovienii
  Promoter location: Contig name=SeqID_16914; Position on contig =64728..64787bp; Strand=-
gccattgtaatgataattgagttggaaggttttttggcaacccttgcaataataacgagg

SEQ ID NO: 14726 - DNA, 60 bp, Xenorhabdus bovienii
  Promoter location: Contig name=SeqID_16914; Position on contig =64565..64624bp; Strand=+
gtaatatagtgaatttaatttggtcatgactccaaagagttaacctggtattcttatgcc

SEQ ID NO: 14727 - DNA, 60 bp, Xenorhabdus bovienii
  Promoter location: Contig name=SeqID_16914; Position on contig =65327..65386bp; Strand=-; Gene name=InsB
aaatataaaaacaccattatcaacaaacggtcatgactcccaagcgttataatgatattt

SEQ ID NO: 14728 - DNA, 60 bp, Xenorhabdus bovienii; identical to SEQ ID NO: 12725
  Promoter location: Contig name=SeqID_16914; Position on contig =65073..65132bp; Strand=+; Gene name=InsB

SEQ ID NO: 14729 - DNA, 60 bp, Xenorhabdus bovienii
  Promoter location: Contig name=SeqID_16914; Position on contig =70908..70967bp; Strand=+; Gene name=MenD
aagataaagaaatcgtttctacgggtattacgataaagaaagccttatataatgtgccct

SEQ ID NO: 14730 - DNA, 60 bp, Xenorhabdus bovienii
  Promoter location: Contig name=SeqID_16914; Position on contig =76865..76924bp; Strand=-
agacacaaaaaacaaactgaccacgctgacagcaatgaaacttttcatattcttctcttc

SEQ ID NO: 14731 - DNA, 60 bp, Xenorhabdus bovienii
  Promoter location: Contig name=SeqID_16914; Position on contig =76728..76787bp; Strand=+
ttataaacctgatgatgtataaagatgcagggatatatatattttgataaatttagatat

SEQ ID NO: 14732 - DNA, 60 bp, Xenorhabdus bovienii
  Promoter location: Contig name=SeqID_16914; Position on contig =78433..78492bp; Strand=+
cctgcgccactgatataagccgatgttaaggcatacatcagaaacagcatactgaatccg

SEQ ID NO: 14733 - DNA, 60 bp, Xenorhabdus bovienii
  Promoter location: Contig name=SeqID_16914; Position on contig =78997..79056bp; Strand=+
atataaaaagctatcataatttttgttatggacataaaattgctaaatataattattatt

SEQ ID NO: 14734 - DNA, 60 bp, Xenorhabdus bovienii
  Promoter location: Contig name=SeqID_16914; Position on contig =79462..79521bp; Strand=-
cacgattttttttccttcagggactagacacatcagaacggtataggcataatctcgcgc

SEQ ID NO: 14735 - DNA, 60 bp, Xenorhabdus bovienii
  Promoter location: Contig name=SeqID_16914; Position on contig =79242..79301bp; Strand=+
gccgaaaaataaaaaacccgctatctgaaagataacgggttcttatatggtgccggctac

SEQ ID NO: 14736 - DNA, 60 bp, Xenorhabdus bovienii
  Promoter location: Contig name=SeqID_16914; Position on contig =79578..79637bp; Strand=+; Gene name=BaeS
tgctagtattagcatgatacaacggcttatttgattacgggttgatgtagaatcaaccaa

SEQ ID NO: 14737 - DNA, 60 bp, Xenorhabdus bovienii
  Promoter location: Contig name=SeqID_16914; Position on contig =89103..89162bp; Strand=-; Gene name=UbiG
cccaacatccagcacttttttgccgaaaagacctccggcacgttgcaggatatagttcaa

SEQ ID NO: 14738 - DNA, 60 bp, Xenorhabdus bovienii
  Promoter location: Contig name=SeqID_16914; Position on contig =88820..88879bp; Strand=+; Gene name=UbiG
gacagttttataaaaaccagatgcgggtatttcaagattaaggcatgtataataccctct

SEQ ID NO: 14739 - DNA, 60 bp, Xenorhabdus bovienii
  Promoter location: Contig name=SeqID_16914; Position on contig =89873..89932bp; Strand=-
aaacacaatatatagggggtaattaaaacggtaataacaagatactgttaaatccgcatt

SEQ ID NO: 14740 - DNA, 60 bp, Xenorhabdus bovienii
  Promoter location: Contig name=SeqID_16914; Position on contig =89695..89754bp; Strand=+
cgtgacagttaagggattaataaaacggcaaatagatattatttttaagattttatttcc

SEQ ID NO: 14741 - DNA, 60 bp, Xenorhabdus bovienii
  Promoter location: Contig name=SeqID_16914; Position on contig =90196..90255bp; Strand=-; Gene name=NrdA
ctgccttgatcatggtttcatggatatcggctgttttgatgccatcgtaaaattgaatct

SEQ ID NO: 14742 - DNA, 60 bp, Xenorhabdus bovienii
  Promoter location: Contig name=SeqID_16914; Position on contig =89950..90009bp; Strand=+; Gene name=NrdA
actaattctcgattggcctttagccatttcgggtacatcgtgctgtcaatatgtcaatgt

SEQ ID NO: 14743 - DNA, 60 bp, Xenorhabdus bovienii
  Promoter location: Contig name=SeqID_16914; Position on contig =95646..95705bp; Strand=+
tgcggaatgacggataagttaatcaatgaaattatctgcacttttgttatagtcggtaat

SEQ ID NO: 14744 - DNA, 60 bp, Xenorhabdus bovienii
  Promoter location: Contig name=SeqID_16914; Position on contig =96786..96845bp; Strand=+
ttataaaaatactcttatttattatttcagtataaaagcatatgtactatattttaatca

SEQ ID NO: 14745 - DNA, 60 bp, Xenorhabdus bovienii
  Promoter location: Contig name=SeqID_16914; Position on contig =98116..98175bp; Strand=-
aaagcaaccaaatatataaaaatgtaatttataccccccttaaaagtattctgcccgctc

SEQ ID NO: 14746 - DNA, 60 bp, Xenorhabdus bovienii
  Promoter location: Contig name=SeqID_16914; Position on contig =98132..98191bp; Strand=+
tttaaggggggtataaattacatttttatatatttggttgctttatctattttgataatg

SEQ ID NO: 14747 - DNA, 60 bp, Xenorhabdus bovienii; identical to SEQ ID NO: 14121
  Promoter location: Contig name=SeqID_16914; Position on contig =100653..100712bp; Strand=+

SEQ ID NO: 14748 - DNA, 60 bp, Xenorhabdus bovienii
  Promoter location: Contig name=SeqID_16914; Position on contig =101793..101852bp; Strand=-
tttagattatcactcaagtaatattttaataggatgaataactgatataaaatatatctt

SEQ ID NO: 14749 - DNA, 60 bp, Xenorhabdus bovienii
  Promoter location: Contig name=SeqID_16914; Position on contig =101733..101792bp; Strand=+
aaaatccattaaattaatatgattaccttgcttttcaggtgaatatttaaattaatttta

SEQ ID NO: 14750 - DNA, 60 bp, Xenorhabdus bovienii
  Promoter location: Contig name=SeqID_16914; Position on contig =102252..102311bp; Strand=-
caaaaaaacaattaaataaatattttcaatgagttacacctaaatgtaaaaatattttaa

SEQ ID NO: 14751 - DNA, 60 bp, Xenorhabdus bovienii
  Promoter location: Contig name=SeqID_16914; Position on contig =101997..102056bp; Strand=+
tttataaaaaagccagctcttgcttttgaaccggctatctccatctctatactaacaaac

SEQ ID NO: 14752 - DNA, 60 bp, Xenorhabdus bovienii
  Promoter location: Contig name=SeqID_16914; Position on contig =102755..102814bp; Strand=-
aaattcaactttttcagcaacgttgaatgaataaaattacctactcctaaattaaaaata

SEQ ID NO: 14753 - DNA, 60 bp, Xenorhabdus bovienii
  unsure (1)..(60): unsure at all n locations
  Promoter location: Contig name=SeqID_16914; Position on contig =103735..103794bp; Strand=-
nnnnnnnnnnnnnnnnnnnnnnnnnnnnnnnnnnnnnnnnatgtcattctcggtgtttgg

SEQ ID NO: 14754 - DNA, 60 bp, Xenorhabdus bovienii
  Promoter location: Contig name=SeqID_16915; Position on contig =1159..1218bp; Strand=-
agataacgtagcagtgacaaaatcttggcgggttcctgcttacaaccccctatactgtgt

SEQ ID NO: 14755 - DNA, 60 bp, Xenorhabdus bovienii
  Promoter location: Contig name=SeqID_16915; Position on contig =1575..1634bp; Strand=+
attagaccaggcacaggctctctatgttttcaatagagcactttggctaaactagggata

SEQ ID NO: 14756 - DNA, 60 bp, Xenorhabdus bovienii
  Promoter location: Contig name=SeqID_16915; Position on contig =2702..2761bp; Strand=-
cgatttaacttactgttttacttatttaattagttaatttaattcgctaatctgaaaaag

SEQ ID NO: 14757 - DNA, 60 bp, Xenorhabdus bovienii
  Promoter location: Contig name=SeqID_16915; Position on contig =3259..3318bp; Strand=+
gccgatagtgttttcagcttaacgggttgaataaaataattcaataataaaatcaataat

SEQ ID NO: 14758 - DNA, 60 bp, Xenorhabdus bovienii
  unsure (1)..(60): unsure at all n locations
  Promoter location: Contig name=SeqID_16915; Position on contig =5678..5737bp; Strand=-
atccttgccgggatggttttttcttttcaagactaaagattacaacctaacnnnnnnnnn

SEQ ID NO: 14759 - DNA, 60 bp, Xenorhabdus bovienii
  Promoter location: Contig name=SeqID_16915; Position on contig =6291..6350bp; Strand=+
cccgcaatgctcgccgcagtattgactagcgtagtctgttaatatgttatactgtcattt

SEQ ID NO: 14760 - DNA, 60 bp, Xenorhabdus bovienii
  Promoter location: Contig name=SeqID_16915; Position on contig =6828..6887bp; Strand=+
cctcgacttcttgaaaaaaaaacaaatgactatatttaagtaatgggtaatattcgccca

SEQ ID NO: 14761 - DNA, 60 bp, Xenorhabdus bovienii
  unsure (1)..(60): unsure at all n locations
  Promoter location: Contig name=SeqID_16915; Position on contig =8196..8255bp; Strand=-
nnnnnnnnnnnnnnnnnnnnnnnnnnnnnnncaacaaaaataaccgtcaatgatatatcc

SEQ ID NO: 14762 - DNA, 60 bp, Xenorhabdus bovienii; identical to SEQ ID NO: 12261
  unsure (1)..(60): unsure at all n locations
  Promoter location: Contig name=SeqID_16918; Position on contig =302..361bp; Strand=+

SEQ ID NO: 14763 - DNA, 60 bp, Xenorhabdus bovienii; identical to SEQ ID NO: 13084
  Promoter location: Contig name=SeqID_16918; Position on contig =5277..5336bp; Strand=+

SEQ ID NO: 14764 - DNA, 60 bp, Xenorhabdus bovienii
  Promoter location: Contig name=SeqID_16918; Position on contig =7846..7905bp; Strand=-
aaaaagattcattcatttattatcctattgattaattttatcgatatacaatagtgcatg

SEQ ID NO: 14765 - DNA, 60 bp, Xenorhabdus bovienii
  Promoter location: Contig name=SeqID_16918; Position on contig =7774..7833bp; Strand=+
taattttcgaaagttggattcatatttgaatctaattttgattcatatatagtgttgatt

SEQ ID NO: 14766 - DNA, 60 bp, Xenorhabdus bovienii
  Promoter location: Contig name=SeqID_16918; Position on contig =9047..9106bp; Strand=-; Gene name=InsB
gctcttcttctgaaagacaatcataaaccgcataatcatccgtgcaataaaatcgaactt

SEQ ID NO: 14767 - DNA, 60 bp, Xenorhabdus bovienii
  Promoter location: Contig name=SeqID_16918; Position on contig =8669..8728bp; Strand=+; Gene name=InsB
tatgactgttgcaaagtctttcagttggaatatacctaccaagcctgtaaactgggcgtt

SEQ ID NO: 14768 - DNA, 60 bp, Xenorhabdus bovienii
  Promoter location: Contig name=SeqID_16918; Position on contig =9658..9717bp; Strand=+
ttagcttattaggcgaatccaatatttatgacgtatttttcataatgtagagtctctatt

SEQ ID NO: 14769 - DNA, 60 bp, Xenorhabdus bovienii
  Promoter location: Contig name=SeqID_16918; Position on contig =10085..10144bp; Strand=-
aacagggccatcagtctgcgtgcataatttttatctcgggttgtttggataatttttttc

SEQ ID NO: 14770 - DNA, 60 bp, Xenorhabdus bovienii
  Promoter location: Contig name=SeqID_16918; Position on contig =11102..11161bp; Strand=+
agtcggaaataactagtcttttaagaaacgaaaaattcagtcttaattataataaaataa

SEQ ID NO: 14771 - DNA, 60 bp, Xenorhabdus bovienii
  Promoter location: Contig name=SeqID_16918; Position on contig =12802..12861bp; Strand=-
cattccgtatccgaatactggagcaacttgtatgttcggtttgcttttaaaatcgttgca

SEQ ID NO: 14772 - DNA, 60 bp, Xenorhabdus bovienii
  Promoter location: Contig name=SeqID_16918; Position on contig =12585..12644bp; Strand=+
tgtgacaataacgacaataaacgttaactttagccatgatccacccttaaaaagtgagag

SEQ ID NO: 14773 - DNA, 60 bp, Xenorhabdus bovienii
  Promoter location: Contig name=SeqID_16918; Position on contig =14590..14649bp; Strand=+
gagtgttttctttcacccgccgactttttctatcaattggctgcataaaaaataattaca

SEQ ID NO: 14774 - DNA, 60 bp, Xenorhabdus bovienii
  Promoter location: Contig name=SeqID_16918; Position on contig =17595..17654bp; Strand=-
cgactttatcagcgagtaatagccctgcctgttcataaaaatagcggtaaatttgctctc

SEQ ID NO: 14775 - DNA, 60 bp, Xenorhabdus bovienii; identical to SEQ ID NO: 13523
  Promoter location: Contig name=SeqID_16918; Position on contig =17405..17464bp; Strand=+

SEQ ID NO: 14776 - DNA, 60 bp, Xenorhabdus bovienii
  Promoter location: Contig name=SeqID_16918; Position on contig =18357..18416bp; Strand=-; Gene name=PenP (BS)
tcatcattagacatgataaaaatttattttagcatgattcgttagcatataataatatat

SEQ ID NO: 14777 - DNA, 60 bp, Xenorhabdus bovienii
  Promoter location: Contig name=SeqID_16918; Position on contig =18237..18296bp; Strand=+; Gene name=PenP (BS)
aaagagaatatcaaaaaatagaaattgatcattttaagaagaaactttaatttttctttt

SEQ ID NO: 14778 - DNA, 60 bp, Xenorhabdus bovienii
  Promoter location: Contig name=SeqID_16918; Position on contig =19611..19670bp; Strand=-
tctgactgtacgtccgtggctatcttcaaattcatcatggtcaggtttaagataaggtgg

SEQ ID NO: 14779 - DNA, 60 bp, Xenorhabdus bovienii
  Promoter location: Contig name=SeqID_16918; Position on contig =19364..19423bp; Strand=+
gatacactgaagtataattttgtccgtgacattgccaccggcagagatattttatcgatt

SEQ ID NO: 14780 - DNA, 60 bp, Xenorhabdus bovienii
  Promoter location: Contig name=SeqID_16918; Position on contig =21658..21717bp; Strand=-
cctatcaggtaaaatgaagtcttattgccacttaaaaagctttttgttataaggggaaat

SEQ ID NO: 14781 - DNA, 60 bp, Xenorhabdus bovienii; identical to SEQ ID NO: 13054
  Promoter location: Contig name=SeqID_16918; Position on contig =21289..21348bp; Strand=+

SEQ ID NO: 14782 - DNA, 60 bp, Xenorhabdus bovienii
  Promoter location: Contig name=SeqID_16918; Position on contig =21946..22005bp; Strand=+; Gene name=PinR
cagacttaatctgacagtcgcccactttgatttagtgcctgtcagattaaattcggttga

SEQ ID NO: 14783 - DNA, 60 bp, Xenorhabdus bovienii
  Promoter location: Contig name=SeqID_16918; Position on contig =25553..25612bp; Strand=-
ttctgtatcgcctttaagattgaacggtatcttgtgcctcgagcatctattttataagtc

SEQ ID NO: 14784 - DNA, 60 bp, Xenorhabdus bovienii
  Promoter location: Contig name=SeqID_16918; Position on contig =25305..25364bp; Strand=+
gtgcgagcggatccccataaattcctgttgcttccatgcaaaaatggtaatttgaggcgg

SEQ ID NO: 14785 - DNA, 60 bp, Xenorhabdus bovienii
  Promoter location: Contig name=SeqID_16918; Position on contig =26743..26802bp; Strand=-
gacacgaatttaattttcaattaaaattgaatagtgggatgccatgaatataaaaattta

SEQ ID NO: 14786 - DNA, 60 bp, Xenorhabdus bovienii
  Promoter location: Contig name=SeqID_16918; Position on contig =27335..27394bp; Strand=-
atatatgcaaaagtatatattggcaacctagtgcgttatttaggttttttaatccacctt

SEQ ID NO: 14787 - DNA, 60 bp, Xenorhabdus bovienii
  Promoter location: Contig name=SeqID_16918; Position on contig =27670..27729bp; Strand=+
ttaatcagagattccgcgagtggttgtttttttatactgtcaatcgataaaattgttccg

SEQ ID NO: 14788 - DNA, 60 bp, Xenorhabdus bovienii
  Promoter location: Contig name=SeqID_16918; Position on contig =28204..28263bp; Strand=+
agtattgtcttttacgtcgcatcgaaacgcgctctatccccgctaaaatcgtttgggccc

SEQ ID NO: 14789 - DNA, 60 bp, Xenorhabdus bovienii
  Promoter location: Contig name=SeqID_16918; Position on contig =28779..28838bp; Strand=+
cactgagcgatgatatcaacgggataatgtaaacgtttgaaggtttttcgaattaaagac

SEQ ID NO: 14790 - DNA, 60 bp, Xenorhabdus bovienii
  Promoter location: Contig name=SeqID_16918; Position on contig =30180..30239bp; Strand=-
gtgagatattacattaccaaggctttgcttattgcaacagaaccctttgaaatccattgg

SEQ ID NO: 14791 - DNA, 60 bp, Xenorhabdus bovienii
  Promoter location: Contig name=SeqID_16918; Position on contig =30089..30148bp; Strand=+
aacgtcattacgtccatcactgaattttatacttacgctactcatattaagcttcctcat

SEQ ID NO: 14792 - DNA, 60 bp, Xenorhabdus bovienii
  Promoter location: Contig name=SeqID_16918; Position on contig =30971..31030bp; Strand=+
ccacctcagcacaaactttctctgttaatgcgacagaacccatcaggtaagctctctatt

SEQ ID NO: 14793 - DNA, 60 bp, Xenorhabdus bovienii
  Promoter location: Contig name=SeqID_16918; Position on contig =31844..31903bp; Strand=+
acgccccttgtttgccaaataatcatttgtcatgaccaaaactaggttaagattgcagcc

SEQ ID NO: 14794 - DNA, 60 bp, Xenorhabdus bovienii
  Promoter location: Contig name=SeqID_16918; Position on contig =33394..33453bp; Strand=-
ccaacgagatttaacgcctaacaatttgattttataggtttttaatttattatttcagag

SEQ ID NO: 14795 - DNA, 60 bp, Xenorhabdus bovienii
  Promoter location: Contig name=SeqID_16918; Position on contig =35719..35778bp; Strand=-
aaatatcaattaattatacatacaattacgatggcgaagtttcaaattaaaatattattt

SEQ ID NO: 14796 - DNA, 60 bp, Xenorhabdus bovienii
  Promoter location: Contig name=SeqID_16918; Position on contig =36443..36502bp; Strand=-
acgtttcacaagcaacggaatcagacgatgaacccaacgggaaagggtagaatgatcaac

SEQ ID NO: 14797 - DNA, 60 bp, Xenorhabdus bovienii
  Promoter location: Contig name=SeqID_16918; Position on contig =36132..36191bp; Strand=+
ggttctgtcgcattagcagagaaagtgcatcaaaagatgaatacgattattttttatgca

SEQ ID NO: 14798 - DNA, 60 bp, Xenorhabdus bovienii; identical to SEQ ID NO: 12949
  Promoter location: Contig name=SeqID_16918; Position on contig =37506..37565bp; Strand=-

SEQ ID NO: 14799 - DNA, 60 bp, Xenorhabdus bovienii
  Promoter location: Contig name=SeqID_16918; Position on contig =37279..37338bp; Strand=+
tttatcaacaaataagtgagatattacctagatggtgtcgtcataaataaattcatgtaa

SEQ ID NO: 14800 - DNA, 60 bp, Xenorhabdus bovienii
  Promoter location: Contig name=SeqID_16918; Position on contig =39471..39530bp; Strand=-
gcaacaccacttttgctaacttgccgccgttaacgcgacactgcccttaaaatgccttta

SEQ ID NO: 14801 - DNA, 60 bp, Xenorhabdus bovienii
  Promoter location: Contig name=SeqID_16918; Position on contig =40134..40193bp; Strand=-
attttttaggcgagcagtagggttctgtcgcattaaggaatcgtcgggtaacatgttgtt

SEQ ID NO: 14802 - DNA, 60 bp, Xenorhabdus bovienii
  Promoter location: Contig name=SeqID_16918; Position on contig =40015..40074bp; Strand=+
gtgcagactcagggcataagcgaggtaccaccgaacacactgagcgataacatcggtggg

SEQ ID NO: 14803 - DNA, 60 bp, Xenorhabdus bovienii
  Promoter location: Contig name=SeqID_16918; Position on contig =58609..58668bp; Strand=-
ccttaaatttaagtatagaggttagtttttgctgcctgaaatcgtgatgtatttgagtga

SEQ ID NO: 14804 - DNA, 60 bp, Xenorhabdus bovienii
  Promoter location: Contig name=SeqID_16918; Position on contig =60870..60929bp; Strand=-; Gene name=KamA
acaactttcggctcccataactatcgatttttaacacgatagctttttaaaacgaacgat

SEQ ID NO: 14805 - DNA, 60 bp, Xenorhabdus bovienii
  Promoter location: Contig name=SeqID_16918; Position on contig =62206..62265bp; Strand=-
acccacatttttccgtgagttatccctttggttgtcgatacgagagctattttattacgc

SEQ ID NO: 14806 - DNA, 60 bp, Xenorhabdus bovienii
  Promoter location: Contig name=SeqID_16918; Position on contig =62005..62064bp; Strand=+
tttctccgtcagttaacgcaacccatttttccagtccctcagatgttttaattaagttac

SEQ ID NO: 14807 - DNA, 60 bp, Xenorhabdus bovienii
  Promoter location: Contig name=SeqID_16918; Position on contig =64364..64423bp; Strand=-
cagcgaatagctaccaatgagtattttttacagttgatcgcgctgtgtaaattctgttgc

SEQ ID NO: 14808 - DNA, 60 bp, Xenorhabdus bovienii
  Promoter location: Contig name=SeqID_16918; Position on contig =63939..63998bp; Strand=+
catcaatgaacaaccattctgtatctgtattctcagataataatttgaataataaattaa

SEQ ID NO: 14809 - DNA, 60 bp, Xenorhabdus bovienii
  Promoter location: Contig name=SeqID_16918; Position on contig =65370..65429bp; Strand=-
cgtcgcaatgcatgggcctataaattgatttggggatttttgactgttttgttttcaatc

SEQ ID NO: 14810 - DNA, 60 bp, Xenorhabdus bovienii
  Promoter location: Contig name=SeqID_16918; Position on contig =64986..65045bp; Strand=+
atttgcgcactgttcttctgcttctgaggcactgttgcagccctttttttaatgctcccc

SEQ ID NO: 14811 - DNA, 60 bp, Xenorhabdus bovienii
  Promoter location: Contig name=SeqID_16918; Position on contig =66756..66815bp; Strand=-
atcataaacaacctgccttgatgttacctgttttggcgacagttttttaaagtacgcatt

SEQ ID NO: 14812 - DNA, 60 bp, Xenorhabdus bovienii
  Promoter location: Contig name=SeqID_16918; Position on contig =66436..66495bp; Strand=+
agccttactcagcaatggtgggtcatgactccaaagcgttaacctgatattcttatgcct

SEQ ID NO: 14813 - DNA, 60 bp, Xenorhabdus bovienii
  Promoter location: Contig name=SeqID_16918; Position on contig =68104..68163bp; Strand=-
tctgtcaaaatttgaatacgacttgatttgatttttttcattgttcttatgctatatcag

SEQ ID NO: 14814 - DNA, 60 bp, Xenorhabdus bovienii
  Promoter location: Contig name=SeqID_16918; Position on contig =68036..68095bp; Strand=+
ttaacttaaattgtactactcgtatcgattgagtcatcttctcattatattatgtcgcct

SEQ ID NO: 14815 - DNA, 60 bp, Xenorhabdus bovienii
  Promoter location: Contig name=SeqID_16918; Position on contig =82879..82938bp; Strand=-
attttttcgggattttccgccgaattatttatacggttattgagtatttattgtgataac

SEQ ID NO: 14816 - DNA, 60 bp, Xenorhabdus bovienii
  Promoter location: Contig name=SeqID_16918; Position on contig =85019..85078bp; Strand=-
gtgccaaaacggatgttatggtattcgaatacacatcgaatatagtttgtaattattaac

SEQ ID NO: 14817 - DNA, 60 bp, Xenorhabdus bovienii
  Promoter location: Contig name=SeqID_16918; Position on contig =84975..85034bp; Strand=+
taaactacacgcatattcccctgagcttcaagcggatgctcaaagttaataattacaaac

SEQ ID NO: 14818 - DNA, 60 bp, Xenorhabdus bovienii
  Promoter location: Contig name=SeqID_16918; Position on contig =85905..85964bp; Strand=-
ttcaccgacatattaagggttctgtcgcattaaggagtggagtcaggtaacctgtcattt

SEQ ID NO: 14819 - DNA, 60 bp, Xenorhabdus bovienii
  Promoter location: Contig name=SeqID_16918; Position on contig =85836..85895bp; Strand=+
atatcaacaggatagtgtaaacgtttgaaggcttttcggataaggggcatcgttagaact

SEQ ID NO: 14820 - DNA, 60 bp, Xenorhabdus bovienii
  Promoter location: Contig name=SeqID_16918; Position on contig =86851..86910bp; Strand=-
agtgtgactaactcacctgtttcttttctaacttccgaaaaggctggtattaactccccg

SEQ ID NO: 14821 - DNA, 60 bp, Xenorhabdus bovienii
  Promoter location: Contig name=SeqID_16918; Position on contig =86747..86806bp; Strand=+
tcataactgctatggacaggaataatagaccactgtaatgagcaagctagccttagaaaa

SEQ ID NO: 14822 - DNA, 60 bp, Xenorhabdus bovienii
  Promoter location: Contig name=SeqID_16918; Position on contig =88287..88346bp; Strand=-
gcgcagactcaaggcataagcgaggtaccaacgaacacactgggcgataatatcaacagg

SEQ ID NO: 14823 - DNA, 60 bp, Xenorhabdus bovienii
  Promoter location: Contig name=SeqID_16918; Position on contig =89123..89182bp; Strand=+
cagagtgttttctttcacccgccgactttttctatcaattggctgcataaaaaacaatta

SEQ ID NO: 14824 - DNA, 60 bp, Xenorhabdus bovienii
  Promoter location: Contig name=SeqID_16918; Position on contig =89993..90052bp; Strand=+
cgtatggcttctttttccgttgaaaagaagatagaaattcaagcagctacaattacggat

SEQ ID NO: 14825 - DNA, 60 bp, Xenorhabdus bovienii
  Promoter location: Contig name=SeqID_16918; Position on contig =91908..91967bp; Strand=-
taatgtgacactttacaagcgttcccttttgtagagcagttagtaagtaacatagaggga

SEQ ID NO: 14826 - DNA, 60 bp, Xenorhabdus bovienii
  Promoter location: Contig name=SeqID_16918; Position on contig =91726..91785bp; Strand=+
aattgtaatcgctctgtagctagtttgatatgtgtcatatgaatcacctttaatacattt

SEQ ID NO: 14827 - DNA, 60 bp, Xenorhabdus bovienii
  Promoter location: Contig name=SeqID_16918; Position on contig =94140..94199bp; Strand=-
ccatgtcattgatccgaaaggttctgtcgcattaagcggtcatcaggtaagcttccctgt

SEQ ID NO: 14828 - DNA, 60 bp, Xenorhabdus bovienii
  Promoter location: Contig name=SeqID_16918; Position on contig =93891..93950bp; Strand=+
tctgcctcataacttattcgttatgattaaaggtataacatatttgttatattatcaaga

SEQ ID NO: 14829 - DNA, 60 bp, Xenorhabdus bovienii
  Promoter location: Contig name=SeqID_16918; Position on contig =95164..95223bp; Strand=-; Gene name=LysR
tgctcgggtaaaaccatggtgttctgcaacggcgagaaaatacctgatataacggaaatt

SEQ ID NO: 14830 - DNA, 60 bp, Xenorhabdus bovienii
  Promoter location: Contig name=SeqID_16918; Position on contig =95075..95134bp; Strand=+; Gene name=LysR
atgcggtgaaggttacaccccatattccataaggtaaaagtctcgtttatgatgattatc

SEQ ID NO: 14831 - DNA, 60 bp, Xenorhabdus bovienii
  Promoter location: Contig name=SeqID_16918; Position on contig =96176..96235bp; Strand=-
gcgcagactcagggcataggccagataccaccgaacacactgagcgataacatcggtggg

SEQ ID NO: 14832 - DNA, 60 bp, Xenorhabdus bovienii
  Promoter location: Contig name=SeqID_16918; Position on contig =96840..96899bp; Strand=+
gcaacaaaggataacgacattattatccggcagaataagtatcttaataacctgattgaa

SEQ ID NO: 14833 - DNA, 60 bp, Xenorhabdus bovienii
  Promoter location: Contig name=SeqID_16918; Position on contig =97091..97150bp; Strand=+
cttatcttcactcgtactttctttattaatgcgacagaaccgcctgacatcattaccctc

SEQ ID NO: 14834 - DNA, 60 bp, Xenorhabdus bovienii
  Promoter location: Contig name=SeqID_16918; Position on contig =98967..99026bp; Strand=-
agcacatagtgtgtgcatttaaaattaacacaaaataatgtagtttttataatttgcgga

SEQ ID NO: 14835 - DNA, 60 bp, Xenorhabdus bovienii
  Promoter location: Contig name=SeqID_16918; Position on contig =98822..98881bp; Strand=+
cgcttggaagcagaaagcgccactttttttaaagaaaggcatctcggtaaattactattt

SEQ ID NO: 14836 - DNA, 60 bp, Xenorhabdus bovienii
  Promoter location: Contig name=SeqID_16918; Position on contig =99410..99469bp; Strand=-
ctctaagttatagtaccttggtggtggattcacatatgggtatcgactaacatggtatac

SEQ ID NO: 14837 - DNA, 60 bp, Xenorhabdus bovienii
  Promoter location: Contig name=SeqID_16918; Position on contig =99603..99662bp; Strand=-
aaaaatataataaatataattatatttaaaatatgttaatttcagtttttaattatctaa

SEQ ID NO: 14838 - DNA, 60 bp, Xenorhabdus bovienii
  Promoter location: Contig name=SeqID_16918; Position on contig =99640..99699bp; Strand=+
ataattatatttattatatttttacctttaacacacagtataagatttatttttttgtta

SEQ ID NO: 14839 - DNA, 60 bp, Xenorhabdus bovienii
  Promoter location: Contig name=SeqID_16918; Position on contig =100357..100416bp; Strand=+
ataaatataaacaactaaaaacaaacatacactataaataaaaaaacaatattatttatc

SEQ ID NO: 14840 - DNA, 60 bp, Xenorhabdus bovienii; identical to SEQ ID NO: 14811
  Promoter location: Contig name=SeqID_16918; Position on contig =101341..101400bp; Strand=-

SEQ ID NO: 14841 - DNA, 60 bp, Xenorhabdus bovienii
  Promoter location: Contig name=SeqID_16918; Position on contig =101012..101071bp; Strand=+
ttgttttttatgcagccaattgatagaaaggtcatgactccaaagcgttaacctgatatt

SEQ ID NO: 14842 - DNA, 60 bp, Xenorhabdus bovienii
  Promoter location: Contig name=SeqID_16918; Position on contig =102669..102728bp; Strand=-
cataaatgtcacattccgtttgttaattttgattcatatatagtgtttattattttttta

SEQ ID NO: 14843 - DNA, 60 bp, Xenorhabdus bovienii
  Promoter location: Contig name=SeqID_16918; Position on contig =102605..102664bp; Strand=+
aaaaagattcattcatttattatcctattgattaattttatcgatatataatagtacatg

SEQ ID NO: 14844 - DNA, 60 bp, Xenorhabdus bovienii
  Promoter location: Contig name=SeqID_16918; Position on contig =105971..106030bp; Strand=-; Gene name=PinR
ataccgtaccatttttatgagacaacttcagccgcgctgcatcattctataataattatt

SEQ ID NO: 14845 - DNA, 60 bp, Xenorhabdus bovienii
  Promoter location: Contig name=SeqID_16918; Position on contig =105962..106021bp; Strand=+; Gene name=PinR
acagtaaaaaataattattatagaatgatgcagcgcggctgaagttgtctcataaaaatg

SEQ ID NO: 14846 - DNA, 60 bp, Xenorhabdus bovienii; identical to SEQ ID NO: 12709
  Promoter location: Contig name=SeqID_16918; Position on contig =108752..108811bp; Strand=-; Gene name=PinR

SEQ ID NO: 14847 - DNA, 60 bp, Xenorhabdus bovienii; identical to SEQ ID NO: 13989
  Promoter location: Contig name=SeqID_16918; Position on contig =108581..108640bp; Strand=+; Gene name=PinR

SEQ ID NO: 14848 - DNA, 60 bp, Xenorhabdus bovienii
  Promoter location: Contig name=SeqID_16918; Position on contig =109362..109421bp; Strand=+
attattgagcatggaatagcttaactggcagtccgctttggggcaagtatagtcattcac

SEQ ID NO: 14849 - DNA, 60 bp, Xenorhabdus bovienii
  Promoter location: Contig name=SeqID_16918; Position on contig =110140..110199bp; Strand=-
gatacagaattttgtagcagcaagataaatatacacaatcaatttcctttttaaatattt

SEQ ID NO: 14850 - DNA, 60 bp, Xenorhabdus bovienii
  Promoter location: Contig name=SeqID_16918; Position on contig =110717..110776bp; Strand=-; Gene name=AslB
atcaataagaatggcatttgtttggcatgctaagttgaattttgttttattataactccc

SEQ ID NO: 14851 - DNA, 60 bp, Xenorhabdus bovienii
  Promoter location: Contig name=SeqID_16918; Position on contig =116200..116259bp; Strand=-
aaatggcataaaaacgcctacgagcttcactgtgcggttttttctctttaaataccatcc

SEQ ID NO: 14852 - DNA, 60 bp, Xenorhabdus bovienii
  Promoter location: Contig name=SeqID_16918; Position on contig =117202..117261bp; Strand=-
tgattcaggaatggcaggcatattttagataaatttatctttttagttaaatttatcttt

SEQ ID NO: 14853 - DNA, 60 bp, Xenorhabdus bovienii
  Promoter location: Contig name=SeqID_16918; Position on contig =116929..116988bp; Strand=+
aatagataaattttttgtcctatttcaaacgcatatagcgttctagctatgtttttagct

SEQ ID NO: 14854 - DNA, 60 bp, Xenorhabdus bovienii
  Promoter location: Contig name=SeqID_16918; Position on contig =117398..117457bp; Strand=-
aaccattcataaaaaaaatcttcattgaatttcatcgattaccccttccataaatgatca

SEQ ID NO: 14855 - DNA, 60 bp, Xenorhabdus bovienii
  Promoter location: Contig name=SeqID_16918; Position on contig =117321..117380bp; Strand=+
ggtgagcacgaagcgatagagggtatgacacaatactggtgcctagaatctggagcatca

SEQ ID NO: 14856 - DNA, 60 bp, Xenorhabdus bovienii
  Promoter location: Contig name=SeqID_16918; Position on contig =117980..118039bp; Strand=-
agtgtgaaattggccataagactttgattacgttgagtttttcggcttaaattttgtgga

SEQ ID NO: 14857 - DNA, 60 bp, Xenorhabdus bovienii
  Promoter location: Contig name=SeqID_16918; Position on contig =118640..118699bp; Strand=-
tatgtttattttagaaaacaaaaaaataaaaaaaaccaaaaaaaatctataagcatcggt

SEQ ID NO: 14858 - DNA, 60 bp, Xenorhabdus bovienii
  Promoter location: Contig name=SeqID_16918; Position on contig =119237..119296bp; Strand=-
catcacaaactgagcataattatattgactcagacaaataataaatgtattgaggctatc

SEQ ID NO: 14859 - DNA, 60 bp, Xenorhabdus bovienii
  Promoter location: Contig name=SeqID_16918; Position on contig =119166..119225bp; Strand=+
ttcatcagatagtattatgtttttgctttggggtatcgtaatcgttttattatgctattt

SEQ ID NO: 14860 - DNA, 60 bp, Xenorhabdus bovienii
  Promoter location: Contig name=SeqID_16918; Position on contig =120348..120407bp; Strand=-
tctccctaaataccggagtgttggtcatgtattaaatagttagttgttatgataatcttc

SEQ ID NO: 14861 - DNA, 60 bp, Xenorhabdus bovienii
  Promoter location: Contig name=SeqID_16918; Position on contig =120307..120366bp; Strand=+
aatcaacatctactttagccacgttccaccacgaaataccggaagattatcataacaact

SEQ ID NO: 14862 - DNA, 60 bp, Xenorhabdus bovienii
  Promoter location: Contig name=SeqID_16918; Position on contig =121177..121236bp; Strand=-
caagcccgacaaaattttggacggttccggcttacaaccccaatatgtaaatttctggcc

SEQ ID NO: 14863 - DNA, 60 bp, Xenorhabdus bovienii; identical to SEQ ID NO: 14845
  Promoter location: Contig name=SeqID_16918; Position on contig =123009..123068bp; Strand=-

SEQ ID NO: 14864 - DNA, 60 bp, Xenorhabdus bovienii; identical to SEQ ID NO: 14844
  Promoter location: Contig name=SeqID_16918; Position on contig =123000..123059bp; Strand=+

SEQ ID NO: 14865 - DNA, 60 bp, Xenorhabdus bovienii
  Promoter location: Contig name=SeqID_16918; Position on contig =126190..126249bp; Strand=+
tagaatcccttatagttaatgagatctttactcattaatgtgtcgcctataatccataga

SEQ ID NO: 14866 - DNA, 60 bp, Xenorhabdus bovienii
  Promoter location: Contig name=SeqID_16918; Position on contig =127887..127946bp; Strand=-; Gene name=ParE
aatcggctcaggcaatattatggatattgtaagcaaatataggaaattaaaagaaattta

SEQ ID NO: 14867 - DNA, 60 bp, Xenorhabdus bovienii
  Promoter location: Contig name=SeqID_16918; Position on contig =128575..128634bp; Strand=-
atgaccgtcaaacggtcgtttgccggacaaaacgatatctgaccattgtttaataaatag

SEQ ID NO: 14868 - DNA, 28 bp, Xenorhabdus bovienii
  unsure (1)..(28): unsure at all n locations
  Terminator location: Contig name=SeqID_16433; Position on contig =695..722bp; Strand=-
gggggggggnnnnnnatatatatattta

SEQ ID NO: 14869 - DNA, 46 bp, Xenorhabdus bovienii
  unsure (1)..(46): unsure at all n locations
  Terminator location: Contig name=SeqID_16458; Position on contig =678..723bp; Strand=-
cttctncgtggggtgggggccccccccgggggggttttccagggag

SEQ ID NO: 14870 - DNA, 33 bp, Xenorhabdus bovienii
  Terminator location: Contig name=SeqID_16462; Position on contig =757..789bp; Strand=+
ttagcgggagtgccctgttgatttttgctgtca

SEQ ID NO: 14871 - DNA, 40 bp, Xenorhabdus bovienii
  Terminator location: Contig name=SeqID_16476; Position on contig =218..257bp; Strand=-
ccagttgggggggtaacccgggttggttttttggcccaaa

SEQ ID NO: 14872 - DNA, 30 bp, Xenorhabdus bovienii
  Terminator location: Contig name=SeqID_16490; Position on contig =288..317bp; Strand=+
ggggggccccccccccaaaatttttttttt

SEQ ID NO: 14873 - DNA, 55 bp, Xenorhabdus bovienii
  Terminator location: Contig name=SeqID_16511; Position on contig =389..443bp; Strand=+
ggtgaaaaacgtgggggggagggaaccccccccactttcccacaatttttttttt

SEQ ID NO: 14874 - DNA, 53 bp, Xenorhabdus bovienii
  unsure (1)..(53): unsure at all n locations
  Terminator location: Contig name=SeqID_16530; Position on contig =516..568bp; Strand=+
ttttttggggggggggggggnnnngnnnnnnnnnnaaaaaaatttntnnnngg

SEQ ID NO: 14875 - DNA, 45 bp, Xenorhabdus bovienii
  Terminator location: Contig name=SeqID_16549; Position on contig =303..347bp; Strand=+
ggggcctcccccgggggtggggtgggcacccaatctttttttggg

SEQ ID NO: 14876 - DNA, 37 bp, Xenorhabdus bovienii
  unsure (1)..(37): unsure at all n locations
  Terminator location: Contig name=SeqID_16551; Position on contig =489..525bp; Strand=-
ccccccacttttttggtggnggaggtttttttatata

SEQ ID NO: 14877 - DNA, 30 bp, Xenorhabdus bovienii
  Terminator location: Contig name=SeqID_16576; Position on contig =455..484bp; Strand=-
ccggcgggggggccggtcctctttttcttt

SEQ ID NO: 14878 - DNA, 69 bp, Xenorhabdus bovienii
  unsure (1)..(69): unsure at all n locations
  Terminator location: Contig name=SeqID_16585; Position on contig =742..810bp; Strand=+
gggggggggggggggggggagagggggagnnnattttnttttttttatttttttttttttntcttcccc

SEQ ID NO: 14879 - DNA, 52 bp, Xenorhabdus bovienii
  Terminator location: Contig name=SeqID_16597; Position on contig =393..444bp; Strand=+
cgggagaaaaaaaaaaaaaaaaaaattttttttttttttgttttctccccaa

SEQ ID NO: 14880 - DNA, 34 bp, Xenorhabdus bovienii
  Terminator location: Contig name=SeqID_16601; Position on contig =413..446bp; Strand=-
ggtggggggccacccccccctcttttattttttc

SEQ ID NO: 14881 - DNA, 75 bp, Xenorhabdus bovienii
  unsure (1)..(75): unsure at all n locations
  Terminator location: Contig name=SeqID_16619; Position on contig =802..876bp; Strand=+
gggggggggggggggggggggggnnnnnnnnnnnnnnnnnccnnnncncccccctctttcccntnttcttttttn

SEQ ID NO: 14882 - DNA, 38 bp, Xenorhabdus bovienii
  Terminator location: Contig name=SeqID_16715; Position on contig =623..660bp; Strand=-
cccccctctctttttttggggggggttttttgtggggg

SEQ ID NO: 14883 - DNA, 45 bp, Xenorhabdus bovienii
  Terminator location: Contig name=SeqID_16722; Position on contig =389..433bp; Strand=-
cagataacagcccctttttggggcttttttgttttttgacgttag

SEQ ID NO: 14884 - DNA, 52 bp, Xenorhabdus bovienii
  unsure (1)..(52): unsure at all n locations
  Terminator location: Contig name=SeqID_16731; Position on contig =137..188bp; Strand=-
gggggcccncccccaaggagggggggaccggggggccttttttttttttaaa

SEQ ID NO: 14885 - DNA, 46 bp, Xenorhabdus bovienii
  unsure (1)..(46): unsure at all n locations
  Terminator location: Contig name=SeqID_16740; Position on contig =447..492bp; Strand=-
gnntcccaagggnnaaaaaancccgggggggngaattcttttccca

SEQ ID NO: 14886 - DNA, 43 bp, Xenorhabdus bovienii
  Terminator location: Contig name=SeqID_16750; Position on contig =662..704bp; Strand=+
ggcatttccattttctcaaatggaaatccattttaaaaatgca

SEQ ID NO: 14887 - DNA, 43 bp, Xenorhabdus bovienii
  Terminator location: Contig name=SeqID_16750; Position on contig =617..659bp; Strand=-
ggcacttttgtaatgctagctggagtgccaatatatatcccaa

SEQ ID NO: 14888 - DNA, 33 bp, Xenorhabdus bovienii
  Terminator location: Contig name=SeqID_16761; Position on contig =452..484bp; Strand=-
gacccgttgttatagcgggtttttcatttctta

SEQ ID NO: 14889 - DNA, 35 bp, Xenorhabdus bovienii
  Terminator location: Contig name=SeqID_16764; Position on contig =371..405bp; Strand=-
ctatttttccctggggagggtggttttaaaacacc

SEQ ID NO: 14890 - DNA, 51 bp, Xenorhabdus bovienii
  unsure (1)..(51): unsure at all n locations
  Terminator location: Contig name=SeqID_16771; Position on contig =392..442bp; Strand=-
ggggggggggnaaaaaaaaattttttttttttttctttttctctctccgcg

SEQ ID NO: 14891 - DNA, 44 bp, Xenorhabdus bovienii
  Terminator location: Contig name=SeqID_16797; Position on contig =564..607bp; Strand=+
taataaggcgttcatatacgggcgcttttttgttgctatcaata

SEQ ID NO: 14892 - DNA, 29 bp, Xenorhabdus bovienii
  Terminator location: Contig name=SeqID_16800; Position on contig =351..379bp; Strand=+
cccccaacaaggggggggttttttaaaaa

SEQ ID NO: 14893 - DNA, 31 bp, Xenorhabdus bovienii
  Terminator location: Contig name=SeqID_16805; Position on contig =340..370bp; Strand=-
cgccgtcgcctccggcgccttgctaggtgca

SEQ ID NO: 14894 - DNA, 26 bp, Xenorhabdus bovienii
  Terminator location: Contig name=SeqID_16812; Position on contig =496..521bp; Strand=+
ccccaggatggggatgtctcgttgag

SEQ ID NO: 14895 - DNA, 37 bp, Xenorhabdus bovienii
  Terminator location: Contig name=SeqID_16813; Position on contig =728..764bp; Strand=+
gaagcccactcttagagtgggctttttcgtattcctc

SEQ ID NO: 14896 - DNA, 30 bp, Xenorhabdus bovienii
  Terminator location: Contig name=SeqID_16817; Position on contig =2040..2069bp; Strand=+
gagaagctatagcttctctttcaaatcttg

SEQ ID NO: 14897 - DNA, 40 bp, Xenorhabdus bovienii
  Terminator location: Contig name=SeqID_16818; Position on contig =940..979bp; Strand=+
ctgctgttgaagtcgttttcaacatcagatttgaattttt

SEQ ID NO: 14898 - DNA, 46 bp, Xenorhabdus bovienii
  Terminator location: Contig name=SeqID_16820; Position on contig =840..885bp; Strand=+
taacctcgtcttgtgcagtgattcgacgaggttatgttctggaata

SEQ ID NO: 14899 - DNA, 46 bp, Xenorhabdus bovienii
  Terminator location: Contig name=SeqID_16820; Position on contig =828..873bp; Strand=-
taacctcgtcgaatcactgcacaagacgaggttatttcctcattct

SEQ ID NO: 14900 - DNA, 29 bp, Xenorhabdus bovienii
  Terminator location: Contig name=SeqID_16822; Position on contig =2387..2415bp; Strand=-
tggggcggaatgccccatttttctaatgg

SEQ ID NO: 14901 - DNA, 45 bp, Xenorhabdus bovienii
  Terminator location: Contig name=SeqID_16822; Position on contig =3625..3669bp; Strand=-
tcgttagcatcctcgtgtgaggatgctatgaaatatcttaaaatt

SEQ ID NO: 14902 - DNA, 48 bp, Xenorhabdus bovienii
  Terminator location: Contig name=SeqID_16824; Position on contig =138..185bp; Strand=-
ttgatgacgtggatgcattgccatcgttgtttaataattgttaatttg

SEQ ID NO: 14903 - DNA, 39 bp, Xenorhabdus bovienii
  Terminator location: Contig name=SeqID_16825; Position on contig =1669..1707bp; Strand=+; Gene name=ZnuB
gggttattatctcaatgattgtagccctttttaatcgag

SEQ ID NO: 14904 - DNA, 43 bp, Xenorhabdus bovienii
  Terminator location: Contig name=SeqID_16828; Position on contig =3..45bp; Strand=-
taaacggctcaaaaagtaacgggccgtttatttttctgtccat

SEQ ID NO: 14905 - DNA, 36 bp, Xenorhabdus bovienii
  Terminator location: Contig name=SeqID_16828; Position on contig =5276..5311bp; Strand=-; Gene name=RpsJ
cgccctataaatttgcatagggcgttttccctcttt

SEQ ID NO: 14906 - DNA, 39 bp, Xenorhabdus bovienii
  Terminator location: Contig name=SeqID_16829; Position on contig =283..321bp; Strand=+; Gene name=HipB
ttaagtgctcgtggtgagcatatgaaatctatgctgctt

SEQ ID NO: 14907 - DNA, 38 bp, Xenorhabdus bovienii
  Terminator location: Contig name=SeqID_16831; Position on contig =5341..5378bp; Strand=+; Gene name=NrfG
tcaacagcagctacggctgctgttatttttcatggttc

SEQ ID NO: 14908 - DNA, 29 bp, Xenorhabdus bovienii
  Terminator location: Contig name=SeqID_16831; Position on contig =6036..6064bp; Strand=+
cgcgctcaatgagcgcgtttttattgccc

SEQ ID NO: 14909 - DNA, 44 bp, Xenorhabdus bovienii
  Terminator location: Contig name=SeqID_16831; Position on contig =7477..7520bp; Strand=+; Gene name=PheA
tagaaaaccggatgttttcatccggtttcacaatttggaatcga

SEQ ID NO: 14910 - DNA, 38 bp, Xenorhabdus bovienii
  Terminator location: Contig name=SeqID_16831; Position on contig =7468..7505bp; Strand=-; Gene name=PheA
gaaaccggatgaaaacatccggttttctattttagcag

SEQ ID NO: 14911 - DNA, 43 bp, Xenorhabdus bovienii
  Terminator location: Contig name=SeqID_16831; Position on contig =10796..10838bp; Strand=-
tatagaggcctgcatatgcaggcctctaattatttattacaat

SEQ ID NO: 14912 - DNA, 35 bp, Xenorhabdus bovienii
  Terminator location: Contig name=SeqID_16831; Position on contig =11242..11276bp; Strand=-; Gene name=RplS
ggcatatcctgtgaaggaatgtctttgatatatca

SEQ ID NO: 14913 - DNA, 47 bp, Xenorhabdus bovienii
  Terminator location: Contig name=SeqID_16831; Position on contig =12906..12952bp; Strand=-; Gene name=RpsP
tagccggacttcattcctcgatgaagtctggttgttttgctaactaa

SEQ ID NO: 14914 - DNA, 56 bp, Xenorhabdus bovienii
  Terminator location: Contig name=SeqID_16832; Position on contig =2732..2787bp; Strand=-
tgaaaaagccaaaggttggtaaggttcaacctttggctgccttattttagtgataa

SEQ ID NO: 14915 - DNA, 53 bp, Xenorhabdus bovienii
  Terminator location: Contig name=SeqID_16832; Position on contig =4340..4392bp; Strand=-; Gene name=ProP
ctttctgccaaattctgcccagttagttaatgtgcagaaagttttcttgagag

SEQ ID NO: 14916 - DNA, 27 bp, Xenorhabdus bovienii
  Terminator location: Contig name=SeqID_16832; Position on contig =5631..5657bp; Strand=+; Gene name=BolA
cagccttcgggctgtatttttgtatat

SEQ ID NO: 14917 - DNA, 42 bp, Xenorhabdus bovienii
  Terminator location: Contig name=SeqID_16832; Position on contig =7297..7338bp; Strand=+; Gene name=Tig
gcaaacccgcaggctatgcttgcgggtttttttattgtcctt

SEQ ID NO: 14918 - DNA, 40 bp, Xenorhabdus bovienii
  Terminator location: Contig name=SeqID_16832; Position on contig =9594..9633bp; Strand=+; Gene name=ClpX
taaaaatgagggattctccctcattttgctttttgcaggc

SEQ ID NO: 14919 - DNA, 37 bp, Xenorhabdus bovienii
  Terminator location: Contig name=SeqID_16833; Position on contig =690..726bp; Strand=-; Gene name=DjlA
ctggcggtaaaccttttgccaccagtttatcgggatg

SEQ ID NO: 14920 - DNA, 38 bp, Xenorhabdus bovienii
  Terminator location: Contig name=SeqID_16833; Position on contig =1533..1570bp; Strand=-; Gene name=RluA
ggggcgatctcaatgagatgcccctgcattttaatctc

SEQ ID NO: 14921 - DNA, 54 bp, Xenorhabdus bovienii
  Terminator location: Contig name=SeqID_16834; Position on contig =3269..3322bp; Strand=+; Gene name=RibC
ggtgaaagctacaggaatggggttctgtagctttctgtacaacctttttaggtt

SEQ ID NO: 14922 - DNA, 36 bp, Xenorhabdus bovienii
  Terminator location: Contig name=SeqID_16834; Position on contig =3264..3299bp; Strand=-; Gene name=RibC
gctacagaaccccattcctgtagctttcacctacaa

SEQ ID NO: 14923 - DNA, 53 bp, Xenorhabdus bovienii
  Terminator location: Contig name=SeqID_16834; Position on contig =4701..4753bp; Strand=-; Gene name=Cfa
tcatctaaaggttgcgtcataaatgtgacctttagatgattgtttaaatatta

SEQ ID NO: 14924 - DNA, 41 bp, Xenorhabdus bovienii
  Terminator location: Contig name=SeqID_16834; Position on contig =9862..9902bp; Strand=-
gccccatgcctgctgaagatgtatggggctttaaccatcat

SEQ ID NO: 14925 - DNA, 29 bp, Xenorhabdus bovienii
  Terminator location: Contig name=SeqID_16834; Position on contig =10640..10668bp; Strand=-; Gene name=DnaQ
gggcattttccatgcccttcatttctaaa

SEQ ID NO: 14926 - DNA, 48 bp, Xenorhabdus bovienii
  Terminator location: Contig name=SeqID_16834; Position on contig =13043..13090bp; Strand=+
gaacaataaaagagcttattttctatcttattgtttttaatgttattt

SEQ ID NO: 14927 - DNA, 53 bp, Xenorhabdus bovienii
  Terminator location: Contig name=SeqID_16834; Position on contig =13973..14025bp; Strand=+; Gene name=MarR
gaaaatcgcggtccagcagatactggcaagccgcgatttttttgtttgactgt

SEQ ID NO: 14928 - DNA, 43 bp, Xenorhabdus bovienii
  Terminator location: Contig name=SeqID_16834; Position on contig =13966..14008bp; Strand=-; Gene name=MarR
tcgcggcttgccagtatctgctggaccgcgattttctcttcat

SEQ ID NO: 14929 - DNA, 37 bp, Xenorhabdus bovienii
  Terminator location: Contig name=SeqID_16835; Position on contig =2178..2214bp; Strand=+; Gene name=IscU
ggtggatattgattcaatatccacctttactagtttt

SEQ ID NO: 14930 - DNA, 27 bp, Xenorhabdus bovienii
  Terminator location: Contig name=SeqID_16835; Position on contig =5666..5692bp; Strand=+
ctggcaatcgccagtttttttacatta

SEQ ID NO: 14931 - DNA, 56 bp, Xenorhabdus bovienii
  Terminator location: Contig name=SeqID_16835; Position on contig =7069..7124bp; Strand=+; Gene name=PepB
tttcttcatagtctcctttcaaaaggggaggctatgattgaacctttcaatagtct

SEQ ID NO: 14932 - DNA, 38 bp, Xenorhabdus bovienii
  Terminator location: Contig name=SeqID_16835; Position on contig =7603..7640bp; Strand=+
gaattttgttctagatgaaaattccgttattttttctg

SEQ ID NO: 14933 - DNA, 36 bp, Xenorhabdus bovienii
  Terminator location: Contig name=SeqID_16835; Position on contig =12802..12837bp; Strand=+
gcccctatccttagtgataggggctgttccctttcg

SEQ ID NO: 14934 - DNA, 38 bp, Xenorhabdus bovienii
  Terminator location: Contig name=SeqID_16836; Position on contig =11315..11352bp; Strand=+; Gene name=WecE
gatgagcgttaaaccaacagcttattttgttgctcaaa

SEQ ID NO: 14935 - DNA, 50 bp, Xenorhabdus bovienii
  Terminator location: Contig name=SeqID_16836; Position on contig =13238..13287bp; Strand=+; Gene name=GlnS
cattaaaaaggcgcgattattatcgcgctttttttatgtttaaaatattt

SEQ ID NO: 14936 - DNA, 46 bp, Xenorhabdus bovienii
  Terminator location: Contig name=SeqID_16836; Position on contig =16282..16327bp; Strand=+; Gene name=Chb
gcctgccgattagcttgagctaatcggcagtagcttattcagacta

SEQ ID NO: 14937 - DNA, 45 bp, Xenorhabdus bovienii
  Terminator location: Contig name=SeqID_16836; Position on contig =16269..16313bp; Strand=-; Gene name=Chb
tactgccgattagctcaagctaatcggcaggctgctttttaaaag

SEQ ID NO: 14938 - DNA, 44 bp, Xenorhabdus bovienii
  Terminator location: Contig name=SeqID_16837; Position on contig =2876..2919bp; Strand=+
ggtcaataacgcttcgtcacgttattgaccttttttcatttgca

SEQ ID NO: 14939 - DNA, 39 bp, Xenorhabdus bovienii
  Terminator location: Contig name=SeqID_16837; Position on contig =2729..2767bp; Strand=-
taattttctggtcagcaagagaattgaatttttctttta

SEQ ID NO: 14940 - DNA, 33 bp, Xenorhabdus bovienii
  Terminator location: Contig name=SeqID_16837; Position on contig =6383..6415bp; Strand=+; Gene name=SseA
gggcatcaaaatatcatgccctttttcctatca

SEQ ID NO: 14941 - DNA, 60 bp, Xenorhabdus bovienii
  Terminator location: Contig name=SeqID_16837; Position on contig =6355..6414bp; Strand=-; Gene name=SseA
gataggaaaaagggcatgatattttgatgccctttgctgttttatctatttttctaacgg

SEQ ID NO: 14942 - DNA, 35 bp, Xenorhabdus bovienii
  Terminator location: Contig name=SeqID_16837; Position on contig =7012..7046bp; Strand=-
gcggctgggactcacccagccgctattaaattatc

SEQ ID NO: 14943 - DNA, 28 bp, Xenorhabdus bovienii
  Terminator location: Contig name=SeqID_16837; Position on contig =15764..15791bp; Strand=+
cctgctggtgcaggttttttccaaaata

SEQ ID NO: 14944 - DNA, 39 bp, Xenorhabdus bovienii
  Terminator location: Contig name=SeqID_16837; Position on contig =15746..15784bp; Strand=-
gaaaaaacctgcaccagcaggtttttttatattagaaat

SEQ ID NO: 14945 - DNA, 41 bp, Xenorhabdus bovienii
  Terminator location: Contig name=SeqID_16837; Position on contig =16557..16597bp; Strand=-
tctatgctaatgtataacatttgaatagattgtttattttt

SEQ ID NO: 14946 - DNA, 49 bp, Xenorhabdus bovienii
  Terminator location: Contig name=SeqID_16837; Position on contig =20253..20301bp; Strand=+
gcaagtggagagtgatgctattcactccccacattccattctatttcca

SEQ ID NO: 14947 - DNA, 43 bp, Xenorhabdus bovienii
  Terminator location: Contig name=SeqID_16837; Position on contig =20215..20257bp; Strand=-
cttgcaaaatagtcagcccaatttttgcagggtattttcgata

SEQ ID NO: 14948 - DNA, 44 bp, Xenorhabdus bovienii
  Terminator location: Contig name=SeqID_16838; Position on contig =5231..5274bp; Strand=+; Gene name=BioA
taaagccagcattaataacatgctggctttatttgtcattctcg

SEQ ID NO: 14949 - DNA, 40 bp, Xenorhabdus bovienii
  Terminator location: Contig name=SeqID_16838; Position on contig =6120..6159bp; Strand=+
ttgccgcgctaaaaatagcgcggctcaagtttacaatgcc

SEQ ID NO: 14950 - DNA, 35 bp, Xenorhabdus bovienii
  Terminator location: Contig name=SeqID_16838; Position on contig =6109..6143bp; Strand=-
gccgcgctatttttagcgcggcaatatttcccctt

SEQ ID NO: 14951 - DNA, 39 bp, Xenorhabdus bovienii
  Terminator location: Contig name=SeqID_16838; Position on contig =8121..8159bp; Strand=+; Gene name=Cof
gggagcgccagacaaccgtgctccctcaatttattgcag

SEQ ID NO: 14952 - DNA, 33 bp, Xenorhabdus bovienii
  Terminator location: Contig name=SeqID_16838; Position on contig =10906..10938bp; Strand=-; Gene name=ModA
ttacccggttttgccgggtaatttcttttctct

SEQ ID NO: 14953 - DNA, 40 bp, Xenorhabdus bovienii
  Terminator location: Contig name=SeqID_16838; Position on contig =12133..12172bp; Strand=+; Gene name=ModE
taagtgtcagaggggaatggcaacttacctgtttcattct

SEQ ID NO: 14954 - DNA, 61 bp, Xenorhabdus bovienii
  Terminator location: Contig name=SeqID_16838; Position on contig =13790..13850bp; Strand=+; Gene name=ModF
tcagtgcaagttctctcccgatttaacgtcgaaagagggctttcactcgaattttttcact

SEQ ID NO: 14955 - DNA, 32 bp, Xenorhabdus bovienii
  Terminator location: Contig name=SeqID_16838; Position on contig =15759..15790bp; Strand=+; Gene name=GpmA
gccggtaatcactccggcttttttatgctgct

SEQ ID NO: 14956 - DNA, 43 bp, Xenorhabdus bovienii
  Terminator location: Contig name=SeqID_16838; Position on contig =15741..15783bp; Strand=-; Gene name=GpmA
taaaaaagccggagtgattaccggctttttagtattacgtttc

SEQ ID NO: 14957 - DNA, 45 bp, Xenorhabdus bovienii
  Terminator location: Contig name=SeqID_16838; Position on contig =17034..17078bp; Strand=-; Gene name=AroG
caggtcataggtagccaatctatctacggcctgctattaagtgtt

SEQ ID NO: 14958 - DNA, 39 bp, Xenorhabdus bovienii
  Terminator location: Contig name=SeqID_16839; Position on contig =5671..5709bp; Strand=+; Gene name=Fmt
tgtctgtatgctttgagcatacaggcgtcttccttttta

SEQ ID NO: 14959 - DNA, 43 bp, Xenorhabdus bovienii
  Terminator location: Contig name=SeqID_16839; Position on contig =7036..7078bp; Strand=+; Gene name=Sun
tcttcctcgtcaaaatatcggacgaggaggggtttagtgactt

SEQ ID NO: 14960 - DNA, 33 bp, Xenorhabdus bovienii
  Terminator location: Contig name=SeqID_16839; Position on contig =8313..8345bp; Strand=-; Gene name=TrkA
ggtggtagtctaatatcaccaatcttgcgtcca

SEQ ID NO: 14961 - DNA, 62 bp, Xenorhabdus bovienii
  Terminator location: Contig name=SeqID_16839; Position on contig =9354..9415bp; Strand=-; Gene name=SoxR
tagaagcataaaaaaccgggataacacccggttttttattgctctttattttttcttccaat

SEQ ID NO: 14962 - DNA, 44 bp, Xenorhabdus bovienii
  Terminator location: Contig name=SeqID_16839; Position on contig =12371..12414bp; Strand=-; Gene name=RpsM
ggttgagctggctaaattggccagccaatcttttttatctgaca

SEQ ID NO: 14963 - DNA, 45 bp, Xenorhabdus bovienii; identical to SEQ ID NO: 14883
  Terminator location: Contig name=SeqID_16840; Position on contig =548..592bp; Strand=-

SEQ ID NO: 14964 - DNA, 40 bp, Xenorhabdus bovienii
  Terminator location: Contig name=SeqID_16840; Position on contig =1906..1945bp; Strand=-
tcacgcccttggcctaaaggggagtggattattgcgaatc

SEQ ID NO: 14965 - DNA, 42 bp, Xenorhabdus bovienii
  Terminator location: Contig name=SeqID_16840; Position on contig =5875..5916bp; Strand=+; Gene name=MazF
tgaatgctacgaattgtcagtgcatttaaatatatttaaaac

SEQ ID NO: 14966 - DNA, 41 bp, Xenorhabdus bovienii
  Terminator location: Contig name=SeqID_16841; Position on contig =10919..10959bp; Strand=+; Gene name=MesJ
tagccgatgtaaaaactgacatcggcataattatggtcaat

SEQ ID NO: 14967 - DNA, 38 bp, Xenorhabdus bovienii
  Terminator location: Contig name=SeqID_16841; Position on contig =10907..10944bp; Strand=-; Gene name=MesJ
gccgatgtcagtttttacatcggctatttttttcgcta

SEQ ID NO: 14968 - DNA, 41 bp, Xenorhabdus bovienii
  Terminator location: Contig name=SeqID_16841; Position on contig =14691..14731bp; Strand=+
ggcggcaagctatttgtgattgccgccaacttatcttatca

SEQ ID NO: 14969 - DNA, 47 bp, Xenorhabdus bovienii
  Terminator location: Contig name=SeqID_16841; Position on contig =16206..16252bp; Strand=-; Gene name=SPS1
ttagccccatcaaatattttatctgatggggctaattttcggacttc

SEQ ID NO: 14970 - DNA, 47 bp, Xenorhabdus bovienii
  Terminator location: Contig name=SeqID_16841; Position on contig =23297..23343bp; Strand=+; Gene name=PspF
ttctcaatgcgatttgcaaagtgttttattgagaatttttctcatta

SEQ ID NO: 14971 - DNA, 45 bp, Xenorhabdus bovienii
  Terminator location: Contig name=SeqID_16841; Position on contig =29783..29827bp; Strand=+; Gene name=FabI
taagcctagtgataactgtatttctgggcttatttctttcccacc

SEQ ID NO: 14972 - DNA, 29 bp, Xenorhabdus bovienii
  Terminator location: Contig name=SeqID_16842; Position on contig =403..431bp; Strand=-
ggaggcagatgcctcctttttttatggta

SEQ ID NO: 14973 - DNA, 33 bp, Xenorhabdus bovienii
  Terminator location: Contig name=SeqID_16842; Position on contig =3483..3515bp; Strand=-; Gene name=AcnB
cggctcctattcagggggccgtttttaatttat

SEQ ID NO: 14974 - DNA, 37 bp, Xenorhabdus bovienii
  Terminator location: Contig name=SeqID_16842; Position on contig =5125..5161bp; Strand=-; Gene name=Lpd
ctttatgattacgatcgtgacagatattttagactta

SEQ ID NO: 14975 - DNA, 41 bp, Xenorhabdus bovienii
  Terminator location: Contig name=SeqID_16842; Position on contig =12081..12121bp; Strand=-; Gene name=FadR
gaaaggggtctggttttaagattcctttctttttaaatcat

SEQ ID NO: 14976 - DNA, 40 bp, Xenorhabdus bovienii
  Terminator location: Contig name=SeqID_16842; Position on contig =18941..18980bp; Strand=+
gtagcgccgattgtattcggcgctaccgttaattatttgt

SEQ ID NO: 14977 - DNA, 51 bp, Xenorhabdus bovienii
  Terminator location: Contig name=SeqID_16842; Position on contig =18922..18972bp; Strand=-
ttaacggtagcgccgaatacaatcggcgctactttgatggttattaccgat

SEQ ID NO: 14978 - DNA, 47 bp, Xenorhabdus bovienii
  Terminator location: Contig name=SeqID_16842; Position on contig =21246..21292bp; Strand=-; Gene name=Uup
cctcaaaattcatttctcagagaatgatttgaggtttttttatgaag

SEQ ID NO: 14979 - DNA, 44 bp, Xenorhabdus bovienii
  Terminator location: Contig name=SeqID_16842; Position on contig =24115..24158bp; Strand=-; Gene name=SecA
ctgtcttactttttgttttttgatgagacagttttgcttggaca

SEQ ID NO: 14980 - DNA, 34 bp, Xenorhabdus bovienii
  Terminator location: Contig name=SeqID_16842; Position on contig =25457..25490bp; Strand=+
caagactgcttgcagcagcttgttattcaatgca

SEQ ID NO: 14981 - DNA, 52 bp, Xenorhabdus bovienii
  Terminator location: Contig name=SeqID_16842; Position on contig =25210..25261bp; Strand=-
ttggctgtactggtaccctctccggccagcgcagccaatctctctaatttcc

SEQ ID NO: 14982 - DNA, 42 bp, Xenorhabdus bovienii
  Terminator location: Contig name=SeqID_16843; Position on contig =32..73bp; Strand=-
gaaagtggtgtcttggcagatgccactttttcttttatatct

SEQ ID NO: 14983 - DNA, 47 bp, Xenorhabdus bovienii
  Terminator location: Contig name=SeqID_16843; Position on contig =1358..1404bp; Strand=-; Gene name=NupC
tagtgaattattgtgataataatcacaatttactattatgcattaca

SEQ ID NO: 14984 - DNA, 29 bp, Xenorhabdus bovienii
  Terminator location: Contig name=SeqID_16843; Position on contig =3524..3552bp; Strand=-; Gene name=Lig
cccccgctagccgggggtttttcatgtct

SEQ ID NO: 14985 - DNA, 39 bp, Xenorhabdus bovienii
  Terminator location: Contig name=SeqID_16843; Position on contig =5530..5568bp; Strand=+; Gene name=CysZ
ccctgatgtatcaaaaatacaccggggttttgtgttagc

SEQ ID NO: 14986 - DNA, 27 bp, Xenorhabdus bovienii
  Terminator location: Contig name=SeqID_16843; Position on contig =6779..6805bp; Strand=+; Gene name=CysK
gcaccttaagggtgcttttttgtgcat

SEQ ID NO: 14987 - DNA, 29 bp, Xenorhabdus bovienii
  Terminator location: Contig name=SeqID_16843; Position on contig =6765..6793bp; Strand=-; Gene name=CysK
gcacccttaaggtgcttttttgtcaatga

SEQ ID NO: 14988 - DNA, 35 bp, Xenorhabdus bovienii
  Terminator location: Contig name=SeqID_16843; Position on contig =7427..7461bp; Strand=+; Gene name=FruB
ccccagataaataaaatctggggatatttagagcc

SEQ ID NO: 14989 - DNA, 40 bp, Xenorhabdus bovienii
  Terminator location: Contig name=SeqID_16843; Position on contig =10955..10994bp; Strand=-; Gene name=CysK
cccgtctctcgtcatttgggggagcgggtattttttgttt

SEQ ID NO: 14990 - DNA, 39 bp, Xenorhabdus bovienii
  Terminator location: Contig name=SeqID_16843; Position on contig =15004..15042bp; Strand=-
gatgaagcagagctctcttttcatccgtttatatattat

SEQ ID NO: 14991 - DNA, 38 bp, Xenorhabdus bovienii
  Terminator location: Contig name=SeqID_16843; Position on contig =16117..16154bp; Strand=-
gagataattctaacttgaatttttccttcgttatctcg

SEQ ID NO: 14992 - DNA, 50 bp, Xenorhabdus bovienii
  Terminator location: Contig name=SeqID_16843; Position on contig =23350..23399bp; Strand=+; Gene name=InsB
tcactcaatgtaacgtatgttagtatcattgagtgataatattttagaac

SEQ ID NO: 14993 - DNA, 52 bp, Xenorhabdus bovienii
  Terminator location: Contig name=SeqID_16843; Position on contig =24013..24064bp; Strand=+; Gene name=Hcp
taaaaacaaaatggtacgctcagtatcattttgttttatacttataatggta

SEQ ID NO: 14994 - DNA, 57 bp, Xenorhabdus bovienii
  Terminator location: Contig name=SeqID_16843; Position on contig =23882..23938bp; Strand=-; Gene name=Hcp
tatgctatcatatgaaattgttatactttcatatggttgcatatcattgtggcttag

SEQ ID NO: 14995 - DNA, 39 bp, Xenorhabdus bovienii
  Terminator location: Contig name=SeqID_16843; Position on contig =33697..33735bp; Strand=+
cactggtaggatgtttctaccagtgaccttgttcaccct

SEQ ID NO: 14996 - DNA, 42 bp, Xenorhabdus bovienii
  Terminator location: Contig name=SeqID_16843; Position on contig =35361..35402bp; Strand=+; Gene name=HemF
caggaatatcggataacgcctgtattcctgttctatatcaga

SEQ ID NO: 14997 - DNA, 36 bp, Xenorhabdus bovienii
  Terminator location: Contig name=SeqID_16843; Position on contig =36704..36739bp; Strand=+; Gene name=LasB
gaaagggctgaaaatagccctttcttatattcatag

SEQ ID NO: 14998 - DNA, 35 bp, Xenorhabdus bovienii
  Terminator location: Contig name=SeqID_16843; Position on contig =37288..37322bp; Strand=+
taaagggctaaaatagccctttatttcatacatat

SEQ ID NO: 14999 - DNA, 51 bp, Xenorhabdus bovienii
  Terminator location: Contig name=SeqID_16843; Position on contig =37267..37317bp; Strand=-
tatgaaataaagggctattttagccctttattattactggtttagttaatt

SEQ ID NO: 15000 - DNA, 43 bp, Xenorhabdus bovienii
  Terminator location: Contig name=SeqID_16843; Position on contig =38905..38947bp; Strand=-
cggctcctgtgctgacagtaacaggagccgtttcgtcttttta

SEQ ID NO: 15001 - DNA, 47 bp, Xenorhabdus bovienii
  Terminator location: Contig name=SeqID_16843; Position on contig =42148..42194bp; Strand=-; Gene name=HisS
tgatactggctcatgttatcatgagccagtattgtttctgattgctg

SEQ ID NO: 15002 - DNA, 42 bp, Xenorhabdus bovienii
  Terminator location: Contig name=SeqID_16843; Position on contig =43446..43487bp; Strand=+
ttgccaaaatagttaattattttctggcagtttcagttgggc

SEQ ID NO: 15003 - DNA, 51 bp, Xenorhabdus bovienii
  Terminator location: Contig name=SeqID_16843; Position on contig =43382..43432bp; Strand=-
tataggcgaatattgaatagaaattcaagttcgcctgtgtgtattattcac

SEQ ID NO: 15004 - DNA, 42 bp, Xenorhabdus bovienii
  Terminator location: Contig name=SeqID_16843; Position on contig =46324..46365bp; Strand=-
cgcctcactgatttgacttagtggggcgtttattattttatc

SEQ ID NO: 15005 - DNA, 38 bp, Xenorhabdus bovienii
  Terminator location: Contig name=SeqID_16843; Position on contig =46908..46945bp; Strand=-; Gene name=Ndk
tttattcctgtcaggtacaggataaatttcgtctccct

SEQ ID NO: 15006 - DNA, 49 bp, Xenorhabdus bovienii
  Terminator location: Contig name=SeqID_16844; Position on contig =6290..6338bp; Strand=-; Gene name=Hcp
ttggaaatccattgctattttatctggatttccgatttttttatatatg

SEQ ID NO: 15007 - DNA, 45 bp, Xenorhabdus bovienii
  Terminator location: Contig name=SeqID_16844; Position on contig =10306..10350bp; Strand=-
gctgtattttgatgaatacaaaaaatacagccttttgaaaatttt

SEQ ID NO: 15008 - DNA, 29 bp, Xenorhabdus bovienii
  Terminator location: Contig name=SeqID_16845; Position on contig =287..315bp; Strand=+
gccaccgtaatggtggcttttttatggat

SEQ ID NO: 15009 - DNA, 46 bp, Xenorhabdus bovienii
  Terminator location: Contig name=SeqID_16845; Position on contig =1541..1586bp; Strand=+
tcaaagtcaccgtctaaagaccgtggttttaaacctttcatatgga

SEQ ID NO: 15010 - DNA, 47 bp, Xenorhabdus bovienii
  Terminator location: Contig name=SeqID_16845; Position on contig =1341..1387bp; Strand=-
caatgcctgccaaatacgatatttgactgtcattgattttggcgtat

SEQ ID NO: 15011 - DNA, 46 bp, Xenorhabdus bovienii
  Terminator location: Contig name=SeqID_16845; Position on contig =1583..1628bp; Strand=-
caacctgagttaaatattcataaaactcaggttgttgatttttcca

SEQ ID NO: 15012 - DNA, 69 bp, Xenorhabdus bovienii
  Terminator location: Contig name=SeqID_16845; Position on contig =3356..3424bp; Strand=+
cacgtgtaataaaataagatatatgcaatatatattgttatttgtgtaatatacgtgatgttgttgtgg

SEQ ID NO: 15013 - DNA, 36 bp, Xenorhabdus bovienii
  Terminator location: Contig name=SeqID_16845; Position on contig =7229..7264bp; Strand=+
cttgatcggaagttctgattcagggtattaatgcag

SEQ ID NO: 15014 - DNA, 43 bp, Xenorhabdus bovienii
  Terminator location: Contig name=SeqID_16845; Position on contig =9739..9781bp; Strand=+; Gene name=Gst
ttgaatataatttattgagtgattattttaattttattaacca

SEQ ID NO: 15015 - DNA, 31 bp, Xenorhabdus bovienii
  Terminator location: Contig name=SeqID_16845; Position on contig =18006..18036bp; Strand=+
ctacagaccatctgtggataatttggatcgc

SEQ ID NO: 15016 - DNA, 45 bp, Xenorhabdus bovienii
  Terminator location: Contig name=SeqID_16845; Position on contig =17806..17850bp; Strand=-
tcaaagtcaccgtctaaagacggtggttttaaacctttcatatgg

SEQ ID NO: 15017 - DNA, 48 bp, Xenorhabdus bovienii
  Terminator location: Contig name=SeqID_16845; Position on contig =18332..18379bp; Strand=-
gccgctttctatctgatttccatgatggaatgcggcctttcttcgtga

SEQ ID NO: 15018 - DNA, 43 bp, Xenorhabdus bovienii
  Terminator location: Contig name=SeqID_16845; Position on contig =19053..19095bp; Strand=+
tggtgtagtagatgattcttactccgccactttttcccattcc

SEQ ID NO: 15019 - DNA, 45 bp, Xenorhabdus bovienii; identical to SEQ ID NO: 15016
  Terminator location: Contig name=SeqID_16845; Position on contig =18801..18845bp; Strand=-

SEQ ID NO: 15020 - DNA, 55 bp, Xenorhabdus bovienii
  Terminator location: Contig name=SeqID_16845; Position on contig =20351..20405bp; Strand=+
ttttggttgttggtcttttactactaaacctactaccaaaaacatttacgattgc

SEQ ID NO: 15021 - DNA, 34 bp, Xenorhabdus bovienii
  Terminator location: Contig name=SeqID_16845; Position on contig =21083..21116bp; Strand=-
taaggcggaatccggccttagtcctttgatttaa

SEQ ID NO: 15022 - DNA, 58 bp, Xenorhabdus bovienii
  Terminator location: Contig name=SeqID_16845; Position on contig =25219..25276bp; Strand=+
ttttggtagtaagtgttttagtagtgtagacgacttactaccaaaattatcgaattaa

SEQ ID NO: 15023 - DNA, 45 bp, Xenorhabdus bovienii
  Terminator location: Contig name=SeqID_16845; Position on contig =25529..25573bp; Strand=+
cccaggcagggcatccacgcgatctcttttgggtttgacctctct

SEQ ID NO: 15024 - DNA, 65 bp, Xenorhabdus bovienii
  Terminator location: Contig name=SeqID_16845; Position on contig =27168..27232bp; Strand=+
ccgatatctatttattcgccagatgcattactggcgaataaataaaattccgcgtcttactgatc

SEQ ID NO: 15025 - DNA, 55 bp, Xenorhabdus bovienii
  Terminator location: Contig name=SeqID_16845; Position on contig =31049..31103bp; Strand=+; Gene name=GrpE
ccgtgattacaatgccgccatacacagggcggcatttttgtggttattctattgt

SEQ ID NO: 15026 - DNA, 60 bp, Xenorhabdus bovienii
  Terminator location: Contig name=SeqID_16845; Position on contig =31866..31925bp; Strand=+
tgaagctaattgataggatgaaattctgattttataaattatttttaaaatttataaaaa

SEQ ID NO: 15027 - DNA, 40 bp, Xenorhabdus bovienii
  Terminator location: Contig name=SeqID_16845; Position on contig =33297..33336bp; Strand=+
tctgtttgtcagagatgataaagcgggctgtttgcccgct

SEQ ID NO: 15028 - DNA, 45 bp, Xenorhabdus bovienii
  Terminator location: Contig name=SeqID_16845; Position on contig =38599..38643bp; Strand=+; Gene name=RseC
ctggtcatactgaaaaccacaggcatgactaggttttcgcaggtt

SEQ ID NO: 15029 - DNA, 46 bp, Xenorhabdus bovienii
  Terminator location: Contig name=SeqID_16845; Position on contig =38257..38302bp; Strand=-; Gene name=RseC
ttctactttttgaccaggttgaagaggttgggaaatttccagttct

SEQ ID NO: 15030 - DNA, 61 bp, Xenorhabdus bovienii
  Terminator location: Contig name=SeqID_16845; Position on contig =41650..41710bp; Strand=+; Gene name=LepB
caaacgcaacagttttgtagggtctatccccacaggtctgttgcgtgtgcttttttgatga

SEQ ID NO: 15031 - DNA, 45 bp, Xenorhabdus bovienii
  Terminator location: Contig name=SeqID_16845; Position on contig =53790..53834bp; Strand=+; Gene name=PurL
ctttggtattagtccctgaagatttaccagggttttaagctaaga

SEQ ID NO: 15032 - DNA, 37 bp, Xenorhabdus bovienii
  Terminator location: Contig name=SeqID_16845; Position on contig =60432..60468bp; Strand=-; Gene name=GlnK
gggcgtatctttactgcatacgcccgttatcacttca

SEQ ID NO: 15033 - DNA, 60 bp, Xenorhabdus bovienii
  Terminator location: Contig name=SeqID_16845; Position on contig =63819..63878bp; Strand=+; Gene name=Hcp
taacacataatgttttgttgcaatttaatttaaatgttatgtgttaatttctcaatattg

SEQ ID NO: 15034 - DNA, 48 bp, Xenorhabdus bovienii
  Terminator location: Contig name=SeqID_16845; Position on contig =63616..63663bp; Strand=-; Gene name=Hcp
tgttttataaaagcatttcgcaattttatggaataaaatttttcagct

SEQ ID NO: 15035 - DNA, 41 bp, Xenorhabdus bovienii
  Terminator location: Contig name=SeqID_16845; Position on contig =66922..66962bp; Strand=+; Gene name=GlyA
cccgactcataacattagttttgagcgggtttttttacatt

SEQ ID NO: 15036 - DNA, 31 bp, Xenorhabdus bovienii
  Terminator location: Contig name=SeqID_16845; Position on contig =68219..68249bp; Strand=-; Gene name=ProP
gggcaccatctggtgccctttttatggttac

SEQ ID NO: 15037 - DNA, 37 bp, Xenorhabdus bovienii
  Terminator location: Contig name=SeqID_16846; Position on contig =1673..1709bp; Strand=-
ccattatcctgacttggggtagggggtatttgtaatc

SEQ ID NO: 15038 - DNA, 41 bp, Xenorhabdus bovienii
  Terminator location: Contig name=SeqID_16846; Position on contig =2970..3010bp; Strand=-
gttcctgtcagtattttattgacaggaactgtttggtattt

SEQ ID NO: 15039 - DNA, 39 bp, Xenorhabdus bovienii
  Terminator location: Contig name=SeqID_16846; Position on contig =7851..7889bp; Strand=+; Gene name=PerM
tgcgcgaaaatattattttttcgcgcaattatcatattg

SEQ ID NO: 15040 - DNA, 48 bp, Xenorhabdus bovienii
  Terminator location: Contig name=SeqID_16846; Position on contig =8238..8285bp; Strand=-
ttaaaaagcctgttggaatatttgcaggcttttttgttttgtgtaaca

SEQ ID NO: 15041 - DNA, 42 bp, Xenorhabdus bovienii
  Terminator location: Contig name=SeqID_16846; Position on contig =11842..11883bp; Strand=+
ctttgcacgatactttctcgtgcaaatgtcattattgtttgt

SEQ ID NO: 15042 - DNA, 51 bp, Xenorhabdus bovienii
  Terminator location: Contig name=SeqID_16846; Position on contig =13019..13069bp; Strand=+; Gene name=AroG
ttttatctgacccctgtttcttgcaagagttagatgaaattctaaaatatc

SEQ ID NO: 15043 - DNA, 44 bp, Xenorhabdus bovienii
  Terminator location: Contig name=SeqID_16846; Position on contig =19314..19357bp; Strand=-; Gene name=FepC
ggcaaattttgtgaataccaacaaaatttgccttttccgtaggg

SEQ ID NO: 15044 - DNA, 42 bp, Xenorhabdus bovienii
  Terminator location: Contig name=SeqID_16846; Position on contig =25160..25201bp; Strand=+
gttaaaggtgagaaatcccaccttttgctaatttattgattt

SEQ ID NO: 15045 - DNA, 40 bp, Xenorhabdus bovienii
  Terminator location: Contig name=SeqID_16846; Position on contig =25906..25945bp; Strand=-
tgaacccgcagaaaattgcgggttgaatattgttcgcacc

SEQ ID NO: 15046 - DNA, 27 bp, Xenorhabdus bovienii
  Terminator location: Contig name=SeqID_16846; Position on contig =26494..26520bp; Strand=-
ggggcttgatgccccttattgttattc

SEQ ID NO: 15047 - DNA, 36 bp, Xenorhabdus bovienii
  Terminator location: Contig name=SeqID_16846; Position on contig =36199..36234bp; Strand=+
gcgcgttgtcttcaatcggcgtgcttaatctgataa

SEQ ID NO: 15048 - DNA, 51 bp, Xenorhabdus bovienii
  Terminator location: Contig name=SeqID_16846; Position on contig =38360..38410bp; Strand=+
gcatcgctacggtcacgtcaataccgtccagtgggtgcgtatctatggggt

SEQ ID NO: 15049 - DNA, 52 bp, Xenorhabdus bovienii
  Terminator location: Contig name=SeqID_16846; Position on contig =38247..38298bp; Strand=-
cccgttactgggcggctcgttcgctgcccggtcaggggcgaatttttgcccg

SEQ ID NO: 15050 - DNA, 47 bp, Xenorhabdus bovienii
  Terminator location: Contig name=SeqID_16846; Position on contig =47322..47368bp; Strand=+
caatcaatatagtggctccctctgtatggattgaattcgttgtcttt

SEQ ID NO: 15051 - DNA, 31 bp, Xenorhabdus bovienii
  Terminator location: Contig name=SeqID_16846; Position on contig =47054..47084bp; Strand=-
tttgggtccttacccgagatcttatatatca

SEQ ID NO: 15052 - DNA, 41 bp, Xenorhabdus bovienii
  Terminator location: Contig name=SeqID_16846; Position on contig =50512..50552bp; Strand=-
gccatcatgattcacagagtcgtgatagctatgtagtcaaa

SEQ ID NO: 15053 - DNA, 39 bp, Xenorhabdus bovienii
  Terminator location: Contig name=SeqID_16846; Position on contig =52253..52291bp; Strand=+
ttgttttcgatattcctcgaaagcggcttttgctatatc

SEQ ID NO: 15054 - DNA, 37 bp, Xenorhabdus bovienii
  Terminator location: Contig name=SeqID_16846; Position on contig =55665..55701bp; Strand=-
tatctgtttgtttgaacagtgtatttattcatctttt

SEQ ID NO: 15055 - DNA, 31 bp, Xenorhabdus bovienii
  Terminator location: Contig name=SeqID_16846; Position on contig =56689..56719bp; Strand=+
gccctgagcatctagggcagattttatcaac

SEQ ID NO: 15056 - DNA, 33 bp, Xenorhabdus bovienii
  Terminator location: Contig name=SeqID_16846; Position on contig =56402..56434bp; Strand=-
gcctcgcccagtgcggggctttttgttgagaca

SEQ ID NO: 15057 - DNA, 45 bp, Xenorhabdus bovienii
  Terminator location: Contig name=SeqID_16846; Position on contig =62036..62080bp; Strand=+
ttggaacgggagttatatacctcccagttccaattctaattaact

SEQ ID NO: 15058 - DNA, 44 bp, Xenorhabdus bovienii
  Terminator location: Contig name=SeqID_16846; Position on contig =62556..62599bp; Strand=-
gtttggggataattaccaataattttccgagcttcctgattggc

SEQ ID NO: 15059 - DNA, 36 bp, Xenorhabdus bovienii
  Terminator location: Contig name=SeqID_16846; Position on contig =75315..75350bp; Strand=-; Gene name=WecE
tgatgtttcgttgaacaaacgtcatttagaattttt

SEQ ID NO: 15060 - DNA, 50 bp, Xenorhabdus bovienii
  Terminator location: Contig name=SeqID_16846; Position on contig =77271..77320bp; Strand=-
taaaaaaggccgcattattgtgcggtctttttcttacctttaatatccca

SEQ ID NO: 15061 - DNA, 30 bp, Xenorhabdus bovienii
  Terminator location: Contig name=SeqID_16846; Position on contig =81283..81312bp; Strand=+
gagggagcaagctccctcttctaacctgac

SEQ ID NO: 15062 - DNA, 33 bp, Xenorhabdus bovienii
  Terminator location: Contig name=SeqID_16846; Position on contig =81088..81120bp; Strand=-
gagcctccagtgtggaggcttttttatttttat

SEQ ID NO: 15063 - DNA, 53 bp, Xenorhabdus bovienii
  Terminator location: Contig name=SeqID_16846; Position on contig =81941..81993bp; Strand=-; Gene name=RpmI
gtaatgggctccagtcagtttttggttggagtctattcgccttactaattcgt

SEQ ID NO: 15064 - DNA, 43 bp, Xenorhabdus bovienii
  Terminator location: Contig name=SeqID_16846; Position on contig =82588..82630bp; Strand=+
tgtcagtagtttttctgtaaactcactgacattaatgctacct

SEQ ID NO: 15065 - DNA, 31 bp, Xenorhabdus bovienii
  Terminator location: Contig name=SeqID_16847; Position on contig =872..902bp; Strand=-
gccacctctgttgggtggcttctctggctaa

SEQ ID NO: 15066 - DNA, 37 bp, Xenorhabdus bovienii
  Terminator location: Contig name=SeqID_16847; Position on contig =7409..7445bp; Strand=+; Gene name=AccC
tacccgccaatataggcgggtagcggtattcactggc

SEQ ID NO: 15067 - DNA, 31 bp, Xenorhabdus bovienii
  Terminator location: Contig name=SeqID_16847; Position on contig =8225..8255bp; Strand=-
gcccacaaaaggtgggcttatttattggaga

SEQ ID NO: 15068 - DNA, 33 bp, Xenorhabdus bovienii
  Terminator location: Contig name=SeqID_16847; Position on contig =13473..13505bp; Strand=+
ggcgcagcttctggctgccccttcatcgctagt

SEQ ID NO: 15069 - DNA, 38 bp, Xenorhabdus bovienii
  Terminator location: Contig name=SeqID_16847; Position on contig =15047..15084bp; Strand=-; Gene name=UgpQ
ccgcagtatcattgttaatactgcggttacttgaaaaa

SEQ ID NO: 15070 - DNA, 56 bp, Xenorhabdus bovienii
  Terminator location: Contig name=SeqID_16847; Position on contig =20776..20831bp; Strand=+; Gene name=EntF
tgaatagcaggcatgttccagaaggagcatgccttttatttatccttctattctta

SEQ ID NO: 15071 - DNA, 38 bp, Xenorhabdus bovienii
  Terminator location: Contig name=SeqID_16847; Position on contig =22404..22441bp; Strand=+
ctgttctggggtgactttaaacggcatattgtgaatag

SEQ ID NO: 15072 - DNA, 40 bp, Xenorhabdus bovienii
  Terminator location: Contig name=SeqID_16847; Position on contig =22290..22329bp; Strand=-
ttcagggcggaaattcccgccctgaatgtttttgtcgcga

SEQ ID NO: 15073 - DNA, 44 bp, Xenorhabdus bovienii
  Terminator location: Contig name=SeqID_16847; Position on contig =24894..24937bp; Strand=+; Gene name=SirA
ttgaaaaggtgcatttttgcaccttttcaatttatcttgtttat

SEQ ID NO: 15074 - DNA, 29 bp, Xenorhabdus bovienii
  Terminator location: Contig name=SeqID_16847; Position on contig =24888..24916bp; Strand=-; Gene name=SirA
ggtgcaaaaatgcaccttttcaaaattac

SEQ ID NO: 15075 - DNA, 50 bp, Xenorhabdus bovienii
  Terminator location: Contig name=SeqID_16847; Position on contig =27457..27506bp; Strand=-; Gene name=ZntA
gtcagtgatgccgacggtattctgtcggtatcatttattttgattattca

SEQ ID NO: 15076 - DNA, 50 bp, Xenorhabdus bovienii
  Terminator location: Contig name=SeqID_16847; Position on contig =32836..32885bp; Strand=+; Gene name=RpoD
cggattaaaaagcgataatttatttatcgctttttttgtgtctgctgccc

SEQ ID NO: 15077 - DNA, 48 bp, Xenorhabdus bovienii
  Terminator location: Contig name=SeqID_16847; Position on contig =44470..44517bp; Strand=+
tagcaccgaaaaatattataattatctcggtgctaattttaaagtttt

SEQ ID NO: 15078 - DNA, 34 bp, Xenorhabdus bovienii
  Terminator location: Contig name=SeqID_16847; Position on contig =46829..46862bp; Strand=+; Gene name=LivK
gcccctgtcttggcgcaggggcgatttttcagag

SEQ ID NO: 15079 - DNA, 47 bp, Xenorhabdus bovienii
  Terminator location: Contig name=SeqID_16847; Position on contig =50778..50824bp; Strand=-; Gene name=LivF
cagggtgattgttaaaatctcataatcaccctggatttttatttatc

SEQ ID NO: 15080 - DNA, 46 bp, Xenorhabdus bovienii
  Terminator location: Contig name=SeqID_16847; Position on contig =64664..64709bp; Strand=-; Gene name=ProP
tgcctgataccgtcccttacatgtatcaggtatattcattaattct

SEQ ID NO: 15081 - DNA, 36 bp, Xenorhabdus bovienii
  Terminator location: Contig name=SeqID_16848; Position on contig =4017..4052bp; Strand=+; Gene name=TrmA
cgccacagcgatcaatttgtggcgttgttcgttcaa

SEQ ID NO: 15082 - DNA, 35 bp, Xenorhabdus bovienii
  Terminator location: Contig name=SeqID_16848; Position on contig =4005..4039bp; Strand=-; Gene name=TrmA
gccacaaattgatcgctgtggcgttttggtcttcc

SEQ ID NO: 15083 - DNA, 52 bp, Xenorhabdus bovienii
  Terminator location: Contig name=SeqID_16848; Position on contig =6611..6662bp; Strand=-; Gene name=Lpd
gaaggttgtattaacgaaatattcgatagtattgccttctcctttttgttcc

SEQ ID NO: 15084 - DNA, 32 bp, Xenorhabdus bovienii
  Terminator location: Contig name=SeqID_16848; Position on contig =8013..8044bp; Strand=+
cctgccggattgggcaggcatatattaggttc

SEQ ID NO: 15085 - DNA, 30 bp, Xenorhabdus bovienii
  Terminator location: Contig name=SeqID_16848; Position on contig =8001..8030bp; Strand=-
cctgcccaatccggcaggtttttctgtatt

SEQ ID NO: 15086 - DNA, 40 bp, Xenorhabdus bovienii
  Terminator location: Contig name=SeqID_16848; Position on contig =10897..10936bp; Strand=+
cattggttatgattccatgctcaatgagctgttttatttt

SEQ ID NO: 15087 - DNA, 32 bp, Xenorhabdus bovienii
  Terminator location: Contig name=SeqID_16848; Position on contig =13888..13919bp; Strand=+; Gene name=ArgE
cctcgataagtgcatcggggtttttcgctatt

SEQ ID NO: 15088 - DNA, 41 bp, Xenorhabdus bovienii
  Terminator location: Contig name=SeqID_16848; Position on contig =15166..15206bp; Strand=-
gggatgccctctgttggggaggcgattccgatttacatcgc

SEQ ID NO: 15089 - DNA, 55 bp, Xenorhabdus bovienii
  Terminator location: Contig name=SeqID_16848; Position on contig =16245..16299bp; Strand=-
gaatgaagaaagccgaatggggaactgttcggcttttttatttttgattaagaat

SEQ ID NO: 15090 - DNA, 40 bp, Xenorhabdus bovienii
  Terminator location: Contig name=SeqID_16848; Position on contig =26394..26433bp; Strand=+; Gene name=PriA
caaagtaacagattgatctgttactttgtttaaaatgcac

SEQ ID NO: 15091 - DNA, 47 bp, Xenorhabdus bovienii
  Terminator location: Contig name=SeqID_16848; Position on contig =28180..28226bp; Strand=-; Gene name=FtsN
catcaacttggattcatttatcgcaggtttcggtgatttattggttt

SEQ ID NO: 15092 - DNA, 48 bp, Xenorhabdus bovienii
  Terminator location: Contig name=SeqID_16848; Position on contig =30480..30527bp; Strand=+; Gene name=HslU
tgaagaaatgggaggcttgcctcccatttcttcattttcattgcaaca

SEQ ID NO: 15093 - DNA, 47 bp, Xenorhabdus bovienii
  Terminator location: Contig name=SeqID_16848; Position on contig =32111..32157bp; Strand=-
tgttgagaagggcgatgaatacgccctctttaacattttggcataat

SEQ ID NO: 15094 - DNA, 43 bp, Xenorhabdus bovienii
  Terminator location: Contig name=SeqID_16848; Position on contig =35136..35178bp; Strand=+; Gene name=GlpK
gctctgacatagcataccgctctgtcagagccttttagcggga

SEQ ID NO: 15095 - DNA, 45 bp, Xenorhabdus bovienii
  Terminator location: Contig name=SeqID_16848; Position on contig =35123..35167bp; Strand=-; Gene name=GlpK
ggctctgacagagcggtatgctatgtcagagctttgatttccata

SEQ ID NO: 15096 - DNA, 41 bp, Xenorhabdus bovienii
  Terminator location: Contig name=SeqID_16848; Position on contig =37444..37484bp; Strand=-; Gene name=Hmp
cggcgcaggtgttttgccatattgcgttgttctttcagaag

SEQ ID NO: 15097 - DNA, 52 bp, Xenorhabdus bovienii
  Terminator location: Contig name=SeqID_16848; Position on contig =38722..38773bp; Strand=+
cgcttacagagaatggcacaaacgctattccctcaaagcgtgttaattcaga

SEQ ID NO: 15098 - DNA, 40 bp, Xenorhabdus bovienii
  Terminator location: Contig name=SeqID_16848; Position on contig =39631..39670bp; Strand=+; Gene name=TpiA
ccgccacgtaatatcatccagtggcggttatttctaaaca

SEQ ID NO: 15099 - DNA, 39 bp, Xenorhabdus bovienii
  Terminator location: Contig name=SeqID_16848; Position on contig =39619..39657bp; Strand=-; Gene name=TpiA
ccgccactggatgatattacgtggcggtttttataggca

SEQ ID NO: 15100 - DNA, 31 bp, Xenorhabdus bovienii
  Terminator location: Contig name=SeqID_16848; Position on contig =42601..42631bp; Strand=+
cgctattccgggatagcgcttgatcatctca

SEQ ID NO: 15101 - DNA, 62 bp, Xenorhabdus bovienii
  Terminator location: Contig name=SeqID_16848; Position on contig =45487..45548bp; Strand=-
ttagaccctaataccgctcgtgcttaagcgagcggtattagggttgaggccgttttggtgac

SEQ ID NO: 15102 - DNA, 29 bp, Xenorhabdus bovienii
  Terminator location: Contig name=SeqID_16848; Position on contig =46516..46544bp; Strand=-
gcccccttgtggggcttttttttcaagca

SEQ ID NO: 15103 - DNA, 39 bp, Xenorhabdus bovienii
  Terminator location: Contig name=SeqID_16848; Position on contig =49436..49474bp; Strand=+; Gene name=BaeS
cttaacacaaatggtttgtgcttatggttttttttatta

SEQ ID NO: 15104 - DNA, 35 bp, Xenorhabdus bovienii
  Terminator location: Contig name=SeqID_16848; Position on contig =49147..49181bp; Strand=-; Gene name=BaeS
tctgttcgataaaacgggcggaagatttgttcacg

SEQ ID NO: 15105 - DNA, 45 bp, Xenorhabdus bovienii
  Terminator location: Contig name=SeqID_16848; Position on contig =69120..69164bp; Strand=+; Gene name=CspR (BS)
ggccattcagcgcttacatcgcgctgaatggccttaattctttat

SEQ ID NO: 15106 - DNA, 52 bp, Xenorhabdus bovienii
  Terminator location: Contig name=SeqID_16848; Position on contig =69105..69156bp; Strand=-; Gene name=CspR (BS)
ttaaggccattcagcgcgatgtaagcgctgaatggcctaatattaatcccgc

SEQ ID NO: 15107 - DNA, 52 bp, Xenorhabdus bovienii
  Terminator location: Contig name=SeqID_16848; Position on contig =74738..74789bp; Strand=-
cagcacaggcgtctgtcgttgtacgggcgtctgtgctgccttgtactgtttt

SEQ ID NO: 15108 - DNA, 35 bp, Xenorhabdus bovienii
  Terminator location: Contig name=SeqID_16848; Position on contig =80193..80227bp; Strand=-; Gene name=RfaF
tgcatcactttcagtggtgcaatgctttgcatcgt

SEQ ID NO: 15109 - DNA, 51 bp, Xenorhabdus bovienii
  Terminator location: Contig name=SeqID_16848; Position on contig =81248..81298bp; Strand=-
gagtagaatatattaattgaattagtatattctattcttttcttttcctgt

SEQ ID NO: 15110 - DNA, 40 bp, Xenorhabdus bovienii
  Terminator location: Contig name=SeqID_16848; Position on contig =96585..96624bp; Strand=-
gaaaaaacccagcgtatgctgggtttttttatacctgcca

SEQ ID NO: 15111 - DNA, 48 bp, Xenorhabdus bovienii
  Terminator location: Contig name=SeqID_16848; Position on contig =97145..97192bp; Strand=-
cctatctcagtaagtttttttattgggataatgtgagtcttttcagtg

SEQ ID NO: 15112 - DNA, 59 bp, Xenorhabdus bovienii
  Terminator location: Contig name=SeqID_16848; Position on contig =99898..99956bp; Strand=+; Gene name=Dut
ttcatattttttgcccatgatcgtggtgggcaaaaaatagctggatttgttttgctgtt

SEQ ID NO: 15113 - DNA, 30 bp, Xenorhabdus bovienii
  Terminator location: Contig name=SeqID_16848; Position on contig =101491..101520bp; Strand=-; Gene name=PyrE
ggcggctgaatagtcgccttttttatgcct

SEQ ID NO: 15114 - DNA, 39 bp, Xenorhabdus bovienii
  Terminator location: Contig name=SeqID_16848; Position on contig =103282..103320bp; Strand=+
gccagtatatactttgttatatctggcttttttactatc

SEQ ID NO: 15115 - DNA, 38 bp, Xenorhabdus bovienii
  Terminator location: Contig name=SeqID_16848; Position on contig =104102..104139bp; Strand=+
cggcattattttttaaaataatgccgttgataatatta

SEQ ID NO: 15116 - DNA, 38 bp, Xenorhabdus bovienii
  Terminator location: Contig name=SeqID_16848; Position on contig =104090..104127bp; Strand=-
cggcattattttaaaaaataatgccgcttttcttcatc

SEQ ID NO: 15117 - DNA, 56 bp, Xenorhabdus bovienii
  Terminator location: Contig name=SeqID_16848; Position on contig =106331..106386bp; Strand=+
tgaataaaacctacacgacgggaagcgagtaggttttattcaccttgatgtccatt

SEQ ID NO: 15118 - DNA, 55 bp, Xenorhabdus bovienii
  Terminator location: Contig name=SeqID_16848; Position on contig =106318..106372bp; Strand=-
tgaataaaacctactcgcttcccgtcgtgtaggttttattcaatctatttcaatg

SEQ ID NO: 15119 - DNA, 70 bp, Xenorhabdus bovienii
  Terminator location: Contig name=SeqID_16848; Position on contig =113184..113253bp; Strand=-; Gene name=MdoB
tttgctctagccgaattaatttcgtgaacttttttcgcgaaatggtttcagatgaatggttttaacgaaa

SEQ ID NO: 15120 - DNA, 46 bp, Xenorhabdus bovienii
  Terminator location: Contig name=SeqID_16848; Position on contig =119099..119144bp; Strand=+
tttggtgggatcaataaaagcgatcccttaggtttttgcctcgcgt

SEQ ID NO: 15121 - DNA, 58 bp, Xenorhabdus bovienii
  Terminator location: Contig name=SeqID_16848; Position on contig =120242..120299bp; Strand=+
catatataaaaattcatccgtagacatcggtggatttttatatatgttgctgccttac

SEQ ID NO: 15122 - DNA, 33 bp, Xenorhabdus bovienii
  Terminator location: Contig name=SeqID_16848; Position on contig =121330..121362bp; Strand=-
tttcattcgcccgaatggagtagtttattatgg

SEQ ID NO: 15123 - DNA, 25 bp, Xenorhabdus bovienii
  Terminator location: Contig name=SeqID_16848; Position on contig =127635..127659bp; Strand=+; Gene name=FdhD
cccactttgtgggaatttcatgcct

SEQ ID NO: 15124 - DNA, 47 bp, Xenorhabdus bovienii
  Terminator location: Contig name=SeqID_16848; Position on contig =129655..129701bp; Strand=+
cagagaacaatgccatttttggcattgttctctgttttgtttattgc

SEQ ID NO: 15125 - DNA, 39 bp, Xenorhabdus bovienii
  Terminator location: Contig name=SeqID_16848; Position on contig =135217..135255bp; Strand=+; Gene name=TonB
cccaacgtgacatacaccgttgcggatttgtctgtcaga

SEQ ID NO: 15126 - DNA, 41 bp, Xenorhabdus bovienii
  Terminator location: Contig name=SeqID_16848; Position on contig =135697..135737bp; Strand=-; Gene name=MdaB
tgctattccagtctattgtgaataagtgctattgataatgt

SEQ ID NO: 15127 - DNA, 52 bp, Xenorhabdus bovienii
  Terminator location: Contig name=SeqID_16848; Position on contig =145751..145802bp; Strand=+
ttaaataaagcgcaatatgtcctaattgtacattgtttaatttttttaaaaa

SEQ ID NO: 15128 - DNA, 45 bp, Xenorhabdus bovienii
  Terminator location: Contig name=SeqID_16848; Position on contig =147472..147516bp; Strand=-; Gene name=ThdF
taactagaaggcggtcattggccgcctttattatttcagttgatt

SEQ ID NO: 15129 - DNA, 48 bp, Xenorhabdus bovienii
  Terminator location: Contig name=SeqID_16848; Position on contig =149947..149994bp; Strand=-
tatatattgatgttgcgactgaggcatcggtgtctacttatttctcac

SEQ ID NO: 15130 - DNA, 54 bp, Xenorhabdus bovienii
  Terminator location: Contig name=SeqID_16848; Position on contig =156702..156755bp; Strand=+; Gene name=GyrB
taatctggctcacctttcaacacaaggtgagccagatttattttatcggttctt

SEQ ID NO: 15131 - DNA, 54 bp, Xenorhabdus bovienii
  Terminator location: Contig name=SeqID_16848; Position on contig =156688..156741bp; Strand=-; Gene name=GyrB
taaatctggctcaccttgtgttgaaaggtgagccagattaaggattttttgtat

SEQ ID NO: 15132 - DNA, 42 bp, Xenorhabdus bovienii
  Terminator location: Contig name=SeqID_16848; Position on contig =163125..163166bp; Strand=+
tacaaaatacggctatcagccgtattttaaattattcccatc

SEQ ID NO: 15133 - DNA, 39 bp, Xenorhabdus bovienii
  Terminator location: Contig name=SeqID_16848; Position on contig =163115..163153bp; Strand=-
taaaatacggctgatagccgtattttgtatctattttta

SEQ ID NO: 15134 - DNA, 41 bp, Xenorhabdus bovienii
  Terminator location: Contig name=SeqID_16848; Position on contig =166151..166191bp; Strand=-
tttagtttgttaaacttaatagatggatatttattttactg

SEQ ID NO: 15135 - DNA, 50 bp, Xenorhabdus bovienii
  Terminator location: Contig name=SeqID_16848; Position on contig =166692..166741bp; Strand=+
tgtcagataaagagtcgtttttatttttattctgtataattttccaaaga

SEQ ID NO: 15136 - DNA, 44 bp, Xenorhabdus bovienii
  Terminator location: Contig name=SeqID_16848; Position on contig =166801..166844bp; Strand=-
tccggttatgctgattaaaagctgaccggatttttttatggtga

SEQ ID NO: 15137 - DNA, 40 bp, Xenorhabdus bovienii
  Terminator location: Contig name=SeqID_16848; Position on contig =168956..168995bp; Strand=+
tactgtggtgcctgcaccaatggtcgcgcctttagctact

SEQ ID NO: 15138 - DNA, 39 bp, Xenorhabdus bovienii
  Terminator location: Contig name=SeqID_16853; Position on contig =970..1008bp; Strand=+; Gene name=GapA
taaagccaccttaagcaggtggctttattttttatctat

SEQ ID NO: 15139 - DNA, 52 bp, Xenorhabdus bovienii
  Terminator location: Contig name=SeqID_16853; Position on contig =3021..3072bp; Strand=-
taggcatttttccgtaccgaaatttggaataaatgcctgcatctttctttat

SEQ ID NO: 15140 - DNA, 48 bp, Xenorhabdus bovienii
  Terminator location: Contig name=SeqID_16853; Position on contig =5915..5962bp; Strand=-; Gene name=DadA
taaaagcgcactagtttagttagtgcgcttttttacatttggttgttt

SEQ ID NO: 15141 - DNA, 40 bp, Xenorhabdus bovienii
  Terminator location: Contig name=SeqID_16853; Position on contig =8545..8584bp; Strand=+; Gene name=NhaB
ccggatggtgaaaatatgcactgtccggttttttgttgcc

SEQ ID NO: 15142 - DNA, 28 bp, Xenorhabdus bovienii
  Terminator location: Contig name=SeqID_16853; Position on contig =9301..9328bp; Strand=+; Gene name=DsbB
cagcccgtaagggctgttccttaaaata

SEQ ID NO: 15143 - DNA, 40 bp, Xenorhabdus bovienii
  Terminator location: Contig name=SeqID_16853; Position on contig =9341..9380bp; Strand=-; Gene name=DsbB
cacaccgacgacgatgttgggtagtgtgtttgctattttg

SEQ ID NO: 15144 - DNA, 42 bp, Xenorhabdus bovienii
  Terminator location: Contig name=SeqID_16853; Position on contig =11462..11503bp; Strand=+
tttaacccgcaacctcctgcgggttaatcattcctttactct

SEQ ID NO: 15145 - DNA, 40 bp, Xenorhabdus bovienii
  Terminator location: Contig name=SeqID_16853; Position on contig =11449..11488bp; Strand=-
ttaacccgcaggaggttgcgggttaaaaattattgatgtg

SEQ ID NO: 15146 - DNA, 30 bp, Xenorhabdus bovienii
  Terminator location: Contig name=SeqID_16853; Position on contig =13797..13826bp; Strand=-
gcctcgcactcgcgaggttttttgccatct

SEQ ID NO: 15147 - DNA, 43 bp, Xenorhabdus bovienii
  Terminator location: Contig name=SeqID_16853; Position on contig =15757..15799bp; Strand=-
ttttccggaacgctatggttcctggaaaacggtttataaccga

SEQ ID NO: 15148 - DNA, 45 bp, Xenorhabdus bovienii
  Terminator location: Contig name=SeqID_16853; Position on contig =18341..18385bp; Strand=-
taaaaggcgtgctctaagaacacgtcttttaatatttactttcaa

SEQ ID NO: 15149 - DNA, 39 bp, Xenorhabdus bovienii
  Terminator location: Contig name=SeqID_16853; Position on contig =19950..19988bp; Strand=-
gaacatgtacactcgtgtgtacatttttttcatgactct

SEQ ID NO: 15150 - DNA, 45 bp, Xenorhabdus bovienii; identical to SEQ ID NO: 15016
  Terminator location: Contig name=SeqID_16853; Position on contig =22122..22166bp; Strand=+

SEQ ID NO: 15151 - DNA, 30 bp, Xenorhabdus bovienii
  Terminator location: Contig name=SeqID_16853; Position on contig =24117..24146bp; Strand=+
gcctcggactcgcggggctttttgctatct

SEQ ID NO: 15152 - DNA, 35 bp, Xenorhabdus bovienii
  Terminator location: Contig name=SeqID_16853; Position on contig =25298..25332bp; Strand=+
gccatcagttaacgctggtggcttttttgttttca

SEQ ID NO: 15153 - DNA, 52 bp, Xenorhabdus bovienii
  Terminator location: Contig name=SeqID_16853; Position on contig =27358..27409bp; Strand=-; Gene name=Rnd
tcttaagggagacggtttagccgtttatagccttaagaacgattttttaaag

SEQ ID NO: 15154 - DNA, 35 bp, Xenorhabdus bovienii
  Terminator location: Contig name=SeqID_16853; Position on contig =31038..31072bp; Strand=-
ggggctatggtagtatagcccccttatttcgaatt

SEQ ID NO: 15155 - DNA, 55 bp, Xenorhabdus bovienii
  Terminator location: Contig name=SeqID_16853; Position on contig =34634..34688bp; Strand=-; Gene name=EmrE
gttatacattcagctggatttgatattcggctgaatgactgacttgttatcaatt

SEQ ID NO: 15156 - DNA, 39 bp, Xenorhabdus bovienii
  Terminator location: Contig name=SeqID_16853; Position on contig =37514..37552bp; Strand=+; Gene name=RpiR
cccgtcagtatcattcttattgcggggttgataatcaag

SEQ ID NO: 15157 - DNA, 42 bp, Xenorhabdus bovienii
  Terminator location: Contig name=SeqID_16853; Position on contig =39065..39106bp; Strand=-; Gene name=PykF
tatcaggggcagcatattctgcccctgatgctattcattgat

SEQ ID NO: 15158 - DNA, 44 bp, Xenorhabdus bovienii
  Terminator location: Contig name=SeqID_16853; Position on contig =40134..40177bp; Strand=-; Gene name=HtrB
taaaagcggatgattgatatcatccgtttttatattattttttg

SEQ ID NO: 15159 - DNA, 48 bp, Xenorhabdus bovienii
  Terminator location: Contig name=SeqID_16854; Position on contig =1543..1590bp; Strand=+
ctaatcaaggggattgaaacaaattcccttatagtacgttttggggtt

SEQ ID NO: 15160 - DNA, 61 bp, Xenorhabdus bovienii
  Terminator location: Contig name=SeqID_16854; Position on contig =15162..15222bp; Strand=-; Gene name=EutG
tgttatagaaaaaatcaaatagtaatcatttaaatgtttctatagcataaattttaagtta

SEQ ID NO: 15161 - DNA, 37 bp, Xenorhabdus bovienii
  Terminator location: Contig name=SeqID_16854; Position on contig =17847..17883bp; Strand=+
tagtgttcacggctgtagtactagcattttttttgat

SEQ ID NO: 15162 - DNA, 39 bp, Xenorhabdus bovienii
  Terminator location: Contig name=SeqID_16854; Position on contig =19857..19895bp; Strand=+
gagcgtcaatgtcttccattgccgcttttactctgagaa

SEQ ID NO: 15163 - DNA, 27 bp, Xenorhabdus bovienii
  Terminator location: Contig name=SeqID_16854; Position on contig =21390..21416bp; Strand=+
gcctcatgatgaggcttcttacctgta

SEQ ID NO: 15164 - DNA, 28 bp, Xenorhabdus bovienii
  Terminator location: Contig name=SeqID_16854; Position on contig =21329..21356bp; Strand=-
ggcttgcaatcaagccgttatttcagaa

SEQ ID NO: 15165 - DNA, 28 bp, Xenorhabdus bovienii
  Terminator location: Contig name=SeqID_16854; Position on contig =26460..26487bp; Strand=+; Gene name=PrpB
ggccttattaaaggccacttttaggaac

SEQ ID NO: 15166 - DNA, 38 bp, Xenorhabdus bovienii
  Terminator location: Contig name=SeqID_16854; Position on contig =28168..28205bp; Strand=-
ttttgcctgggcttaaccgggcaaaatattcagtccaa

SEQ ID NO: 15167 - DNA, 46 bp, Xenorhabdus bovienii
  Terminator location: Contig name=SeqID_16854; Position on contig =32585..32630bp; Strand=+
tgtcggttcagacagaacactctgaatcaacagcgtattaatatac

SEQ ID NO: 15168 - DNA, 33 bp, Xenorhabdus bovienii
  Terminator location: Contig name=SeqID_16854; Position on contig =38911..38943bp; Strand=+
gccgccggtggtccggtggctcttctttacggt

SEQ ID NO: 15169 - DNA, 64 bp, Xenorhabdus bovienii
  Terminator location: Contig name=SeqID_16854; Position on contig =41890..41953bp; Strand=+
cattggctttgatatgcttttgatacaaaaaggaagcaggtcatagcccatgtattcggtcctc

SEQ ID NO: 15170 - DNA, 56 bp, Xenorhabdus bovienii
  Terminator location: Contig name=SeqID_16854; Position on contig =45377..45432bp; Strand=+
tgtaaagcagctgagaaatagttaacttccacagctgctttacattataatgacct

SEQ ID NO: 15171 - DNA, 44 bp, Xenorhabdus bovienii
  Terminator location: Contig name=SeqID_16854; Position on contig =45371..45414bp; Strand=-
gcagctgtggaagttaactatttctcagctgctttacattaact

SEQ ID NO: 15172 - DNA, 54 bp, Xenorhabdus bovienii
  Terminator location: Contig name=SeqID_16854; Position on contig =47340..47393bp; Strand=+
gtagccttattgcaatgcctaagtttgttaataaaggttacattataagctaca

SEQ ID NO: 15173 - DNA, 73 bp, Xenorhabdus bovienii
  Terminator location: Contig name=SeqID_16854; Position on contig =47649..47721bp; Strand=-
gaatcaataaatatatgttgaaaaatagggtcattagtcgtataatatatttattgattcggtattgtatcga

SEQ ID NO: 15174 - DNA, 45 bp, Xenorhabdus bovienii
  Terminator location: Contig name=SeqID_16854; Position on contig =49411..49455bp; Strand=-
ggctttttcattgaaaaaatttaatgaaaaattaatttagtggat

SEQ ID NO: 15175 - DNA, 37 bp, Xenorhabdus bovienii
  Terminator location: Contig name=SeqID_16855; Position on contig =3169..3205bp; Strand=+; Gene name=CyoE
gagggctgggtcttcccctgccctcttttcctttccc

SEQ ID NO: 15176 - DNA, 47 bp, Xenorhabdus bovienii
  Terminator location: Contig name=SeqID_16855; Position on contig =4751..4797bp; Strand=+; Gene name=ProP
gtacggtgcatggatataatcccctagcaccgtactatgtctgtatt

SEQ ID NO: 15177 - DNA, 53 bp, Xenorhabdus bovienii
  Terminator location: Contig name=SeqID_16855; Position on contig =4735..4787bp; Strand=-; Gene name=ProP
tagtacggtgctaggggattatatccatgcaccgtactgttttattacaaacg

SEQ ID NO: 15178 - DNA, 60 bp, Xenorhabdus bovienii
  Terminator location: Contig name=SeqID_16855; Position on contig =6514..6573bp; Strand=-; Gene name=ChiA
ttaagggaagcggagtaatttcagtaattactaatgcttcccttaataaattttccatca

SEQ ID NO: 15179 - DNA, 42 bp, Xenorhabdus bovienii
  Terminator location: Contig name=SeqID_16855; Position on contig =8808..8849bp; Strand=+; Gene name=ThiJ
ctgcttacagaatattattcctgtaagcagttctgctgccct

SEQ ID NO: 15180 - DNA, 42 bp, Xenorhabdus bovienii
  Terminator location: Contig name=SeqID_16855; Position on contig =13520..13561bp; Strand=-; Gene name=Dxs
tggctggctgctatttctagcactagttggttatccagtggt

SEQ ID NO: 15181 - DNA, 70 bp, Xenorhabdus bovienii
  Terminator location: Contig name=SeqID_16855; Position on contig =18793..18862bp; Strand=+; Gene name=ProP
ttttaaaatcagcaccgaagtattctatattgcttttcggtgctgattttccagagagcttatcaatgac

SEQ ID NO: 15182 - DNA, 49 bp, Xenorhabdus bovienii
  Terminator location: Contig name=SeqID_16855; Position on contig =18789..18837bp; Strand=-; Gene name=ProP
cagcaccgaaaagcaatatagaatacttcggtgctgattttaaaattga

SEQ ID NO: 15183 - DNA, 45 bp, Xenorhabdus bovienii
  Terminator location: Contig name=SeqID_16855; Position on contig =21888..21932bp; Strand=+; Gene name=Pcp (BS)
taaattagccactgagtacagtggctaatcggtcatttatctcaa

SEQ ID NO: 15184 - DNA, 40 bp, Xenorhabdus bovienii
  Terminator location: Contig name=SeqID_16855; Position on contig =21878..21917bp; Strand=-; Gene name=Pcp (BS)
gattagccactgtactcagtggctaatttatttttatcgc

SEQ ID NO: 15185 - DNA, 32 bp, Xenorhabdus bovienii
  Terminator location: Contig name=SeqID_16855; Position on contig =33449..33480bp; Strand=+; Gene name=AhpC
ccagccgctctgtcggctggtttttcttatct

SEQ ID NO: 15186 - DNA, 40 bp, Xenorhabdus bovienii
  Terminator location: Contig name=SeqID_16855; Position on contig =35436..35475bp; Strand=+; Gene name=Ggt
gggtgagcagtttgatatgctcaccctttttacaggtctc

SEQ ID NO: 15187 - DNA, 40 bp, Xenorhabdus bovienii
  Terminator location: Contig name=SeqID_16855; Position on contig =35422..35461bp; Strand=-; Gene name=Ggt
gggtgagcatatcaaactgctcacccttgttttttacatc

SEQ ID NO: 15188 - DNA, 32 bp, Xenorhabdus bovienii
  Terminator location: Contig name=SeqID_16855; Position on contig =44606..44637bp; Strand=-
gagcctgttcagtcaggctctttcatctttca

SEQ ID NO: 15189 - DNA, 34 bp, Xenorhabdus bovienii
  Terminator location: Contig name=SeqID_16855; Position on contig =48003..48036bp; Strand=-; Gene name=OppA
gtagcttgttgccgcaggctacttactagataaa

SEQ ID NO: 15190 - DNA, 40 bp, Xenorhabdus bovienii
  Terminator location: Contig name=SeqID_16855; Position on contig =51588..51627bp; Strand=-; Gene name=OppA
gagcaacgctacttatctggcgttgctttttacgttacgt

SEQ ID NO: 15191 - DNA, 34 bp, Xenorhabdus bovienii
  Terminator location: Contig name=SeqID_16855; Position on contig =53367..53400bp; Strand=-; Gene name=UshA
gcctgccctgtggggcaggctgattgtttcattg

SEQ ID NO: 15192 - DNA, 45 bp, Xenorhabdus bovienii
  Terminator location: Contig name=SeqID_16855; Position on contig =57662..57706bp; Strand=+
gatagcgacatgtttaattcatgccgctatctgtgttaattacca

SEQ ID NO: 15193 - DNA, 38 bp, Xenorhabdus bovienii
  Terminator location: Contig name=SeqID_16855; Position on contig =59901..59938bp; Strand=+; Gene name=RdgC
tgatgttcacttttttggtgaagtcattgtctttcatc

SEQ ID NO: 15194 - DNA, 44 bp, Xenorhabdus bovienii
  Terminator location: Contig name=SeqID_16855; Position on contig =59811..59854bp; Strand=-; Gene name=RdgC
ttatcagccagatttaatctctggctgcatgattatcattttgt

SEQ ID NO: 15195 - DNA, 41 bp, Xenorhabdus bovienii
  Terminator location: Contig name=SeqID_16855; Position on contig =61159..61199bp; Strand=-; Gene name=OmpC
tttttgttaatttttgttagcaaaacgttattttggatctt

SEQ ID NO: 15196 - DNA, 45 bp, Xenorhabdus bovienii
  Terminator location: Contig name=SeqID_16855; Position on contig =66591..66635bp; Strand=+
tcagcgaggagaattgtgcgctcttcgtcgatttgtatcgtgtct

SEQ ID NO: 15197 - DNA, 37 bp, Xenorhabdus bovienii
  Terminator location: Contig name=SeqID_16855; Position on contig =66354..66390bp; Strand=-
ggctgagaacagggtttctcagcctttttcataacag

SEQ ID NO: 15198 - DNA, 53 bp, Xenorhabdus bovienii
  Terminator location: Contig name=SeqID_16855; Position on contig =70318..70370bp; Strand=+
ggatatagaataatttttccaataaagaattattcaattccatatttggtgtt

SEQ ID NO: 15199 - DNA, 50 bp, Xenorhabdus bovienii
  Terminator location: Contig name=SeqID_16855; Position on contig =74559..74608bp; Strand=+; Gene name=DedA
taaaactgatgataaacaatacattgcatcacgttttatttatcccgaag

SEQ ID NO: 15200 - DNA, 36 bp, Xenorhabdus bovienii
  Terminator location: Contig name=SeqID_16855; Position on contig =76182..76217bp; Strand=+
gatactgtcaaagctgacggtattttatccggtaat

SEQ ID NO: 15201 - DNA, 42 bp, Xenorhabdus bovienii
  Terminator location: Contig name=SeqID_16855; Position on contig =80977..81018bp; Strand=-
ttacgtaattattttagtgtaattgcgtaatttttcgattca

SEQ ID NO: 15202 - DNA, 31 bp, Xenorhabdus bovienii
  Terminator location: Contig name=SeqID_16855; Position on contig =84192..84222bp; Strand=+
ccacttccacaggaagtggttttcagctaaa

SEQ ID NO: 15203 - DNA, 37 bp, Xenorhabdus bovienii
  Terminator location: Contig name=SeqID_16855; Position on contig =84915..84951bp; Strand=-
ctaacaatgctcctggtattgttggtattatgaataa

SEQ ID NO: 15204 - DNA, 40 bp, Xenorhabdus bovienii
  Terminator location: Contig name=SeqID_16855; Position on contig =86897..86936bp; Strand=-
tttgtgatacccgaacgggtgtaaaatacatttatacctg

SEQ ID NO: 15205 - DNA, 50 bp, Xenorhabdus bovienii
  Terminator location: Contig name=SeqID_16855; Position on contig =93930..93979bp; Strand=+
ggtctaccataatcgacttatttattcatggtagacctttaatatcttgg

SEQ ID NO: 15206 - DNA, 58 bp, Xenorhabdus bovienii
  Terminator location: Contig name=SeqID_16855; Position on contig =93913..93970bp; Strand=-
taaaggtctaccatgaataaataagtcgattatggtagaccttatgattttcgcatta

SEQ ID NO: 15207 - DNA, 33 bp, Xenorhabdus bovienii
  Terminator location: Contig name=SeqID_16855; Position on contig =99972..100004bp; Strand=+
gttttttgttgcgaaagactgtattccctttca

SEQ ID NO: 15208 - DNA, 42 bp, Xenorhabdus bovienii
  Terminator location: Contig name=SeqID_16855; Position on contig =99882..99923bp; Strand=-
tggcctgtttttattgtaagaatcaggttattaattaaaaac

SEQ ID NO: 15209 - DNA, 27 bp, Xenorhabdus bovienii
  Terminator location: Contig name=SeqID_16855; Position on contig =100433..100459bp; Strand=-
ccggcactaggccggttttttcagcat

SEQ ID NO: 15210 - DNA, 52 bp, Xenorhabdus bovienii
  Terminator location: Contig name=SeqID_16855; Position on contig =103680..103731bp; Strand=+; Gene name=RhaT
ttcccctgattatcaaagcaaaaagataatcaagggaacgattattctcgat

SEQ ID NO: 15211 - DNA, 52 bp, Xenorhabdus bovienii
  Terminator location: Contig name=SeqID_16855; Position on contig =103667..103718bp; Strand=-; Gene name=RhaT
gttcccttgattatctttttgctttgataatcaggggaatatttttagtaat

SEQ ID NO: 15212 - DNA, 32 bp, Xenorhabdus bovienii
  Terminator location: Contig name=SeqID_16855; Position on contig =104940..104971bp; Strand=-; Gene name=DnaJ
gtaacagggcgcctgttacttgttaactgaca

SEQ ID NO: 15213 - DNA, 40 bp, Xenorhabdus bovienii
  Terminator location: Contig name=SeqID_16855; Position on contig =107855..107894bp; Strand=+
caggatgagccatcacgctcatcctgtttttttgcgtcac

SEQ ID NO: 15214 - DNA, 32 bp, Xenorhabdus bovienii
  Terminator location: Contig name=SeqID_16855; Position on contig =107846..107877bp; Strand=-
gatgagcgtgatggctcatcctgttgaataga

SEQ ID NO: 15215 - DNA, 44 bp, Xenorhabdus bovienii
  Terminator location: Contig name=SeqID_16855; Position on contig =119908..119951bp; Strand=-; Gene name=EntF
ccgtcgataaataactttatgtttatcgacggtatatactaatc

SEQ ID NO: 15216 - DNA, 35 bp, Xenorhabdus bovienii
  Terminator location: Contig name=SeqID_16855; Position on contig =121319..121353bp; Strand=-; Gene name=PspE
ttgttattcatgtgaatgaatagtatttatagttc

SEQ ID NO: 15217 - DNA, 37 bp, Xenorhabdus bovienii
  Terminator location: Contig name=SeqID_16855; Position on contig =122462..122498bp; Strand=-
tgtaatccatccaatggattatcacctatttttttta

SEQ ID NO: 15218 - DNA, 33 bp, Xenorhabdus bovienii
  Terminator location: Contig name=SeqID_16855; Position on contig =123398..123430bp; Strand=+
taggcttatttagaagcctgtgctttgtataca

SEQ ID NO: 15219 - DNA, 46 bp, Xenorhabdus bovienii
  Terminator location: Contig name=SeqID_16855; Position on contig =124450..124495bp; Strand=-
taaaataagctattctaatggatggcttattcaatattcaatattc

SEQ ID NO: 15220 - DNA, 45 bp, Xenorhabdus bovienii
  Terminator location: Contig name=SeqID_16855; Position on contig =124671..124715bp; Strand=-
tgggctgaatgataattttatcgcttcagtccggatttggctggc

SEQ ID NO: 15221 - DNA, 45 bp, Xenorhabdus bovienii
  Terminator location: Contig name=SeqID_16855; Position on contig =125438..125482bp; Strand=-; Gene name=MoaB
tacaaaggcgacataatgaggtcgccttttattttttcacttcac

SEQ ID NO: 15222 - DNA, 58 bp, Xenorhabdus bovienii
  Terminator location: Contig name=SeqID_16855; Position on contig =127440..127497bp; Strand=+
ttgatgtcactccacccgccattcaggtggagtgacagatacggcgttatttcggcgc

SEQ ID NO: 15223 - DNA, 56 bp, Xenorhabdus bovienii
  Terminator location: Contig name=SeqID_16855; Position on contig =127411..127466bp; Strand=-
cctgaatggcgggtggagtgacatcaatcaatgctgttcagggcgtttaaataccc

SEQ ID NO: 15224 - DNA, 46 bp, Xenorhabdus bovienii
  Terminator location: Contig name=SeqID_16855; Position on contig =132670..132715bp; Strand=-
caattgtagcacgttaacattcgttgtaattgttaattttaaactc

SEQ ID NO: 15225 - DNA, 52 bp, Xenorhabdus bovienii
  Terminator location: Contig name=SeqID_16855; Position on contig =133747..133798bp; Strand=+; Gene name=OmpR
taaaaaagccctgaatgtccttcgacatcagggcttttgtttaatgagtaac

SEQ ID NO: 15226 - DNA, 41 bp, Xenorhabdus bovienii
  Terminator location: Contig name=SeqID_16855; Position on contig =133740..133780bp; Strand=-; Gene name=OmpR
gccctgatgtcgaaggacattcagggcttttttacaaatgc

SEQ ID NO: 15227 - DNA, 34 bp, Xenorhabdus bovienii
  Terminator location: Contig name=SeqID_16855; Position on contig =135785..135818bp; Strand=-; Gene name=AraC
ctttgagactcatcctcaaggtttttccattcaa

SEQ ID NO: 15228 - DNA, 35 bp, Xenorhabdus bovienii
  Terminator location: Contig name=SeqID_16855; Position on contig =137108..137142bp; Strand=+
ggggtcataacaaaatgaccccgctttggttattt

SEQ ID NO: 15229 - DNA, 56 bp, Xenorhabdus bovienii
  Terminator location: Contig name=SeqID_16855; Position on contig =137063..137118bp; Strand=-
gttatgacccctgacggccaggccgttaaggttggttattcaactctttgtaaatt

SEQ ID NO: 15230 - DNA, 58 bp, Xenorhabdus bovienii
  Terminator location: Contig name=SeqID_16855; Position on contig =139566..139623bp; Strand=-
tgtggggaggaatacaaacgagattgtgtgtgttcttctaaacgatacttttataaaa

SEQ ID NO: 15231 - DNA, 31 bp, Xenorhabdus bovienii
  Terminator location: Contig name=SeqID_16855; Position on contig =141505..141535bp; Strand=-
cggcctgatatcaggccgttttcgctatcag

SEQ ID NO: 15232 - DNA, 60 bp, Xenorhabdus bovienii
  Terminator location: Contig name=SeqID_16855; Position on contig =144724..144783bp; Strand=-
gtctgattgcctgctatcgtcacgttgactgtggcaggtcatcagacactttttcaataa

SEQ ID NO: 15233 - DNA, 36 bp, Xenorhabdus bovienii
  Terminator location: Contig name=SeqID_16855; Position on contig =147869..147904bp; Strand=-
ttgctgccagcgactgggagtgagttgtagtaagtt

SEQ ID NO: 15234 - DNA, 40 bp, Xenorhabdus bovienii
  Terminator location: Contig name=SeqID_16855; Position on contig =150956..150995bp; Strand=-; Gene name=FimA
tcccatcagtcgtcatgctgatgggaaatttaaagtctca

SEQ ID NO: 15235 - DNA, 35 bp, Xenorhabdus bovienii
  Terminator location: Contig name=SeqID_16855; Position on contig =154951..154985bp; Strand=+
cattaatggcacacattgatgacttaattttcaat

SEQ ID NO: 15236 - DNA, 43 bp, Xenorhabdus bovienii
  Terminator location: Contig name=SeqID_16855; Position on contig =155067..155109bp; Strand=-
ttgttattataggtttcctgataattgatagcttattcagggt

SEQ ID NO: 15237 - DNA, 53 bp, Xenorhabdus bovienii
  Terminator location: Contig name=SeqID_16855; Position on contig =156357..156409bp; Strand=-; Gene name=FimA
taaaaaaagccctttccataattggaaagggcttttttatttattaagttttg

SEQ ID NO: 15238 - DNA, 37 bp, Xenorhabdus bovienii
  Terminator location: Contig name=SeqID_16855; Position on contig =157189..157225bp; Strand=-; Gene name=DeoD
caggacagccgattggctgtcttagtattcacctgtt

SEQ ID NO: 15239 - DNA, 43 bp, Xenorhabdus bovienii
  Terminator location: Contig name=SeqID_16855; Position on contig =159941..159983bp; Strand=+
tatgtggttattgatctcaataaccactactttgcttttggcc

SEQ ID NO: 15240 - DNA, 53 bp, Xenorhabdus bovienii
  Terminator location: Contig name=SeqID_16855; Position on contig =159776..159828bp; Strand=-
ccggttgagtgaagaagagatccgtttctttattaacggagttcgtgataata

SEQ ID NO: 15241 - DNA, 42 bp, Xenorhabdus bovienii
  Terminator location: Contig name=SeqID_16855; Position on contig =161078..161119bp; Strand=-
gaatgcaggtgagataatctcacctgcttttgttttttctga

SEQ ID NO: 15242 - DNA, 37 bp, Xenorhabdus bovienii
  Terminator location: Contig name=SeqID_16855; Position on contig =162608..162644bp; Strand=+
catctagtttctaagggattagatgattttgcggtga

SEQ ID NO: 15243 - DNA, 42 bp, Xenorhabdus bovienii
  Terminator location: Contig name=SeqID_16855; Position on contig =165977..166018bp; Strand=-; Gene name=OsmY
catagggtcaacaaatagttgacccttgtcagtttgtaacct

SEQ ID NO: 15244 - DNA, 33 bp, Xenorhabdus bovienii
  Terminator location: Contig name=SeqID_16856; Position on contig =416..448bp; Strand=-
tttgggggtcgcccaccgaggtctatggtaatg

SEQ ID NO: 15245 - DNA, 36 bp, Xenorhabdus bovienii
  Terminator location: Contig name=SeqID_16859; Position on contig =822..857bp; Strand=+
cggttgactgcttatcgtcaaccgttttacaaatta

SEQ ID NO: 15246 - DNA, 42 bp, Xenorhabdus bovienii
  Terminator location: Contig name=SeqID_16860; Position on contig =5457..5498bp; Strand=-; Gene name=XerC
ttaggcgctaaatgagcatatcgcctgaccatttcaattgac

SEQ ID NO: 15247 - DNA, 43 bp, Xenorhabdus bovienii
  Terminator location: Contig name=SeqID_16860; Position on contig =7195..7237bp; Strand=-; Gene name=Tra8
gagtgggtattcctttaaataactcattcggtgtttggtaatc

SEQ ID NO: 15248 - DNA, 45 bp, Xenorhabdus bovienii
  Terminator location: Contig name=SeqID_16860; Position on contig =18383..18427bp; Strand=-
ttgggcttgttgcaaaatatatgcaagcccaagtttttttaatgt

SEQ ID NO: 15249 - DNA, 66 bp, Xenorhabdus bovienii
  Terminator location: Contig name=SeqID_16860; Position on contig =21843..21908bp; Strand=-
ctgttcactctatagtttaaatcagatatatcaatatattatagggtgaatggttatttttaaact

SEQ ID NO: 15250 - DNA, 47 bp, Xenorhabdus bovienii
  Terminator location: Contig name=SeqID_16860; Position on contig =24863..24909bp; Strand=-
tcatactttgttggcactgccaacaaagtatgatttttatacagaat

SEQ ID NO: 15251 - DNA, 27 bp, Xenorhabdus bovienii
  Terminator location: Contig name=SeqID_16860; Position on contig =27724..27750bp; Strand=+; Gene name=XerC
ggcagaaaactgccctttgagattcag

SEQ ID NO: 15252 - DNA, 43 bp, Xenorhabdus bovienii
  Terminator location: Contig name=SeqID_16860; Position on contig =38250..38292bp; Strand=+
gaccggaagagatctccgtaatcttccggtttttttcttttta

SEQ ID NO: 15253 - DNA, 39 bp, Xenorhabdus bovienii
  Terminator location: Contig name=SeqID_16860; Position on contig =38240..38278bp; Strand=-
ccggaagattacggagatctcttccggtcttatgtttta

SEQ ID NO: 15254 - DNA, 40 bp, Xenorhabdus bovienii
  Terminator location: Contig name=SeqID_16860; Position on contig =38780..38819bp; Strand=+
ccggaaagatccctgtgatcttccggctttgttcttttta

SEQ ID NO: 15255 - DNA, 32 bp, Xenorhabdus bovienii
  Terminator location: Contig name=SeqID_16860; Position on contig =63322..63353bp; Strand=+
gcctcatcattacttgaggctctatcgttaat

SEQ ID NO: 15256 - DNA, 47 bp, Xenorhabdus bovienii
  Terminator location: Contig name=SeqID_16860; Position on contig =64565..64611bp; Strand=+
cagggagaacgtttgaaaaacgtgtcatcatctcggctttccattaa

SEQ ID NO: 15257 - DNA, 30 bp, Xenorhabdus bovienii
  Terminator location: Contig name=SeqID_16860; Position on contig =64504..64533bp; Strand=-
ggtcggttaatgccggcctttcgtgttgtg

SEQ ID NO: 15258 - DNA, 29 bp, Xenorhabdus bovienii
  Terminator location: Contig name=SeqID_16860; Position on contig =64864..64892bp; Strand=+
ccttgcacggggcaaggtttaaaatgtct

SEQ ID NO: 15259 - DNA, 33 bp, Xenorhabdus bovienii; identical to SEQ ID NO: 14888
  Terminator location: Contig name=SeqID_16860; Position on contig =70438..70470bp; Strand=+

SEQ ID NO: 15260 - DNA, 61 bp, Xenorhabdus bovienii
  Terminator location: Contig name=SeqID_16860; Position on contig =71867..71927bp; Strand=+
tgaaaaactgtaccctcaatgttttatacatccacggtacagttttttatttaaaaatata

SEQ ID NO: 15261 - DNA, 40 bp, Xenorhabdus bovienii
  Terminator location: Contig name=SeqID_16860; Position on contig =72520..72559bp; Strand=+
gaaccgcccactgatggggcggtttctagttattttatga

SEQ ID NO: 15262 - DNA, 40 bp, Xenorhabdus bovienii
  Terminator location: Contig name=SeqID_16860; Position on contig =72506..72545bp; Strand=-
gaaaccgccccatcagtgggcggttcgtcttttagcgctt

SEQ ID NO: 15263 - DNA, 49 bp, Xenorhabdus bovienii
  Terminator location: Contig name=SeqID_16860; Position on contig =77242..77290bp; Strand=+; Gene name=PurK
ggaagtggtaattttgaagataatttaccacttcctattctagttccag

SEQ ID NO: 15264 - DNA, 54 bp, Xenorhabdus bovienii
  Terminator location: Contig name=SeqID_16860; Position on contig =81703..81756bp; Strand=+
tgacaaatgggaaacctcatatgaacggtttcccatttattattaatagctcga

SEQ ID NO: 15265 - DNA, 40 bp, Xenorhabdus bovienii
  Terminator location: Contig name=SeqID_16860; Position on contig =81698..81737bp; Strand=-
tgggaaaccgttcatatgaggtttcccatttgtcaaagaa

SEQ ID NO: 15266 - DNA, 47 bp, Xenorhabdus bovienii
  Terminator location: Contig name=SeqID_16860; Position on contig =93530..93576bp; Strand=+; Gene name=EbsC
gctggctctgttttcttgaaagcagagcttagtcctatattgttcta

SEQ ID NO: 15267 - DNA, 48 bp, Xenorhabdus bovienii
  Terminator location: Contig name=SeqID_16860; Position on contig =93338..93385bp; Strand=-; Gene name=EbsC
gtttgagcctgactatcgataatggtgggcaaacgttttttttgccct

SEQ ID NO: 15268 - DNA, 37 bp, Xenorhabdus bovienii
  Terminator location: Contig name=SeqID_16860; Position on contig =94438..94474bp; Strand=+
gaccacctatcttacaggtggtctttttatacagata

SEQ ID NO: 15269 - DNA, 36 bp, Xenorhabdus bovienii
  Terminator location: Contig name=SeqID_16860; Position on contig =94461..94496bp; Strand=-
taattgatagatagtcgttaattatctgtataaaaa

SEQ ID NO: 15270 - DNA, 42 bp, Xenorhabdus bovienii
  Terminator location: Contig name=SeqID_16860; Position on contig =103634..103675bp; Strand=-; Gene name=HemH
gagcaggcggtgttaataaccgcctgacttttttgagtgtca

SEQ ID NO: 15271 - DNA, 42 bp, Xenorhabdus bovienii
  Terminator location: Contig name=SeqID_16860; Position on contig =106647..106688bp; Strand=+
gtgaatgggacagcgttgtgccatccaccatttcaagttcac

SEQ ID NO: 15272 - DNA, 36 bp, Xenorhabdus bovienii
  Terminator location: Contig name=SeqID_16860; Position on contig =107682..107717bp; Strand=+
ggattggcgtgcttgtgccaatttttcttcataaat

SEQ ID NO: 15273 - DNA, 37 bp, Xenorhabdus bovienii
  Terminator location: Contig name=SeqID_16860; Position on contig =109588..109624bp; Strand=-
ggctgtgctagcatgatacacagtcatgttcaatttc

SEQ ID NO: 15274 - DNA, 43 bp, Xenorhabdus bovienii
  Terminator location: Contig name=SeqID_16860; Position on contig =111234..111276bp; Strand=+
catctgaatggtggctcccaccgttcaatgccttctgtacctc

SEQ ID NO: 15275 - DNA, 29 bp, Xenorhabdus bovienii
  Terminator location: Contig name=SeqID_16860; Position on contig =119994..120022bp; Strand=+; Gene name=AcrB
ggccactgatgtggccttttaaatgggcc

SEQ ID NO: 15276 - DNA, 71 bp, Xenorhabdus bovienii
  Terminator location: Contig name=SeqID_16860; Position on contig =121629..121699bp; Strand=-
cctattgatggttcgtatgctatgtgtctgatttgccatagtagcaggattgtcgtgggttcttaacgagg

SEQ ID NO: 15277 - DNA, 49 bp, Xenorhabdus bovienii
  Terminator location: Contig name=SeqID_16860; Position on contig =123568..123616bp; Strand=-; Gene name=TesB
tgtcgtgtgccgtagatatagtacggcacacaatattattttcgtttgc

SEQ ID NO: 15278 - DNA, 40 bp, Xenorhabdus bovienii
  Terminator location: Contig name=SeqID_16860; Position on contig =128988..129027bp; Strand=-; Gene name=MdlB
tgatggagttaatgctaattctttcattttttacttcggg

SEQ ID NO: 15279 - DNA, 36 bp, Xenorhabdus bovienii
  Terminator location: Contig name=SeqID_16860; Position on contig =131445..131480bp; Strand=+
tgagaggctgccaagcctctcactattttaaacttt

SEQ ID NO: 15280 - DNA, 40 bp, Xenorhabdus bovienii
  Terminator location: Contig name=SeqID_16860; Position on contig =135051..135090bp; Strand=-
gttggcgagtatattaagacttgccagctttttttgtctc

SEQ ID NO: 15281 - DNA, 38 bp, Xenorhabdus bovienii
  Terminator location: Contig name=SeqID_16861; Position on contig =279..316bp; Strand=-
tcccttctcgctatcgctagaggggattttttgtatct

SEQ ID NO: 15282 - DNA, 41 bp, Xenorhabdus bovienii
  Terminator location: Contig name=SeqID_16862; Position on contig =4129..4169bp; Strand=+; Gene name=BirA
gcaaagccggaaatagttccggctattgttttattttctca

SEQ ID NO: 15283 - DNA, 30 bp, Xenorhabdus bovienii
  Terminator location: Contig name=SeqID_16862; Position on contig =4122..4151bp; Strand=-; Gene name=BirA
gccggaactatttccggctttgcattcaac

SEQ ID NO: 15284 - DNA, 31 bp, Xenorhabdus bovienii
  Terminator location: Contig name=SeqID_16865; Position on contig =763..793bp; Strand=-
gccacccggtgggggtggcttctctgactaa

SEQ ID NO: 15285 - DNA, 38 bp, Xenorhabdus bovienii
  Terminator location: Contig name=SeqID_16865; Position on contig =5980..6017bp; Strand=+; Gene name=SodA
tgctggtcagtattatggccagcatttttactattcga

SEQ ID NO: 15286 - DNA, 50 bp, Xenorhabdus bovienii
  Terminator location: Contig name=SeqID_16865; Position on contig =18296..18345bp; Strand=+; Gene name=MrcA
gaaaaatgccctgtcgggaaactgacggggcttttcattattatcagctt

SEQ ID NO: 15287 - DNA, 46 bp, Xenorhabdus bovienii
  Terminator location: Contig name=SeqID_16865; Position on contig =25870..25915bp; Strand=+
taattattttaattaatttagtttaagtgattgatgttttttgtca

SEQ ID NO: 15288 - DNA, 29 bp, Xenorhabdus bovienii
  Terminator location: Contig name=SeqID_16865; Position on contig =30542..30570bp; Strand=+
gggcgtaatatacgcccttttttatgtgt

SEQ ID NO: 15289 - DNA, 42 bp, Xenorhabdus bovienii
  Terminator location: Contig name=SeqID_16865; Position on contig =32372..32413bp; Strand=+; Gene name=PckA
gtaaaaccctatctggctggatagggttttttcattcatcga

SEQ ID NO: 15290 - DNA, 33 bp, Xenorhabdus bovienii
  Terminator location: Contig name=SeqID_16865; Position on contig =32365..32397bp; Strand=-; Gene name=PckA
ccctatccagccagatagggttttacgtggttt

SEQ ID NO: 15291 - DNA, 30 bp, Xenorhabdus bovienii
  Terminator location: Contig name=SeqID_16865; Position on contig =33235..33264bp; Strand=-
gccaacttgaatgttggcttttttttatac

SEQ ID NO: 15292 - DNA, 32 bp, Xenorhabdus bovienii
  Terminator location: Contig name=SeqID_16865; Position on contig =36453..36484bp; Strand=+; Gene name=PutA
taccctgttaattcagggtattttttctctac

SEQ ID NO: 15293 - DNA, 34 bp, Xenorhabdus bovienii
  Terminator location: Contig name=SeqID_16865; Position on contig =39756..39789bp; Strand=+
tagttatttgtcgagataactatctgtaatggct

SEQ ID NO: 15294 - DNA, 37 bp, Xenorhabdus bovienii
  Terminator location: Contig name=SeqID_16865; Position on contig =39388..39424bp; Strand=-
cagcatcaatcctgactgatgcctgtgtttttaccgg

SEQ ID NO: 15295 - DNA, 32 bp, Xenorhabdus bovienii
  Terminator location: Contig name=SeqID_16865; Position on contig =40202..40233bp; Strand=-
gagggtcgttgacgaccctcatttgaggtctt

SEQ ID NO: 15296 - DNA, 33 bp, Xenorhabdus bovienii
  Terminator location: Contig name=SeqID_16865; Position on contig =41574..41606bp; Strand=-
caacacggtttatcgtgtatgttttggcagtgt

SEQ ID NO: 15297 - DNA, 34 bp, Xenorhabdus bovienii
  Terminator location: Contig name=SeqID_16865; Position on contig =50163..50196bp; Strand=-
gaggtgggattttttccgccttttttgtatctag

SEQ ID NO: 15298 - DNA, 31 bp, Xenorhabdus bovienii
  Terminator location: Contig name=SeqID_16865; Position on contig =58820..58850bp; Strand=+
ccgccttctatgaaggcggatttttacttta

SEQ ID NO: 15299 - DNA, 39 bp, Xenorhabdus bovienii
  Terminator location: Contig name=SeqID_16865; Position on contig =59062..59100bp; Strand=-
ccggaagccttatcatgaggcttccggttctgtcgccac

SEQ ID NO: 15300 - DNA, 37 bp, Xenorhabdus bovienii
  Terminator location: Contig name=SeqID_16865; Position on contig =69804..69840bp; Strand=-
tattgaccagaatgctctgttaatattaattaattat

SEQ ID NO: 15301 - DNA, 44 bp, Xenorhabdus bovienii
  Terminator location: Contig name=SeqID_16865; Position on contig =87378..87421bp; Strand=+
cacaactgccttcagtctgcgggcagttcgtgtttaaattggtg

SEQ ID NO: 15302 - DNA, 51 bp, Xenorhabdus bovienii
  Terminator location: Contig name=SeqID_16865; Position on contig =87332..87382bp; Strand=-
ttgtgatattacctgaccccagaaggtgttatcgtgattttttgcccattc

SEQ ID NO: 15303 - DNA, 44 bp, Xenorhabdus bovienii
  Terminator location: Contig name=SeqID_16865; Position on contig =91457..91500bp; Strand=-; Gene name=DdlA
cacgaccccctttaaaatagggggttgtcgtaatattagttaat

SEQ ID NO: 15304 - DNA, 50 bp, Xenorhabdus bovienii
  Terminator location: Contig name=SeqID_16865; Position on contig =93474..93523bp; Strand=-; Gene name=PaaX
cgccaccgttgaggttatctcatcgtgcaacggtggcggttttccgaacg

SEQ ID NO: 15305 - DNA, 47 bp, Xenorhabdus bovienii
  Terminator location: Contig name=SeqID_16865; Position on contig =117318..117364bp; Strand=-
taaaaaatggcgataatctcttatcgccattttatctttcctcgcgc

SEQ ID NO: 15306 - DNA, 55 bp, Xenorhabdus bovienii
  Terminator location: Contig name=SeqID_16865; Position on contig =123508..123562bp; Strand=+; Gene name=MhpC
tgttgcttattacccataaccatcaagttatgggtaatcgacagtttattcggaa

SEQ ID NO: 15307 - DNA, 36 bp, Xenorhabdus bovienii
  Terminator location: Contig name=SeqID_16865; Position on contig =124994..125029bp; Strand=+; Gene name=RelE
ggaggaagtatcgacttcctccaatttgcccattgt

SEQ ID NO: 15308 - DNA, 41 bp, Xenorhabdus bovienii
  Terminator location: Contig name=SeqID_16865; Position on contig =124866..124906bp; Strand=-; Gene name=RelE
gcctgtctggtgtggtgaatcaggcgggctattctcagaga

SEQ ID NO: 15309 - DNA, 32 bp, Xenorhabdus bovienii
  Terminator location: Contig name=SeqID_16865; Position on contig =128068..128099bp; Strand=-
gccccatatgttatcggggcttgtaatagcag

SEQ ID NO: 15310 - DNA, 49 bp, Xenorhabdus bovienii
  Terminator location: Contig name=SeqID_16865; Position on contig =129868..129916bp; Strand=+
ccctctaactggctcaaacgagccagttagaggatgattatctcgaatt

SEQ ID NO: 15311 - DNA, 58 bp, Xenorhabdus bovienii
  Terminator location: Contig name=SeqID_16865; Position on contig =129847..129904bp; Strand=-
tcatcctctaactggctcgtttgagccagttagagggtcaacagaccttattcgtaac

SEQ ID NO: 15312 - DNA, 27 bp, Xenorhabdus bovienii
  Terminator location: Contig name=SeqID_16865; Position on contig =134779..134805bp; Strand=+; Gene name=BaeS
ccccttcaaaaggggttgtcataaaaa

SEQ ID NO: 15313 - DNA, 29 bp, Xenorhabdus bovienii
  Terminator location: Contig name=SeqID_16865; Position on contig =134765..134793bp; Strand=-; Gene name=BaeS
ccccttttgaaggggcgttattatttcgt

SEQ ID NO: 15314 - DNA, 51 bp, Xenorhabdus bovienii
  Terminator location: Contig name=SeqID_16865; Position on contig =139528..139578bp; Strand=+; Gene name=PhoU
gcctgaaacgcgggaattttattccggcgtttttggctttcttattcctaa

SEQ ID NO: 15315 - DNA, 31 bp, Xenorhabdus bovienii
  Terminator location: Contig name=SeqID_16865; Position on contig =140556..140586bp; Strand=+; Gene name=ArtI
gccccgtttttgcggggctttgctgtttgtt

SEQ ID NO: 15316 - DNA, 35 bp, Xenorhabdus bovienii
  Terminator location: Contig name=SeqID_16865; Position on contig =142121..142155bp; Strand=+; Gene name=ArtM
tcctttgttgttaaggcaggggatttttttataac

SEQ ID NO: 15317 - DNA, 50 bp, Xenorhabdus bovienii
  Terminator location: Contig name=SeqID_16865; Position on contig =145790..145839bp; Strand=-
caagtaaagaatcactatttctgattctattatctgtgattttatacaga

SEQ ID NO: 15318 - DNA, 63 bp, Xenorhabdus bovienii
  Terminator location: Contig name=SeqID_16865; Position on contig =147382..147444bp; Strand=+
gatgataagaaaaagcctggtattcactaccaggcttttttttagttatcgttactgattatt

SEQ ID NO: 15319 - DNA, 33 bp, Xenorhabdus bovienii
  Terminator location: Contig name=SeqID_16865; Position on contig =147384..147416bp; Strand=-
gcctggtagtgaataccaggctttttcttatca

SEQ ID NO: 15320 - DNA, 41 bp, Xenorhabdus bovienii
  Terminator location: Contig name=SeqID_16865; Position on contig =149629..149669bp; Strand=+
ccacagtattagtatgttatttattgtggttattgggtaaa

SEQ ID NO: 15321 - DNA, 50 bp, Xenorhabdus bovienii
  Terminator location: Contig name=SeqID_16865; Position on contig =151219..151268bp; Strand=+; Gene name=HemN
ctgtctcagtaatagatgctatctattactgagaggcttttaacctgaga

SEQ ID NO: 15322 - DNA, 45 bp, Xenorhabdus bovienii
  Terminator location: Contig name=SeqID_16865; Position on contig =151208..151252bp; Strand=-; Gene name=HemN
tctcagtaatagatagcatctattactgagacagtattctgatag

SEQ ID NO: 15323 - DNA, 41 bp, Xenorhabdus bovienii
  Terminator location: Contig name=SeqID_16865; Position on contig =154057..154097bp; Strand=+
cggatgtggcgtcatgcgtacgcgttcgatttcaccatgca

SEQ ID NO: 15324 - DNA, 32 bp, Xenorhabdus bovienii
  Terminator location: Contig name=SeqID_16865; Position on contig =153948..153979bp; Strand=-
gacccatcttcggatgggtccttttcctgcac

SEQ ID NO: 15325 - DNA, 38 bp, Xenorhabdus bovienii
  Terminator location: Contig name=SeqID_16865; Position on contig =156103..156140bp; Strand=+
tgtggtacatgtatcagtattatagcaatttctatata

SEQ ID NO: 15326 - DNA, 56 bp, Xenorhabdus bovienii
  Terminator location: Contig name=SeqID_16865; Position on contig =157343..157398bp; Strand=+
ttctggtttagagtgaactaactattattctggtatcagatatcatcttaatccat

SEQ ID NO: 15327 - DNA, 47 bp, Xenorhabdus bovienii
  Terminator location: Contig name=SeqID_16865; Position on contig =162474..162520bp; Strand=-
taattatgaagttttaaaaaatttcataatggtgattatcataagat

SEQ ID NO: 15328 - DNA, 68 bp, Xenorhabdus bovienii
  Terminator location: Contig name=SeqID_16865; Position on contig =165671..165738bp; Strand=-
tgatatagagcggttatcagatgataattttttgtcattatactttttatattgatgtatttatattg

SEQ ID NO: 15329 - DNA, 50 bp, Xenorhabdus bovienii
  Terminator location: Contig name=SeqID_16865; Position on contig =167343..167392bp; Strand=+
tagcctgattttatactgattcagtaaaaatcaggctgttaattataatt

SEQ ID NO: 15330 - DNA, 45 bp, Xenorhabdus bovienii
  Terminator location: Contig name=SeqID_16865; Position on contig =172769..172813bp; Strand=+
gtgttagatgaatgcgcgttgcgttctgcacgctgtatccgttta

SEQ ID NO: 15331 - DNA, 46 bp, Xenorhabdus bovienii
  Terminator location: Contig name=SeqID_16865; Position on contig =174709..174754bp; Strand=+; Gene name=TypA
gaatagcttagggtgctccggcactctgagtttctttgacgtttct

SEQ ID NO: 15332 - DNA, 42 bp, Xenorhabdus bovienii
  Terminator location: Contig name=SeqID_16865; Position on contig =177252..177293bp; Strand=+; Gene name=WecD
tgagcaatggactgtgagtctttgtttgatgatttatcttca

SEQ ID NO: 15333 - DNA, 33 bp, Xenorhabdus bovienii
  Terminator location: Contig name=SeqID_16865; Position on contig =179052..179084bp; Strand=-
ctcccgctttttcagtgggagttttttcacttt

SEQ ID NO: 15334 - DNA, 37 bp, Xenorhabdus bovienii
  Terminator location: Contig name=SeqID_16865; Position on contig =181998..182034bp; Strand=+; Gene name=GltS
tgccgctgaaatattcagcggcatttttttgcttaca

SEQ ID NO: 15335 - DNA, 36 bp, Xenorhabdus bovienii
  Terminator location: Contig name=SeqID_16865; Position on contig =181985..182020bp; Strand=-; Gene name=GltS
tgccgctgaatatttcagcggcatttttagccaagt

SEQ ID NO: 15336 - DNA, 32 bp, Xenorhabdus bovienii
  Terminator location: Contig name=SeqID_16865; Position on contig =189512..189543bp; Strand=-; Gene name=Lig
gggagcacgctcttgctcccttgcttctgaat

SEQ ID NO: 15337 - DNA, 49 bp, Xenorhabdus bovienii
  Terminator location: Contig name=SeqID_16865; Position on contig =191636..191684bp; Strand=+
ctggggctgttgctgtggcagttgagcgttgctccagtttttcaaggcg

SEQ ID NO: 15338 - DNA, 42 bp, Xenorhabdus bovienii
  Terminator location: Contig name=SeqID_16866; Position on contig =18406..18447bp; Strand=-
tgtcctccagcaaaacctgtggagggcatgattgtgcgtcag

SEQ ID NO: 15339 - DNA, 55 bp, Xenorhabdus bovienii
  Terminator location: Contig name=SeqID_16866; Position on contig =29360..29414bp; Strand=+; Gene name=MalQ
ttaaaccaccatcgatagttgttctatcgatggtggtgtagctttttaactgaac

SEQ ID NO: 15340 - DNA, 43 bp, Xenorhabdus bovienii
  Terminator location: Contig name=SeqID_16866; Position on contig =29353..29395bp; Strand=-; Gene name=MalQ
ccaccatcgatagaacaactatcgatggtggtttaagtgatta

SEQ ID NO: 15341 - DNA, 31 bp, Xenorhabdus bovienii
  Terminator location: Contig name=SeqID_16866; Position on contig =36786..36816bp; Strand=-
gtaacggctgtcgttgctgtttgcatggagc

SEQ ID NO: 15342 - DNA, 34 bp, Xenorhabdus bovienii
  Terminator location: Contig name=SeqID_16866; Position on contig =38470..38503bp; Strand=-; Gene name=CDA1
tgccctctcttggtggagggcattttttattgga

SEQ ID NO: 15343 - DNA, 39 bp, Xenorhabdus bovienii
  Terminator location: Contig name=SeqID_16866; Position on contig =47197..47235bp; Strand=-
ggctggcgatttttaatcgccagcctttttgcgctgtag

SEQ ID NO: 15344 - DNA, 46 bp, Xenorhabdus bovienii
  Terminator location: Contig name=SeqID_16866; Position on contig =48465..48510bp; Strand=-
ttagcgttggatttgtctaaaatctggcgcttaaaatttgccttat

SEQ ID NO: 15345 - DNA, 53 bp, Xenorhabdus bovienii
  Terminator location: Contig name=SeqID_16866; Position on contig =49762..49814bp; Strand=-; Gene name=RplK
gcaaagggtgtgaaattatcatacaatttcgcgccttttatttttaagtattg

SEQ ID NO: 15346 - DNA, 36 bp, Xenorhabdus bovienii
  Terminator location: Contig name=SeqID_16866; Position on contig =51027..51062bp; Strand=-
gaagggcatcgacagatgccctttttatacgttgtc

SEQ ID NO: 15347 - DNA, 44 bp, Xenorhabdus bovienii
  Terminator location: Contig name=SeqID_16866; Position on contig =57783..57826bp; Strand=-
gtgatagcaggggctgatagcccctgttttgttatctcggtatt

SEQ ID NO: 15348 - DNA, 35 bp, Xenorhabdus bovienii
  Terminator location: Contig name=SeqID_16866; Position on contig =59116..59150bp; Strand=-
gggaagcgcagatgaagcttctcttttttgtgttc

SEQ ID NO: 15349 - DNA, 37 bp, Xenorhabdus bovienii
  Terminator location: Contig name=SeqID_16866; Position on contig =64552..64588bp; Strand=-; Gene name=Uup
ttttttgttttgtaaacaagggacggttttttcaaga

SEQ ID NO: 15350 - DNA, 38 bp, Xenorhabdus bovienii
  Terminator location: Contig name=SeqID_16866; Position on contig =73667..73704bp; Strand=+
caggtaacaaaaaataacgttgcctgttttacgcaaat

SEQ ID NO: 15351 - DNA, 43 bp, Xenorhabdus bovienii
  Terminator location: Contig name=SeqID_16866; Position on contig =77962..78004bp; Strand=-
caaaagagccacaaaaaaagtggcttttttgttatggtgcaga

SEQ ID NO: 15352 - DNA, 57 bp, Xenorhabdus bovienii
  Terminator location: Contig name=SeqID_16866; Position on contig =81166..81222bp; Strand=+
caattattgtgccagctttatcatgactggcacaatacgcatatgattttatattaa

SEQ ID NO: 15353 - DNA, 34 bp, Xenorhabdus bovienii
  Terminator location: Contig name=SeqID_16866; Position on contig =81086..81119bp; Strand=-
cagtgatttttaagtcattgtaatatttctttaa

SEQ ID NO: 15354 - DNA, 49 bp, Xenorhabdus bovienii
  Terminator location: Contig name=SeqID_16866; Position on contig =84052..84100bp; Strand=-; Gene name=MobB
ggccgtggcgatagagagctatttttgcaatggcctcttccttgaagcc

SEQ ID NO: 15355 - DNA, 53 bp, Xenorhabdus bovienii
  Terminator location: Contig name=SeqID_16866; Position on contig =86255..86307bp; Strand=+
ggtggtgtcgttaaaaattccacgtgataataggcgccacctttgcatggttc

SEQ ID NO: 15356 - DNA, 43 bp, Xenorhabdus bovienii
  Terminator location: Contig name=SeqID_16866; Position on contig =87001..87043bp; Strand=+
gattatgttgcgggctgtgcatatatcaatcatattataacgc

SEQ ID NO: 15357 - DNA, 38 bp, Xenorhabdus bovienii
  Terminator location: Contig name=SeqID_16866; Position on contig =86980..87017bp; Strand=-
cagcccgcaacataatctgtgggctgttttccgaaaat

SEQ ID NO: 15358 - DNA, 38 bp, Xenorhabdus bovienii
  Terminator location: Contig name=SeqID_16866; Position on contig =95552..95589bp; Strand=-; Gene name=XylB
gcaattgcacagcccaacgcggttgcttccttaactac

SEQ ID NO: 15359 - DNA, 34 bp, Xenorhabdus bovienii
  Terminator location: Contig name=SeqID_16866; Position on contig =96041..96074bp; Strand=-
gccctctataggaatagagggctttttggtcatg

SEQ ID NO: 15360 - DNA, 38 bp, Xenorhabdus bovienii
  Terminator location: Contig name=SeqID_16866; Position on contig =97644..97681bp; Strand=-
ggttatgagttgtcagactcataacctattagatttac

SEQ ID NO: 15361 - DNA, 33 bp, Xenorhabdus bovienii
  Terminator location: Contig name=SeqID_16866; Position on contig =99098..99130bp; Strand=-
caggttgaactttagcttgtacttgtaagttaa

SEQ ID NO: 15362 - DNA, 32 bp, Xenorhabdus bovienii
  Terminator location: Contig name=SeqID_16866; Position on contig =102515..102546bp; Strand=-
tgccttgagcgtttggggcagatttttggtga

SEQ ID NO: 15363 - DNA, 33 bp, Xenorhabdus bovienii
  Terminator location: Contig name=SeqID_16866; Position on contig =111629..111661bp; Strand=-
gccctcatcttatgagggcttttttattatttt

SEQ ID NO: 15364 - DNA, 39 bp, Xenorhabdus bovienii
  Terminator location: Contig name=SeqID_16866; Position on contig =119019..119057bp; Strand=-; Gene name=XerC
caattgtctgataagacatcagacaagttatcaatattc

SEQ ID NO: 15365 - DNA, 39 bp, Xenorhabdus bovienii
  Terminator location: Contig name=SeqID_16866; Position on contig =121450..121488bp; Strand=+
tactggctatttatacatgccagtatggtttttacgtat

SEQ ID NO: 15366 - DNA, 35 bp, Xenorhabdus bovienii
  Terminator location: Contig name=SeqID_16866; Position on contig =124806..124840bp; Strand=-
cccccctgcctccgggcggggggttttttaaggaa

SEQ ID NO: 15367 - DNA, 45 bp, Xenorhabdus bovienii
  Terminator location: Contig name=SeqID_16866; Position on contig =128357..128401bp; Strand=-
gcggtgatgatcaaacagcccggcatcaccctgatttttaacgga

SEQ ID NO: 15368 - DNA, 46 bp, Xenorhabdus bovienii
  Terminator location: Contig name=SeqID_16866; Position on contig =129045..129090bp; Strand=+
taaaccggaatgctgacatggaattccggtttattttatttttaga

SEQ ID NO: 15369 - DNA, 56 bp, Xenorhabdus bovienii
  Terminator location: Contig name=SeqID_16866; Position on contig =129027..129082bp; Strand=-
taaaataaaccggaattccatgtcagcattccggtttatttttattgattttttca

SEQ ID NO: 15370 - DNA, 48 bp, Xenorhabdus bovienii
  Terminator location: Contig name=SeqID_16866; Position on contig =130164..130211bp; Strand=-
gtttattattgaacacggttttatatagtaaatccaatgtttataaaa

SEQ ID NO: 15371 - DNA, 49 bp, Xenorhabdus bovienii
  Terminator location: Contig name=SeqID_16866; Position on contig =131373..131421bp; Strand=-
gtaaacaaacctcattcgaatttatgaggtttgttttttattttcacaa

SEQ ID NO: 15372 - DNA, 61 bp, Xenorhabdus bovienii
  Terminator location: Contig name=SeqID_16866; Position on contig =139883..139943bp; Strand=+
taaaacaaagctggaaaattccaagaatcttccagcttaaatggttttatttataaataat

SEQ ID NO: 15373 - DNA, 41 bp, Xenorhabdus bovienii
  Terminator location: Contig name=SeqID_16866; Position on contig =139878..139918bp; Strand=-
gctggaagattcttggaattttccagctttgttttatctac

SEQ ID NO: 15374 - DNA, 46 bp, Xenorhabdus bovienii
  Terminator location: Contig name=SeqID_16866; Position on contig =145625..145670bp; Strand=+
gatatcgccctcaagggatttgagggtgattgttttcttcacactc

SEQ ID NO: 15375 - DNA, 33 bp, Xenorhabdus bovienii
  Terminator location: Contig name=SeqID_16866; Position on contig =149095..149127bp; Strand=-
cccctgcctccgggcgggggtttttttaaggaa

SEQ ID NO: 15376 - DNA, 40 bp, Xenorhabdus bovienii
  Terminator location: Contig name=SeqID_16866; Position on contig =176015..176054bp; Strand=+; Gene name=FhaB
gtacggtatgccatgcggctaccgtacttctatttcttaa

SEQ ID NO: 15377 - DNA, 47 bp, Xenorhabdus bovienii
  Terminator location: Contig name=SeqID_16866; Position on contig =175881..175927bp; Strand=-; Gene name=FhaB
cattttttacgaaaggaatttttccggaaaaaatgtttttttgtgca

SEQ ID NO: 15378 - DNA, 41 bp, Xenorhabdus bovienii
  Terminator location: Contig name=SeqID_16866; Position on contig =186986..187026bp; Strand=-; Gene name=DppB
ccatcccccagatttttctgtggggatggtttcgcttcttt

SEQ ID NO: 15379 - DNA, 29 bp, Xenorhabdus bovienii
  Terminator location: Contig name=SeqID_16867; Position on contig =1920..1948bp; Strand=+
ggttagcttggttaacctatttctggaac

SEQ ID NO: 15380 - DNA, 34 bp, Xenorhabdus bovienii
  Terminator location: Contig name=SeqID_16867; Position on contig =2375..2408bp; Strand=+
gagcctcgcaatcgcggggcttctttttatctgc

SEQ ID NO: 15381 - DNA, 32 bp, Xenorhabdus bovienii
  Terminator location: Contig name=SeqID_16867; Position on contig =5331..5362bp; Strand=+; Gene name=EntF
ggcctcatggatgaggccaattatcgttaatc

SEQ ID NO: 15382 - DNA, 49 bp, Xenorhabdus bovienii
  Terminator location: Contig name=SeqID_16867; Position on contig =5436..5484bp; Strand=-; Gene name=EntF
cagggtagttcaggctttagccgcctgaactacctgattaataatgaag

SEQ ID NO: 15383 - DNA, 35 bp, Xenorhabdus bovienii
  Terminator location: Contig name=SeqID_16867; Position on contig =6874..6908bp; Strand=-
ggtggtgtcatttagtcaccatcgcttttttggtt

SEQ ID NO: 15384 - DNA, 52 bp, Xenorhabdus bovienii
  Terminator location: Contig name=SeqID_16867; Position on contig =10554..10605bp; Strand=+; Gene name=FlgL
tataaaataaggatcggcttgccgatccttattttttaacctttgtcaggga

SEQ ID NO: 15385 - DNA, 48 bp, Xenorhabdus bovienii
  Terminator location: Contig name=SeqID_16867; Position on contig =12089..12136bp; Strand=+
tagaggggaatgcgataataacgcattcccccctatattttaattata

SEQ ID NO: 15386 - DNA, 41 bp, Xenorhabdus bovienii
  Terminator location: Contig name=SeqID_16867; Position on contig =11897..11937bp; Strand=-
tttccggcgtaaactcttgtgctgggtaattgcttgatgtt

SEQ ID NO: 15387 - DNA, 44 bp, Xenorhabdus bovienii
  Terminator location: Contig name=SeqID_16867; Position on contig =18193..18236bp; Strand=+; Gene name=PutP
taaaaagcctctgattgttcaggggctctttaatttagctgctt

SEQ ID NO: 15388 - DNA, 56 bp, Xenorhabdus bovienii
  Terminator location: Contig name=SeqID_16867; Position on contig =21520..21575bp; Strand=-
gcactttttgattgtgtgaatgctaatttatcaattaaaatcaattagttattaat

SEQ ID NO: 15389 - DNA, 44 bp, Xenorhabdus bovienii
  Terminator location: Contig name=SeqID_16867; Position on contig =22157..22200bp; Strand=-
tggcgcgatgggggtaatacctgtcgcattggttttcgatatat

SEQ ID NO: 15390 - DNA, 30 bp, Xenorhabdus bovienii
  Terminator location: Contig name=SeqID_16867; Position on contig =24442..24471bp; Strand=+
gtctgccagcgggtaggcttttgagccctt

SEQ ID NO: 15391 - DNA, 30 bp, Xenorhabdus bovienii
  Terminator location: Contig name=SeqID_16867; Position on contig =26367..26396bp; Strand=+; Gene name=AnsP
ggcccgaattcagggccatttttttaccta

SEQ ID NO: 15392 - DNA, 31 bp, Xenorhabdus bovienii
  Terminator location: Contig name=SeqID_16867; Position on contig =26354..26384bp; Strand=-; Gene name=AnsP
tggccctgaattcgggccattgattaattag

SEQ ID NO: 15393 - DNA, 40 bp, Xenorhabdus bovienii
  Terminator location: Contig name=SeqID_16867; Position on contig =27481..27520bp; Strand=+; Gene name=WecD
ggaaaagcgttcctttggtcgcttttccttcttccttata

SEQ ID NO: 15394 - DNA, 28 bp, Xenorhabdus bovienii
  Terminator location: Contig name=SeqID_16867; Position on contig =29526..29553bp; Strand=+; Gene name=RhaT
ggcaggattttctgcctttttttgtcaa

SEQ ID NO: 15395 - DNA, 38 bp, Xenorhabdus bovienii
  Terminator location: Contig name=SeqID_16867; Position on contig =38145..38182bp; Strand=-
tacagccctgaaataccagggctgtatttattcagcct

SEQ ID NO: 15396 - DNA, 43 bp, Xenorhabdus bovienii
  Terminator location: Contig name=SeqID_16867; Position on contig =39618..39660bp; Strand=+
gaaaaccctatcgaatattgatggggttttctatatgaattaa

SEQ ID NO: 15397 - DNA, 47 bp, Xenorhabdus bovienii
  Terminator location: Contig name=SeqID_16867; Position on contig =39604..39650bp; Strand=-
tagaaaaccccatcaatattcgatagggttttctatttaaatcttat

SEQ ID NO: 15398 - DNA, 36 bp, Xenorhabdus bovienii
  Terminator location: Contig name=SeqID_16867; Position on contig =43448..43483bp; Strand=+
tatgagggaaattattccctcatattttttgatata

SEQ ID NO: 15399 - DNA, 32 bp, Xenorhabdus bovienii
  Terminator location: Contig name=SeqID_16868; Position on contig =1003..1034bp; Strand=-; Gene name=SpoU
gggcggcttctgctgccctccatttttcaggt

SEQ ID NO: 15400 - DNA, 29 bp, Xenorhabdus bovienii
  Terminator location: Contig name=SeqID_16868; Position on contig =4125..4153bp; Strand=-
ccgggtcttatgcccggtttttacttttt

SEQ ID NO: 15401 - DNA, 60 bp, Xenorhabdus bovienii
  Terminator location: Contig name=SeqID_16868; Position on contig =5714..5773bp; Strand=+
ctatctgagcggctcagtcattggtattactgtgctgcttaactggcgctttcatataac

SEQ ID NO: 15402 - DNA, 44 bp, Xenorhabdus bovienii
  Terminator location: Contig name=SeqID_16868; Position on contig =16662..16705bp; Strand=-
ctagcggggagatgttggcactttttgctggatgttagcgttat

SEQ ID NO: 15403 - DNA, 41 bp, Xenorhabdus bovienii
  Terminator location: Contig name=SeqID_16868; Position on contig =19903..19943bp; Strand=+
tttgttgcgctttgtaattagccagcagagtttccatattc

SEQ ID NO: 15404 - DNA, 59 bp, Xenorhabdus bovienii
  Terminator location: Contig name=SeqID_16868; Position on contig =23834..23892bp; Strand=+
gttggtatttcagcgtattaacagtcgttaatgcgcaggatcagcttttatatttgaaa

SEQ ID NO: 15405 - DNA, 42 bp, Xenorhabdus bovienii
  Terminator location: Contig name=SeqID_16868; Position on contig =25939..25980bp; Strand=+
ggttgtaacgacggaaaacgttgacaaacctattgcagtcac

SEQ ID NO: 15406 - DNA, 59 bp, Xenorhabdus bovienii
  Terminator location: Contig name=SeqID_16868; Position on contig =40689..40747bp; Strand=+
ctggaacgaaaaaaggacctttcggtccttttttctgtgacttgcagaatttcataaaa

SEQ ID NO: 15407 - DNA, 36 bp, Xenorhabdus bovienii
  Terminator location: Contig name=SeqID_16868; Position on contig =41560..41595bp; Strand=+
tttcggtatgccgtactgttgaaattcttcatcggt

SEQ ID NO: 15408 - DNA, 42 bp, Xenorhabdus bovienii
  Terminator location: Contig name=SeqID_16868; Position on contig =41118..41159bp; Strand=-
ctgccattcaatgtaatgattgaatgataggttattatgact

SEQ ID NO: 15409 - DNA, 52 bp, Xenorhabdus bovienii
  Terminator location: Contig name=SeqID_16868; Position on contig =51159..51210bp; Strand=-
taaaatcgccgatcaaaaattatgatcggcggtttttatctttataaataat

SEQ ID NO: 15410 - DNA, 47 bp, Xenorhabdus bovienii
  Terminator location: Contig name=SeqID_16868; Position on contig =54824..54870bp; Strand=+
ttaatttgcttcacgaatattagtgaaaaattagattttgtaattaa

SEQ ID NO: 15411 - DNA, 42 bp, Xenorhabdus bovienii
  Terminator location: Contig name=SeqID_16868; Position on contig =55203..55244bp; Strand=-
gagagcagcacctgatggggtgctgttttttttctagccatt

SEQ ID NO: 15412 - DNA, 37 bp, Xenorhabdus bovienii
  Terminator location: Contig name=SeqID_16868; Position on contig =58983..59019bp; Strand=-
tacaggcgcctgaatcgcgtctgtattttttactgcc

SEQ ID NO: 15413 - DNA, 53 bp, Xenorhabdus bovienii
  Terminator location: Contig name=SeqID_16868; Position on contig =59854..59906bp; Strand=-
taaaaaaggaatgtgtttttatggcacattcccttattttggcttttgggagt

SEQ ID NO: 15414 - DNA, 34 bp, Xenorhabdus bovienii
  Terminator location: Contig name=SeqID_16868; Position on contig =62277..62310bp; Strand=+; Gene name=RarD
ctccgcccaccagtgggcggggattattacagcc

SEQ ID NO: 15415 - DNA, 56 bp, Xenorhabdus bovienii
  Terminator location: Contig name=SeqID_16868; Position on contig =68704..68759bp; Strand=-
tggtcttggcaatgattttatggtcgttgatgcggtgacccaaaatgtttattttt

SEQ ID NO: 15416 - DNA, 36 bp, Xenorhabdus bovienii
  Terminator location: Contig name=SeqID_16868; Position on contig =70514..70549bp; Strand=-
gcaggttgtgttctcgtaaccagcgatttctgattt

SEQ ID NO: 15417 - DNA, 27 bp, Xenorhabdus bovienii
  Terminator location: Contig name=SeqID_16868; Position on contig =78507..78533bp; Strand=+
gcacgtttcgtgccaacttttagtcat

SEQ ID NO: 15418 - DNA, 30 bp, Xenorhabdus bovienii
  Terminator location: Contig name=SeqID_16868; Position on contig =78605..78634bp; Strand=-
cgtctcaaatgagagacggtattgttcgat

SEQ ID NO: 15419 - DNA, 47 bp, Xenorhabdus bovienii
  Terminator location: Contig name=SeqID_16868; Position on contig =78880..78926bp; Strand=-
gagaaagccctgctatttttgtagggctttttctttttgtatctctg

SEQ ID NO: 15420 - DNA, 51 bp, Xenorhabdus bovienii
  Terminator location: Contig name=SeqID_16870; Position on contig =228..278bp; Strand=+
tcatcaaggctatcccgacaggcaggataaccttgatgatgtttaccccat

SEQ ID NO: 15421 - DNA, 55 bp, Xenorhabdus bovienii
  Terminator location: Contig name=SeqID_16870; Position on contig =212..266bp; Strand=-
tcatcaaggttatcctgcctgtcgggatagccttgatgaaaaccattttgtcgcc

SEQ ID NO: 15422 - DNA, 45 bp, Xenorhabdus bovienii
  Terminator location: Contig name=SeqID_16870; Position on contig =867..911bp; Strand=-; Gene name=RimL
ccgccggaaaatgtgtatgatttttcggcggtttttattttgacg

SEQ ID NO: 15423 - DNA, 39 bp, Xenorhabdus bovienii
  Terminator location: Contig name=SeqID_16870; Position on contig =1686..1724bp; Strand=-
tttatactggtataatgctaggatgaattttcacagcct

SEQ ID NO: 15424 - DNA, 45 bp, Xenorhabdus bovienii
  Terminator location: Contig name=SeqID_16870; Position on contig =3902..3946bp; Strand=-; Gene name=AraC
tagtgtgacttagcggtgataagtcacatcgactatatgtgagat

SEQ ID NO: 15425 - DNA, 40 bp, Xenorhabdus bovienii
  Terminator location: Contig name=SeqID_16870; Position on contig =4803..4842bp; Strand=-
cagggagaggaattatgttctctccctgattttttgttgt

SEQ ID NO: 15426 - DNA, 34 bp, Xenorhabdus bovienii
  Terminator location: Contig name=SeqID_16870; Position on contig =25186..25219bp; Strand=-
taagactctgtcgggtgttttattaatataataa

SEQ ID NO: 15427 - DNA, 54 bp, Xenorhabdus bovienii
  Terminator location: Contig name=SeqID_16870; Position on contig =29926..29979bp; Strand=+; Gene name=ARC1
cgattactgcggttcgatacggtgatgtcagtcgtataattgttgttgcttatt

SEQ ID NO: 15428 - DNA, 26 bp, Xenorhabdus bovienii
  Terminator location: Contig name=SeqID_16870; Position on contig =44659..44684bp; Strand=+
gcgccttaaggcgctttttttacttt

SEQ ID NO: 15429 - DNA, 51 bp, Xenorhabdus bovienii
  Terminator location: Contig name=SeqID_16870; Position on contig =44636..44686bp; Strand=-
gcaaagtaaaaaaagcgccttaaggcgctttttttgtgctttcaaaatatc

SEQ ID NO: 15430 - DNA, 44 bp, Xenorhabdus bovienii
  Terminator location: Contig name=SeqID_16870; Position on contig =45899..45942bp; Strand=-
tacagatgaataagatattattcagtttgctgaatttatttgtt

SEQ ID NO: 15431 - DNA, 40 bp, Xenorhabdus bovienii
  Terminator location: Contig name=SeqID_16870; Position on contig =48880..48919bp; Strand=-; Gene name=LysR
tatgattgtcgcctcagcaatgatcgtattatgctaattt

SEQ ID NO: 15432 - DNA, 50 bp, Xenorhabdus bovienii
  Terminator location: Contig name=SeqID_16870; Position on contig =68948..68997bp; Strand=-
gtagagattattttaatgccaataataatctctacctgatttaatctatt

SEQ ID NO: 15433 - DNA, 54 bp, Xenorhabdus bovienii
  Terminator location: Contig name=SeqID_16870; Position on contig =81764..81817bp; Strand=-
ggttttttgggtttgaataagactaatattataaaaaacctcctttctttcgta

SEQ ID NO: 15434 - DNA, 49 bp, Xenorhabdus bovienii
  Terminator location: Contig name=SeqID_16870; Position on contig =83267..83315bp; Strand=+; Gene name=AcrR
tcagtcccttaaccaaaagatctggttaagggactgactattataagaa

SEQ ID NO: 15435 - DNA, 60 bp, Xenorhabdus bovienii
  Terminator location: Contig name=SeqID_16870; Position on contig =83481..83540bp; Strand=+
cacgctaaaatcaacatataaaaacataaatgttgattttagtgatgaatattcgtgtca

SEQ ID NO: 15436 - DNA, 43 bp, Xenorhabdus bovienii
  Terminator location: Contig name=SeqID_16870; Position on contig =83816..83858bp; Strand=-
gaatggcatggggaacttctccatgccattttttgataaaacc

SEQ ID NO: 15437 - DNA, 33 bp, Xenorhabdus bovienii
  Terminator location: Contig name=SeqID_16870; Position on contig =87560..87592bp; Strand=-; Gene name=CodB
tgcccagccgatggtgggtgtttcattgggaag

SEQ ID NO: 15438 - DNA, 53 bp, Xenorhabdus bovienii
  Terminator location: Contig name=SeqID_16870; Position on contig =94560..94612bp; Strand=-
ttaatgttggatatggaatttttatttcatatcccgtaatgctattgctctcc

SEQ ID NO: 15439 - DNA, 41 bp, Xenorhabdus bovienii
  Terminator location: Contig name=SeqID_16870; Position on contig =119467..119507bp; Strand=+; Gene name=EntF
tcccgtcatcattcattggtgatgggattttttctttttaa

SEQ ID NO: 15440 - DNA, 48 bp, Xenorhabdus bovienii
  Terminator location: Contig name=SeqID_16870; Position on contig =126274..126321bp; Strand=-
ccacgtccggaaataattaattattcccggacgtggttttattgaata

SEQ ID NO: 15441 - DNA, 38 bp, Xenorhabdus bovienii
  Terminator location: Contig name=SeqID_16870; Position on contig =150816..150853bp; Strand=-; Gene name=EntF
tggctgtcgaattatagtggcagccatttatttttttg

SEQ ID NO: 15442 - DNA, 63 bp, Xenorhabdus bovienii
  Terminator location: Contig name=SeqID_16870; Position on contig =153427..153489bp; Strand=-
ggccgccggaatgaactgtctgtgtgttttgagcagtttattgcggcggtttttttattctgg

SEQ ID NO: 15443 - DNA, 29 bp, Xenorhabdus bovienii
  Terminator location: Contig name=SeqID_16870; Position on contig =161603..161631bp; Strand=-
gctatctgacggatggcctgttcaatggc

SEQ ID NO: 15444 - DNA, 51 bp, Xenorhabdus bovienii
  Terminator location: Contig name=SeqID_16870; Position on contig =164359..164409bp; Strand=+; Gene name=AraC
caaagccggaagataacgcggatctttccggctattagatttcatcaatta

SEQ ID NO: 15445 - DNA, 50 bp, Xenorhabdus bovienii
  Terminator location: Contig name=SeqID_16870; Position on contig =164346..164395bp; Strand=-; Gene name=AraC
taatagccggaaagatccgcgttatcttccggctttgttcttttaagagc

SEQ ID NO: 15446 - DNA, 45 bp, Xenorhabdus bovienii
  Terminator location: Contig name=SeqID_16870; Position on contig =164970..165014bp; Strand=-
ttaaatccagattggactaatcatggatttaagcatttccctcag

SEQ ID NO: 15447 - DNA, 27 bp, Xenorhabdus bovienii
  Terminator location: Contig name=SeqID_16870; Position on contig =174732..174758bp; Strand=-
ggcagaaagctgccctttgaaatccgg

SEQ ID NO: 15448 - DNA, 52 bp, Xenorhabdus bovienii
  Terminator location: Contig name=SeqID_16870; Position on contig =180654..180705bp; Strand=-
tcctccactcgttctctgaataaatatcgagtggagggtcttttcaatcaga

SEQ ID NO: 15449 - DNA, 40 bp, Xenorhabdus bovienii
  Terminator location: Contig name=SeqID_16870; Position on contig =184278..184317bp; Strand=-
gacgccactgcctgaacgcagtggcgttttctgcttatct

SEQ ID NO: 15450 - DNA, 40 bp, Xenorhabdus bovienii
  Terminator location: Contig name=SeqID_16870; Position on contig =185873..185912bp; Strand=+
tggaattaggaatttttcctagttttactcttatcggtca

SEQ ID NO: 15451 - DNA, 60 bp, Xenorhabdus bovienii
  Terminator location: Contig name=SeqID_16870; Position on contig =188215..188274bp; Strand=+
gagttatccatttttctatataaatatagtaaaacatgaggtaactctcattttttattt

SEQ ID NO: 15452 - DNA, 41 bp, Xenorhabdus bovienii
  Terminator location: Contig name=SeqID_16870; Position on contig =189795..189835bp; Strand=+
ccgggccattccacagaatggttttggcatctttcaggatt

SEQ ID NO: 15453 - DNA, 27 bp, Xenorhabdus bovienii
  Terminator location: Contig name=SeqID_16870; Position on contig =189516..189542bp; Strand=-
gcagcatttgctgcctgttcaatgtca

SEQ ID NO: 15454 - DNA, 44 bp, Xenorhabdus bovienii
  Terminator location: Contig name=SeqID_16870; Position on contig =192054..192097bp; Strand=+
gcgcattcgctcagatattgatgcgaatgcgcttatcgtttcgt

SEQ ID NO: 15455 - DNA, 46 bp, Xenorhabdus bovienii
  Terminator location: Contig name=SeqID_16870; Position on contig =192040..192085bp; Strand=-
gcgcattcgcatcaatatctgagcgaatgcgctctttttttatgca

SEQ ID NO: 15456 - DNA, 37 bp, Xenorhabdus bovienii
  Terminator location: Contig name=SeqID_16870; Position on contig =195059..195095bp; Strand=-; Gene name=WecD
gccctgagtttttaactcggggctttttctttttccg

SEQ ID NO: 15457 - DNA, 53 bp, Xenorhabdus bovienii
  Terminator location: Contig name=SeqID_16870; Position on contig =196515..196567bp; Strand=-; Gene name=RnhA
gtgggtgaattggcggcggtacgagccaattcatcacactgttcgttttctcg

SEQ ID NO: 15458 - DNA, 49 bp, Xenorhabdus bovienii
  Terminator location: Contig name=SeqID_16870; Position on contig =197520..197568bp; Strand=-
tcacatacaacaagcgtgtgttcgcttttgatggggatttcaatcaaac

SEQ ID NO: 15459 - DNA, 38 bp, Xenorhabdus bovienii
  Terminator location: Contig name=SeqID_16870; Position on contig =200741..200778bp; Strand=+; Gene name=MltE
ctccctgtccagaaggacagggagttttttcgctgaat

SEQ ID NO: 15460 - DNA, 38 bp, Xenorhabdus bovienii
  Terminator location: Contig name=SeqID_16870; Position on contig =202285..202322bp; Strand=+
ggcagtctttcactgacagactgccctttacgtaatcc

SEQ ID NO: 15461 - DNA, 28 bp, Xenorhabdus bovienii
  Terminator location: Contig name=SeqID_16870; Position on contig =202370..202397bp; Strand=-
gtcacccttcggtgactttctcatatat

SEQ ID NO: 15462 - DNA, 37 bp, Xenorhabdus bovienii
  Terminator location: Contig name=SeqID_16870; Position on contig =202812..202848bp; Strand=-
taaattgatatgtatgtataatttatgttcgtattat

SEQ ID NO: 15463 - DNA, 30 bp, Xenorhabdus bovienii
  Terminator location: Contig name=SeqID_16870; Position on contig =218029..218058bp; Strand=-
ccgttgtcgttacaatggcatttttaggca

SEQ ID NO: 15464 - DNA, 27 bp, Xenorhabdus bovienii
  Terminator location: Contig name=SeqID_16870; Position on contig =219821..219847bp; Strand=-
gagggcaaccctcccctttaggctctc

SEQ ID NO: 15465 - DNA, 47 bp, Xenorhabdus bovienii
  Terminator location: Contig name=SeqID_16870; Position on contig =221208..221254bp; Strand=+
gtgcctgttctgcaatcgggcaggcatatgcgcattctgtcggtggg

SEQ ID NO: 15466 - DNA, 51 bp, Xenorhabdus bovienii
  Terminator location: Contig name=SeqID_16870; Position on contig =223983..224033bp; Strand=-
gattagtctaatttataattattgaaattaggctatcttatttcactttat

SEQ ID NO: 15467 - DNA, 44 bp, Xenorhabdus bovienii
  Terminator location: Contig name=SeqID_16870; Position on contig =232375..232418bp; Strand=-; Gene name=UvrD
tgtagttattaatttgatattcatggctataatatgttgtggct

SEQ ID NO: 15468 - DNA, 31 bp, Xenorhabdus bovienii
  Terminator location: Contig name=SeqID_16870; Position on contig =234325..234355bp; Strand=-
gcagtgaatctgacactgcatttaatagatt

SEQ ID NO: 15469 - DNA, 44 bp, Xenorhabdus bovienii
  Terminator location: Contig name=SeqID_16870; Position on contig =235278..235321bp; Strand=-
gacccacagtgttatattaaaaatgtgggtcgatttaattttat

SEQ ID NO: 15470 - DNA, 51 bp, Xenorhabdus bovienii
  Terminator location: Contig name=SeqID_16873; Position on contig =2063..2113bp; Strand=+
tttcagaacccatggggaacacgcccgtgtgttgtgaaatttttgctcttt

SEQ ID NO: 15471 - DNA, 71 bp, Xenorhabdus bovienii
  Terminator location: Contig name=SeqID_16873; Position on contig =1960..2030bp; Strand=-
ccgctgacctcctgcgtgcaaggcaggcgctctcccagctgagctatagccccatacagtgttatcaccgg

SEQ ID NO: 15472 - DNA, 37 bp, Xenorhabdus bovienii
  Terminator location: Contig name=SeqID_16873; Position on contig =5341..5377bp; Strand=+
gaagccacccccaccgggtggcttttttgcgtttgga

SEQ ID NO: 15473 - DNA, 31 bp, Xenorhabdus bovienii; identical to SEQ ID NO: 15284
  Terminator location: Contig name=SeqID_16873; Position on contig =5332..5362bp; Strand=-

SEQ ID NO: 15474 - DNA, 38 bp, Xenorhabdus bovienii; identical to SEQ ID NO: 15281
  Terminator location: Contig name=SeqID_16873; Position on contig =5794..5831bp; Strand=-

SEQ ID NO: 15475 - DNA, 44 bp, Xenorhabdus bovienii
  Terminator location: Contig name=SeqID_16873; Position on contig =12001..12044bp; Strand=+; Gene name=SpoU
taaggctctggttatttaaccagagcctttattttaccactaat

SEQ ID NO: 15476 - DNA, 40 bp, Xenorhabdus bovienii
  Terminator location: Contig name=SeqID_16873; Position on contig =21571..21610bp; Strand=+
ccgttggtgaaaaacgcctcattaatgggattttaattat

SEQ ID NO: 15477 - DNA, 49 bp, Xenorhabdus bovienii
  Terminator location: Contig name=SeqID_16873; Position on contig =25626..25674bp; Strand=+; Gene name=RimL
tgtctcttgattataagtttgactcaagaggcagataattatgatgagg

SEQ ID NO: 15478 - DNA, 30 bp, Xenorhabdus bovienii
  Terminator location: Contig name=SeqID_16873; Position on contig =26657..26686bp; Strand=+
cgggagcattcactcccgttgataagtagt

SEQ ID NO: 15479 - DNA, 46 bp, Xenorhabdus bovienii
  Terminator location: Contig name=SeqID_16873; Position on contig =29521..29566bp; Strand=-
tttccagtagtgtaaatgcacactactggaggtgtgttctgtctac

SEQ ID NO: 15480 - DNA, 57 bp, Xenorhabdus bovienii
  Terminator location: Contig name=SeqID_16873; Position on contig =35787..35843bp; Strand=+
caatatatgttgtgtttttttataaaagccactatatatagtggctttatctttttt

SEQ ID NO: 15481 - DNA, 42 bp, Xenorhabdus bovienii
  Terminator location: Contig name=SeqID_16873; Position on contig =36626..36667bp; Strand=+
tacagacagtagactatattattgttgtactgtatgtgacac

SEQ ID NO: 15482 - DNA, 47 bp, Xenorhabdus bovienii
  Terminator location: Contig name=SeqID_16873; Position on contig =36562..36608bp; Strand=-
tataacaaaatgtgaaaaacgcacgttttgttttatttcataaagtt

SEQ ID NO: 15483 - DNA, 31 bp, Xenorhabdus bovienii
  Terminator location: Contig name=SeqID_16873; Position on contig =36922..36952bp; Strand=-
cccgttgtagtaaacgggttttcaaaatacg

SEQ ID NO: 15484 - DNA, 51 bp, Xenorhabdus bovienii
  Terminator location: Contig name=SeqID_16873; Position on contig =40776..40826bp; Strand=+; Gene name=TrkG
tgatattgataattattatcaaaatgatattgatttaagatattccttgaa

SEQ ID NO: 15485 - DNA, 41 bp, Xenorhabdus bovienii
  Terminator location: Contig name=SeqID_16873; Position on contig =53677..53717bp; Strand=-
gtcggcggataacacgacttccgccgaccttaatctgcttc

SEQ ID NO: 15486 - DNA, 43 bp, Xenorhabdus bovienii
  Terminator location: Contig name=SeqID_16873; Position on contig =55946..55988bp; Strand=-; Gene name=ArtM
ggggtgaggtagtcgttccctacctcatttttttagcctgttc

SEQ ID NO: 15487 - DNA, 60 bp, Xenorhabdus bovienii
  Terminator location: Contig name=SeqID_16873; Position on contig =57214..57273bp; Strand=+
tttggttaagcgtatggtaaaaataatgaattatgcgacttggttggagttttctgtgga

SEQ ID NO: 15488 - DNA, 41 bp, Xenorhabdus bovienii
  Terminator location: Contig name=SeqID_16873; Position on contig =57281..57321bp; Strand=-
gatcagggtatattatttataccctgatcttctctacgact

SEQ ID NO: 15489 - DNA, 29 bp, Xenorhabdus bovienii
  Terminator location: Contig name=SeqID_16873; Position on contig =67103..67131bp; Strand=+
gccacctttcggtggccttctgcatcaaa

SEQ ID NO: 15490 - DNA, 46 bp, Xenorhabdus bovienii
  Terminator location: Contig name=SeqID_16876; Position on contig =3875..3920bp; Strand=-
cagcgggttatttgttgtttacgtgatctcgctgttctttatccta

SEQ ID NO: 15491 - DNA, 30 bp, Xenorhabdus bovienii
  Terminator location: Contig name=SeqID_16876; Position on contig =15068..15097bp; Strand=-; Gene name=Rfe
cgccacattcttgtggcgttttttttatca

SEQ ID NO: 15492 - DNA, 37 bp, Xenorhabdus bovienii
  Terminator location: Contig name=SeqID_16876; Position on contig =20345..20381bp; Strand=+; Gene name=GppA
ccctgtattcaacgcgaatacagggtattcatcagat

SEQ ID NO: 15493 - DNA, 64 bp, Xenorhabdus bovienii
  Terminator location: Contig name=SeqID_16876; Position on contig =24348..24411bp; Strand=+; Gene name=AcuC (BS)
cccccataaaataacgcccgatagaatttcatcgggcgttattttatgggggttcatctctatc

SEQ ID NO: 15494 - DNA, 42 bp, Xenorhabdus bovienii
  Terminator location: Contig name=SeqID_16876; Position on contig =24347..24388bp; Strand=-; Gene name=AcuC (BS)
taacgcccgatgaaattctatcgggcgttattttatgggggt

SEQ ID NO: 15495 - DNA, 34 bp, Xenorhabdus bovienii
  Terminator location: Contig name=SeqID_16876; Position on contig =26958..26991bp; Strand=+; Gene name=LysR
tagcacctgccaaggtgctattttttatgccgat

SEQ ID NO: 15496 - DNA, 33 bp, Xenorhabdus bovienii
  Terminator location: Contig name=SeqID_16876; Position on contig =26945..26977bp; Strand=-; Gene name=LysR
tagcaccttggcaggtgctattttcagaataaa

SEQ ID NO: 15497 - DNA, 34 bp, Xenorhabdus bovienii
  Terminator location: Contig name=SeqID_16876; Position on contig =30438..30471bp; Strand=-; Gene name=IlvD
caggcggctcgttccctgcctgttttgattgctg

SEQ ID NO: 15498 - DNA, 40 bp, Xenorhabdus bovienii
  Terminator location: Contig name=SeqID_16876; Position on contig =35707..35746bp; Strand=+
tcttgatggatcattactatcaatgatgatattaatcatc

SEQ ID NO: 15499 - DNA, 32 bp, Xenorhabdus bovienii
  Terminator location: Contig name=SeqID_16876; Position on contig =35677..35708bp; Strand=-
gaggggcgaaatagtccctcttctagattacc

SEQ ID NO: 15500 - DNA, 32 bp, Xenorhabdus bovienii
  Terminator location: Contig name=SeqID_16876; Position on contig =37128..37159bp; Strand=+; Gene name=LysR
cccagctaaatttagctgggctattaatctga

SEQ ID NO: 15501 - DNA, 51 bp, Xenorhabdus bovienii
  Terminator location: Contig name=SeqID_16880; Position on contig =3198..3248bp; Strand=+
tagcacgggggcaggaaattattacctgcccccgtgctatttaatatgtgt

SEQ ID NO: 15502 - DNA, 38 bp, Xenorhabdus bovienii
  Terminator location: Contig name=SeqID_16880; Position on contig =4945..4982bp; Strand=+
gctttttttacgttggaaaaaggcttttattctattga

SEQ ID NO: 15503 - DNA, 48 bp, Xenorhabdus bovienii
  Terminator location: Contig name=SeqID_16880; Position on contig =9692..9739bp; Strand=+
cccaaaagttggacgctatacttcaacttaagggatgctttttatgaa

SEQ ID NO: 15504 - DNA, 46 bp, Xenorhabdus bovienii
  Terminator location: Contig name=SeqID_16880; Position on contig =11924..11969bp; Strand=+; Gene name=WcaA
tttcaaggctatgcattgcatagccttggggtagttgttctattct

SEQ ID NO: 15505 - DNA, 38 bp, Xenorhabdus bovienii
  Terminator location: Contig name=SeqID_16880; Position on contig =13273..13310bp; Strand=-
ccgactgaatccctacggacagttggttttttttgact

SEQ ID NO: 15506 - DNA, 35 bp, Xenorhabdus bovienii
  Terminator location: Contig name=SeqID_16880; Position on contig =14094..14128bp; Strand=-
gagcggctcaaaacagccgttactttgttgccgat

SEQ ID NO: 15507 - DNA, 49 bp, Xenorhabdus bovienii
  Terminator location: Contig name=SeqID_16881; Position on contig =2165..2213bp; Strand=+
gatattggtattattttatataaaaatagtttaatttgtttatttactt

SEQ ID NO: 15508 - DNA, 42 bp, Xenorhabdus bovienii
  Terminator location: Contig name=SeqID_16881; Position on contig =3338..3379bp; Strand=+; Gene name=FabG
gccggaaagaatcttaaggatatttccggcttattaatgggc

SEQ ID NO: 15509 - DNA, 42 bp, Xenorhabdus bovienii
  Terminator location: Contig name=SeqID_16881; Position on contig =3326..3367bp; Strand=-; Gene name=FabG
gccggaaatatccttaagattctttccggctattcatactca

SEQ ID NO: 15510 - DNA, 40 bp, Xenorhabdus bovienii
  Terminator location: Contig name=SeqID_16881; Position on contig =6271..6310bp; Strand=-; Gene name=XerC
gttaacagtttggcactaaatgtaaccccttttctcttcc

SEQ ID NO: 15511 - DNA, 48 bp, Xenorhabdus bovienii
  Terminator location: Contig name=SeqID_16881; Position on contig =16188..16235bp; Strand=+
tggataatgacataccacatcagtttattgtccggaatatttttggca

SEQ ID NO: 15512 - DNA, 51 bp, Xenorhabdus bovienii
  Terminator location: Contig name=SeqID_16881; Position on contig =16036..16086bp; Strand=-
ctgatgccagttgatcacagtcaactggcataacgatgattcatctcttct

SEQ ID NO: 15513 - DNA, 38 bp, Xenorhabdus bovienii
  Terminator location: Contig name=SeqID_16881; Position on contig =17915..17952bp; Strand=+
tgatgggaaaagaggtattttcgtcatttatctatggc

SEQ ID NO: 15514 - DNA, 39 bp, Xenorhabdus bovienii
  Terminator location: Contig name=SeqID_16881; Position on contig =21164..21202bp; Strand=-; Gene name=CaiA
ttcgctatgttaatttccataagcgaattatgatcacct

SEQ ID NO: 15515 - DNA, 49 bp, Xenorhabdus bovienii
  Terminator location: Contig name=SeqID_16881; Position on contig =31870..31918bp; Strand=+
tgctaataacggtcaggtatatgaccgttattagcatatttcaattcga

SEQ ID NO: 15516 - DNA, 56 bp, Xenorhabdus bovienii
  Terminator location: Contig name=SeqID_16881; Position on contig =31852..31907bp; Strand=-
tatgctaataacggtcatatacctgaccgttattagcatggggtgatttaattaag

SEQ ID NO: 15517 - DNA, 39 bp, Xenorhabdus bovienii
  Terminator location: Contig name=SeqID_16881; Position on contig =45350..45388bp; Strand=+
cagtggcaggtataacttgtcactgatttccttctggac

SEQ ID NO: 15518 - DNA, 59 bp, Xenorhabdus bovienii
  Terminator location: Contig name=SeqID_16881; Position on contig =50324..50382bp; Strand=+
taatttggtatatgtttcggaaaattatttccacatataccattacaaatttaatctta

SEQ ID NO: 15519 - DNA, 56 bp, Xenorhabdus bovienii
  Terminator location: Contig name=SeqID_16881; Position on contig =53124..53179bp; Strand=+; Gene name=EntF
caaccgtttatcagcttagtgttattcaggcatataaacggttgttatcgcattaa

SEQ ID NO: 15520 - DNA, 40 bp, Xenorhabdus bovienii
  Terminator location: Contig name=SeqID_16881; Position on contig =57345..57384bp; Strand=-
catcaatttcggataaacccaattgatgtttcaatacctc

SEQ ID NO: 15521 - DNA, 33 bp, Xenorhabdus bovienii
  Terminator location: Contig name=SeqID_16881; Position on contig =58038..58070bp; Strand=+
tcatcggcagtgctgatgaaatgtattcaaggc

SEQ ID NO: 15522 - DNA, 40 bp, Xenorhabdus bovienii
  Terminator location: Contig name=SeqID_16881; Position on contig =57884..57923bp; Strand=-
ggggtgatgcgagagagtatctcccccatttgattcaact

SEQ ID NO: 15523 - DNA, 45 bp, Xenorhabdus bovienii; identical to SEQ ID NO: 15016
  Terminator location: Contig name=SeqID_16881; Position on contig =61995..62039bp; Strand=-

SEQ ID NO: 15524 - DNA, 43 bp, Xenorhabdus bovienii
  Terminator location: Contig name=SeqID_16881; Position on contig =63849..63891bp; Strand=+
tattcatttttgtaagtaaaaaatgaattgttattattttttt

SEQ ID NO: 15525 - DNA, 35 bp, Xenorhabdus bovienii
  Terminator location: Contig name=SeqID_16881; Position on contig =63738..63772bp; Strand=-
ttggaagtcaatattgacttcaagtttttcaaaat

SEQ ID NO: 15526 - DNA, 39 bp, Xenorhabdus bovienii
  Terminator location: Contig name=SeqID_16881; Position on contig =65544..65582bp; Strand=+
cgttatcagcccatgaggctgttaacgcttttcttaagc

SEQ ID NO: 15527 - DNA, 62 bp, Xenorhabdus bovienii
  Terminator location: Contig name=SeqID_16881; Position on contig =65388..65449bp; Strand=-
gggtgctgctgcgcatattcccgcagtgtgcagaaccggtacgcatccttattctgtgtatc

SEQ ID NO: 15528 - DNA, 48 bp, Xenorhabdus bovienii
  Terminator location: Contig name=SeqID_16881; Position on contig =67570..67617bp; Strand=+
tcaaccgaaaggggaaccggttcccttttcggggcgtgttttcctttt

SEQ ID NO: 15529 - DNA, 28 bp, Xenorhabdus bovienii
  Terminator location: Contig name=SeqID_16881; Position on contig =68361..68388bp; Strand=+
gcgcctttcggggcgctttttttttgtt

SEQ ID NO: 15530 - DNA, 39 bp, Xenorhabdus bovienii
  Terminator location: Contig name=SeqID_16881; Position on contig =73447..73485bp; Strand=-
ctcgtcattcccggaattaatgacgagatgttgattgat

SEQ ID NO: 15531 - DNA, 30 bp, Xenorhabdus bovienii
  Terminator location: Contig name=SeqID_16881; Position on contig =81512..81541bp; Strand=-
gccctgttatcacagggcttatttctaata

SEQ ID NO: 15532 - DNA, 32 bp, Xenorhabdus bovienii
  Terminator location: Contig name=SeqID_16881; Position on contig =85450..85481bp; Strand=+
cgggtgtgtaacgcgtccgttttttaccgcca

SEQ ID NO: 15533 - DNA, 29 bp, Xenorhabdus bovienii
  Terminator location: Contig name=SeqID_16881; Position on contig =85331..85359bp; Strand=-
gcgcctttcggggcgcttttcagttttta

SEQ ID NO: 15534 - DNA, 47 bp, Xenorhabdus bovienii
  Terminator location: Contig name=SeqID_16881; Position on contig =86101..86147bp; Strand=-
tcaaccgaaaggggaaccggttccctttcgggacgtgttttcctttt

SEQ ID NO: 15535 - DNA, 38 bp, Xenorhabdus bovienii
  Terminator location: Contig name=SeqID_16881; Position on contig =87679..87716bp; Strand=+
tgctgttgctgttccagtgacaggcattctgacgtcag

SEQ ID NO: 15536 - DNA, 39 bp, Xenorhabdus bovienii; identical to SEQ ID NO: 15526
  Terminator location: Contig name=SeqID_16881; Position on contig =88134..88172bp; Strand=-

SEQ ID NO: 15537 - DNA, 52 bp, Xenorhabdus bovienii
  Terminator location: Contig name=SeqID_16881; Position on contig =90955..91006bp; Strand=+
ttggtatgcattgatttttatcgagagtaatgcagcagagatgtttagtatt

SEQ ID NO: 15538 - DNA, 31 bp, Xenorhabdus bovienii
  Terminator location: Contig name=SeqID_16881; Position on contig =93814..93844bp; Strand=+
cagcgctttgacggtgctgttgtaatggttg

SEQ ID NO: 15539 - DNA, 43 bp, Xenorhabdus bovienii
  Terminator location: Contig name=SeqID_16881; Position on contig =101488..101530bp; Strand=+
ccggcggcgacagtgacattgttgtacccggtattgatgccgt

SEQ ID NO: 15540 - DNA, 37 bp, Xenorhabdus bovienii
  Terminator location: Contig name=SeqID_16881; Position on contig =104265..104301bp; Strand=+
ttgagtggagccccccactcacgatcatttctagtta

SEQ ID NO: 15541 - DNA, 37 bp, Xenorhabdus bovienii
  Terminator location: Contig name=SeqID_16881; Position on contig =110438..110474bp; Strand=-
gattgacgaacgatcgtccggtctggttttcaacccg

SEQ ID NO: 15542 - DNA, 33 bp, Xenorhabdus bovienii
  Terminator location: Contig name=SeqID_16881; Position on contig =117388..117420bp; Strand=-
gcattaagtttaaactgatgcgttatttttact

SEQ ID NO: 15543 - DNA, 57 bp, Xenorhabdus bovienii
  Terminator location: Contig name=SeqID_16881; Position on contig =120934..120990bp; Strand=-
ttatatctgtctgccggcagggaatgccgggagctgggtgagggcgattttaccgtc

SEQ ID NO: 15544 - DNA, 36 bp, Xenorhabdus bovienii
  Terminator location: Contig name=SeqID_16881; Position on contig =124372..124407bp; Strand=-
ggtgaacacagtttgtgctcacctttttgcgttgaa

SEQ ID NO: 15545 - DNA, 40 bp, Xenorhabdus bovienii
  Terminator location: Contig name=SeqID_16881; Position on contig =128895..128934bp; Strand=-; Gene name=DcuB
tagatagcatgatttatgctattcctaattatgagtcgta

SEQ ID NO: 15546 - DNA, 44 bp, Xenorhabdus bovienii
  Terminator location: Contig name=SeqID_16881; Position on contig =129498..129541bp; Strand=-
gaggcacgcaattccaaccggaagcgtgcctttttaattcatca

SEQ ID NO: 15547 - DNA, 42 bp, Xenorhabdus bovienii
  Terminator location: Contig name=SeqID_16881; Position on contig =134167..134208bp; Strand=+; Gene name=GroL
gaaggcgagcagaaaaatctgctcgcctttttacttttttgt

SEQ ID NO: 15548 - DNA, 67 bp, Xenorhabdus bovienii
  Terminator location: Contig name=SeqID_16881; Position on contig =134734..134800bp; Strand=+
gccagaaaaacgtgacagagcatggttagctctgtgtacgttttagtttctggcgttgtccgttcct

SEQ ID NO: 15549 - DNA, 41 bp, Xenorhabdus bovienii
  Terminator location: Contig name=SeqID_16881; Position on contig =136502..136542bp; Strand=+; Gene name=Efp
ccgcagtatcttcgtttagaggctgcggtttttttattggt

SEQ ID NO: 15550 - DNA, 37 bp, Xenorhabdus bovienii
  Terminator location: Contig name=SeqID_16881; Position on contig =137125..137161bp; Strand=+
tattagcggggaatgccgtaatacattctccgctaat

SEQ ID NO: 15551 - DNA, 34 bp, Xenorhabdus bovienii
  Terminator location: Contig name=SeqID_16883; Position on contig =5840..5873bp; Strand=-
tggtggcggatatcgccaccgtttttcactggtc

SEQ ID NO: 15552 - DNA, 48 bp, Xenorhabdus bovienii; identical to SEQ ID NO: 15503
  Terminator location: Contig name=SeqID_16883; Position on contig =9394..9441bp; Strand=+

SEQ ID NO: 15553 - DNA, 33 bp, Xenorhabdus bovienii
  Terminator location: Contig name=SeqID_16887; Position on contig =7989..8021bp; Strand=+; Gene name=PaaJ
cccgcctgtcaggggcgggtttttttattgtta

SEQ ID NO: 15554 - DNA, 38 bp, Xenorhabdus bovienii
  Terminator location: Contig name=SeqID_16887; Position on contig =11113..11150bp; Strand=+; Gene name=NusG
gaaaacgggctattttgcccgtttttattatctgtttt

SEQ ID NO: 15555 - DNA, 28 bp, Xenorhabdus bovienii
  Terminator location: Contig name=SeqID_16887; Position on contig =11106..11133bp; Strand=-; Gene name=NusG
cgggcaaaatagcccgttttctctgatt

SEQ ID NO: 15556 - DNA, 39 bp, Xenorhabdus bovienii
  Terminator location: Contig name=SeqID_16887; Position on contig =13839..13877bp; Strand=-; Gene name=TatA
ccgtagctttaatagtgtggttgcggtattttcgaacaa

SEQ ID NO: 15557 - DNA, 45 bp, Xenorhabdus bovienii; identical to SEQ ID NO: 15016
  Terminator location: Contig name=SeqID_16887; Position on contig =17755..17799bp; Strand=-

SEQ ID NO: 15558 - DNA, 53 bp, Xenorhabdus bovienii
  Terminator location: Contig name=SeqID_16887; Position on contig =18429..18481bp; Strand=-
cctgctgattggcagtttaagtggattgctgggcggagggattttcgtctggc

SEQ ID NO: 15559 - DNA, 45 bp, Xenorhabdus bovienii
  Terminator location: Contig name=SeqID_16887; Position on contig =21697..21741bp; Strand=+
tgagggttaaaaaatgaattttttaccctcatttttcatgtaaac

SEQ ID NO: 15560 - DNA, 45 bp, Xenorhabdus bovienii
  Terminator location: Contig name=SeqID_16887; Position on contig =21683..21727bp; Strand=-
tgagggtaaaaaattcattttttaaccctcataatgtttttacca

SEQ ID NO: 15561 - DNA, 40 bp, Xenorhabdus bovienii
  Terminator location: Contig name=SeqID_16887; Position on contig =26388..26427bp; Strand=-; Gene name=EmrK
gcatatcagtataaatgtttggatatgcttattagttcaa

SEQ ID NO: 15562 - DNA, 55 bp, Xenorhabdus bovienii
  Terminator location: Contig name=SeqID_16887; Position on contig =35600..35654bp; Strand=+
gatagctccgttgttggtgctcaatctctacaacggagctatttcttaatttttc

SEQ ID NO: 15563 - DNA, 33 bp, Xenorhabdus bovienii
  Terminator location: Contig name=SeqID_16887; Position on contig =36630..36662bp; Strand=-
gggccagaacatgctggcccgatctttttgctt

SEQ ID NO: 15564 - DNA, 45 bp, Xenorhabdus bovienii
  Terminator location: Contig name=SeqID_16887; Position on contig =38262..38306bp; Strand=+
cgcccgccacattttatctgctgtagcgggcgtttttcagcttag

SEQ ID NO: 15565 - DNA, 33 bp, Xenorhabdus bovienii
  Terminator location: Contig name=SeqID_16887; Position on contig =53936..53968bp; Strand=+
tgccctgtgtatttcagggcatgtctttagtat

SEQ ID NO: 15566 - DNA, 42 bp, Xenorhabdus bovienii
  Terminator location: Contig name=SeqID_16887; Position on contig =53919..53960bp; Strand=-
gacatgccctgaaatacacagggcatcgttaatttattatga

SEQ ID NO: 15567 - DNA, 30 bp, Xenorhabdus bovienii
  Terminator location: Contig name=SeqID_16887; Position on contig =61166..61195bp; Strand=-
cccagcaaatatgctgggtttttttattct

SEQ ID NO: 15568 - DNA, 26 bp, Xenorhabdus bovienii
  Terminator location: Contig name=SeqID_16887; Position on contig =67499..67524bp; Strand=+
gtgcctcaggcactttagttcctttc

SEQ ID NO: 15569 - DNA, 38 bp, Xenorhabdus bovienii
  Terminator location: Contig name=SeqID_16887; Position on contig =69532..69569bp; Strand=-
cccttgttacagtattaggcaggggatttttgttacca

SEQ ID NO: 15570 - DNA, 40 bp, Xenorhabdus bovienii
  Terminator location: Contig name=SeqID_16887; Position on contig =74692..74731bp; Strand=+; Gene name=Qor
ccataatatcagcgccggtcttatgggcattctcactcaa

SEQ ID NO: 15571 - DNA, 29 bp, Xenorhabdus bovienii
  Terminator location: Contig name=SeqID_16887; Position on contig =74574..74602bp; Strand=-; Gene name=Qor
gccgtgggtggcgcggctttccagtgtgc

SEQ ID NO: 15572 - DNA, 38 bp, Xenorhabdus bovienii
  Terminator location: Contig name=SeqID_16887; Position on contig =75823..75860bp; Strand=-
ctaagaacgacaatcgttgcttttagttcgtatggatt

SEQ ID NO: 15573 - DNA, 37 bp, Xenorhabdus bovienii
  Terminator location: Contig name=SeqID_16887; Position on contig =77699..77735bp; Strand=-; Gene name=Fur
tgtgattatgctgacatgtatcgcgttctgtacagga

SEQ ID NO: 15574 - DNA, 39 bp, Xenorhabdus bovienii
  Terminator location: Contig name=SeqID_16887; Position on contig =78549..78587bp; Strand=-; Gene name=LexA
ggtaggttcccaattcgaatttacctgtatatactcaca

SEQ ID NO: 15575 - DNA, 45 bp, Xenorhabdus bovienii
  Terminator location: Contig name=SeqID_16887; Position on contig =81738..81782bp; Strand=+; Gene name=PlsB
tcaaagtcaccgtctaaagaccgtggttttaaacctttcatatgg

SEQ ID NO: 15576 - DNA, 38 bp, Xenorhabdus bovienii
  Terminator location: Contig name=SeqID_16887; Position on contig =81782..81819bp; Strand=-
taacgggcggataacccgcccgttcagctttatttttc

SEQ ID NO: 15577 - DNA, 51 bp, Xenorhabdus bovienii
  Terminator location: Contig name=SeqID_16887; Position on contig =83412..83462bp; Strand=-
tgcctcgcctccaataaacacggttattgaggtgaggcgcttatgattacg

SEQ ID NO: 15578 - DNA, 35 bp, Xenorhabdus bovienii
  Terminator location: Contig name=SeqID_16887; Position on contig =88759..88793bp; Strand=-; Gene name=Eda
tgcggaaatgttgaatttccgcatttcaatatact

SEQ ID NO: 15579 - DNA, 36 bp, Xenorhabdus bovienii
  Terminator location: Contig name=SeqID_16887; Position on contig =91489..91524bp; Strand=-
gggggattctgtgaggaattcccctttacgcgtcag

SEQ ID NO: 15580 - DNA, 43 bp, Xenorhabdus bovienii
  Terminator location: Contig name=SeqID_16887; Position on contig =95799..95841bp; Strand=-; Gene name=MetA
tcaatttgagtacaataactcgacattgatcttgtcttttgat

SEQ ID NO: 15581 - DNA, 30 bp, Xenorhabdus bovienii
  Terminator location: Contig name=SeqID_16888; Position on contig =396..425bp; Strand=-; Gene name=RuvA
gctggatatacgtccagctttttttatgct

SEQ ID NO: 15582 - DNA, 53 bp, Xenorhabdus bovienii
  Terminator location: Contig name=SeqID_16888; Position on contig =6631..6683bp; Strand=+; Gene name=SmtA
ttaatgagtgaactgtccaatatggcaattcactcattaagttctaagatttc

SEQ ID NO: 15583 - DNA, 54 bp, Xenorhabdus bovienii
  Terminator location: Contig name=SeqID_16888; Position on contig =6617..6670bp; Strand=-; Gene name=SmtA
ttaatgagtgaattgccatattggacagttcactcattaatatttgttcaatat

SEQ ID NO: 15584 - DNA, 39 bp, Xenorhabdus bovienii
  Terminator location: Contig name=SeqID_16888; Position on contig =7738..7776bp; Strand=+
ttttggatgactctccttcatccgaaaattatctggtaa

SEQ ID NO: 15585 - DNA, 51 bp, Xenorhabdus bovienii
  Terminator location: Contig name=SeqID_16888; Position on contig =10225..10275bp; Strand=+; Gene name=ArgS
gaaaactggcgtgatatgattttatcacgccagttttttcctttctccgcc

SEQ ID NO: 15586 - DNA, 37 bp, Xenorhabdus bovienii
  Terminator location: Contig name=SeqID_16888; Position on contig =10742..10778bp; Strand=-
ccgcccaagtttttattgggcggttttttattttgca

SEQ ID NO: 15587 - DNA, 45 bp, Xenorhabdus bovienii
  Terminator location: Contig name=SeqID_16888; Position on contig =12720..12764bp; Strand=+
gcgctgcatatagcggatcgcaggttgcagcgcttcatacatcaa

SEQ ID NO: 15588 - DNA, 52 bp, Xenorhabdus bovienii
  Terminator location: Contig name=SeqID_16888; Position on contig =15138..15189bp; Strand=+
taataagggcaaattactaatggataatttgcccttttattttatcaattag

SEQ ID NO: 15589 - DNA, 51 bp, Xenorhabdus bovienii
  Terminator location: Contig name=SeqID_16888; Position on contig =15126..15176bp; Strand=-
taaaagggcaaattatccattagtaatttgcccttattatttcaatgacga

SEQ ID NO: 15590 - DNA, 67 bp, Xenorhabdus bovienii
  Terminator location: Contig name=SeqID_16888; Position on contig =17151..17217bp; Strand=+
ggaaagtgtgtatacgtgaaaacgtatcgagggttcgaacccctctctcaccgccatattctaagaa

SEQ ID NO: 15591 - DNA, 73 bp, Xenorhabdus bovienii
  Terminator location: Contig name=SeqID_16888; Position on contig =17320..17392bp; Strand=-
acgttttcacgtatacacactttccaggcgtgctccttcagcctctcggacacctcaccgtgttttgtttctg

SEQ ID NO: 15592 - DNA, 47 bp, Xenorhabdus bovienii
  Terminator location: Contig name=SeqID_16888; Position on contig =25447..25493bp; Strand=-; Gene name=SUL1
gtcaccctctgccagttatgctggcagagggtgacttgttgttacta

SEQ ID NO: 15593 - DNA, 58 bp, Xenorhabdus bovienii
  Terminator location: Contig name=SeqID_16888; Position on contig =33298..33355bp; Strand=+; Gene name=PrsA
ctgaaaaaacccgttgacgcatccgcagcaacgggttttttccgtcattttaatacac

SEQ ID NO: 15594 - DNA, 44 bp, Xenorhabdus bovienii
  Terminator location: Contig name=SeqID_16888; Position on contig =35869..35912bp; Strand=-
ggcaaggcggttattgatgaccaccttgcctttttgcttatatc

SEQ ID NO: 15595 - DNA, 42 bp, Xenorhabdus bovienii
  Terminator location: Contig name=SeqID_16888; Position on contig =38398..38439bp; Strand=+
taaaatccgcgtggttgcgcggatttttgtttttactgcgac

SEQ ID NO: 15596 - DNA, 42 bp, Xenorhabdus bovienii
  Terminator location: Contig name=SeqID_16888; Position on contig =38385..38426bp; Strand=-
caaaaatccgcgcaaccacgcggattttaggtattttaatca

SEQ ID NO: 15597 - DNA, 44 bp, Xenorhabdus bovienii
  Terminator location: Contig name=SeqID_16888; Position on contig =41788..41831bp; Strand=+; Gene name=MdaB
tgctcccacctgccatgcaggtgggtaatgtgatttttatcacg

SEQ ID NO: 15598 - DNA, 34 bp, Xenorhabdus bovienii
  Terminator location: Contig name=SeqID_16888; Position on contig =43668..43701bp; Strand=+; Gene name=MdlB
gagcctattttaataggctctttttttattaact

SEQ ID NO: 15599 - DNA, 36 bp, Xenorhabdus bovienii
  Terminator location: Contig name=SeqID_16888; Position on contig =68107..68142bp; Strand=+; Gene name=EntF
gagcgttcgcgaaagcggacgctttttttatctgcc

SEQ ID NO: 15600 - DNA, 50 bp, Xenorhabdus bovienii
  Terminator location: Contig name=SeqID_16888; Position on contig =68171..68220bp; Strand=-; Gene name=EntF
taaattggattatagattatttgattttaaccgtttgaaatttcatattt

SEQ ID NO: 15601 - DNA, 35 bp, Xenorhabdus bovienii
  Terminator location: Contig name=SeqID_16888; Position on contig =71238..71272bp; Strand=+
cgagggcctgatggtgctctcggtgttcgtgcagc

SEQ ID NO: 15602 - DNA, 45 bp, Xenorhabdus bovienii
  Terminator location: Contig name=SeqID_16888; Position on contig =70988..71032bp; Strand=-
gtgaagtatcacttcatcatggggtaatttaccaattttggaaaa

SEQ ID NO: 15603 - DNA, 37 bp, Xenorhabdus bovienii; identical to SEQ ID NO: 15550
  Terminator location: Contig name=SeqID_16888; Position on contig =73381..73417bp; Strand=+

SEQ ID NO: 15604 - DNA, 43 bp, Xenorhabdus bovienii
  Terminator location: Contig name=SeqID_16888; Position on contig =85050..85092bp; Strand=+
gacagataccggaatagaaacggtaactgtcagtttggattag

SEQ ID NO: 15605 - DNA, 47 bp, Xenorhabdus bovienii
  Terminator location: Contig name=SeqID_16888; Position on contig =85036..85082bp; Strand=-
ctgacagttaccgtttctattccggtatctgtcagtttaaaaattac

SEQ ID NO: 15606 - DNA, 39 bp, Xenorhabdus bovienii
  Terminator location: Contig name=SeqID_16888; Position on contig =91424..91462bp; Strand=-
gccgggattcattatgaattccggcttttttatcgctct

SEQ ID NO: 15607 - DNA, 34 bp, Xenorhabdus bovienii
  Terminator location: Contig name=SeqID_16888; Position on contig =92524..92557bp; Strand=-
ggccgacttggtagtcggccttttttgtaacact

SEQ ID NO: 15608 - DNA, 46 bp, Xenorhabdus bovienii
  Terminator location: Contig name=SeqID_16888; Position on contig =95434..95479bp; Strand=-
gtggcatttatcagtaaggctattataatgtcgcctgttcatgcct

SEQ ID NO: 15609 - DNA, 37 bp, Xenorhabdus bovienii
  Terminator location: Contig name=SeqID_16888; Position on contig =96457..96493bp; Strand=-
caactacgctttaagtggtaggttgttctacgtctca

SEQ ID NO: 15610 - DNA, 49 bp, Xenorhabdus bovienii
  Terminator location: Contig name=SeqID_16888; Position on contig =99647..99695bp; Strand=+
gaagataaccacccacttaagtgggtggttatctcagctattttccagc

SEQ ID NO: 15611 - DNA, 45 bp, Xenorhabdus bovienii
  Terminator location: Contig name=SeqID_16888; Position on contig =99637..99681bp; Strand=-
gagataaccacccacttaagtgggtggttatcttcttcgtcccat

SEQ ID NO: 15612 - DNA, 35 bp, Xenorhabdus bovienii
  Terminator location: Contig name=SeqID_16888; Position on contig =100652..100686bp; Strand=-; Gene name=MhpC
cgggatactgggagtgtatctcgttttatttaacc

SEQ ID NO: 15613 - DNA, 50 bp, Xenorhabdus bovienii
  Terminator location: Contig name=SeqID_16888; Position on contig =105017..105066bp; Strand=+; Gene name=SdaA
cagatgccgttcatcaacaccctgatgagcggtatttgttatccattatt

SEQ ID NO: 15614 - DNA, 37 bp, Xenorhabdus bovienii
  Terminator location: Contig name=SeqID_16888; Position on contig =108303..108339bp; Strand=+
ttggggaggtttttcctccccaatttctttattgtaa

SEQ ID NO: 15615 - DNA, 38 bp, Xenorhabdus bovienii
  Terminator location: Contig name=SeqID_16888; Position on contig =108884..108921bp; Strand=+
gaggccaataattaatattagcttcatttttcaatcaa

SEQ ID NO: 15616 - DNA, 38 bp, Xenorhabdus bovienii
  Terminator location: Contig name=SeqID_16888; Position on contig =108871..108908bp; Strand=-
gaagctaatattaattattggcctcatttaaaatatgt

SEQ ID NO: 15617 - DNA, 32 bp, Xenorhabdus bovienii
  Terminator location: Contig name=SeqID_16888; Position on contig =109633..109664bp; Strand=-
gtagccataatcatggttattattccaattgt

SEQ ID NO: 15618 - DNA, 36 bp, Xenorhabdus bovienii
  Terminator location: Contig name=SeqID_16888; Position on contig =111615..111650bp; Strand=+
taatgtattgtcagttacgttgttttttgacactgg

SEQ ID NO: 15619 - DNA, 47 bp, Xenorhabdus bovienii
  Terminator location: Contig name=SeqID_16888; Position on contig =111491..111537bp; Strand=-
ttattgtcataagccatacaatttaatggtaatagttcataatagtt

SEQ ID NO: 15620 - DNA, 58 bp, Xenorhabdus bovienii
  Terminator location: Contig name=SeqID_16888; Position on contig =111990..112047bp; Strand=-
tatctttaggttgatggaatttttcagttatcaatttagtggtgtacttttggtgaga

SEQ ID NO: 15621 - DNA, 40 bp, Xenorhabdus bovienii
  Terminator location: Contig name=SeqID_16888; Position on contig =114095..114134bp; Strand=-; Gene name=GuaA
ttagggtggcccgctatcgggccactgacttctttatttt

SEQ ID NO: 15622 - DNA, 34 bp, Xenorhabdus bovienii
  Terminator location: Contig name=SeqID_16888; Position on contig =117161..117194bp; Strand=+; Gene name=XseA
tagcggtgatttcttaccgctatttaaattctat

SEQ ID NO: 15623 - DNA, 36 bp, Xenorhabdus bovienii
  Terminator location: Contig name=SeqID_16888; Position on contig =117147..117182bp; Strand=-; Gene name=XseA
tagcggtaagaaatcaccgctatttctattttttgt

SEQ ID NO: 15624 - DNA, 50 bp, Xenorhabdus bovienii
  Terminator location: Contig name=SeqID_16888; Position on contig =119509..119558bp; Strand=-; Gene name=CirA
cccaaggcgctgataatttgttatcagtgtcatgggtattttatcgccaa

SEQ ID NO: 15625 - DNA, 44 bp, Xenorhabdus bovienii
  Terminator location: Contig name=SeqID_16888; Position on contig =123641..123684bp; Strand=-; Gene name=PhuW
ctaccctgccaagcataggcttaacagggtagttttatttgtaa

SEQ ID NO: 15626 - DNA, 36 bp, Xenorhabdus bovienii
  Terminator location: Contig name=SeqID_16888; Position on contig =127243..127278bp; Strand=+; Gene name=CitB
ttccctgagtctgccaacggggaaattgtgagttaa

SEQ ID NO: 15627 - DNA, 64 bp, Xenorhabdus bovienii
  Terminator location: Contig name=SeqID_16888; Position on contig =132985..133048bp; Strand=+
ttattattaataattgttgataataacattaaataatttattggtaatggaaatattataatga

SEQ ID NO: 15628 - DNA, 43 bp, Xenorhabdus bovienii
  Terminator location: Contig name=SeqID_16888; Position on contig =134111..134153bp; Strand=-
gatatcctacactaaaatagtgggggtatctttgatcgtgatg

SEQ ID NO: 15629 - DNA, 36 bp, Xenorhabdus bovienii
  Terminator location: Contig name=SeqID_16888; Position on contig =134952..134987bp; Strand=-; Gene name=PurC
taaaggggcctaggcccctttatattttgggtgaaa

SEQ ID NO: 15630 - DNA, 35 bp, Xenorhabdus bovienii
  Terminator location: Contig name=SeqID_16888; Position on contig =138258..138292bp; Strand=+; Gene name=Bcp
tccccctgtttgacagggggaatttcgttatctac

SEQ ID NO: 15631 - DNA, 39 bp, Xenorhabdus bovienii
  Terminator location: Contig name=SeqID_16888; Position on contig =141412..141450bp; Strand=+; Gene name=ArsC
gtgatagggacatattcactatcacttttttcctgtttc

SEQ ID NO: 15632 - DNA, 53 bp, Xenorhabdus bovienii
  Terminator location: Contig name=SeqID_16888; Position on contig =141392..141444bp; Strand=-; Gene name=ArsC
ggaaaaaagtgatagtgaatatgtccctatcacttttttgtttgtatgatttt

SEQ ID NO: 15633 - DNA, 38 bp, Xenorhabdus bovienii
  Terminator location: Contig name=SeqID_16888; Position on contig =142805..142842bp; Strand=-
gaagggttttaaagagcaagcccttctctttttgactc

SEQ ID NO: 15634 - DNA, 28 bp, Xenorhabdus bovienii
  Terminator location: Contig name=SeqID_16888; Position on contig =144207..144234bp; Strand=-
ccgactgaaaagtcggttttttttggct

SEQ ID NO: 15635 - DNA, 45 bp, Xenorhabdus bovienii
  Terminator location: Contig name=SeqID_16888; Position on contig =146739..146783bp; Strand=-; Gene name=PurN
tgtggcagtgttttgccatccagtattgctatattatcgctcatg

SEQ ID NO: 15636 - DNA, 58 bp, Xenorhabdus bovienii
  Terminator location: Contig name=SeqID_16888; Position on contig =153140..153197bp; Strand=+; Gene name=MgtE
tgggagaaacgccgatttataaatgatatcggcgttttttctcaaactattaataaac

SEQ ID NO: 15637 - DNA, 42 bp, Xenorhabdus bovienii
  Terminator location: Contig name=SeqID_16888; Position on contig =164942..164983bp; Strand=+
ggctagctcaatctcccttgagctggccttttcttttatccc

SEQ ID NO: 15638 - DNA, 38 bp, Xenorhabdus bovienii
  Terminator location: Contig name=SeqID_16888; Position on contig =166504..166541bp; Strand=+; Gene name=FbaB
cacttaatcaccatatggttatggtgcttctactacca

SEQ ID NO: 15639 - DNA, 35 bp, Xenorhabdus bovienii
  Terminator location: Contig name=SeqID_16888; Position on contig =174410..174444bp; Strand=+
gtaaagggcctttcagccctttctttttcccgtta

SEQ ID NO: 15640 - DNA, 42 bp, Xenorhabdus bovienii
  Terminator location: Contig name=SeqID_16888; Position on contig =181010..181051bp; Strand=-
tttggctggtatttgattactgaccaaatagatttatcgtta

SEQ ID NO: 15641 - DNA, 37 bp, Xenorhabdus bovienii
  Terminator location: Contig name=SeqID_16888; Position on contig =182143..182179bp; Strand=-
ccggccggatctatttccggctggtcttatgattaga

SEQ ID NO: 15642 - DNA, 33 bp, Xenorhabdus bovienii
  Terminator location: Contig name=SeqID_16888; Position on contig =184811..184843bp; Strand=+; Gene name=AraC
gcggccattcgttaaggccgccgtttccttccc

SEQ ID NO: 15643 - DNA, 29 bp, Xenorhabdus bovienii
  Terminator location: Contig name=SeqID_16888; Position on contig =184868..184896bp; Strand=-; Gene name=AraC
cagcacaatagtgctgtgttattcagagc

SEQ ID NO: 15644 - DNA, 35 bp, Xenorhabdus bovienii
  Terminator location: Contig name=SeqID_16888; Position on contig =186199..186233bp; Strand=+
gttggttgtagtccttagccagctttatcgcaata

SEQ ID NO: 15645 - DNA, 30 bp, Xenorhabdus bovienii
  Terminator location: Contig name=SeqID_16888; Position on contig =188535..188564bp; Strand=+
cgggagtttccactcccgttgattttctgg

SEQ ID NO: 15646 - DNA, 42 bp, Xenorhabdus bovienii
  Terminator location: Contig name=SeqID_16888; Position on contig =189907..189948bp; Strand=+
tagagcgacgaacacccatcgtcgctctatttatcatcaaat

SEQ ID NO: 15647 - DNA, 35 bp, Xenorhabdus bovienii
  Terminator location: Contig name=SeqID_16888; Position on contig =189860..189894bp; Strand=-
gagtaccttgagataaggtattttttatttgagtc

SEQ ID NO: 15648 - DNA, 42 bp, Xenorhabdus bovienii
  Terminator location: Contig name=SeqID_16888; Position on contig =192915..192956bp; Strand=-
tttaattgttgcgggtaacgattgataagattaatcagtagt

SEQ ID NO: 15649 - DNA, 34 bp, Xenorhabdus bovienii
  Terminator location: Contig name=SeqID_16888; Position on contig =206848..206881bp; Strand=+
tccatctgcatagcagatggattttctatatgtc

SEQ ID NO: 15650 - DNA, 35 bp, Xenorhabdus bovienii
  Terminator location: Contig name=SeqID_16888; Position on contig =206834..206868bp; Strand=-
tccatctgctatgcagatggattttttactcagag

SEQ ID NO: 15651 - DNA, 46 bp, Xenorhabdus bovienii
  Terminator location: Contig name=SeqID_16888; Position on contig =209099..209144bp; Strand=-; Gene name=SIR2
tgtcggtttaatcgatagcgatttaacgggtagggttctaatcagc

SEQ ID NO: 15652 - DNA, 39 bp, Xenorhabdus bovienii
  Terminator location: Contig name=SeqID_16888; Position on contig =212298..212336bp; Strand=-
ggcggatttcatgtttcaatctgtctcattatttatagg

SEQ ID NO: 15653 - DNA, 66 bp, Xenorhabdus bovienii
  Terminator location: Contig name=SeqID_16888; Position on contig =216325..216390bp; Strand=-; Gene name=Mfd
ggagattgcactgtttcgcctggaaccgtatcggcgaaacagtgcaatcgttgtgttatatctgat

SEQ ID NO: 15654 - DNA, 48 bp, Xenorhabdus bovienii
  Terminator location: Contig name=SeqID_16888; Position on contig =217383..217430bp; Strand=-
tggttcatctgaatttaattaacacagatgagccatttatctatccta

SEQ ID NO: 15655 - DNA, 45 bp, Xenorhabdus bovienii
  Terminator location: Contig name=SeqID_16888; Position on contig =219084..219128bp; Strand=-
gggatgggttgctagttggcaattctgtcccttttttgtttttct

SEQ ID NO: 15656 - DNA, 47 bp, Xenorhabdus bovienii
  Terminator location: Contig name=SeqID_16888; Position on contig =226626..226672bp; Strand=-; Gene name=IlvE
tatgaagagcctcaacatttgttgaggcttttttattcctgattttt

SEQ ID NO: 15657 - DNA, 36 bp, Xenorhabdus bovienii
  Terminator location: Contig name=SeqID_16889; Position on contig =5117..5152bp; Strand=-; Gene name=Maf (BS)
gtttatcccctggcggatgagcatttctgttagagt

SEQ ID NO: 15658 - DNA, 40 bp, Xenorhabdus bovienii
  Terminator location: Contig name=SeqID_16889; Position on contig =6280..6319bp; Strand=-; Gene name=RluA
ccattgctattggggtgatagcaaggtgactttatcgctt

SEQ ID NO: 15659 - DNA, 31 bp, Xenorhabdus bovienii
  Terminator location: Contig name=SeqID_16889; Position on contig =9896..9926bp; Strand=+; Gene name=CafA
ccgccttcatagaaggcggctttgatttcgc

SEQ ID NO: 15660 - DNA, 33 bp, Xenorhabdus bovienii
  Terminator location: Contig name=SeqID_16889; Position on contig =9882..9914bp; Strand=-; Gene name=CafA
ccgccttctatgaaggcggatttttacttttct

SEQ ID NO: 15661 - DNA, 39 bp, Xenorhabdus bovienii
  Terminator location: Contig name=SeqID_16889; Position on contig =11299..11337bp; Strand=-
gtaaccacgccctttgggcgtggttattttgtcagcccc

SEQ ID NO: 15662 - DNA, 44 bp, Xenorhabdus bovienii
  Terminator location: Contig name=SeqID_16889; Position on contig =13662..13705bp; Strand=+
gaccggaaagctaacaatcacactttccgtcctctcttccccaa

SEQ ID NO: 15663 - DNA, 30 bp, Xenorhabdus bovienii
  Terminator location: Contig name=SeqID_16889; Position on contig =15529..15558bp; Strand=-; Gene name=GlcD
cagcatcttagggtgctgtttttaattgaa

SEQ ID NO: 15664 - DNA, 53 bp, Xenorhabdus bovienii
  Terminator location: Contig name=SeqID_16889; Position on contig =17458..17510bp; Strand=+
tccttgtttggaatttaataaatttttagcacagaaggaaactatttgctatt

SEQ ID NO: 15665 - DNA, 47 bp, Xenorhabdus bovienii
  Terminator location: Contig name=SeqID_16889; Position on contig =17518..17564bp; Strand=-
tcaacctttcatcagttctatgatgaaaggttgaaccttttgatatc

SEQ ID NO: 15666 - DNA, 39 bp, Xenorhabdus bovienii
  Terminator location: Contig name=SeqID_16889; Position on contig =19657..19695bp; Strand=-; Gene name=CirA
gacagggataaataattatccctgtactttgagcgtata

SEQ ID NO: 15667 - DNA, 39 bp, Xenorhabdus bovienii
  Terminator location: Contig name=SeqID_16889; Position on contig =24571..24609bp; Strand=-; Gene name=LysP
cttataatcggcggtcaattatgagggtatcttataatc

SEQ ID NO: 15668 - DNA, 31 bp, Xenorhabdus bovienii
  Terminator location: Contig name=SeqID_16889; Position on contig =26823..26853bp; Strand=+
tctctgtttttgacagagattttattggcag

SEQ ID NO: 15669 - DNA, 55 bp, Xenorhabdus bovienii
  Terminator location: Contig name=SeqID_16889; Position on contig =27636..27690bp; Strand=-; Gene name=Nfo
tgatcgtttcaagaaccaatggaatgccattgaaacgatcatctttcataatgta

SEQ ID NO: 15670 - DNA, 34 bp, Xenorhabdus bovienii
  Terminator location: Contig name=SeqID_16889; Position on contig =30782..30815bp; Strand=+; Gene name=SdaC
gcctcagtatttttactgaggttttcatatcacc

SEQ ID NO: 15671 - DNA, 49 bp, Xenorhabdus bovienii
  Terminator location: Contig name=SeqID_16889; Position on contig =31481..31529bp; Strand=-; Gene name=Efp
tgaattgctcttttcatcgaaagggaaagagcaattaatattttaagga

SEQ ID NO: 15672 - DNA, 53 bp, Xenorhabdus bovienii
  Terminator location: Contig name=SeqID_16889; Position on contig =33633..33685bp; Strand=+; Gene name=PgpB
gtaatggtgaggagatattgcttatctcctcaaaactacacaatttttaccaa

SEQ ID NO: 15673 - DNA, 54 bp, Xenorhabdus bovienii
  Terminator location: Contig name=SeqID_16889; Position on contig =34578..34631bp; Strand=+; Gene name=Spr
gacataaaaaaacgcttccaaagggaagcgtttttttatccaattgttatccac

SEQ ID NO: 15674 - DNA, 32 bp, Xenorhabdus bovienii
  Terminator location: Contig name=SeqID_16889; Position on contig =34576..34607bp; Strand=-; Gene name=Spr
cgcttccctttggaagcgtttttttatgtctg

SEQ ID NO: 15675 - DNA, 42 bp, Xenorhabdus bovienii
  Terminator location: Contig name=SeqID_16889; Position on contig =35134..35175bp; Strand=+
taaaaagtgagatcaaactcgcattttgtatatatttatact

SEQ ID NO: 15676 - DNA, 42 bp, Xenorhabdus bovienii
  Terminator location: Contig name=SeqID_16889; Position on contig =35607..35648bp; Strand=-
ggggctatcagatagcataaggtagcctctgtttttttaatt

SEQ ID NO: 15677 - DNA, 40 bp, Xenorhabdus bovienii
  Terminator location: Contig name=SeqID_16889; Position on contig =39734..39773bp; Strand=+; Gene name=SSL2
cctgctgctgggtcgcctgtagcaggatttattttcttct

SEQ ID NO: 15678 - DNA, 51 bp, Xenorhabdus bovienii
  Terminator location: Contig name=SeqID_16889; Position on contig =40104..40154bp; Strand=+; Gene name=RplY
gagtagataacgccgcatttgcggcgttatttatttctactattttattct

SEQ ID NO: 15679 - DNA, 28 bp, Xenorhabdus bovienii
  Terminator location: Contig name=SeqID_16889; Position on contig =40102..40129bp; Strand=-; Gene name=RplY
cgccgcaaatgcggcgttatctactcgg

SEQ ID NO: 15680 - DNA, 53 bp, Xenorhabdus bovienii
  Terminator location: Contig name=SeqID_16889; Position on contig =41233..41285bp; Strand=-
ttgctgccattctgaagtctgttgcatcagaaaggtaacggtgtttgaatacg

SEQ ID NO: 15681 - DNA, 39 bp, Xenorhabdus bovienii
  Terminator location: Contig name=SeqID_16889; Position on contig =43393..43431bp; Strand=+
caagcactcactaaattgagggcttgctttgaaaataaa

SEQ ID NO: 15682 - DNA, 71 bp, Xenorhabdus bovienii
  Terminator location: Contig name=SeqID_16889; Position on contig =43441..43511bp; Strand=-
aacctacgacccccgacaccccatgacggtgcgctaccaagctgcgctacatgccgatgacttttactata

SEQ ID NO: 15683 - DNA, 48 bp, Xenorhabdus bovienii
  Terminator location: Contig name=SeqID_16889; Position on contig =45064..45111bp; Strand=+
ctcaacaaccaccaactaaagtcggtggttgttgagtttctgccagtt

SEQ ID NO: 15684 - DNA, 45 bp, Xenorhabdus bovienii; identical to SEQ ID NO: 15016
  Terminator location: Contig name=SeqID_16889; Position on contig =47876..47920bp; Strand=-

SEQ ID NO: 15685 - DNA, 35 bp, Xenorhabdus bovienii
  Terminator location: Contig name=SeqID_16889; Position on contig =49020..49054bp; Strand=+
tcttcagtgaagttttattaagattatgccctaca

SEQ ID NO: 15686 - DNA, 42 bp, Xenorhabdus bovienii
  Terminator location: Contig name=SeqID_16889; Position on contig =48983..49024bp; Strand=-
gaagactcagctatttttggctgggtctttttttttgagaca

SEQ ID NO: 15687 - DNA, 51 bp, Xenorhabdus bovienii
  Terminator location: Contig name=SeqID_16889; Position on contig =64649..64699bp; Strand=-
ggctaatatttccattttatttgtggagatattagcctttttctaaactgt

SEQ ID NO: 15688 - DNA, 41 bp, Xenorhabdus bovienii
  Terminator location: Contig name=SeqID_16889; Position on contig =68477..68517bp; Strand=+
gtgcagcttccttgatgcggaagctgcactatttaaactta

SEQ ID NO: 15689 - DNA, 65 bp, Xenorhabdus bovienii
  Terminator location: Contig name=SeqID_16889; Position on contig =68450..68514bp; Strand=-
gtttaaatagtgcagcttccgcatcaaggaagctgcactgtggttacaggctgatttcatcaagg

SEQ ID NO: 15690 - DNA, 38 bp, Xenorhabdus bovienii
  Terminator location: Contig name=SeqID_16889; Position on contig =70433..70470bp; Strand=-; Gene name=CitT
ccaatctgcctatcggcagattggtattgctgatggga

SEQ ID NO: 15691 - DNA, 35 bp, Xenorhabdus bovienii
  Terminator location: Contig name=SeqID_16889; Position on contig =71853..71887bp; Strand=-
ccgtcagatccccgccctgacggttgctgaatcaa

SEQ ID NO: 15692 - DNA, 39 bp, Xenorhabdus bovienii
  Terminator location: Contig name=SeqID_16889; Position on contig =76186..76224bp; Strand=+; Gene name=Pta
taaccccattctttttggctggggttatttttttatagt

SEQ ID NO: 15693 - DNA, 39 bp, Xenorhabdus bovienii
  Terminator location: Contig name=SeqID_16889; Position on contig =87626..87664bp; Strand=+; Gene name=Uup
catccggcaaaccaacccgccggatgtttataataatca

SEQ ID NO: 15694 - DNA, 39 bp, Xenorhabdus bovienii
  Terminator location: Contig name=SeqID_16889; Position on contig =87613..87651bp; Strand=-; Gene name=Uup
catccggcgggttggtttgccggatgtttattttcaaaa

SEQ ID NO: 15695 - DNA, 29 bp, Xenorhabdus bovienii
  Terminator location: Contig name=SeqID_16889; Position on contig =109854..109882bp; Strand=-
ctcctctttacgaggagttttttatttgt

SEQ ID NO: 15696 - DNA, 51 bp, Xenorhabdus bovienii
  Terminator location: Contig name=SeqID_16889; Position on contig =125889..125939bp; Strand=+
ttcagatactttttattgttaatgaaaggtaaatgaaaggtttcgcattta

SEQ ID NO: 15697 - DNA, 39 bp, Xenorhabdus bovienii
  Terminator location: Contig name=SeqID_16889; Position on contig =128956..128994bp; Strand=+
gccaatccatctaatcaatggattggctttcattttaac

SEQ ID NO: 15698 - DNA, 58 bp, Xenorhabdus bovienii
  Terminator location: Contig name=SeqID_16889; Position on contig =128936..128993bp; Strand=-
ttaaaatgaaagccaatccattgattagatggattggctattttaatttatgcggccg

SEQ ID NO: 15699 - DNA, 49 bp, Xenorhabdus bovienii
  Terminator location: Contig name=SeqID_16889; Position on contig =132499..132547bp; Strand=-; Gene name=DadA
tctgcatcaaacactgtttcactgtgcctgatgcagatatatgatttta

SEQ ID NO: 15700 - DNA, 33 bp, Xenorhabdus bovienii
  Terminator location: Contig name=SeqID_16889; Position on contig =134663..134695bp; Strand=-
ggggttattcatatagcccctttattttttctg

SEQ ID NO: 15701 - DNA, 34 bp, Xenorhabdus bovienii
  Terminator location: Contig name=SeqID_16889; Position on contig =138847..138880bp; Strand=-
ccaccctgtgaatacagggtggttctcttaccct

SEQ ID NO: 15702 - DNA, 41 bp, Xenorhabdus bovienii
  Terminator location: Contig name=SeqID_16889; Position on contig =140301..140341bp; Strand=-; Gene name=AnsP
ctaaggccggtttctatccggccttatcgttgtatttatct

SEQ ID NO: 15703 - DNA, 41 bp, Xenorhabdus bovienii
  Terminator location: Contig name=SeqID_16889; Position on contig =143839..143879bp; Strand=-
tctccctttgtttttagtatagggagattttttcacaaaca

SEQ ID NO: 15704 - DNA, 41 bp, Xenorhabdus bovienii
  Terminator location: Contig name=SeqID_16889; Position on contig =147734..147774bp; Strand=+
gagaggtttgccataacaggcggcctttctctgtttgagga

SEQ ID NO: 15705 - DNA, 35 bp, Xenorhabdus bovienii
  Terminator location: Contig name=SeqID_16889; Position on contig =147552..147586bp; Strand=-
gcaagccataaaggagcttgctgtttaagaatatg

SEQ ID NO: 15706 - DNA, 36 bp, Xenorhabdus bovienii
  Terminator location: Contig name=SeqID_16889; Position on contig =148466..148501bp; Strand=-; Gene name=SixA
tcggctcttgttatcggagccgatttttttatgaaa

SEQ ID NO: 15707 - DNA, 61 bp, Xenorhabdus bovienii
  Terminator location: Contig name=SeqID_16889; Position on contig =154180..154240bp; Strand=+; Gene name=FadL
gctgtgatcgaaaaaaggatagcgggtgctatccttttttgatcatggcttcatcattaat

SEQ ID NO: 15708 - DNA, 30 bp, Xenorhabdus bovienii
  Terminator location: Contig name=SeqID_16889; Position on contig =154184..154213bp; Strand=-; Gene name=FadL
ggatagcacccgctatccttttttcgatca

SEQ ID NO: 15709 - DNA, 44 bp, Xenorhabdus bovienii
  Terminator location: Contig name=SeqID_16889; Position on contig =155633..155676bp; Strand=-
tatgtttgcgatgtcaggatgacacgaaatgactgtttggaaat

SEQ ID NO: 15710 - DNA, 61 bp, Xenorhabdus bovienii
  Terminator location: Contig name=SeqID_16889; Position on contig =158423..158483bp; Strand=+
gaataatccttaacccgtaactttccgcgggttaagactggcttcattcttctaccatccc

SEQ ID NO: 15711 - DNA, 40 bp, Xenorhabdus bovienii
  Terminator location: Contig name=SeqID_16889; Position on contig =165833..165872bp; Strand=+
ttgttatgactcatcaggtcaaacaatgactttggcttta

SEQ ID NO: 15712 - DNA, 36 bp, Xenorhabdus bovienii
  Terminator location: Contig name=SeqID_16889; Position on contig =167097..167132bp; Strand=+
ggtttggccttgatggtcgaaatcttgatcattgaa

SEQ ID NO: 15713 - DNA, 27 bp, Xenorhabdus bovienii
  Terminator location: Contig name=SeqID_16889; Position on contig =167476..167502bp; Strand=+
gccccgtgatggggctgtttagctttc

SEQ ID NO: 15714 - DNA, 27 bp, Xenorhabdus bovienii
  Terminator location: Contig name=SeqID_16889; Position on contig =167464..167490bp; Strand=-
gccccatcacggggcttacttgataag

SEQ ID NO: 15715 - DNA, 52 bp, Xenorhabdus bovienii
  Terminator location: Contig name=SeqID_16889; Position on contig =168756..168807bp; Strand=+
ttaaacttaattgttctaatgcagaataattaaagttaggttttacaaaagt

SEQ ID NO: 15716 - DNA, 51 bp, Xenorhabdus bovienii
  Terminator location: Contig name=SeqID_16889; Position on contig =170681..170731bp; Strand=-
tatcaggatgcgattcattaaacccaatccattctgatactattactggta

SEQ ID NO: 15717 - DNA, 37 bp, Xenorhabdus bovienii
  Terminator location: Contig name=SeqID_16892; Position on contig =1872..1908bp; Strand=+
tgcaggcaaatccggcttgctgcaaaatttgtaccgc

SEQ ID NO: 15718 - DNA, 40 bp, Xenorhabdus bovienii
  Terminator location: Contig name=SeqID_16892; Position on contig =8779..8818bp; Strand=+
ggcggcgacagtgacattgttgtgcccggtattgatgccg

SEQ ID NO: 15719 - DNA, 36 bp, Xenorhabdus bovienii
  Terminator location: Contig name=SeqID_16892; Position on contig =8475..8510bp; Strand=-
gggagaattaacaaactctccctttttaatgacaga

SEQ ID NO: 15720 - DNA, 52 bp, Xenorhabdus bovienii
  Terminator location: Contig name=SeqID_16892; Position on contig =13056..13107bp; Strand=+
gttagtatagcgtcatcatccagatgacgatgtaataacccttgtgagtgta

SEQ ID NO: 15721 - DNA, 38 bp, Xenorhabdus bovienii
  Terminator location: Contig name=SeqID_16892; Position on contig =14479..14516bp; Strand=+
tggttcgtgatattcatgtggccaatattttatgataa

SEQ ID NO: 15722 - DNA, 38 bp, Xenorhabdus bovienii
  Terminator location: Contig name=SeqID_16892; Position on contig =14049..14086bp; Strand=-
gcaggttgtgttctcgtaaccagcgatttctgattttt

SEQ ID NO: 15723 - DNA, 40 bp, Xenorhabdus bovienii
  Terminator location: Contig name=SeqID_16892; Position on contig =14761..14800bp; Strand=-
tgtaggtataagtttaaggtacttgcatttaatttcaatt

SEQ ID NO: 15724 - DNA, 45 bp, Xenorhabdus bovienii
  Terminator location: Contig name=SeqID_16892; Position on contig =17534..17578bp; Strand=+; Gene name=Nlp
tgagataacaaagaaaccgtttttgttctcatggctttttctttg

SEQ ID NO: 15725 - DNA, 37 bp, Xenorhabdus bovienii
  Terminator location: Contig name=SeqID_16892; Position on contig =17659..17695bp; Strand=-
gcactttttcttttaggggaagtgcttttttttgttt

SEQ ID NO: 15726 - DNA, 51 bp, Xenorhabdus bovienii
  Terminator location: Contig name=SeqID_16892; Position on contig =22269..22319bp; Strand=-
tgattaaaatcccatctttttaaaggtgggattttttgttttcatactgga

SEQ ID NO: 15727 - DNA, 41 bp, Xenorhabdus bovienii
  Terminator location: Contig name=SeqID_16892; Position on contig =38265..38305bp; Strand=+
gagcacctgaggtattcatcaggtgctctgttctacttctt

SEQ ID NO: 15728 - DNA, 37 bp, Xenorhabdus bovienii
  Terminator location: Contig name=SeqID_16892; Position on contig =38600..38636bp; Strand=-
ccgccaattctttaagaactggcggtattctctttct

SEQ ID NO: 15729 - DNA, 44 bp, Xenorhabdus bovienii
  Terminator location: Contig name=SeqID_16892; Position on contig =41209..41252bp; Strand=-
taacacccccctccttgtgatgcggggtgttattttgtattgag

SEQ ID NO: 15730 - DNA, 44 bp, Xenorhabdus bovienii
  Terminator location: Contig name=SeqID_16892; Position on contig =54582..54625bp; Strand=+
cgcccttgtaagtcaccctcttacaagggcgtttttcttggttt

SEQ ID NO: 15731 - DNA, 38 bp, Xenorhabdus bovienii
  Terminator location: Contig name=SeqID_16892; Position on contig =54949..54986bp; Strand=+; Gene name=BolA
gttgtttgcctcgccgcgaacagcacactttgaattaa

SEQ ID NO: 15732 - DNA, 42 bp, Xenorhabdus bovienii
  Terminator location: Contig name=SeqID_16892; Position on contig =57476..57517bp; Strand=-; Gene name=DegQ
gacagacacagcataagctgtgtctgttcgcttctatgctat

SEQ ID NO: 15733 - DNA, 50 bp, Xenorhabdus bovienii
  Terminator location: Contig name=SeqID_16892; Position on contig =59183..59232bp; Strand=+
caatgagccgtggtatcaacaggttaccacggccggagaatttactgttt

SEQ ID NO: 15734 - DNA, 43 bp, Xenorhabdus bovienii
  Terminator location: Contig name=SeqID_16892; Position on contig =62480..62522bp; Strand=+
gaatagccgtttttcactgaagggctgttcgttcctttgttta

SEQ ID NO: 15735 - DNA, 47 bp, Xenorhabdus bovienii
  Terminator location: Contig name=SeqID_16892; Position on contig =63698..63744bp; Strand=+; Gene name=SspB
gaaaataaaggagattttggtctcctttattatttttagtggtaccc

SEQ ID NO: 15736 - DNA, 36 bp, Xenorhabdus bovienii
  Terminator location: Contig name=SeqID_16892; Position on contig =64373..64408bp; Strand=-
tttcttttctcaaagagaagacgattttttagtgca

SEQ ID NO: 15737 - DNA, 58 bp, Xenorhabdus bovienii
  Terminator location: Contig name=SeqID_16892; Position on contig =70872..70929bp; Strand=+
ctgcataatatttattttaaatattcttttaaaatgtattattgcgatattttaatct

SEQ ID NO: 15738 - DNA, 38 bp, Xenorhabdus bovienii
  Terminator location: Contig name=SeqID_16892; Position on contig =73670..73707bp; Strand=+; Gene name=BaeS
tgtttaaccctctaaggggttaagcattaatctactac

SEQ ID NO: 15739 - DNA, 34 bp, Xenorhabdus bovienii
  Terminator location: Contig name=SeqID_16892; Position on contig =75104..75137bp; Strand=-; Gene name=MrcA
gcggcacaagtcagtgccgcttttatttgagcat

SEQ ID NO: 15740 - DNA, 36 bp, Xenorhabdus bovienii
  Terminator location: Contig name=SeqID_16892; Position on contig =79657..79692bp; Strand=-
ggtttgatatccgatgtataggccttttcacacacc

SEQ ID NO: 15741 - DNA, 40 bp, Xenorhabdus bovienii
  Terminator location: Contig name=SeqID_16892; Position on contig =81966..82005bp; Strand=+; Gene name=LysR
ccccttactgagaatcgacagtcaggggctttttacaata

SEQ ID NO: 15742 - DNA, 42 bp, Xenorhabdus bovienii
  Terminator location: Contig name=SeqID_16892; Position on contig =81952..81993bp; Strand=-; Gene name=LysR
cccctgactgtcgattctcagtaagggggcttaattttattg

SEQ ID NO: 15743 - DNA, 42 bp, Xenorhabdus bovienii
  Terminator location: Contig name=SeqID_16892; Position on contig =83838..83879bp; Strand=+
ctgttcaagcctgttaccacgattgagcagttttactaggac

SEQ ID NO: 15744 - DNA, 68 bp, Xenorhabdus bovienii
  Terminator location: Contig name=SeqID_16892; Position on contig =84257..84324bp; Strand=+
tataaaatattgctaagcatatattttatatatgcttagttacataattttgtatcttttacatattt

SEQ ID NO: 15745 - DNA, 44 bp, Xenorhabdus bovienii
  Terminator location: Contig name=SeqID_16892; Position on contig =84083..84126bp; Strand=-
cacaggaaagatcagtgatcgttgcttctgtgattttgacttca

SEQ ID NO: 15746 - DNA, 61 bp, Xenorhabdus bovienii
  Terminator location: Contig name=SeqID_16892; Position on contig =86022..86082bp; Strand=-
gatttttgcaaacatgttctctattttgtagcgttgtttgtagagtattttatcataaggt

SEQ ID NO: 15747 - DNA, 58 bp, Xenorhabdus bovienii
  Terminator location: Contig name=SeqID_16892; Position on contig =90164..90221bp; Strand=+; Gene name=SstT
taaaaacggtgataatcagcggatagctttttatcaccgtttctacatttaaggtcta

SEQ ID NO: 15748 - DNA, 57 bp, Xenorhabdus bovienii
  Terminator location: Contig name=SeqID_16892; Position on contig =90152..90208bp; Strand=-; Gene name=SstT
tagaaacggtgataaaaagctatccgctgattatcaccgtttttatttcagtcaatc

SEQ ID NO: 15749 - DNA, 50 bp, Xenorhabdus bovienii
  Terminator location: Contig name=SeqID_16892; Position on contig =92752..92801bp; Strand=+; Gene name=RimL
gtatcccttcttgatgataattaatcagtaagggctactttgatatggtt

SEQ ID NO: 15750 - DNA, 41 bp, Xenorhabdus bovienii
  Terminator location: Contig name=SeqID_16892; Position on contig =94688..94728bp; Strand=+
gacttggtttagccactaggctgcgtcccttaattagataa

SEQ ID NO: 15751 - DNA, 29 bp, Xenorhabdus bovienii
  Terminator location: Contig name=SeqID_16892; Position on contig =94649..94677bp; Strand=-
cgccgcactctgcggcgttttttttacac

SEQ ID NO: 15752 - DNA, 36 bp, Xenorhabdus bovienii
  Terminator location: Contig name=SeqID_16892; Position on contig =118198..118233bp; Strand=-; Gene name=SmtA
tggtcagaattgtgattcgaccgcgttctgactgta

SEQ ID NO: 15753 - DNA, 39 bp, Xenorhabdus bovienii
  Terminator location: Contig name=SeqID_16892; Position on contig =122639..122677bp; Strand=-; Gene name=PspE
gccgcccgcgctggtagcgggcagcgctttcgatcgtaa

SEQ ID NO: 15754 - DNA, 43 bp, Xenorhabdus bovienii
  Terminator location: Contig name=SeqID_16892; Position on contig =129702..129744bp; Strand=+
tagaatggcgatttacatcgccatttctatacttgtatgctgt

SEQ ID NO: 15755 - DNA, 36 bp, Xenorhabdus bovienii
  Terminator location: Contig name=SeqID_16892; Position on contig =130155..130190bp; Strand=-
tcatcagccaattgctgcatgatttgtttgttcaac

SEQ ID NO: 15756 - DNA, 45 bp, Xenorhabdus bovienii
  Terminator location: Contig name=SeqID_16892; Position on contig =135524..135568bp; Strand=+
caaggggttgcatcaaaagtgcgaccccttagttttttctaggat

SEQ ID NO: 15757 - DNA, 37 bp, Xenorhabdus bovienii
  Terminator location: Contig name=SeqID_16892; Position on contig =136839..136875bp; Strand=+
tacggcaatgagccgttgtcgtatctttgtccgtgat

SEQ ID NO: 15758 - DNA, 28 bp, Xenorhabdus bovienii
  Terminator location: Contig name=SeqID_16892; Position on contig =137540..137567bp; Strand=-; Gene name=Nlp
cagctcgcatgagctgtttaatagcaca

SEQ ID NO: 15759 - DNA, 28 bp, Xenorhabdus bovienii
  Terminator location: Contig name=SeqID_16892; Position on contig =138206..138233bp; Strand=+
cctcgcttcggcggggttttgttttttg

SEQ ID NO: 15760 - DNA, 33 bp, Xenorhabdus bovienii
  Terminator location: Contig name=SeqID_16892; Position on contig =138502..138534bp; Strand=+
ccagccccttaaggggctggttcttgggctaac

SEQ ID NO: 15761 - DNA, 32 bp, Xenorhabdus bovienii
  Terminator location: Contig name=SeqID_16892; Position on contig =138990..139021bp; Strand=+
ggctactcttcggcgtagcctttttcatgccc

SEQ ID NO: 15762 - DNA, 32 bp, Xenorhabdus bovienii
  Terminator location: Contig name=SeqID_16892; Position on contig =140379..140410bp; Strand=-
gccactttttaacaagtggcttttttgttttc

SEQ ID NO: 15763 - DNA, 30 bp, Xenorhabdus bovienii
  Terminator location: Contig name=SeqID_16892; Position on contig =141587..141616bp; Strand=+
cgcctgtcgaaacaggcgttttttaggttt

SEQ ID NO: 15764 - DNA, 30 bp, Xenorhabdus bovienii
  Terminator location: Contig name=SeqID_16892; Position on contig =141575..141604bp; Strand=-
cgcctgtttcgacaggcgtttttttatgac

SEQ ID NO: 15765 - DNA, 40 bp, Xenorhabdus bovienii
  Terminator location: Contig name=SeqID_16892; Position on contig =145513..145552bp; Strand=-; Gene name=DnaG
gccgtgctttccccaaaggaagcgcggcttattctcgttc

SEQ ID NO: 15766 - DNA, 49 bp, Xenorhabdus bovienii
  Terminator location: Contig name=SeqID_16892; Position on contig =147348..147396bp; Strand=+; Gene name=QRI7
ctaatgatcgctaaagtttagcgatcattgcatcgaatattggttattt

SEQ ID NO: 15767 - DNA, 55 bp, Xenorhabdus bovienii
  Terminator location: Contig name=SeqID_16892; Position on contig =147328..147382bp; Strand=-; Gene name=QRI7
cgatgcaatgatcgctaaactttagcgatcattagcgtggtcgtattgaattttc

SEQ ID NO: 15768 - DNA, 43 bp, Xenorhabdus bovienii
  Terminator location: Contig name=SeqID_16892; Position on contig =149972..150014bp; Strand=+; Gene name=FolB
gcgcctcaaattgataggttatttagggcgcttttaccaatta

SEQ ID NO: 15769 - DNA, 45 bp, Xenorhabdus bovienii
  Terminator location: Contig name=SeqID_16892; Position on contig =149958..150002bp; Strand=-; Gene name=FolB
gcgccctaaataacctatcaatttgaggcgctttttttaatgcag

SEQ ID NO: 15770 - DNA, 31 bp, Xenorhabdus bovienii
  Terminator location: Contig name=SeqID_16892; Position on contig =156043..156073bp; Strand=+; Gene name=GlnE
cttgctggcattcagtaaggttatggtaata

SEQ ID NO: 15771 - DNA, 48 bp, Xenorhabdus bovienii
  Terminator location: Contig name=SeqID_16892; Position on contig =159150..159197bp; Strand=+; Gene name=RibB
ttgaaaggccgcagtccacacactgcggccttcagtatttttgaaata

SEQ ID NO: 15772 - DNA, 46 bp, Xenorhabdus bovienii
  Terminator location: Contig name=SeqID_16892; Position on contig =160267..160312bp; Strand=+
gcagggcatggaattgctgtacgatcatgccttctttcccataagg

SEQ ID NO: 15773 - DNA, 31 bp, Xenorhabdus bovienii
  Terminator location: Contig name=SeqID_16892; Position on contig =162055..162085bp; Strand=-
gcccgccaattgtgtgggctattttttaaga

SEQ ID NO: 15774 - DNA, 54 bp, Xenorhabdus bovienii
  Terminator location: Contig name=SeqID_16892; Position on contig =164090..164143bp; Strand=-; Gene name=MutT
gttcctcccgggctggaaaggtagctcagggcaggctgacagcgtttgacttca

SEQ ID NO: 15775 - DNA, 35 bp, Xenorhabdus bovienii
  Terminator location: Contig name=SeqID_16892; Position on contig =170236..170270bp; Strand=+; Gene name=GyrA
caggccagatttattctggcctgctttataagagg

SEQ ID NO: 15776 - DNA, 55 bp, Xenorhabdus bovienii
  Terminator location: Contig name=SeqID_16892; Position on contig =171062..171116bp; Strand=+; Gene name=PlsC
gcggattctggctataaatttaagatagttttagaatttgcactttattcgcgat

SEQ ID NO: 15777 - DNA, 38 bp, Xenorhabdus bovienii
  Terminator location: Contig name=SeqID_16892; Position on contig =172884..172921bp; Strand=+
gctaatcttatcgactgagagtagccctttccgtatag

SEQ ID NO: 15778 - DNA, 31 bp, Xenorhabdus bovienii
  Terminator location: Contig name=SeqID_16892; Position on contig =178174..178204bp; Strand=+
cagctggcttgccggctgtttctctttggta

SEQ ID NO: 15779 - DNA, 27 bp, Xenorhabdus bovienii
  Terminator location: Contig name=SeqID_16892; Position on contig =177905..177931bp; Strand=-
cccgccaaggcgggattgatatgatgg

SEQ ID NO: 15780 - DNA, 64 bp, Xenorhabdus bovienii
  Terminator location: Contig name=SeqID_16893; Position on contig =2528..2591bp; Strand=-
tccgtacctgttttctgattaaggccggcgccttaatcagaaggctcggaaaatattgtcatca

SEQ ID NO: 15781 - DNA, 66 bp, Xenorhabdus bovienii
  Terminator location: Contig name=SeqID_16893; Position on contig =3322..3387bp; Strand=-
ttattttatgtccggcatgtttttgtgcaaattaacagccggacataaataacatttaagcatttt

SEQ ID NO: 15782 - DNA, 44 bp, Xenorhabdus bovienii
  Terminator location: Contig name=SeqID_16893; Position on contig =8466..8509bp; Strand=+
ttttccagccagtgcttggcctgtgacagacgtatctgctggat

SEQ ID NO: 15783 - DNA, 43 bp, Xenorhabdus bovienii
  Terminator location: Contig name=SeqID_16893; Position on contig =8082..8124bp; Strand=-
tctgcccgtcggtatcaaccgaccggtaaaggtatttccactg

SEQ ID NO: 15784 - DNA, 32 bp, Xenorhabdus bovienii
  Terminator location: Contig name=SeqID_16893; Position on contig =30644..30675bp; Strand=+
tggctcacgaaagtgggccatttcagactgtt

SEQ ID NO: 15785 - DNA, 42 bp, Xenorhabdus bovienii
  Terminator location: Contig name=SeqID_16893; Position on contig =30627..30668bp; Strand=-
tgaaatggcccactttcgtgagccattatatttaatgaagat

SEQ ID NO: 15786 - DNA, 45 bp, Xenorhabdus bovienii
  Terminator location: Contig name=SeqID_16893; Position on contig =32990..33034bp; Strand=+
ttttttgatttttttggagaaatcataaataaattgctatagtta

SEQ ID NO: 15787 - DNA, 53 bp, Xenorhabdus bovienii
  Terminator location: Contig name=SeqID_16893; Position on contig =33085..33137bp; Strand=-
ggacaatgtccgactctttaatctcgaatgaacattgtccatttaacttgagt

SEQ ID NO: 15788 - DNA, 41 bp, Xenorhabdus bovienii
  Terminator location: Contig name=SeqID_16893; Position on contig =37500..37540bp; Strand=+; Gene name=Pgm
gccgtagcaatagactgttgctgcggctttttgcttccggc

SEQ ID NO: 15789 - DNA, 39 bp, Xenorhabdus bovienii
  Terminator location: Contig name=SeqID_16893; Position on contig =37488..37526bp; Strand=-; Gene name=Pgm
gccgcagcaacagtctattgctacggcttttataatctc

SEQ ID NO: 15790 - DNA, 44 bp, Xenorhabdus bovienii
  Terminator location: Contig name=SeqID_16893; Position on contig =42570..42613bp; Strand=+; Gene name=GlgX
cgctgttggtcagcaattcggtcagcagacgatattccgtcggc

SEQ ID NO: 15791 - DNA, 44 bp, Xenorhabdus bovienii
  Terminator location: Contig name=SeqID_16893; Position on contig =50913..50956bp; Strand=+
gacaccttgcctgtttatgctgacgaggtgttttgcttttatcg

SEQ ID NO: 15792 - DNA, 45 bp, Xenorhabdus bovienii
  Terminator location: Contig name=SeqID_16893; Position on contig =51841..51885bp; Strand=+
caggcggggctatcagaacggtagccccgttgttttttcccaatt

SEQ ID NO: 15793 - DNA, 34 bp, Xenorhabdus bovienii
  Terminator location: Contig name=SeqID_16893; Position on contig =51555..51588bp; Strand=-
cgtacaccatgccagtgtacgaatttcttccggt

SEQ ID NO: 15794 - DNA, 62 bp, Xenorhabdus bovienii
  Terminator location: Contig name=SeqID_16893; Position on contig =53919..53980bp; Strand=-; Gene name=AraC
ctgcaccttaatcaggttcaatcgtaatattgaacctgattaaggtgcagttatcgcctgca

SEQ ID NO: 15795 - DNA, 56 bp, Xenorhabdus bovienii
  Terminator location: Contig name=SeqID_16893; Position on contig =55506..55561bp; Strand=+
gtattcttaacataaaatgttgtcattttgtgtctaatgagtacttttgcataact

SEQ ID NO: 15796 - DNA, 43 bp, Xenorhabdus bovienii
  Terminator location: Contig name=SeqID_16893; Position on contig =59354..59396bp; Strand=+; Gene name=FrdB
cctttaaaaaccgatatccagtttttaaaggttccttgaaggg

SEQ ID NO: 15797 - DNA, 47 bp, Xenorhabdus bovienii
  Terminator location: Contig name=SeqID_16893; Position on contig =63355..63401bp; Strand=-; Gene name=AceF
gcgatctttgatggcatgcatgccgaggatcgcactttgtggtgggt

SEQ ID NO: 15798 - DNA, 44 bp, Xenorhabdus bovienii
  Terminator location: Contig name=SeqID_16893; Position on contig =65784..65827bp; Strand=+; Gene name=SucD
tgaaaaaggtcaccttagggtgacctttttatttatatttataa

SEQ ID NO: 15799 - DNA, 34 bp, Xenorhabdus bovienii
  Terminator location: Contig name=SeqID_16893; Position on contig =69557..69590bp; Strand=+
tttatagaccgatggtctataaattttttttgat

SEQ ID NO: 15800 - DNA, 41 bp, Xenorhabdus bovienii
  Terminator location: Contig name=SeqID_16894; Position on contig =3750..3790bp; Strand=+
gatcaaaagctttttccagcttttgctctttatttgccaat

SEQ ID NO: 15801 - DNA, 27 bp, Xenorhabdus bovienii
  Terminator location: Contig name=SeqID_16894; Position on contig =15487..15513bp; Strand=+; Gene name=PncB
gctcctgatggagcatttacggtaaat

SEQ ID NO: 15802 - DNA, 45 bp, Xenorhabdus bovienii
  Terminator location: Contig name=SeqID_16894; Position on contig =18453..18497bp; Strand=+; Gene name=OmpC
tgaaaagcagcgcttaggcgctgcttttttacgttttactttact

SEQ ID NO: 15803 - DNA, 28 bp, Xenorhabdus bovienii
  Terminator location: Contig name=SeqID_16894; Position on contig =18448..18475bp; Strand=-; Gene name=OmpC
cagcgcctaagcgctgcttttcagagat

SEQ ID NO: 15804 - DNA, 31 bp, Xenorhabdus bovienii
  Terminator location: Contig name=SeqID_16894; Position on contig =19877..19907bp; Strand=+; Gene name=TyrB
gccgctgaaaaagcggcttttatcttccgag

SEQ ID NO: 15805 - DNA, 29 bp, Xenorhabdus bovienii
  Terminator location: Contig name=SeqID_16894; Position on contig =19865..19893bp; Strand=-; Gene name=TyrB
gccgctttttcagcggctttgtgattgag

SEQ ID NO: 15806 - DNA, 57 bp, Xenorhabdus bovienii
  Terminator location: Contig name=SeqID_16894; Position on contig =21222..21278bp; Strand=-
cagtaatatacaaaaattattgaaactactttttgtttgttgctgtcttattagtcg

SEQ ID NO: 15807 - DNA, 31 bp, Xenorhabdus bovienii
  Terminator location: Contig name=SeqID_16894; Position on contig =23473..23503bp; Strand=-
gaggcacttaaggtgcctttttcttttttag

SEQ ID NO: 15808 - DNA, 40 bp, Xenorhabdus bovienii
  Terminator location: Contig name=SeqID_16894; Position on contig =35613..35652bp; Strand=-
tcagagaatgatggctctgtcactttgatatttattgaga

SEQ ID NO: 15809 - DNA, 32 bp, Xenorhabdus bovienii
  Terminator location: Contig name=SeqID_16894; Position on contig =41478..41509bp; Strand=-
gtcgttgggctaacaacgactttaatcagttt

SEQ ID NO: 15810 - DNA, 49 bp, Xenorhabdus bovienii
  Terminator location: Contig name=SeqID_16894; Position on contig =43736..43784bp; Strand=-
ctttgttggttgcgttcattcacaccaatcatagagttatctatgctcc

SEQ ID NO: 15811 - DNA, 40 bp, Xenorhabdus bovienii
  Terminator location: Contig name=SeqID_16894; Position on contig =44644..44683bp; Strand=-; Gene name=WbbJ
ctacggagatggtgatcgttcctgtggagttatgtcagta

SEQ ID NO: 15812 - DNA, 52 bp, Xenorhabdus bovienii
  Terminator location: Contig name=SeqID_16894; Position on contig =53733..53784bp; Strand=+
gaaaaaagagaatgccgcttccgcggcattctcttttgactgttataccgga

SEQ ID NO: 15813 - DNA, 40 bp, Xenorhabdus bovienii
  Terminator location: Contig name=SeqID_16894; Position on contig =53726..53765bp; Strand=-
gagaatgccgcggaagcggcattctcttttttcagtatga

SEQ ID NO: 15814 - DNA, 40 bp, Xenorhabdus bovienii
  Terminator location: Contig name=SeqID_16894; Position on contig =54816..54855bp; Strand=+
tgtaatgatttaccaagattatctacgcatgttcacttta

SEQ ID NO: 15815 - DNA, 49 bp, Xenorhabdus bovienii
  Terminator location: Contig name=SeqID_16894; Position on contig =70358..70406bp; Strand=+
ccatctttagcggcttgagccaaggtgtcaaaaatggatttatagatat

SEQ ID NO: 15816 - DNA, 41 bp, Xenorhabdus bovienii
  Terminator location: Contig name=SeqID_16894; Position on contig =70051..70091bp; Strand=-
cagaaagacgcctttaatgcgtctttctgtatttaagttca

SEQ ID NO: 15817 - DNA, 41 bp, Xenorhabdus bovienii
  Terminator location: Contig name=SeqID_16894; Position on contig =76708..76748bp; Strand=+; Gene name=PflD
taaaggccccttcacaattggggcctttattatcctgtcag

SEQ ID NO: 15818 - DNA, 40 bp, Xenorhabdus bovienii
  Terminator location: Contig name=SeqID_16894; Position on contig =77537..77576bp; Strand=+; Gene name=PflA
cctggcttaaaacttagtttcagtcaggtttttctaaaaa

SEQ ID NO: 15819 - DNA, 52 bp, Xenorhabdus bovienii
  Terminator location: Contig name=SeqID_16894; Position on contig =79063..79114bp; Strand=+
gataagcaaaaaggcgctatttcggcgcttttttgctatcttgtaacattat

SEQ ID NO: 15820 - DNA, 48 bp, Xenorhabdus bovienii
  Terminator location: Contig name=SeqID_16894; Position on contig =80097..80144bp; Strand=+
gataaaaaaagcgcccaacacggcgctttttttattatttagaataat

SEQ ID NO: 15821 - DNA, 55 bp, Xenorhabdus bovienii
  Terminator location: Contig name=SeqID_16894; Position on contig =80079..80133bp; Strand=-
taataaaaaaagcgccgtgttgggcgctttttttatcggtaatgatttatatcca

SEQ ID NO: 15822 - DNA, 45 bp, Xenorhabdus bovienii
  Terminator location: Contig name=SeqID_16894; Position on contig =81476..81520bp; Strand=-; Gene name=SerS
gtgtcggcttggtcaatccgagctgatttcaccacttttttctca

SEQ ID NO: 15823 - DNA, 52 bp, Xenorhabdus bovienii
  Terminator location: Contig name=SeqID_16894; Position on contig =87076..87127bp; Strand=+
tgcataaacaggagtgtacctaagtttttcctgttttgcatctgtacatttt

SEQ ID NO: 15824 - DNA, 32 bp, Xenorhabdus bovienii
  Terminator location: Contig name=SeqID_16894; Position on contig =87033..87064bp; Strand=-
cgctgagcaatcctcagcgttgttccatttaa

SEQ ID NO: 15825 - DNA, 30 bp, Xenorhabdus bovienii
  Terminator location: Contig name=SeqID_16894; Position on contig =89245..89274bp; Strand=+; Gene name=TrxB
gcgctatttcggtagcgctttttaacaggg

SEQ ID NO: 15826 - DNA, 48 bp, Xenorhabdus bovienii
  Terminator location: Contig name=SeqID_16894; Position on contig =97270..97317bp; Strand=+; Gene name=CspC
cacgccacaaatgaataatggcttatttgtggcgtgctattaatacaa

SEQ ID NO: 15827 - DNA, 60 bp, Xenorhabdus bovienii
  Terminator location: Contig name=SeqID_16894; Position on contig =97249..97308bp; Strand=-; Gene name=CspC
tagcacgccacaaataagccattattcatttgtggcgtgggaattacgaatttatctggt

SEQ ID NO: 15828 - DNA, 37 bp, Xenorhabdus bovienii
  Terminator location: Contig name=SeqID_16894; Position on contig =101993..102029bp; Strand=+; Gene name=ArtM
gatattgctcaagcgcagcaatatcttttgccattgt

SEQ ID NO: 15829 - DNA, 42 bp, Xenorhabdus bovienii
  Terminator location: Contig name=SeqID_16894; Position on contig =107828..107869bp; Strand=+; Gene name=SdaC
tgccggccgacttcacgattgactggcattttcctatttatc

SEQ ID NO: 15830 - DNA, 36 bp, Xenorhabdus bovienii
  Terminator location: Contig name=SeqID_16894; Position on contig =107675..107710bp; Strand=-; Gene name=SdaC
ccagcatatttgcgcatagctggcactttgtgaata

SEQ ID NO: 15831 - DNA, 25 bp, Xenorhabdus bovienii
  Terminator location: Contig name=SeqID_16894; Position on contig =110002..110026bp; Strand=+; Gene name=Gst
ggctccctgagcctttgactgtgaa

SEQ ID NO: 15832 - DNA, 34 bp, Xenorhabdus bovienii
  Terminator location: Contig name=SeqID_16894; Position on contig =118444..118477bp; Strand=+; Gene name=HisI
tcttgccatagaaatggcaagatttatcgagtta

SEQ ID NO: 15833 - DNA, 36 bp, Xenorhabdus bovienii
  Terminator location: Contig name=SeqID_16894; Position on contig =120080..120115bp; Strand=+
gggtgctgaacttccagcaccctatttactaacagt

SEQ ID NO: 15834 - DNA, 27 bp, Xenorhabdus bovienii
  Terminator location: Contig name=SeqID_16894; Position on contig =123451..123477bp; Strand=+
ccgacataatgtcggttttttcagctc

SEQ ID NO: 15835 - DNA, 46 bp, Xenorhabdus bovienii
  Terminator location: Contig name=SeqID_16894; Position on contig =123429..123474bp; Strand=-
ctgaaaaaaccgacattatgtcggtttttgtcagttagtgatgggt

SEQ ID NO: 15836 - DNA, 35 bp, Xenorhabdus bovienii
  Terminator location: Contig name=SeqID_16894; Position on contig =129366..129400bp; Strand=+
ggtgatcgcctcggcgatcacctttaatatgcggt

SEQ ID NO: 15837 - DNA, 35 bp, Xenorhabdus bovienii
  Terminator location: Contig name=SeqID_16894; Position on contig =132840..132874bp; Strand=-; Gene name=Udk
tggctctgtttatacagggccattttttcattttt

SEQ ID NO: 15838 - DNA, 35 bp, Xenorhabdus bovienii
  Terminator location: Contig name=SeqID_16894; Position on contig =136449..136483bp; Strand=+; Gene name=MetG
gcgggctcaaaaaagagtccgctttttaatgtgac

SEQ ID NO: 15839 - DNA, 39 bp, Xenorhabdus bovienii
  Terminator location: Contig name=SeqID_16894; Position on contig =141604..141642bp; Strand=+; Gene name=SanA
taagagcctattggataggctcttaccttttcacttaaa

SEQ ID NO: 15840 - DNA, 55 bp, Xenorhabdus bovienii
  Terminator location: Contig name=SeqID_16894; Position on contig =141581..141635bp; Strand=-; Gene name=SanA
gaaaaggtaagagcctatccaataggctcttattctatttctacttttattaact

SEQ ID NO: 15841 - DNA, 52 bp, Xenorhabdus bovienii
  Terminator location: Contig name=SeqID_16894; Position on contig =149960..150011bp; Strand=+; Gene name=Icc
caaataaaaaagcgcttcatatgaggcgcttacttattggttgatacctgat

SEQ ID NO: 15842 - DNA, 54 bp, Xenorhabdus bovienii
  Terminator location: Contig name=SeqID_16894; Position on contig =149946..149999bp; Strand=-; Gene name=Icc
ccaataagtaagcgcctcatatgaagcgcttttttatttgccattattgacgat

SEQ ID NO: 15843 - DNA, 29 bp, Xenorhabdus bovienii
  Terminator location: Contig name=SeqID_16894; Position on contig =157540..157568bp; Strand=+
gctccctaaatgggagtttttctgaatga

SEQ ID NO: 15844 - DNA, 65 bp, Xenorhabdus bovienii
  Terminator location: Contig name=SeqID_16894; Position on contig =158369..158433bp; Strand=+
ttatgcattttaaatttttgatagctgttgtgtgaatgttaaaatgctatggtttcctctttaca

SEQ ID NO: 15845 - DNA, 32 bp, Xenorhabdus bovienii
  Terminator location: Contig name=SeqID_16894; Position on contig =159456..159487bp; Strand=-; Gene name=InsB
cgattgagtcgcttcaatcgatttcttagatt

SEQ ID NO: 15846 - DNA, 40 bp, Xenorhabdus bovienii
  Terminator location: Contig name=SeqID_16894; Position on contig =160829..160868bp; Strand=-
cgtattttgttgctatcgcacgaaaatgtttgattctggc

SEQ ID NO: 15847 - DNA, 41 bp, Xenorhabdus bovienii
  Terminator location: Contig name=SeqID_16894; Position on contig =162100..162140bp; Strand=-
ctttggccagccaatgctggcctgacgggttattgttcttt

SEQ ID NO: 15848 - DNA, 44 bp, Xenorhabdus bovienii
  Terminator location: Contig name=SeqID_16894; Position on contig =163931..163974bp; Strand=-
ttactatcagaataatattctgatagttgatatttttttatttc

SEQ ID NO: 15849 - DNA, 48 bp, Xenorhabdus bovienii
  Terminator location: Contig name=SeqID_16894; Position on contig =165332..165379bp; Strand=+; Gene name=RhaT
gaaaaaccggagagtttcgaaactctccggtttttctattattgaaat

SEQ ID NO: 15850 - DNA, 28 bp, Xenorhabdus bovienii
  Terminator location: Contig name=SeqID_16894; Position on contig =166037..166064bp; Strand=+; Gene name=Dps
ggccgcatctgcggcctttctacatcac

SEQ ID NO: 15851 - DNA, 36 bp, Xenorhabdus bovienii; identical to SEQ ID NO: 15416
  Terminator location: Contig name=SeqID_16894; Position on contig =167887..167922bp; Strand=+

SEQ ID NO: 15852 - DNA, 54 bp, Xenorhabdus bovienii
  Terminator location: Contig name=SeqID_16894; Position on contig =167653..167706bp; Strand=-
gattcaataatagggttcttttttacttcattattgaagtcaatatttataagg

SEQ ID NO: 15853 - DNA, 31 bp, Xenorhabdus bovienii
  Terminator location: Contig name=SeqID_16895; Position on contig =1601..1631bp; Strand=+
gcctcgcccagtgcgaggtttttcatttaaa

SEQ ID NO: 15854 - DNA, 35 bp, Xenorhabdus bovienii
  Terminator location: Contig name=SeqID_16895; Position on contig =1976..2010bp; Strand=+
tttgtttttgagagaaggcaaacttcatcatcata

SEQ ID NO: 15855 - DNA, 30 bp, Xenorhabdus bovienii
  Terminator location: Contig name=SeqID_16895; Position on contig =2544..2573bp; Strand=+
gcctcgcactcgcggggcttcttgcaacgg

SEQ ID NO: 15856 - DNA, 50 bp, Xenorhabdus bovienii
  Terminator location: Contig name=SeqID_16895; Position on contig =3301..3350bp; Strand=+
tcaatacagagcgtctatatctgggcgctcgatattgattattacctaat

SEQ ID NO: 15857 - DNA, 64 bp, Xenorhabdus bovienii
  Terminator location: Contig name=SeqID_16895; Position on contig =3206..3269bp; Strand=-
cagaccgtgcgaacagtgtcacccgtcagagtggtaatgtaggcttggtctgtttttttgatgt

SEQ ID NO: 15858 - DNA, 34 bp, Xenorhabdus bovienii; identical to SEQ ID NO: 15380
  Terminator location: Contig name=SeqID_16895; Position on contig =4210..4243bp; Strand=+

SEQ ID NO: 15859 - DNA, 27 bp, Xenorhabdus bovienii
  Terminator location: Contig name=SeqID_16895; Position on contig =6787..6813bp; Strand=+
ccacctccgggtggttttttattccct

SEQ ID NO: 15860 - DNA, 30 bp, Xenorhabdus bovienii
  Terminator location: Contig name=SeqID_16895; Position on contig =14735..14764bp; Strand=+
gcggccttaaccggtcgcttttttattgga

SEQ ID NO: 15861 - DNA, 27 bp, Xenorhabdus bovienii
  Terminator location: Contig name=SeqID_16895; Position on contig =16419..16445bp; Strand=+
ccgtctgcggacggtttttttatttct

SEQ ID NO: 15862 - DNA, 27 bp, Xenorhabdus bovienii
  Terminator location: Contig name=SeqID_16895; Position on contig =23244..23270bp; Strand=+
ccctcatttgagggtttttttatgagg

SEQ ID NO: 15863 - DNA, 31 bp, Xenorhabdus bovienii
  Terminator location: Contig name=SeqID_16895; Position on contig =23910..23940bp; Strand=+
gggtcgctcaggcggcccttttttatgggtg

SEQ ID NO: 15864 - DNA, 31 bp, Xenorhabdus bovienii
  Terminator location: Contig name=SeqID_16895; Position on contig =29595..29625bp; Strand=-
gccctccccttgagggctttttacacctgtc

SEQ ID NO: 15865 - DNA, 30 bp, Xenorhabdus bovienii
  Terminator location: Contig name=SeqID_16895; Position on contig =30918..30947bp; Strand=-
cccgcaactttctgcgggttcatatcaatc

SEQ ID NO: 15866 - DNA, 48 bp, Xenorhabdus bovienii
  Terminator location: Contig name=SeqID_16895; Position on contig =32144..32191bp; Strand=+
ttgagacaacataaaatagaccgtgttgcctcaatttttaaatattaa

SEQ ID NO: 15867 - DNA, 52 bp, Xenorhabdus bovienii
  Terminator location: Contig name=SeqID_16895; Position on contig =31653..31704bp; Strand=-
ttaggttaaaggggaggattgttccctttaaacgctaagttttatcagtcag

SEQ ID NO: 15868 - DNA, 48 bp, Xenorhabdus bovienii
  Terminator location: Contig name=SeqID_16895; Position on contig =32130..32177bp; Strand=-
ttgaggcaacacggtctattttatgttgtctcaattttacttttcact

SEQ ID NO: 15869 - DNA, 30 bp, Xenorhabdus bovienii
  Terminator location: Contig name=SeqID_16895; Position on contig =32475..32504bp; Strand=-
tggctcaaatctgagtcatctatgtcactt

SEQ ID NO: 15870 - DNA, 41 bp, Xenorhabdus bovienii
  Terminator location: Contig name=SeqID_16895; Position on contig =34420..34460bp; Strand=-
ttgtggcgcgacgttcgtcagccatgaaacctttgtccggt

SEQ ID NO: 15871 - DNA, 35 bp, Xenorhabdus bovienii
  Terminator location: Contig name=SeqID_16895; Position on contig =37240..37274bp; Strand=+
gagcgccgcctgcgggcggtcttttttttgcctga

SEQ ID NO: 15872 - DNA, 33 bp, Xenorhabdus bovienii
  Terminator location: Contig name=SeqID_16895; Position on contig =38014..38046bp; Strand=-
tcccgcctttgggaggcgggatattgataacgg

SEQ ID NO: 15873 - DNA, 37 bp, Xenorhabdus bovienii; identical to SEQ ID NO: 15550
  Terminator location: Contig name=SeqID_16895; Position on contig =44244..44280bp; Strand=+

SEQ ID NO: 15874 - DNA, 56 bp, Xenorhabdus bovienii
  Terminator location: Contig name=SeqID_16895; Position on contig =47076..47131bp; Strand=+; Gene name=WecD
tggattttaattcccccgaattcgagggaatctagcagtctactttttattttcgc

SEQ ID NO: 15875 - DNA, 49 bp, Xenorhabdus bovienii
  Terminator location: Contig name=SeqID_16895; Position on contig =49814..49862bp; Strand=+
cttctatcacgaatttttttacaaattcgataaggccttcatcgttccc

SEQ ID NO: 15876 - DNA, 32 bp, Xenorhabdus bovienii
  Terminator location: Contig name=SeqID_16895; Position on contig =49717..49748bp; Strand=-
gcccctaagttgttaggggctttgacactgcg

SEQ ID NO: 15877 - DNA, 41 bp, Xenorhabdus bovienii; identical to SEQ ID NO: 15052
  Terminator location: Contig name=SeqID_16895; Position on contig =51430..51470bp; Strand=+

SEQ ID NO: 15878 - DNA, 30 bp, Xenorhabdus bovienii
  Terminator location: Contig name=SeqID_16895; Position on contig =54321..54350bp; Strand=+
tggcgatttaattcgccatttaaaatgaaa

SEQ ID NO: 15879 - DNA, 38 bp, Xenorhabdus bovienii
  Terminator location: Contig name=SeqID_16895; Position on contig =54672..54709bp; Strand=-
gccgtcaggttcttgctggcaggctgattcttggcctg

SEQ ID NO: 15880 - DNA, 36 bp, Xenorhabdus bovienii
  Terminator location: Contig name=SeqID_16895; Position on contig =57258..57293bp; Strand=-
tcgccgtttgatgttgcggtgatcctgttcaatcag

SEQ ID NO: 15881 - DNA, 42 bp, Xenorhabdus bovienii
  Terminator location: Contig name=SeqID_16895; Position on contig =57731..57772bp; Strand=-
gtatcgagccaccatagtgtggctcgatgcttattacgattc

SEQ ID NO: 15882 - DNA, 33 bp, Xenorhabdus bovienii
  Terminator location: Contig name=SeqID_16895; Position on contig =60426..60458bp; Strand=-
tggctaattcaattggccacagatttcttaatt

SEQ ID NO: 15883 - DNA, 34 bp, Xenorhabdus bovienii
  Terminator location: Contig name=SeqID_16895; Position on contig =68199..68232bp; Strand=+; Gene name=PotE
gggggctgaaatatcagccccttttttgtgccta

SEQ ID NO: 15884 - DNA, 45 bp, Xenorhabdus bovienii
  Terminator location: Contig name=SeqID_16895; Position on contig =73208..73252bp; Strand=+; Gene name=UspA
taaaaccgtgcagggaattgcacggttatttatttatgcctggtc

SEQ ID NO: 15885 - DNA, 33 bp, Xenorhabdus bovienii
  Terminator location: Contig name=SeqID_16895; Position on contig =73200..73232bp; Strand=-; Gene name=UspA
ccgtgcaattccctgcacggttttaggcatatt

SEQ ID NO: 15886 - DNA, 70 bp, Xenorhabdus bovienii
  Terminator location: Contig name=SeqID_16895; Position on contig =74931..75000bp; Strand=+; Gene name=EndA
gaaccggtgattgagatctgagccaccaataaaaaggtggcgatcttagcgccggttttttcatgggcct

SEQ ID NO: 15887 - DNA, 44 bp, Xenorhabdus bovienii
  Terminator location: Contig name=SeqID_16895; Position on contig =75995..76038bp; Strand=+; Gene name=PhoH
gcagcggaaattgaatttcaatttctgtgccgccttttttgcgt

SEQ ID NO: 15888 - DNA, 55 bp, Xenorhabdus bovienii
  Terminator location: Contig name=SeqID_16895; Position on contig =82171..82225bp; Strand=+
ccataatcaagattgaaaattttatttcaatcttgattatggattatcattatgg

SEQ ID NO: 15889 - DNA, 41 bp, Xenorhabdus bovienii
  Terminator location: Contig name=SeqID_16895; Position on contig =82166..82206bp; Strand=-
tcaagattgaaataaaattttcaatcttgattatggattcg

SEQ ID NO: 15890 - DNA, 37 bp, Xenorhabdus bovienii
  Terminator location: Contig name=SeqID_16895; Position on contig =94265..94301bp; Strand=+
gcagattggcaaacgccaatttccagctttcctgcat

SEQ ID NO: 15891 - DNA, 39 bp, Xenorhabdus bovienii
  Terminator location: Contig name=SeqID_16895; Position on contig =96033..96071bp; Strand=+; Gene name=OmpW
tctggggttgtacgccggaatcccagatttttccgtcac

SEQ ID NO: 15892 - DNA, 35 bp, Xenorhabdus bovienii
  Terminator location: Contig name=SeqID_16895; Position on contig =105734..105768bp; Strand=+
tgtgtttttagaatggaaacgtatttaccatcgtt

SEQ ID NO: 15893 - DNA, 55 bp, Xenorhabdus bovienii
  Terminator location: Contig name=SeqID_16895; Position on contig =109845..109899bp; Strand=+; Gene name=RsuA
gggtcgctgtttcagtgttatatcaaggctgaaacagcggctttttatctatctt

SEQ ID NO: 15894 - DNA, 54 bp, Xenorhabdus bovienii
  Terminator location: Contig name=SeqID_16895; Position on contig =111563..111616bp; Strand=+
gccaaagtggttactgtggtattagcagtcgtcgttctggcagtattttgtatc

SEQ ID NO: 15895 - DNA, 34 bp, Xenorhabdus bovienii
  Terminator location: Contig name=SeqID_16895; Position on contig =115948..115981bp; Strand=+; Gene name=TopA
gccagtcaattaggactggctttttttgttttta

SEQ ID NO: 15896 - DNA, 42 bp, Xenorhabdus bovienii
  Terminator location: Contig name=SeqID_16895; Position on contig =117191..117232bp; Strand=+; Gene name=LysR
gaggaaggcagctgatgttatcttcctctattttttgttgat

SEQ ID NO: 15897 - DNA, 49 bp, Xenorhabdus bovienii
  Terminator location: Contig name=SeqID_16895; Position on contig =121271..121319bp; Strand=+; Gene name=AcnA
gaaaaaaactgcgcctacaccgacgcagtttttatttttttgtagggat

SEQ ID NO: 15898 - DNA, 34 bp, Xenorhabdus bovienii
  Terminator location: Contig name=SeqID_16895; Position on contig =121265..121298bp; Strand=-; Gene name=AcnA
ctgcgtcggtgtaggcgcagtttttttctaaatg

SEQ ID NO: 15899 - DNA, 41 bp, Xenorhabdus bovienii
  Terminator location: Contig name=SeqID_16895; Position on contig =123891..123931bp; Strand=+
taatacatgtttcattacggacatgtttacttttcattagt

SEQ ID NO: 15900 - DNA, 57 bp, Xenorhabdus bovienii
  Terminator location: Contig name=SeqID_16895; Position on contig =125018..125074bp; Strand=+; Gene name=SUI1
ttttaacaggctatgtataactggattgtatagcctgttaagtaatatgtagtaaat

SEQ ID NO: 15901 - DNA, 43 bp, Xenorhabdus bovienii
  Terminator location: Contig name=SeqID_16895; Position on contig =127034..127076bp; Strand=-
tctattgacgattaagacaaacgtaatagaatttattacggat

SEQ ID NO: 15902 - DNA, 47 bp, Xenorhabdus bovienii
  Terminator location: Contig name=SeqID_16895; Position on contig =131550..131596bp; Strand=-
tggacacaacactgctggactagcaggttgtgccatttcggtttcag

SEQ ID NO: 15903 - DNA, 29 bp, Xenorhabdus bovienii
  Terminator location: Contig name=SeqID_16895; Position on contig =144418..144446bp; Strand=-
gactgctaaaagcagtctttattgagaag

SEQ ID NO: 15904 - DNA, 42 bp, Xenorhabdus bovienii
  Terminator location: Contig name=SeqID_16895; Position on contig =145613..145654bp; Strand=-; Gene name=Add
cagacccgtttgattatatatacgggtctgtctattacggat

SEQ ID NO: 15905 - DNA, 57 bp, Xenorhabdus bovienii
  Terminator location: Contig name=SeqID_16895; Position on contig =147204..147260bp; Strand=-
ttttcattggttgttaatgactcttttattgaaaattgattaaaaattttttagtta

SEQ ID NO: 15906 - DNA, 52 bp, Xenorhabdus bovienii
  Terminator location: Contig name=SeqID_16895; Position on contig =150068..150119bp; Strand=+; Gene name=FumC
ggcgatataaaccggaggagaaatcccccggttttttgctttatatttcccg

SEQ ID NO: 15907 - DNA, 32 bp, Xenorhabdus bovienii
  Terminator location: Contig name=SeqID_16895; Position on contig =150067..150098bp; Strand=-; Gene name=FumC
ccgggggatttctcctccggtttatatcgcca

SEQ ID NO: 15908 - DNA, 64 bp, Xenorhabdus bovienii
  Terminator location: Contig name=SeqID_16895; Position on contig =152008..152071bp; Strand=+
tggtaaaaaattgccggaatatatttatggataccggcagttttattttatcattcttcagatt

SEQ ID NO: 15909 - DNA, 47 bp, Xenorhabdus bovienii
  Terminator location: Contig name=SeqID_16895; Position on contig =151796..151842bp; Strand=-
tacatctttgttctatatatttgataacagatgtgttttcatgaaat

SEQ ID NO: 15910 - DNA, 33 bp, Xenorhabdus bovienii
  Terminator location: Contig name=SeqID_16895; Position on contig =156540..156572bp; Strand=+; Gene name=BioD
ggggagctaaacgtgctccccagtttaatttta

SEQ ID NO: 15911 - DNA, 33 bp, Xenorhabdus bovienii
  Terminator location: Contig name=SeqID_16895; Position on contig =156528..156560bp; Strand=-; Gene name=BioD
ggggagcacgtttagctccccttttctaatgat

SEQ ID NO: 15912 - DNA, 42 bp, Xenorhabdus bovienii
  Terminator location: Contig name=SeqID_16895; Position on contig =158474..158515bp; Strand=+
tatatttgtcgatagtcacgatgagctatatttcattgattt

SEQ ID NO: 15913 - DNA, 36 bp, Xenorhabdus bovienii
  Terminator location: Contig name=SeqID_16895; Position on contig =164153..164188bp; Strand=+
gagtacatttcaacaatgtatctcactttttccaac

SEQ ID NO: 15914 - DNA, 58 bp, Xenorhabdus bovienii
  Terminator location: Contig name=SeqID_16895; Position on contig =164068..164125bp; Strand=-
tgaaagttagcccgaatatcggaacgataactgggctaactgacaactttttttctac

SEQ ID NO: 15915 - DNA, 42 bp, Xenorhabdus bovienii
  Terminator location: Contig name=SeqID_16895; Position on contig =165508..165549bp; Strand=+; Gene name=DapA
cgacttcactggaattatccagcggagtcgttataagatgag

SEQ ID NO: 15916 - DNA, 44 bp, Xenorhabdus bovienii
  Terminator location: Contig name=SeqID_16895; Position on contig =165494..165537bp; Strand=-; Gene name=DapA
cgactccgctggataattccagtgaagtcgccgttatatcatta

SEQ ID NO: 15917 - DNA, 35 bp, Xenorhabdus bovienii
  Terminator location: Contig name=SeqID_16895; Position on contig =166544..166578bp; Strand=-
tgagcggtgtttttcaccgctcatatttttctata

SEQ ID NO: 15918 - DNA, 40 bp, Xenorhabdus bovienii
  Terminator location: Contig name=SeqID_16895; Position on contig =170794..170833bp; Strand=+; Gene name=CirA
ttcgccctgactaatgtgtcagggcgaattttccgtcttg

SEQ ID NO: 15919 - DNA, 36 bp, Xenorhabdus bovienii
  Terminator location: Contig name=SeqID_16895; Position on contig =173308..173343bp; Strand=+
gccagcatttaaatagatgctggcttttgctacccc

SEQ ID NO: 15920 - DNA, 49 bp, Xenorhabdus bovienii
  Terminator location: Contig name=SeqID_16895; Position on contig =173288..173336bp; Strand=-
caaaagccagcatctatttaaatgctggctttttgatatttatggctat

SEQ ID NO: 15921 - DNA, 42 bp, Xenorhabdus bovienii
  Terminator location: Contig name=SeqID_16895; Position on contig =175739..175780bp; Strand=+; Gene name=HipB
cgtattgtgaaataaattttttacaattgttttaaagttatt

SEQ ID NO: 15922 - DNA, 38 bp, Xenorhabdus bovienii
  Terminator location: Contig name=SeqID_16895; Position on contig =175641..175678bp; Strand=-; Gene name=HipB
ttgagggggggggttccccctcagatttctgcataaac

SEQ ID NO: 15923 - DNA, 38 bp, Xenorhabdus bovienii
  Terminator location: Contig name=SeqID_16895; Position on contig =179953..179990bp; Strand=+; Gene name=AprE (BS)
ctcactgctggcaagctagcagtgagttttttttcacc

SEQ ID NO: 15924 - DNA, 45 bp, Xenorhabdus bovienii
  Terminator location: Contig name=SeqID_16895; Position on contig =180077..180121bp; Strand=-; Gene name=AprE (BS)
ttttttgattaaatatgcgtgttaataaaaaattattaatttaat

SEQ ID NO: 15925 - DNA, 36 bp, Xenorhabdus bovienii
  Terminator location: Contig name=SeqID_16895; Position on contig =186449..186484bp; Strand=+; Gene name=LysR
ggatatcagcatatttgcgattcctttctggcgatg

SEQ ID NO: 15926 - DNA, 42 bp, Xenorhabdus bovienii
  Terminator location: Contig name=SeqID_16895; Position on contig =186224..186265bp; Strand=-; Gene name=LysR
tgcctttttgctcgatacggggcaaaggcaatattgctagtt

SEQ ID NO: 15927 - DNA, 47 bp, Xenorhabdus bovienii
  Terminator location: Contig name=SeqID_16895; Position on contig =188066..188112bp; Strand=-; Gene name=AraJ
gacaaggcttggaggatagcgcttccaagtcttttttattacgtgac

SEQ ID NO: 15928 - DNA, 65 bp, Xenorhabdus bovienii
  Terminator location: Contig name=SeqID_16895; Position on contig =190505..190569bp; Strand=-; Gene name=GadB
cgttctacataacacgattagtgacagtgtcatgttttttgttatgtagaacgttctcacattca

SEQ ID NO: 15929 - DNA, 41 bp, Xenorhabdus bovienii
  Terminator location: Contig name=SeqID_16895; Position on contig =191969..192009bp; Strand=+; Gene name=Crp
gccggatcgctatattttgctgatctggctttcttttaccc

SEQ ID NO: 15930 - DNA, 37 bp, Xenorhabdus bovienii
  Terminator location: Contig name=SeqID_16895; Position on contig =193086..193122bp; Strand=+; Gene name=UspA
gccagctccataaaggagctggcttatttctctctat

SEQ ID NO: 15931 - DNA, 31 bp, Xenorhabdus bovienii
  Terminator location: Contig name=SeqID_16895; Position on contig =193076..193106bp; Strand=-; Gene name=UspA
cagctcctttatggagctggcttttagaaaa

SEQ ID NO: 15932 - DNA, 28 bp, Xenorhabdus bovienii
  Terminator location: Contig name=SeqID_16895; Position on contig =217399..217426bp; Strand=+; Gene name=CaiA
gggctgattagcccagtttaaattgtat

SEQ ID NO: 15933 - DNA, 42 bp, Xenorhabdus bovienii
  Terminator location: Contig name=SeqID_16895; Position on contig =217483..217524bp; Strand=-; Gene name=CaiA
gagagcttcatgttgtggcatgaagcttttttttgccgtttt

SEQ ID NO: 15934 - DNA, 32 bp, Xenorhabdus bovienii
  Terminator location: Contig name=SeqID_16895; Position on contig =221827..221858bp; Strand=+
gcacaaatgatggtttgtgcttttttatcatg

SEQ ID NO: 15935 - DNA, 46 bp, Xenorhabdus bovienii
  Terminator location: Contig name=SeqID_16895; Position on contig =223565..223610bp; Strand=+; Gene name=PotE
ttaaggagagaatcatcaatttctctccttaattttttgtttgaaa

SEQ ID NO: 15936 - DNA, 46 bp, Xenorhabdus bovienii
  Terminator location: Contig name=SeqID_16895; Position on contig =224755..224800bp; Strand=+
tttaattggatggaaaatttatcatttagttgaattctggctataa

SEQ ID NO: 15937 - DNA, 39 bp, Xenorhabdus bovienii
  Terminator location: Contig name=SeqID_16895; Position on contig =230282..230320bp; Strand=+; Gene name=FimA
gcccaaaggccttttcacttcttgggctattcttttggt

SEQ ID NO: 15938 - DNA, 37 bp, Xenorhabdus bovienii
  Terminator location: Contig name=SeqID_16895; Position on contig =229997..230033bp; Strand=-; Gene name=FimA
caatgcccagatattattggcattgctttttgcaggt

SEQ ID NO: 15939 - DNA, 40 bp, Xenorhabdus bovienii
  Terminator location: Contig name=SeqID_16895; Position on contig =242306..242345bp; Strand=-; Gene name=EntF
ggggctgttggtaactcaacagccccgtatttacattgtc

SEQ ID NO: 15940 - DNA, 30 bp, Xenorhabdus bovienii
  Terminator location: Contig name=SeqID_16895; Position on contig =247282..247311bp; Strand=+; Gene name=AcpD
gcgcgccagatggcgcgctttttcatttta

SEQ ID NO: 15941 - DNA, 51 bp, Xenorhabdus bovienii
  Terminator location: Contig name=SeqID_16895; Position on contig =252273..252323bp; Strand=+; Gene name=HslJ
tgggtaatcagctcaacccgcatttcagcttgttgtccatttgatagccat

SEQ ID NO: 15942 - DNA, 52 bp, Xenorhabdus bovienii
  Terminator location: Contig name=SeqID_16895; Position on contig =252237..252288bp; Strand=-; Gene name=HslJ
ttgagctgattacccagtatggtactgggtaatcacaaatcgttttggtgaa

SEQ ID NO: 15943 - DNA, 41 bp, Xenorhabdus bovienii
  Terminator location: Contig name=SeqID_16895; Position on contig =253130..253170bp; Strand=+
ttggtctcaaacaataatttgagaccaattttttatgtctg

SEQ ID NO: 15944 - DNA, 53 bp, Xenorhabdus bovienii
  Terminator location: Contig name=SeqID_16895; Position on contig =254367..254419bp; Strand=-
tacttattgatatgaaagggactttatatcatatggctgtgttttgggcatct

SEQ ID NO: 15945 - DNA, 45 bp, Xenorhabdus bovienii
  Terminator location: Contig name=SeqID_16895; Position on contig =262727..262771bp; Strand=+
cggtgtcaggggcgttttcgcccctgacctgactttatgttggtt

SEQ ID NO: 15946 - DNA, 40 bp, Xenorhabdus bovienii
  Terminator location: Contig name=SeqID_16895; Position on contig =262716..262755bp; Strand=-
ggtcaggggcgaaaacgcccctgacaccgcttttaacatc

SEQ ID NO: 15947 - DNA, 46 bp, Xenorhabdus bovienii
  Terminator location: Contig name=SeqID_16895; Position on contig =268338..268383bp; Strand=-
ccgccgatgaaattggatattctggttcttgcggatattgtccttt

SEQ ID NO: 15948 - DNA, 36 bp, Xenorhabdus bovienii; identical to SEQ ID NO: 15416
  Terminator location: Contig name=SeqID_16895; Position on contig =280662..280697bp; Strand=+

SEQ ID NO: 15949 - DNA, 41 bp, Xenorhabdus bovienii
  Terminator location: Contig name=SeqID_16895; Position on contig =282266..282306bp; Strand=-
gctctgtgttcccatttcaaacacagagcttttatggcgct

SEQ ID NO: 15950 - DNA, 36 bp, Xenorhabdus bovienii
  Terminator location: Contig name=SeqID_16895; Position on contig =284839..284874bp; Strand=+
tacctgccgaagcattggcaggtattgttgtattca

SEQ ID NO: 15951 - DNA, 33 bp, Xenorhabdus bovienii
  Terminator location: Contig name=SeqID_16895; Position on contig =285364..285396bp; Strand=+
ggagcgtatttattacgctcctttttatttata

SEQ ID NO: 15952 - DNA, 33 bp, Xenorhabdus bovienii
  Terminator location: Contig name=SeqID_16895; Position on contig =285352..285384bp; Strand=-
ggagcgtaataaatacgctcctttagtttatgg

SEQ ID NO: 15953 - DNA, 43 bp, Xenorhabdus bovienii
  Terminator location: Contig name=SeqID_16895; Position on contig =288364..288406bp; Strand=+; Gene name=Cls
cacagccccattagcatcattggggctgtgattagtagtaagg

SEQ ID NO: 15954 - DNA, 45 bp, Xenorhabdus bovienii
  Terminator location: Contig name=SeqID_16895; Position on contig =288949..288993bp; Strand=+
gcatgtttgaagctgccttcaagcaatggacgtgttttggcacat

SEQ ID NO: 15955 - DNA, 29 bp, Xenorhabdus bovienii
  Terminator location: Contig name=SeqID_16895; Position on contig =288872..288900bp; Strand=-
tgtgacactgtcacgagtatatcttctaa

SEQ ID NO: 15956 - DNA, 49 bp, Xenorhabdus bovienii
  Terminator location: Contig name=SeqID_16895; Position on contig =300700..300748bp; Strand=+; Gene name=EutG
ttaaaaggtgcagagaccatcccctgcacctttttattatttcattttc

SEQ ID NO: 15957 - DNA, 37 bp, Xenorhabdus bovienii
  Terminator location: Contig name=SeqID_16895; Position on contig =300693..300729bp; Strand=-; Gene name=EutG
ggtgcaggggatggtctctgcaccttttaaattacat

SEQ ID NO: 15958 - DNA, 41 bp, Xenorhabdus bovienii
  Terminator location: Contig name=SeqID_16895; Position on contig =302458..302498bp; Strand=+; Gene name=Hns
caaaaataccctatcaagggtatttttgttttatgattaat

SEQ ID NO: 15959 - DNA, 42 bp, Xenorhabdus bovienii
  Terminator location: Contig name=SeqID_16895; Position on contig =302617..302658bp; Strand=-; Gene name=Hns
taaaaaggagcggttcgctccttttttataattctatgttaa

SEQ ID NO: 15960 - DNA, 30 bp, Xenorhabdus bovienii
  Terminator location: Contig name=SeqID_16895; Position on contig =306064..306093bp; Strand=-; Gene name=GalU
cgcctgtttacgcgggcgattttcttcaca

SEQ ID NO: 15961 - DNA, 50 bp, Xenorhabdus bovienii
  Terminator location: Contig name=SeqID_16895; Position on contig =311746..311795bp; Strand=+; Gene name=XthA
tgaaacacagcaccttcaatgacggtgctgtgttatcatttcggttactc

SEQ ID NO: 15962 - DNA, 52 bp, Xenorhabdus bovienii
  Terminator location: Contig name=SeqID_16895; Position on contig =311732..311783bp; Strand=-; Gene name=XthA
tgataacacagcaccgtcattgaaggtgctgtgtttcatgtttgaaaattat

SEQ ID NO: 15963 - DNA, 32 bp, Xenorhabdus bovienii
  Terminator location: Contig name=SeqID_16895; Position on contig =317454..317485bp; Strand=+; Gene name=SppA
gcctgatccttacatcaggctttttttattcc

SEQ ID NO: 15964 - DNA, 34 bp, Xenorhabdus bovienii
  Terminator location: Contig name=SeqID_16897; Position on contig =3607..3640bp; Strand=+; Gene name=NlpA
gggcgggtattattatccgcccattttgactggg

SEQ ID NO: 15965 - DNA, 28 bp, Xenorhabdus bovienii
  Terminator location: Contig name=SeqID_16897; Position on contig =4872..4899bp; Strand=+
cgctggtagactagcggtttatctttat

SEQ ID NO: 15966 - DNA, 46 bp, Xenorhabdus bovienii
  Terminator location: Contig name=SeqID_16897; Position on contig =6715..6760bp; Strand=+; Gene name=ProS
gaaaaaacctgcgtattcaatgcgcaggtttttttatgtatgacaa

SEQ ID NO: 15967 - DNA, 35 bp, Xenorhabdus bovienii
  Terminator location: Contig name=SeqID_16897; Position on contig =6708..6742bp; Strand=-; Gene name=ProS
cctgcgcattgaatacgcaggttttttctgaactt

SEQ ID NO: 15968 - DNA, 35 bp, Xenorhabdus bovienii
  Terminator location: Contig name=SeqID_16897; Position on contig =8102..8136bp; Strand=+
gtcctcatataaaatgagggctttcttttccaaat

SEQ ID NO: 15969 - DNA, 52 bp, Xenorhabdus bovienii
  Terminator location: Contig name=SeqID_16897; Position on contig =8233..8284bp; Strand=-
tttatcctcagtatctattaaaggttactgagggtaaattttatccttcact

SEQ ID NO: 15970 - DNA, 44 bp, Xenorhabdus bovienii
  Terminator location: Contig name=SeqID_16897; Position on contig =9269..9312bp; Strand=-
gagagattacattagaaattatgtaatctcttttttattcaata

SEQ ID NO: 15971 - DNA, 56 bp, Xenorhabdus bovienii
  Terminator location: Contig name=SeqID_16897; Position on contig =11810..11865bp; Strand=-; Gene name=RhaT
ggtggacagtactggggagagatagaacctcagtatttccacctattttattgttt

SEQ ID NO: 15972 - DNA, 37 bp, Xenorhabdus bovienii
  Terminator location: Contig name=SeqID_16897; Position on contig =21116..21152bp; Strand=-; Gene name=HlpA
tcgccttattattagataaggtgattgttaattttcc

SEQ ID NO: 15973 - DNA, 59 bp, Xenorhabdus bovienii
  Terminator location: Contig name=SeqID_16897; Position on contig =26688..26746bp; Strand=-
ttcaatatttgtcacacgttttccgagtgtgtgccaaagatagaggctttcattcgggc

SEQ ID NO: 15974 - DNA, 39 bp, Xenorhabdus bovienii
  Terminator location: Contig name=SeqID_16897; Position on contig =28113..28151bp; Strand=-; Gene name=Dxr
taacgccgcagtccttgcggcgttattctttgcatcaca

SEQ ID NO: 15975 - DNA, 46 bp, Xenorhabdus bovienii
  Terminator location: Contig name=SeqID_16897; Position on contig =29667..29712bp; Strand=-; Gene name=PyrH
tgaacggagccgccgattggcggttctgttttatttcatgatgaat

SEQ ID NO: 15976 - DNA, 32 bp, Xenorhabdus bovienii
  Terminator location: Contig name=SeqID_16897; Position on contig =30636..30667bp; Strand=-; Gene name=Tsf
gggggcctgtcacggccccctttacatatctg

SEQ ID NO: 15977 - DNA, 33 bp, Xenorhabdus bovienii
  Terminator location: Contig name=SeqID_16897; Position on contig =36334..36366bp; Strand=+; Gene name=DapD
tagcggataataaatccgctatttttttgatat

SEQ ID NO: 15978 - DNA, 50 bp, Xenorhabdus bovienii
  Terminator location: Contig name=SeqID_16897; Position on contig =36807..36856bp; Strand=+
ttacaccgcttatcctgctcggcataagcggtgtgacatctattctgtca

SEQ ID NO: 15979 - DNA, 43 bp, Xenorhabdus bovienii
  Terminator location: Contig name=SeqID_16897; Position on contig =38902..38944bp; Strand=-
gagatgtctcacatgggacgtgagatatctctattaatcatga

SEQ ID NO: 15980 - DNA, 50 bp, Xenorhabdus bovienii
  Terminator location: Contig name=SeqID_16897; Position on contig =41932..41981bp; Strand=+
taacgataaagttaccctaatcagcaactttatcgttgatttaaatagtt

SEQ ID NO: 15981 - DNA, 51 bp, Xenorhabdus bovienii
  Terminator location: Contig name=SeqID_16897; Position on contig =41920..41970bp; Strand=-
tcaacgataaagttgctgattagggtaactttatcgttatctttcaaatac

SEQ ID NO: 15982 - DNA, 54 bp, Xenorhabdus bovienii
  Terminator location: Contig name=SeqID_16897; Position on contig =48219..48272bp; Strand=+; Gene name=Exo
caaaatactgccgaaattgagtatttacggtagtattttgttatttaaatttat

SEQ ID NO: 15983 - DNA, 38 bp, Xenorhabdus bovienii
  Terminator location: Contig name=SeqID_16897; Position on contig =60600..60637bp; Strand=-
tggggtaggtcttagagccgatcccattaattacgcct

SEQ ID NO: 15984 - DNA, 53 bp, Xenorhabdus bovienii
  Terminator location: Contig name=SeqID_16897; Position on contig =65547..65599bp; Strand=+; Gene name=ArgB
ggccgtttcatgctgaggcaatcggctcggctgaaatggctttatcgtcccat

SEQ ID NO: 15985 - DNA, 33 bp, Xenorhabdus bovienii
  Terminator location: Contig name=SeqID_16897; Position on contig =65236..65268bp; Strand=-; Gene name=ArgB
gcgctggtagttatacagcgcttgtttttccac

SEQ ID NO: 15986 - DNA, 32 bp, Xenorhabdus bovienii
  Terminator location: Contig name=SeqID_16897; Position on contig =79249..79280bp; Strand=-
gagcgggttcagcctgctctttttacatttat

SEQ ID NO: 15987 - DNA, 40 bp, Xenorhabdus bovienii
  Terminator location: Contig name=SeqID_16897; Position on contig =81065..81104bp; Strand=-; Gene name=Lgt
gtaggatggctcttaatccattttactgtctgtgatatta

SEQ ID NO: 15988 - DNA, 40 bp, Xenorhabdus bovienii
  Terminator location: Contig name=SeqID_16897; Position on contig =89036..89075bp; Strand=+
taattagggagcttcggctccctaattatttttcaatatg

SEQ ID NO: 15989 - DNA, 57 bp, Xenorhabdus bovienii
  Terminator location: Contig name=SeqID_16897; Position on contig =91147..91203bp; Strand=+
gtgaaaatatagttgatgattattcattaattgctatttttatcattcctcattttt

SEQ ID NO: 15990 - DNA, 45 bp, Xenorhabdus bovienii
  Terminator location: Contig name=SeqID_16897; Position on contig =92676..92720bp; Strand=+; Gene name=Bax
taatccgctatgtattaattacacagcggattatttttttataac

SEQ ID NO: 15991 - DNA, 43 bp, Xenorhabdus bovienii
  Terminator location: Contig name=SeqID_16897; Position on contig =96880..96922bp; Strand=-; Gene name=TesA
cggcattttactgactgattaaaatgccgtttttttatattta

SEQ ID NO: 15992 - DNA, 53 bp, Xenorhabdus bovienii
  Terminator location: Contig name=SeqID_16897; Position on contig =98895..98947bp; Strand=-; Gene name=GntK
tgttgctggtaatgttactgataataagttaccggtaacattttatggataat

SEQ ID NO: 15993 - DNA, 40 bp, Xenorhabdus bovienii
  Terminator location: Contig name=SeqID_16897; Position on contig =109953..109992bp; Strand=+; Gene name=FabG
tggcgctgttgtaagctacagtgccacgcgtttcctgtcg

SEQ ID NO: 15994 - DNA, 31 bp, Xenorhabdus bovienii
  Terminator location: Contig name=SeqID_16897; Position on contig =113070..113100bp; Strand=+
gccagtattttactggctttttcgtactagg

SEQ ID NO: 15995 - DNA, 31 bp, Xenorhabdus bovienii
  Terminator location: Contig name=SeqID_16897; Position on contig =113056..113086bp; Strand=-
gccagtaaaatactggctttttaacatcaag

SEQ ID NO: 15996 - DNA, 39 bp, Xenorhabdus bovienii
  Terminator location: Contig name=SeqID_16897; Position on contig =122767..122805bp; Strand=+
tgaaatttcgtctgcgaaatgtttgagtgttctccatga

SEQ ID NO: 15997 - DNA, 41 bp, Xenorhabdus bovienii
  Terminator location: Contig name=SeqID_16897; Position on contig =126276..126316bp; Strand=+
gcaaggagatagcaccactatctccttactctttcccgaat

SEQ ID NO: 15998 - DNA, 36 bp, Xenorhabdus bovienii
  Terminator location: Contig name=SeqID_16897; Position on contig =126221..126256bp; Strand=-
tgccgagtcactggctacggtatttatttgctactc

SEQ ID NO: 15999 - DNA, 31 bp, Xenorhabdus bovienii
  Terminator location: Contig name=SeqID_16897; Position on contig =127123..127153bp; Strand=+
cgtggcagggaagccatgttttttagctccc

SEQ ID NO: 16000 - DNA, 43 bp, Xenorhabdus bovienii
  Terminator location: Contig name=SeqID_16897; Position on contig =126844..126886bp; Strand=-
cacttttatcaggaaaacattgatggggtgactattgtgagcg

SEQ ID NO: 16001 - DNA, 49 bp, Xenorhabdus bovienii
  Terminator location: Contig name=SeqID_16897; Position on contig =129396..129444bp; Strand=+; Gene name=LysR
tgagtgtctagtattcaatatgatactggacactcaattaatttcaata

SEQ ID NO: 16002 - DNA, 36 bp, Xenorhabdus bovienii
  Terminator location: Contig name=SeqID_16897; Position on contig =139275..139310bp; Strand=-; Gene name=Uup
gtgggttgtatgcttgacctactctctctttaaata

SEQ ID NO: 16003 - DNA, 43 bp, Xenorhabdus bovienii
  Terminator location: Contig name=SeqID_16897; Position on contig =141341..141383bp; Strand=-; Gene name=ET17
catcggtatcaacatctgtcgataccggtgttttattatttat

SEQ ID NO: 16004 - DNA, 34 bp, Xenorhabdus bovienii
  Terminator location: Contig name=SeqID_16897; Position on contig =144866..144899bp; Strand=+; Gene name=RhaT
tgggggccatctttcccccatgattattaacttt

SEQ ID NO: 16005 - DNA, 36 bp, Xenorhabdus bovienii; identical to SEQ ID NO: 15416
  Terminator location: Contig name=SeqID_16897; Position on contig =145969..146004bp; Strand=-

SEQ ID NO: 16006 - DNA, 33 bp, Xenorhabdus bovienii
  Terminator location: Contig name=SeqID_16897; Position on contig =153408..153440bp; Strand=-
ggggagcggatggctcccctttttaatctgtgt

SEQ ID NO: 16007 - DNA, 35 bp, Xenorhabdus bovienii
  Terminator location: Contig name=SeqID_16897; Position on contig =154689..154723bp; Strand=-
gcgtggccacaggttggtcacgcctttacttcatt

SEQ ID NO: 16008 - DNA, 53 bp, Xenorhabdus bovienii
  Terminator location: Contig name=SeqID_16897; Position on contig =166333..166385bp; Strand=-; Gene name=LysR
ttttccccagtgacatagttacctatgctgctggggattggtttactggctac

SEQ ID NO: 16009 - DNA, 55 bp, Xenorhabdus bovienii
  Terminator location: Contig name=SeqID_16897; Position on contig =167881..167935bp; Strand=-; Gene name=GltP
gaaattaatactattttggaaaaatgatacgctattaattgtttatttctaaatt

SEQ ID NO: 16010 - DNA, 45 bp, Xenorhabdus bovienii
  Terminator location: Contig name=SeqID_16897; Position on contig =170759..170803bp; Strand=-
cttctgttttgaattatttgttgagccagaagaaatttttttctg

SEQ ID NO: 16011 - DNA, 41 bp, Xenorhabdus bovienii
  Terminator location: Contig name=SeqID_16897; Position on contig =174618..174658bp; Strand=-; Gene name=Pnp
gatgggggtggaatttgtcgcttccatcacgtttgatgcag

SEQ ID NO: 16012 - DNA, 52 bp, Xenorhabdus bovienii
  Terminator location: Contig name=SeqID_16897; Position on contig =175366..175417bp; Strand=+
taggttaagccatcttattgtgaggtggcttagatttatgattattctttat

SEQ ID NO: 16013 - DNA, 44 bp, Xenorhabdus bovienii
  Terminator location: Contig name=SeqID_16897; Position on contig =175834..175877bp; Strand=-
cgatattttgtagcgccccttaaaatattgggttctttgcctgt

SEQ ID NO: 16014 - DNA, 47 bp, Xenorhabdus bovienii
  Terminator location: Contig name=SeqID_16897; Position on contig =182123..182169bp; Strand=-
tatatgaaaagtgtctgaatcggcgcttttattatttcattaaatga

SEQ ID NO: 16015 - DNA, 35 bp, Xenorhabdus bovienii
  Terminator location: Contig name=SeqID_16897; Position on contig =183530..183564bp; Strand=-
ctaggatgtataaataattctggtatatcctgtct

SEQ ID NO: 16016 - DNA, 31 bp, Xenorhabdus bovienii
  Terminator location: Contig name=SeqID_16897; Position on contig =185357..185387bp; Strand=+
ggtatccttgtgggtatcattattggcgctg

SEQ ID NO: 16017 - DNA, 52 bp, Xenorhabdus bovienii
  Terminator location: Contig name=SeqID_16897; Position on contig =186723..186774bp; Strand=+; Gene name=AmpC
tcacagccagagatttgtaggtataaagctcaggctgtgatttgtgatgagc

SEQ ID NO: 16018 - DNA, 52 bp, Xenorhabdus bovienii
  Terminator location: Contig name=SeqID_16897; Position on contig =186711..186762bp; Strand=-; Gene name=AmpC
tcacagcctgagctttatacctacaaatctctggctgtgatttttcaagaac

SEQ ID NO: 16019 - DNA, 36 bp, Xenorhabdus bovienii
  Terminator location: Contig name=SeqID_16897; Position on contig =190823..190858bp; Strand=+; Gene name=PepB
gggtattgcggctgcaatacccttttgtatcgcttt

SEQ ID NO: 16020 - DNA, 50 bp, Xenorhabdus bovienii
  Terminator location: Contig name=SeqID_16897; Position on contig =190649..190698bp; Strand=-; Gene name=PepB
gctaagagcgcaaccggacgacctgttgctcctttggctttacctgaacg

SEQ ID NO: 16021 - DNA, 38 bp, Xenorhabdus bovienii
  Terminator location: Contig name=SeqID_16897; Position on contig =194308..194345bp; Strand=+; Gene name=ValS
gccactgcatttaatattgcagtggtttttttcttttc

SEQ ID NO: 16022 - DNA, 33 bp, Xenorhabdus bovienii
  Terminator location: Contig name=SeqID_16897; Position on contig =199496..199528bp; Strand=+; Gene name=WecD
gccccacagaccaagtggggcatttatttcgac

SEQ ID NO: 16023 - DNA, 32 bp, Xenorhabdus bovienii
  Terminator location: Contig name=SeqID_16897; Position on contig =201236..201267bp; Strand=+; Gene name=ArgF
gcggtgcgaatgagcaccgctttttgtttttt

SEQ ID NO: 16024 - DNA, 40 bp, Xenorhabdus bovienii
  Terminator location: Contig name=SeqID_16897; Position on contig =202596..202635bp; Strand=-; Gene name=RbsK
caatgaaaaataaacatttgtttgttgatatatttatcta

SEQ ID NO: 16025 - DNA, 50 bp, Xenorhabdus bovienii
  Terminator location: Contig name=SeqID_16897; Position on contig =204106..204155bp; Strand=+
ggagagcataataaagtgccccacattttatgctctccattatagatagt

SEQ ID NO: 16026 - DNA, 40 bp, Xenorhabdus bovienii
  Terminator location: Contig name=SeqID_16897; Position on contig =203651..203690bp; Strand=-
tttaagcatggcggcctgcatgttggagattgtgataatt

SEQ ID NO: 16027 - DNA, 29 bp, Xenorhabdus bovienii
  Terminator location: Contig name=SeqID_16897; Position on contig =205150..205178bp; Strand=+
ccgcctactcaggcggctttaacttagag

SEQ ID NO: 16028 - DNA, 29 bp, Xenorhabdus bovienii
  Terminator location: Contig name=SeqID_16897; Position on contig =205137..205165bp; Strand=-
ccgcctgagtaggcggttttaactttttt

SEQ ID NO: 16029 - DNA, 43 bp, Xenorhabdus bovienii
  Terminator location: Contig name=SeqID_16897; Position on contig =205875..205917bp; Strand=-
cgaattgtcggggcagctccagcagttcgggaatttctacagg

SEQ ID NO: 16030 - DNA, 32 bp, Xenorhabdus bovienii
  Terminator location: Contig name=SeqID_16897; Position on contig =211749..211780bp; Strand=+; Gene name=ElaC
gtcaccatttttaggtgacatattaacatttt

SEQ ID NO: 16031 - DNA, 51 bp, Xenorhabdus bovienii
  Terminator location: Contig name=SeqID_16897; Position on contig =211525..211575bp; Strand=-; Gene name=ElaC
catttgatattgataagagtatcaaatgtgcaaattgatgatttattaaac

SEQ ID NO: 16032 - DNA, 39 bp, Xenorhabdus bovienii
  Terminator location: Contig name=SeqID_16897; Position on contig =223086..223124bp; Strand=+
tggtattgattatataaatcagtaccattctactcatag

SEQ ID NO: 16033 - DNA, 61 bp, Xenorhabdus bovienii
  Terminator location: Contig name=SeqID_16897; Position on contig =225487..225547bp; Strand=-; Gene name=PyrB
tctggtatattatgattaaggatatctttccttaatcataatattaatggttatctatttt

SEQ ID NO: 16034 - DNA, 40 bp, Xenorhabdus bovienii
  Terminator location: Contig name=SeqID_16897; Position on contig =228733..228772bp; Strand=+; Gene name=ArsR
gataacgcctcctgattggaggcgtatttttcattgagct
